United States Patent 7,090,973 (NUCLEIC ACID SEQUENCES RELATING TO BACTEROIDES FRAGILIS FOR DIAGNOSTICS AND THERAPEUTICS) - sequence listing, part 2

SEQ ID NO: 1617 - DNA, 1197 bp, B.fragilis
gaagtttgtgagacaaataagcgcattataatgaatttggaccttgacttcatattactaaatttactgttattatatacattctggaaagccggtagaaatatctcgcaaagcatggattactggcataatgccggattgtgcgtaatcctattctctattgtacaaggctgccgatttgccagaggaaatgattactttgcgtactccagaattttccgtgaaggtagcctgcatgtcgaaaatccatttttctcagtcattaatgaattactcagaatagttggtattaatgagtatagttgttttatggtgtatgcgttcacatttgcattgtgcgccatgatttttatgaaagactatcgcacgtatgccagatatatgttcccactattcttgataggcttcatgaacttcgaagaaagcatgatacgccaggcattcagctactcttttttcttcctatatttgaaatatctctttaagttgaaatttaacaagccaaaggatatattgcataaccataaaaaattaatatactgcataatatttgccatactaacattagccatacacactggcaatattataagcttatttgtaatcaccaccctctatatattttggcgtaaacctttccagccacagtttgccataccgatatatgttgcgtgtgtctacatattaccacatatatttaatttcaattggctggaacccattttaagctttgcagcagacacaaacgaacgtgcagcagaatatgtgaagaatgctgactattggttttcagaaaagggtgagaacgatcagtatgataaaaattttatcgtggaaattattcaagtgataggctcttctgcattgatgtatttcggatatagactaatcatagaaaagttacccaaacattatgctctgataacaatgcttaatacctttattattggtttgtgtatagagtctatattcgtaaaactagaaattttgcatcgtataggacaaactctagatattgtaggttactttgctttagcaatagtagtatcctataaaacaattaaactaaaacctatccaaaaagtagcctatgtctgtctcctttggtttgtttattactacgtaaaatacttattcttcagtgggcgtactatgttcatctgggatacccattatccttttttcaaatttatataa

SEQ ID NO: 1618 - DNA, 1182 bp, B.fragilis
ataacaatagatatggcagtaaaaatattgagtgtagatgatgaactcgatttagaagtattacttacccagtacttcaggcgacaaatacgaaaaggtgaatacgagttcgcttttgcccataacgggttggaagctttacagaaacttctggaaactcccgatttcgatatcatcctgagtgatattaatatgccggagatggatgggttgaccctattggctaaggtcaatgaactgaaaaatccggcaatgaagtgtataatggtctctgcttatggagacatggataacatacgttctgctatgaacaagggagcgtttgattttgcaaccaaaccgatcgatttggatgatctgtcgcggactattgaaaaggcgatcgaacaggttcgctatatccgtgagtcacagcaggagcacaaccaactggaatctatcaaaaatgacctggccattgcgggagaaatccagcaaacgattcttccccgttcctttcctccttttccggaactgacggaagtggttgatatttatgcttccatgactccggcaaaagatgtaggtggcgatttttatgatttcttccagattgacgatgaacgtatcgggctggtgattgctgacgtatctgggaaaggggtgccggcatccttgttcatggcggttagtcggaccctgctccgtgcaactgctcttcggggtgtttcgtcggcagaatgccttacttatgccaataagttactgtgtaaagagagcctggactctatgtttgttacggtcttttatgggatttatcattataaaaccggcatgatggactataccaatgccgggcataatcccccttatctccttcgcggcggacggactgttgaatgcttgcctgtcgcttctaattttgtggtaggcgtgttcgatgatattgaatttgagagtaatacattgacgttcggcatcggtgacactttacttctgtatacggatggtgtcacagaggcttttaacgacaagcgggaacaattctcggaaagtaacttacaggatatattggcgtctatgcacgaaagtagttccgcaaaagaggttgttacgagtgtattgcagtctgttaagactttctccggagactatcctcagtccgatgacataaccctgctttctcttcaacgaatcaaataa

SEQ ID NO: 1619 - DNA, 480 bp, B.fragilis
aaatcaaaagagaatatgtcaatgcatacttggtttgagtgtaagatccgttacgagaaattgatggaaaacggaatgaacaagaaagttactgaaccttatctcgtggatgcactcagctttacagaagcagaagcacgcattattgaggagatgaccccgttcattacaggagaatttaccgtatcggatatcaaacgagccaactatagtgaacttttccccagcgaagaagaagctgctgaccgctggtttaagtgtaaactgatttttatcacactagacgaaaaaagtggtgctgagaaaaaaacgtcgacacaagttctggtacaggcagctgacctgcgcgatgctgtaaaaaagctggacgaaggcatgaaaggtacaatggctgattatcagataggttctgttgctgaaacagcaataatggatgtatatccatatagttctgagcctaatgataaaccggaagtataa

SEQ ID NO: 1620 - DNA, 405 bp, B.fragilis
tttatgaaagagaattcaatcaaaccgtattgttattgtggtgagtcagaaagctcattggtcgataatgctatttttgtttattttggtgatgaatacagaagagtacttctggatgaaatcttatggctggaagcatccggcagttattgtgtactctgtatggagaacggtgcagagataacagtcagctatcctttggatcggatcttcaataatgaccttcctcgcggcaagtttcagagaattcatcgttcttacgctatcaatgtgttcaaggtgaccggatttgcaggtaactatgtacatataggaaagaagatgttgccggtcagtgaatctcacaaaaagaattttttagcttgtttccataaaatttactcaaagcgtgcattgggaaaataa

SEQ ID NO: 1621 - DNA, 621 bp, B.fragilis
tataatatggataataagaaagttaggagcactagtagccaggtaatggaacttcagcaattgattgccggtcctttgattgcaactattgaagcggattcattatcttcacaaagatatctggattatctgatgaaaatcgcatttgaatcctatgatcctgtgacaggacggaccggtaagatacgtatgcttacgttcaactatcagagtcaggatgccggtgggggaagaacgcaaagtgtaagtataccgatactgacattggtacctctgccactgttgcaagtacaggaagcagatttcgatttcgatattaaaattctggatgcactgtcggaaacagctgaagaaaaattttcactggaagaaggtaaaagcgtgaatgagccgcaaagtggaggaggatttaaactccgggcttcactggctcccaaacagggagaaggcagcagcacttcgaatgtgcagcagagcttgtcggcaaatatgaaagtgaaagtgaagatgcgtcaggcagatatgcctgcggggttgtctaatctgttacatctgacggcgagcaatatgcaagtagaagaaactgaagctgaagaaataacggaaggaggaaataaatga

SEQ ID NO: 1622 - DNA, 582 bp, B.fragilis
cgcattgcggaaagttcagaatgcgcaggagaatttggagagaaaaagcaagttcaacggttaaacggacgaggcatgaaattgacttttttcaagcggatgggggagaagatccgccatccgttccgaaaggaaattccgaaaacaattcccgttgtagaaactgcccctcagccggtagcggataatacaaccgaagcaacggcagaagactcttccgtcataagatcggcagatcaatgtggggaacaggcacgttattttttactaagaaataacaagccggttggtaaacctttcagttattatcatcccgagatacggatcgttcatgtcggtagttttgtaaatgcctttttatttttcttgcgtatgtgcgatcagcgtctgttgacctatcgccagaccggagaatatctgcattgtacagccgtttttccggatgaaagcggtaatttgtatttcacgaataaagtgacttgccgtaacaaggaaaatactgttgcggtcctgaaaattgattatgttggccttaagccaaaaatcactgaaattagatttgaattaaatattaaaaaatga

SEQ ID NO: 1623 - DNA, 573 bp, B.fragilis
cgtatccgggagcgaccctccctcccctttctcaaaccatactcccaatcagacatgaaatcctggcttgccgcctatgtccgtctctatcacgaaaagaaaacccgtgaccgcctgacggcaatgggcatcgaaagtttcctccccgtgcaggaagaaatccatcaatggagcgaccgccgcaaaaagatcgagcgcgtagtcatcccgatgatgatcttcgtacacgtcgacccggcagaacgtgccgaagtgttgaccctttcgtccgtcagccgctacatggtgttgcgcggacaaagcacccccgccgtcatccccgacgagcagatggagcgcttccgcttcatgctcgactactccgaagaagccatcgaagtgtgctcctcccccctcgcccccggcgaacaggtgcgagtcatcaaaggccccctcgccggactggaaggcgagctggtgaccatcgacggcaaaagcaaggtggcggtaaggctggatatgctgggctgcgcccatgtggatatgccggtggggttcgtggagagagtgggaaaaatggaggcggtgagatga

SEQ ID NO: 1624 - DNA, 1650 bp, B.fragilis
aggaatatacttatggaaaaattgcatatccggaagattgcttcattggggttgatgctttgcttttttacgggggtaggagcacagacacctgtcaaagtggaaaaaaggaaagagcataaatcgaatactgtaatacctgttgtcaagggaaatgtgacagataccttgtcacttgtatcatttaacgattttcatggagcctttgcctgcgataagggtgttcccggagccggccaactggtacaaacagtgttgacacagaaagagaaaaataaaaataccatcgtgctttctgtcggagataatttcagcggaagttatttctcaagaataaccagaggcaatccgttaccggaaatgtttcaggaaatggatgtaaaaatgtccgctgtaggcaatcacgagtttgattggggattaccctatctgacggatacggcgaaggtatatatgaattttgtggcagccaatattataacggatcggggagatacgttggagtgggctaaaccttaccggattgtgactctgaatttgaagaatggaggaacggtgcgggtggctttcgtagggttgacaacgactgatacggcacataaaacgagtccggaaaatataaagggactggcttttgtgcatcctgtatatgcagcccgtgtcgagactgcctgtcggttgaagaaagaaggcaaagtggatatggtagtactcttgatgcatatcggcactaacatgaagaatagagatattatagaagaggagaatgctaaattgctgcctttcctgaaaggagtggacgcaatcatttccgggcattctcacgaagttgttcttagtaaggtgaacgatgtacccattatccaggcaggggtaaacggtactcatatcggtaagttggattttagagtagtgaaagaagagggcggcaatcgcatctcttatataggaggtgatacaattcggacagaggggccgtctaatgcacatatcgattcgttggtcgataaagtattggcggtatacggactgtcggaaaagctgattttggcaaaagatgccctgatccacgatcgtaccattaataaatgggagtacactccggtgggagcttatgtgacagctgcctatgtccggagtttcttagagaatgaaaaagtgcctgccgaattgaaagtgttgcctgtcattggggtaaatcattttggtggtttacgtgccagtattccggcgggtgaggtcacaaggttgcgtgccggcaatgtgcttccattcggtggtaacgtggtggcttatgaatttacgggtgaacggttgaagcaattattggacgatggacgcaggaataaaaacggttttctgcaaacttcttatttaaaactacatttgaattcgaaaggaaatgttgaaacgataaccgactgccgtaccaataagataatccgtgatgacgataaatgtatcgttgtattggatgctttcatcacctcgggtggcgacggttatgacagcaaattattttcaggttatgaaataggagattttaatagtcagaatcttgaaacaactgtggcttttattgattatttgaagagtctgaaagggtttgtttcctctgaggctgcgccgatacccatagtacaaaagtaa

SEQ ID NO: 1625 - DNA, 228 bp, B.fragilis
tctcacacacttttttttctacaagcatatcctatgccaatatccattctctgccatactctgcctacatatgattttactgcaccatggtcctatgtgcaacccctctccagatcccacgctaatgcaccccgctttctggctgacctgaatccggcagataaattcatggagctcaatctgccacatgtaggacacctttcacatggttcattactaaccacttag

SEQ ID NO: 1626 - DNA, 777 bp, B.fragilis
acaatgaaactcaacctaaagaatcctatcgtcttttttgatctggaaacgaccgggacaaatatcaactcagaccgaatcgtagaaatctgttatcttaaagtgtatcccaatgggaatgaagagtcgaaaactctccgtatcaatcccgaaatgcctatccctgccgaatcatctgctgttcacggtatttatgatgctgatgtagccgattgtcctacttttaaggaagtggcaaagagtattgccaatgatatcgagggttgtgatctggctggtttcaattccaaccgttttgatattcccgtgttggcagaagaatttctgcgtgcgggtgtggatatcgatatgagtaagcgcaaatttgtcgatgtacaggtgattttccataagatggaacagcgtacccttacggctgcttataagttctattgtggccgtaatctggaagatgcgcacacagcggaagctgatacccgtgccacgtacgaggtactgatggctcaactcgatcgttatccggaagagttgcagaatgatatgtctttcctggccgattattcaagctataacaagaatgtggattttgcaggacgtatggtatatgacgacaatggggtagaggttttcaactttggtaaatacaaaggacagtcggtgagtgaagtactgaaaaaagatccgggatattacagttggattctgaacagtgatttcacgttgaatacaaaagccatgttgaccaagattcgtctgcgtgagttaaccggaaaataa

SEQ ID NO: 1627 - DNA, 1107 bp, B.fragilis
cgccatagttggtgggataccagcaaaagtattaagattcaaagaaataaatatactataaaaccattattatctatgcctaaagttttagtagtggccacctctcgtaaaaccaaaggaggaatcacttctgtagtaaaagcacatgaaacaggagaacaatggaaaaagtttcattgtaaatggattgaaacacatcgggatggaaatagcgtaagaaaattatggtatttagctacagccttaatagaatatatttgtcttctacctttctatgatattgtacatatacatgtaggattaagaacatcagtcaatagaaaacttatatttgcacggattgctcttctgtttagaaagaaaattattgttcactttcatccagcaacggaaaagcatctattcgatcctatgtttagtggcaatataaagcatttattcgaactatctaataaacttcttgtactatctcccaaatggatagaatggataaacgaagcataccgagggaataaatataatatacaagtgctttataatccatgcccgagtgtgaaacgaagcattcaaagagagaattatattctatatgcagggattctatcagacagaaaaggctacaaccgacttattgaagcattcagtaaaattgctgcaaaatatccagattggaaaataaaattcgcaggaaatggagaaattgaaaaaggtaaatccttggctgttaaatttggtatagaacaacaaactgaattcctgggttggatagccggcaatacaaaagagagtatatttcaacatgcttccatttattgtttgcccagttggggagaaggatttcccatgggagtaatagatgcaattgcttatggaattcctgtcattacaactcctgtaggaggattagaaaaagtttttcacgacggtattgatgctatgatttatgaaacttacgatttaaagatgttggctgacaaattagaacaattaataaaatcggagacttataggaatagtatagtaaacgaagcagataaattggtatgtagcgactttaatatcatcactatttgcaataaaattgaaaaaatatatgagaacatgtag

SEQ ID NO: 1628 - DNA, 1137 bp, B.fragilis
tgtcatcatcggagccaatgctgttgtaataaaagacgtaccaaacaactgtatagtagcgggtgtacctgcaaaaattataaagaaaatatgatatatctcatttgccaggactggtcaaataccagcaataatcatgcaggtataaaatacttatgcaaccaaattcaggagatgtatcctgaaagctataaaaccttcgttattcctgccttttggaatgacaggtcaaaatcccccattcgaatcatagcaagtttacaatatcactttgctcgatacaagcacagactatacacaaaaaagttgtacaatcacataatatcaaagctacgaaaaggagataaaataattcttatggaatacatggagaaattttttcccatgctccattttgcacaaaaagtgaaaagatataaattcaacatacctctctacgcaatggttcaccttgttccaagccggttggaaaaaggattctcagacaagaaaacatttgatgaatggacaatctgcatcgataaatttcttacccttggccattcattaacccaattccttattaccaaagggctacctgaagataaagttgttaccacctttcattatgtggatgaatattaccataacaaaagacctgtacgtttgcataagaatatccgtgtaatagccatgggtaatcagatgagaaacctcaaactactaaaaacaatcgttgataataaccctaatgtcaattttaccatttgccaaggggtaaatgatttgtcatcctatttcctgaaaaatacaaatgtcgaactcatcccatttgttgaggaatccgagttacgacagcacatggctaatgccgatatatcgctaaatgtcatggaagataccgtaggtagtaatgtaattgtcacatcattagctatgggattagctatgatttgtagcaatgttggttccatcaaagactattgtgatgatagtaacactatattttgtaataactctaatgtagaagacttctctcaggctataaccgcattacaaacagatagaatacgattgaatacaatgcaacaatcggcagccaatatgggattacaatttactattgagaagtttgtgagacaaataagcgcattataa

SEQ ID NO: 1629 - DNA, 897 bp, B.fragilis
gttggcgaccgaatggagagcacttacatcgagttgaaagatatagctcaggagatatcagatcagggcgaaggcattgaatttaatccattacgactggaggaagtaaatgacgggttgaacttgatctactctttagaacaaaaacatcgtgtgcagaccgtcgaagagttgattgctctttcggagcaatatgcaacaagacttgctgccattacttcgtatgacgaccggatcgttaaactgacggaacggcgcgatgcacaatataataaggtaaagaagcaagccgctgtcttgacaaaggcccgtacagagattgcccgtgaagtggagcaacagatggctgcccgtttgattcctttgggaatacccaatgtccgctttcaagtggagatggggttgaaaaaagaaccgggtccacagggcgcggatactgttaatttcttgttctcagccaacaaaaacggaacgctgcaaagcgtgtcttctgttgcgtcgggtggtgagatagctcgtgttatgttatctattaaggctatgattgcaggagctgtgaaacttcccacaattgtattcgacgagatcgacaccggtgtatccggtgagatagcagatcgtatggcggatattatgcaagagatgggcgaacaaaaccggcaggtaatcagtattacgcatttgccgcagattgcagcccgtggacgtgcccattataaagtgtataagcgggataatgatacggagactaacagtcatatccgtcgtttgaccgatgaagaacgggtagaggaactggctcacatgttgagtggtgccaccctgacggaggcggcgctgagtaatgcgagggcgttgctggaaccatctttgaaagaaagaaaaataataaaataa

SEQ ID NO: 1630 - DNA, 792 bp, B.fragilis
tttatgttacgttcattatacatccagaattatgctctgattgagaaactcgatattcgtttcgaaaccggattttctgtaatcaccggagagaccggtcccgggcaatccattattctgggcgcaatcggacttttactcggacaacgtgccgatgtgaaagctatccggcaaggcgcttctaaatgtgtcatcgaggcacgattcgatatatcggcctatcacatggaagccttttttgaagagaacgagttagagtatgagcccgaatgcatacttcgtcgtgaagtacagtcatccggtaaaagtagggcatttatcaatgatacacctgcttcgctcacacaaatgaaagaactgggtgagcaattgatcgatgtacactctcaacatcagaacctattgctcaataaggagggcttccagcttaatgtgctcgatattctttcccataacgaagaggctttggatgtataccatcatttatatcaggattggaaaaaactctgtaaggaactcgatgaactgattgttctggctgaacaaagtaagacggatgaggattatattcgttttcagttggaacaactggaggaggcgcatcttacggccggagaacaggaagagttggaacaagaggccgagacattggcacacgccgaagacatcaaggccggactgtaccgggtggggcaaactcttgcttcagatgaaggagggctgcttgcctgtattgaaagaaagtcttggcgctttgagtgggctgcagaaagtatatcaacctgccggtga

SEQ ID NO: 1631 - DNA, 456 bp, B.fragilis
attgtgcggcgaagttacaattttttagggatatccgacgaatattcccctgttttttcttctcttttattgtgctgcctcaatcttttttgtaactttgtgctttgcaaaaatataaaatttaaaatcacagattatatgaaatttatcgtttcaagtactgcacttttcagccatttacaggctgttagccgtgtgataaactcaaaaaatgcactgcctattttagattgttttctctttcagttggaggacggaacactgtctgtgactgtctctgatagtgaaactacaatggtaacctcggttgaggtgaacgagagtgattctaacggaaaatttgctgtagctgcaaaaacattgctcgatgcattgaaggagataccggaacacccgttgacattgatatccaaaccggatacttatgaaattacgggtacagtcccagaatggtaa

SEQ ID NO: 1632 - DNA, 579 bp, B.fragilis
atcatgaagctgaataatataaaaacaggattgctgttggccggattgctgctgctattcggaaatgtaaaggcacaggataatccattcaaaccggaatggtttgtatcgggaggtattaacgggatcacagctttaaatggttcggcaaacaacatattgggagggaaagtctccggcggcgtgtggttaaataagatcatcggtctgcgcgtcgatgcagaagccggcaacgtatggctgaaaggcggatacaatgccgtgacagttggtgccggagcggatatcctggtgaacctgatgaagaattataccgacgaagacagaaaattccggttgaacgccattttcggattagggtacaactactattcgtttggtgatgattatcccagactgtcaaagacgaataccatgagcggtaacttctctctgcaagctgctttcaggctgaattcgcatctgagcatctttgctgaaccgggaatcaaaatcagtaccaagttctatgacatcgaaaacaaagatgatgtgtttgccggcggaatgatgaccgtaggtgtgatatacaaattctaa

SEQ ID NO: 1633 - DNA, 687 bp, B.fragilis
actcaaaacagtataaaaatgaatgttactgataacttaaagcaggtcctggccgaattgccatccggcgttcgactggttgcagtctcgaaattccatccgaacgaagccattgaagaagcctatcgcgcgggacagagaattttcggagaaagcaaagtgcaggagatgacaggcaagtatgaaagcctgcccaaagacattgagtggcattttatcgggcacttgcagacaaacaagatcaagtatatggcgccttatgtgtccatgatacacggaatcgactcttacaaactgctggcagaagtgaacaaacaagccataaaggcagaaagagttattcgctgtttactgcaaatacacatcgctcaagaagaaaccaagtttggtttcagttttgacgaatgcaaagagatgttgaatgccgccgaatggaaagcattggcaaacatacagatatgcggactgatgggaatggctaccaacacagattcgaaagaacaaatcgaacgggaattccgttctttaaattgttttttccatgaagtgaaaaaacaatattttgccaacgaaccgactttttgcgaactttcaatgggaatgtcccatgactatcatctggccattaaagagggcagtacattggtaagagtaggaagtaaaatcttcggggaaagagtttattaa

SEQ ID NO: 1634 - DNA, 1044 bp, B.fragilis
caaaaatcaagaaataatcatatgtacaaggctcccccaagagacatcagcattgacattctaaaatgtatcgcagctattatgataaccaactcacatatggatattctatatggagactattcctatctagccactggtggggcgataggtgatgcactgttctttttttgctctggttacaccttatttttaggtcgggatatggatttcttcaactggtataaacgaagaataaaccgtatctatccgacagtgtttacatgggcgctaattgcagcggtatttttcgatcagcgttatgatatgccagaaatactaatcaaaggcggtggttggtttgtaagctgcatcatgatttattatgtagtactgtggtttatacgtaaatttcttaagaaacatcttaaatgggtgtttttcatggcagcaactataacgcttctgtggtactttgtactaggctttggtgaaaaaagcggtaataatatgtatggatggaattactttaaatggtgctattatttcttatttatgcttttaggatctatgatgggattaaaaagaaacctgaataaaaaaacatatccgtttttcgaaggattatatgacaaacacatccatattatcccaatctttctaaaactattgatatgtatagttctattttttggattatgttggtttaagtgccaaacaggtataggatgggaactattgcaaatatcatcactaattcctctattgggcactacatattatttttggagattgtccaacacaaaattattaacccaagcatatcatcatcatctgacaggtcctatcattcgtttcatcagtgggctctgcttggagatatatttagtacaatacaacttgttcactgacaaacttaataatattttcccattaaatctattagtaatattttccactattcttgttacagcttaccttctccgctgtctttcccgaatatggagtcagacttttaaagatggggattatgactggcgggatgtaaccaaactttacagttaa

SEQ ID NO: 1635 - DNA, 951 bp, B.fragilis
tgtgtctgcggcttgtttcctggagtatgcttcgtggatgaattacgcgggttgatcgggtccggacgggttacctctccttatctgcatatcggaggggggagcaacttattgtttactaaagactacgaaggtactatcctgcattcacgcatcgggggcgtagaggttgtggccgaaacggatgacgatattgttgtgcgtgtgggggcaggtgtggtctgggacgacttcgtggactattgcgtgcaacggcattggtacggcgtggagaatctttcactgatccccggagaggtgggagccagtgcggtgcagaacatcggggcctacggggttgaagttaaagatctgattgtccgggtggaaaccctgaacattgaagggaaagagcatgtttatgatgtaacggagtgtggatattcttaccgggacagcatcttcaagcgccctgagaataagagcgtttttgttacctatgtcagtttcaggctgagcaagagggaacattatacattagattacggtactatccgccgggagctggagaagtatcccggagtgacattggatgtggtgcgccgggtgattatcgctatccgtgaagagaagttgcctgatccccgagtaatggggaatgcgggaagtttctttatgaatccgattgtgggtcgtgagcagttcgaagccttacaggcagaatatcctcaaatgcctttttacgagatcgatactgaccgggtgaagattccggccggatggatgattgatctgtgtggctggaagggtaaagcattaggccctgcggcggtacacgataagcaagcgttggtgctggtgaatcgcggaggcgcaaaaggagcggatgtcattgcattgtccgatgccgtgcgtgcttcggtccgtgcgaagtttggcatagacattcatccggaagtgaattttatctga

SEQ ID NO: 1636 - DNA, 903 bp, B.fragilis
agtagatttatgcagactgaaaacttcactttaggtaagaaagagcttcttattttgcttggcttgactcttgtactgccttttccaatcaattgggcattaatcgaactgaatccgttgactctgatggcgggtgcagacgatgtgcccacctggattggtttcggcggcagttatattggaggaatcatcggagggatcatctcgattatgattctgaacaagacacttcagcagacaggtgtacttcatcacgatttgaaactcctgcagttagataccataatttatactcagcaacaagattggtttaccggtttcaaacaagaactggcagagaatctcaaatctattgatttgtatgtgttgaatacggttgtttcgtctatatccatgaaaaactatgcatatgccaaagaggtgttgacagaaatcaataaagggctcgaatatcagatggttgccgcatccttttctttcacttctacgcatttatcatccgaagaaaaaaagtatatgaatctggtacgccgcgtacagactgaatatagctcttttatcaaggatattctttactatattcctttggcagaaacgatatcttccaggaaaaaactaaactatgatcagctgatggactatactttgtcccaatatgattatttgcaaggtcaggaaggggagtctacagcttcgggagccatcataccgcgtgttatggaaatcgatccatctgatgatatacggaaagaactagaacggataatggaagaaagattaaccgggcgtacctatttgtatcacctgaagtcagatcttgcagaggctacgcatcaattaattatttatgaagagaaccgtataaactctattctgcataaacctgagagagaaatgaattga

SEQ ID NO: 1637 - DNA, 402 bp, B.fragilis
atattaattattaatgaatcaaataagatgaaaaaagtaatttgcagtgagaaggcaccgggagctatcgggccttacagtcaagctattgaagctaatggaatggtatttgtctctggtcagcttcctattgatgcggctacgggtgtgatgcctgatggtgtggaggcgcaagcccgccagtcactcgagaatataaaacatatccttgaggctgccggtctgacaatggcagacattgtaaaaacaactgttttcctccaggatatgtctctgtttgccggaatgaacggagtatacgcaacttattttgacggtgcatttcccgctcgttcggctgttgccgtgaaagccttgcctaaagatgccttagtcgagatcgagtgcatcgcggcacgataa

SEQ ID NO: 1638 - DNA, 885 bp, B.fragilis
aaaacaattattatggcagttgacaaaacaccgtcgcaggttgcaaccagtgcgttgcaggcgattccgttcggttctattattggtggtccgttgaaagcatgtgtggaagcacaggctttggcagcaaaaacaacttgggaatttattcagaatgtaggtataaatgttaatcccgaaaccggtgagaagacagcagtcaatgtttctttctctttcattcaaggaggacgtttggtccagttgaatattccgttgttgaccattgttcctatcccttatattgcaatccgtgaagtggatattaattttaaggctaatatcagtgcttcctcttcaacaacggcagagacgaatgaatctgtatctaaggatgcagctttgaaggcttcggccagtatgagattcggatgcttcaaaatgaatgcggatatgaacgcaagctattcatcgaagaaggattctaaagcaacttccgattctaagtacagtgtagagtataccatggacgtggctgtaaaagccggacaagacagtatgcccgcaggtctttctaaaattctggaattgctgggtaactcactggatgtttccgatcctgccggtacactggaagtgaacagcaacttgctgcttattgaaaatggtaaagaaacagtacggttgattgccacctataaggatggcagcggtctgttggctcctgacaaactgactattacaggaaccggagccaatgcggccgactttaaggtaagtggtgacagtaagattatcgacttgccggaaggtacatatactatcaaagcagagggaagcaagaaggaagtgattgtcgaagtgaaaaaagatacggcaactccccaggaagaggtaacggaataa

SEQ ID NO: 1639 - DNA, 267 bp, B.fragilis
tttaattatatggaaaatttggaaacagcgctcctactgatggtagtcgggatggcaactgtctttgctatcctcctcattgtgatctatttaggaaagttacttatctcgttggttaataaatatgctcctgaagaacagcttcctgcaaagcagggtacccaatcaccggttcctattcccggaaatattgttgcaaccattacggcggccgttaatgtggtgactcagggaaaagggaaagtggctaaaatcgagaaaatctga

SEQ ID NO: 1640 - DNA, 1179 bp, B.fragilis
caaaaaaatatacaaatgaaaattggaataatcactatttgcaaagtaaacaactatggagcagagctacaagcttttgcaacgcagaagaaattggaacaaatgggacataatgcagagataataaattacctttattataaagactggcattttaaagacactcccctatcacaaccatttgtacctttagacatgaaaggtaaactaagctactggataaaatacagactaatgagttgggtagtaaataaggtattacctatattcaatgggaacatgagacgaaggttacacaactatcaatcatttatagatagtgagcgcttttcagctcaatacaaatcaatggatgagttgtacaagacttaccctaaatatgacatttatatggtaggaagcgatcaagtatggaatccttcagcttcttcttctattgaaccttactttctaacttttgctccgaaaaatgctcctaaagtgacttatgcttcttcatttggtgtagcatcaatagcacctaatctaagcaaacgctatgcaaagctgttgaacaatctagacacaattgcagtaagggaacagagcggagttgaactcgtaaaacaactgactggacgtgaggcaaaattagttgttgatcccactctactattgagtaaagcagattgggaaccttatatgaaacctttagcaaaaatatctacccagtacatattgatttaccaattatttccatcacaaacagtaatagatgtagcattaaaaataggcaaagagaaaaatctcccagtatataatatttgtaaacgggcttacggaatgaaaaaaattgtcggaatcaacaatatcctggatgccggtccttcagaattcctttggctgatagctaacgctacttgtatggtgaccaattcttttcatggtactgcattctctgtgaattttgcaacacctttttgttgcgtactaaaccgtaaaaggaaaaacaatggacggatgatttcatttctggacaaagtagatatgagtaatcgcatactatacgaagattccatagcagaattaaatgtaatgactgcatgtagtgaagtgaccaacaatcacttgagattattggtcaacaactcaatagattacctcaaaagtataatagagaataaagaacaaaaatgctaa

SEQ ID NO: 1641 - DNA, 576 bp, B.fragilis
cataagaatattatgatacaatcaaaaaaagacttaaaatattatttatccgaggacctgaagcgtttcaataatcataagcctaatataaaagactggttattacacaatgaaatatggtatatcttccactatattcgtcatttgcgttatgtggaatattataaaaacaccaacaaaaataaaattctatttttctaccattttttccgttataaacgactaggtttcaaactaaaaataactatttatcctaatactattggagcaggtttaaggatctatcatgtgggagattttattcatattggggcacagtgtcatataggacataattgcacactacttcctggagtagtatttggtaacaagtatgagaaagcaactgacacacaaataattgcaggcaacaattgctactttggactcggagccaaaattttcggttccattataataggaaacaacgttaccataggagcaaatgcagtggtcacaaaggatattccagataacgccatagttggtgggataccagcaaaagtattaagattcaaagaaataaatatactataa

SEQ ID NO: 1642 - DNA, 585 bp, B.fragilis
agaagatgtataagaattaagagaataactaatatgaagaaaataaaaacagcatttgctctcccgcttttttggctactcttcaaagtaagcaaagatatgcacaagattcaagttgatggacaagcttggtgtcagtggcaacataagaacttcacattatggaacatgtgtagtttatttataggtttcaaggagtttcgcaacctattctattaccgcataggatatctccaccatctgatagagtggatttttccccgcatgacaaatttatatattaccactcctcgctccgatgtggatagcggacttatcatacagcatggttttgccactattatatcagctaaacaaataggaaagaattgcaaaatatatcagcaagttaccattgggtatgaccatactttgcaggctcctataataggtgacaacgtagaaatttgttgtggagccaaagttataggtggtgtcactattggcaataatgtcatcatcggagccaatgctgttgtaataaaagacgtaccaaacaactgtatagtagcgggtgtacctgcaaaaattataaagaaaatatga

SEQ ID NO: 1643 - DNA, 1611 bp, B.fragilis
acctgtatcatgatcaagttaaacgaaaatatcatccgttggatcattgccgttccttgtatacttttgacagtatgtctggtcctataccgggcatatcgtcattcggcatcggacagggagcgtcttgctctgtctctggaggaattccgggataaagaaaagaaatcggttcttatacaacgggtcagtcaacaaatggaggagattgcttatcaacaaaaggatatttccgaaaagagaagacaggaagccgttgcgcaaactcaaaaggccaaccgaatgcaacagcaggcagagttggcacgggaaagagcgcttgctgcacaattggaggctgagaaagcgtatcggatggcagatgaacaaaagaatctggcgatggaacggcaactacaggccgaacagtcgaagagggttgccgatacattggcttttttggctttgggacgttcattggggacactctctgttactcaatatcggtcgggcaacatggaattagcttctctgttggcatataccgcctggtggtttaccaagcgatatgatggcgatgtatatcatccggctgttttcaatgcattgtctttgtcttgcaggcaagatcagctttggttcgggcataaaggagctgttaccgggatcaaactgttatccgaaggcgaggaaaaagcaagagccggtcggaatcctctgccgggattggtcactgtcggcaagtacggtgagatgatacgttggaaatcggaaaatgggcagacctatacctccgaattactgttgaatgatccctgttatgattttcgggatgtgctgttgcggtccgattcacagatgtatgccttgtcatactgcgggcagcttatctccacggattccgccggtatcgttacccgctttttgcctaaaggagaatatcggcaattgatttcgattgcctctaacttggtattggcggtttccacaacaggtatttattcttttgactgtgtcaaccatgagatacaaccttattttcagccggaacattcgataacttgtgtcggtcaaatggaaggctatctctatgttttttttaagaatgggacagtagctttactttcgtcggatggtacatttctcagatttatagacagcttgcccgagaatagtgtggttactgcattctgtcctcttaccaatgaaagatatgccattggctgtcgtgaaggagtcatcctgatttgtgataagaatggaaatatccggcagaagttgatagggcatcaggctgcggttactgctatttcccggaaagggaacaaactgttttcgagtagttacgattgtacgctgcgtctgtgggatcttcgtaaaggaaagaccgagtcggccgttattgtgacaagccccggttggatccatactttttgctttcatccggacggtacatctgtctttataggagacgaacaggggcggttgtatcgggtgcctgtttcacccgatcacatggctactgttgtccgtcaggggttacagcgtgattttactcgagaagaatgggagtattatatcggtaagcaaattccatttgaatcctattacctaaaaacgtatcagccatga

SEQ ID NO: 1644 - DNA, 678 bp, B.fragilis
ttattcttaattaatggcaaagtgttgatgagattcattttatttatcatattttctttatgtttgcctttggtcatgcaaggacaagaacaaaatgtgtggacacaaaatgactctttgaagttaaagaaaatattagtaggacaagctgaaatccgaattaaccgggaggcattaagagaactcgacagagctttttcttctccacgacgcttatttaaatctcaatctcgttctgccattttactaatcaaagatttcctattgtacagacctaacgtctttacaggtaaataccatatatccacttttaaagttaatgagttgaatatccggcaagattcgctcttcatgaatgtccacatgttgggcaataaacagttatttgtaaaatcccagttggatataggggatccccgagtattgataaagaggaaaactgatatacagtttaagtttacagaccatttggcgtatcgtgtttatggtggctatactattgataagaaccgaacaataatattgccaactacagctactccatattatgtgggtacaggcttttcttatagtctcaataagaaattacagttaaaaacagggatagagtatcagtacaatgttatttataagcgttgggaatgggtttggaattccggtatccgttttaacttttaa

SEQ ID NO: 1645 - DNA, 2442 bp, B.fragilis
atcaaactaataatgaaaacaaacattcaagaaaatctttctcgatcactctctacctggggtgacaaaccggcggtcgttgcaaaagacggtaccgtctcttatcaaatgctggaacgttactctgccaatatagcacaatctatccgtcaacgtttatcggtaactgatccgtccggacttcggaatatctgtatcggagtttgtatggaacgaaacaaaactttagtacctgccattctggctattttccggttaggggcaacttatttaccgatagatccctcgctgccggataatcgtaaacggtatatggctgaaaatgcggatatggttttgttgttgaccgattcatcgaatgaagtaggtggaattccgtccgtccgccaactttacctgaatggggagcaactatccgaaccggttgttggtgactatactgaagttcttcccgatgattgcgcctatattatatatacttccggaacaacaggcaatcctaaaggtgtacgtattagttatcggaatctggatacatttacgaggaatctgatagataagaaattgtatcatttgtctgatccggcaaacaggtacctggcgtttgcgagtatcagttttgatgcttccatattagaactgatgatgtgtattccggccggaggaacattgatcctggccggtgaggacgaacgcagagatatttctttactagacgaactgatcaggcgcgagaaggtgaatattgctttttttcctccttcgttgctgggcatgtttgccgaccttgactttccatcctttaagactctgctctttggtgcggaggctattggtgaaaagttatttaacaggctgaaacagcagccttaccggttgatgaatgtatatggaccgacagagaataccgtactcagtaccatacggattgtaggcaaagatacgtcgtatgacgatattggctatccgctcaagggaactgtctgttatgttttgtctgaaaacctccaacagacaactcttggggctacaggagaactttgcttgggaggacctcaggtttcgctgggatatattgggagtgttcagctgaatgaaaaatcattcatctcgtacgatggagaacggttgtacaggacaggtgacttggtacagcagcaaccggacggttcaatacggtttatcgggcgaaaagatactcaggtcaagatacgtggttttcgtatcgaattgactgaaatagcagaacgattgaatagagatccggacgtggagagagcccacgtagtagttgttgagcggaatgggcgtcaattattgggagcttatttgcaaccctcagtctccggtaactttcatccggaagaggtcaaagagcgtttgcgtgcagaacttccttactacatgatacccaatttatggcaggtggtagatcattttcagcgtactataaatgataagattgatgtccgggtgctcccggcttttacttcattggagttgaagtatgttcctcctgttcatccgggggaggttatcttatgtggaattttgaaggaaatgttaggtttgcctcaagtcagtgttgaggccgatttgattgatgatctgggattaacttcgctggatatgttgaggcttgttaccgaggccaataaaaaaggatgtcccatcaacgtatctgcagtttatactgcccgtaatctgcgccgattattgctcgttccgcggcatgaacctatctattggtacaggcagcaaaacctgaagaaacccgtaatcattctggtttgtggatctgcctattttaatcatttgtactttaatttggccgaccgcctttatcccaaatatgactttctagttgtagatgctatctacgatcattttaataaagtggccacggatattccggaactgttggaatattatgtccggacggttcagccaatgatccgggagcgtaccgtctatgcgcttaccggcttttgtatgggagctgaactggctgtcggcctggccgaaatgttacatcgctccatggggataatgccaaaagtttttgctctggatggacaggcttggcaaaatccggctctctgtcaaaattatcctttgttggtatttcccggagatacagatgaaatggtacgtgaacggaacgaaatcataaatatttattttcgaaccactcctaatctgatttatcagggagaggttattgttttgctgtccggattgttccatcaacaggcgggattgtctcctgaagagtcgtggacggaggaaagctatcgtatattccggacagaatatgacaattgcgaaagattatggaataaatattatccgaacgctcctgttttgcgattgccgacagatcattggcactttttagaaggggaatcattggaacaattaataactgtgtttttgaagtag

SEQ ID NO: 1646 - DNA, 714 bp, B.fragilis
catcaatcaatgaggctaaaagaagcagtattaacggtctgtgtaatgatgataacatcaggaatcaaggcacagtataccatggggacaacaggaatgatgaacattccgaccgccgagatgcaacagacaggtaccttcatgatcggcggtaactatttgcctgaagaactgaatccttttaaatacaactccggaaactatttcgtgaacatcaccttcttttcattcctggaattgaattaccgttgcatcttgctgaaaagtgactacatggctaagaagcctaaattcaatcagcaagacagatcgttatctgtaaggctccgcccgctgaaagagggtaaatactggccggcaattgtcattggcagtaacgatccgttcaaagataaaggatacaattatttcgcatccgtatacggagtggccacaaaaagtttcatgataggcgaacaccggctggcagcaaccgcaggatattattatccattaagtaaagacaagtataccttgcaggacggcatattcggcggcctcagctatactccctctttttgcaagccactgtccatcatggccgaatatgactccgacggattcaatgtaggagcggccgcaaagttgtggaaacatctctcactgaacgtgtttacccgcgaatttaaatgtatctccggaggaatacgatatgaatgtgtcttaatccattaa

SEQ ID NO: 1647 - DNA, 621 bp, B.fragilis
ggcagcacaataaaagagaagaaaaaacaggggaatattcgtcggatatccctaaaaaattgtaacttcgccgcacaatttaaaattatcgcaatggaatttacaggaaaaattatcgctatactccagcccagaggtggagtttctaaaaccagcggcaacgaatggaaagcccaggagtatgtaatcgaaaatcatgaccaataccctaagaaaatgtgtttcgacattttcggagcagacaaaatagaacaattcaacatccaaatgggtgaagagttgaccgtgtcattcgacatcgaagcacgtcaatggcaggatcgctggttcaatagtatccgcgcatggaaagtagaacgcgtaggcgcaggcgcacccatgggctccgggagctccggttcctcctccggcaccctcttcgggcacccgaatttattgccggtgacgcaaaagacgatctgcctttctaagcaaacaagctttggcaaaaggcataaaaccccgaaagttcttcaagatctttcggggttttataccttttatggggtcaggaaatgtcatcagactcacctttgtaaatcaataccacattgggatatacaattccgtccgtacaagtaa

SEQ ID NO: 1648 - DNA, 1230 bp, B.fragilis
agaacaaaaatgctaagtatccttatcaacgcttacgcttgttctcccaacatgggcagtgaaccgggtatggcctggaactggtgcataaacctagccaggcattgtgaactatacattatcactgaaggtgaattcagagacaaaatagaggcagtgctccctaccctgcctcaagggaaacacatgcacttttactataatccggtttcggaagaagtacggaagatgtgttggaatcaaggagattggcgtttctataaacactataagaaatggcaatggaagacttacgagatggcacaggaaataatagtcaaacaacatatagatattgtacaccaattaaatatgattggctttagagaacccggatacctttggaaactagataagccatttgtttggggaccggtagatgctaaagaaaaatttccgacagcatatctaagagatgcagggataaaagcaaacttattcatcagattaaaaaatcacataaccggtttacagttacgatattcacaacgagtaaaaaaagctgtaaaaaaagcctctgtagtaacatccgcatcttctgaatctcagaagagtttcaagaaatattttcatattgacgctcccttattaaatgaaacagggtgttatcctaaaacaacaataataaacagtacaaaagaaaaaggtgatttaaatttgctttgggtaggtaaattagatttcagaaaacaattgcctttagcgataaaggccatagcacgactggctaatccacatataaaactccatatcgtaggtggtaacaataactcctatcaaaagttagcgatggaattgaacatatcacatcaatgtatctggcatggggttatctcacataatgaagttcaggaactcatgcagaaagtagatattttcttttttaccagcatagctgaaggaactccacatgttgttttagaagccatcaacaataaccttcctgttatctgtttcgacatatgtggacatggtgactcaattaatgaacaagtagggataaaaattcccctatctactccgcaacaatccatcaacgattttgcggagaagataacatatctgtttaaccatagagacgtacttaagcaaatgtctgaaaattgcagagtccgtcaagaggaactatcgtgggacaataaagccaaacagatggtcagtctatataaaaaagtattgtcacaagaatga

SEQ ID NO: 1649 - DNA, 768 bp, B.fragilis
ttgaaagaaatgaaaataagaatacttggtagcgggacttctaccggagtgcccgaaataggatgtacttgtgcggtttgtacttcaaaagatccgagagattgccgtcttcgcacctcagcattggtgtatactgacgacactactatactgctggattgcggtccggattttagggaacagatgttgcgcgttccgtttggaaagatcgatgctgtgttgatttcgcatgaacattatgatcatgtgggagggttggatgatcttcgccctttctgccgtttcggggaagtgcccatctatgccgaaacttatacagccgaacgtttgcgcagccggatgccctattgctttgtggaacattcctatccgggagttccgaatattcctttgcgtgagattgaacccaatcgcccttttcttgttaatcataccgaagtgttacccttaagggtaatgcatggcaaactgcccattttgggatatcggatcggaaagcttggatatataacagatatgctgaccatgcccgatgaatcgtttgagcagttgcaagggatagaggtgctggtgatgaatgcattgcgcatagcgccacacaacacccatcaaagcctgtctgaagcattggaggctgtgaaacgcatcggagcgaaggaaaacctgctgattcacatgagtcaccatatcggacttcaggcagatgtagagaagcaacttcctccgcatgtgcattttgcattcgacgggcttgaattagaatgttag

SEQ ID NO: 1650 - DNA, 1863 bp, B.fragilis
tcttatagaataataccgaaaacggaaatgaaaagagaagtaaaatttagtctggtttttagagacatgtggcagtctgccggtaaatatgtgcctcgggtagaccagttggtgaaggtagcacctgctattgttgaaatgggatgttttgcccgggtagaaacaaacggcggtggttttgaacaggtaaatttattgtttggtgaaaacccgaataaatcggtgcgtgcatggacaaagcctttccatgaagccgggatacagacacacatgttggatcgtgctctcaacgggcttcgtatgagtcctgttccggccgatgtgcgtaagttgttttataaagtaaagaaagcacaggggacggatatcacccgtacattctgtgggctgaatgatgtacgcaatatcgctccttctatcacttatgccaaagatgcaggaatgatttcgcaatgttcgctttgtatcacccattcgccaatccatacggtggaatattacaccaatatggcactggaactgataaaactgggggcggacgagatttgcattaaagacatggcaggtatcggacgccccgtttctttgggcaagattgtggcaaatatcaaagctgtgcatcccgatattcctattcaatatcacagccatgcaggaccgggctttaacatggccagcattttggaagtatgtgaagccgggtgtgattatgtagatgtcggaatggaaccgttgtcgtggggcacaggacatgccgatttattgagtgtacaggccatgttgaaagatgcgggattccaggtacctgagattaatatggaggcctatatgaaggtgcgtgccctgattcaggaattcatggacgactttctgggactgtatatcagtccgaaaaaccggttgatgaattcattgttgatagctccgggacttccgggcggaatgatgggaagcctgatggcagatttggaaacgaatctggaatctattaataagtataaggcaaaacacaatcttccttttatgacacaagatcagcttctgatcaagttgttcaatgaagtggcttatgtatggccccgcgtcggatatcctcctttggttactcctttcagccagtatgtgaaaaatctttcgatgatgaacgttatcgcgatggagaaaggaaaagagcgttggggaatgatcgctgatgatatttgggatatgattctgggcaaagccggacgtctgccgggcaagcttgctcctgaaattatagagaaagccgagagagaaggacggaaattctttgagggaaatccgcaggataactatccggacgaccttgagaaatatcgtaaactgatgaaagaaaagaagtgggagacaggcgaggacgatgaagaactctttgaatatgcgatgcatccggctcaatatgaagcttataagagtggaaaagcgaaagaggatgtcttggctgatgtagcaaaacgcagggctgagaaagagcaggtgcctacggaagaagcgaaacctaaaacacttacggtacaggtagacgggcaagcttaccgggtgacagttgcttacggagacacggaactgcctgttgcaccggcttcacaaccgtctgctgctgcaggtgaagggaaagaggtactttctccgcttgaaggaaaattcttcctggtaaagaatgcgcaagagactccactcaaggtaggcgatgcggtgaaagaaggtgatgtgctttgctacgtggaagcaatgaaaacctataatgccatccgcgccgaatttggtggaacggtaacagctatttctgcaaatcccggtgatacggtttctgaagatgatgtattaatgaagataggatga

SEQ ID NO: 1651 - DNA, 798 bp, B.fragilis
tgggacagaatgccgattaattccccgcaatcggctacacttggcgataatgcagttcgtgtagagatggaagcacagattctgttgggaggcattaaccggtcggtatttgctacggctgatgatgaacttcgtccggtgatgaacggtatctactttgacattactacggaagacattacgatggtggcttcggacggacacaagttggtgcgttgcaaaacattggctgcgcgcggaaacgaacgtgccgcgtttattttacccaaaaaaccggcgactctgttgaagaaccttttgcctaaggaatcgggtatggtagtgatcgagtttgacgaacgcaacgctgtcttcacgcttgaaagttatcgtatggtatgccgtctgatagagggacgctatcctaattataattcagtaattccgcaaaataatccgcataaagttacggtggaccgtatgcaactgatgggcgccttgcgtcgtgtatctattttttcttcgcaggcaagcagccttataaaactccgcatgcaggaaaaccagatcgtggtttcggctcaggatattgacttctctacctctgcagaggaaacacaggtatgccaatatgccggtgcagccatgagtatcggtttcaaatctactttcctgatcgatatcctgaataatatctcggcggacgaagtggttatcgaattggctgatccgtcaagggccggtgtcattatcccggtagaacaggaagaaaatgaagacttgctgatgttgctgatgccgatgatgctgaacgattaa

SEQ ID NO: 1652 - DNA, 849 bp, B.fragilis
aacagattgattatggaaaaaaacatttcacaagagaaacgaattgaagagttggaagcacggctcaaagagcaggaaaagctgggatcattgggcttgttgagtgcaggcattgcacacgagatacagaatcctttgaattttgtcatcaatttcagtaaactgtccggtcaattgttggccgacctggccgatagggtggatgaagcaaaagctcgtattccggaagcggaactggaagatatcaaagatatactttccgggctgagagagaatgtggacaaaatcaaagagcatggtgatcgggctatcagcattattcgtggtattttgctttactccagggggaaagaagacgaattcatgcctacacaaatacaaaaattgactaaagaatatgtgtggctggcttatcatgccatgcgggccaattataagaatttcaatattgctatccgtgaagattatgctaaagatatcccctcgatccggctgatcccgcaggatttcagtcgggcagtcttgaatgtgatgaataatgcctgctatgcagtatggaaaaaatggcagaatgctcccgaaggatattcccccgagataatggtgactttagaaaagttggataaaagagttgtactttctattcgtgataacggagagggcatgagtccggaggtcaaacgaaaactatttgactcttttttcacaacaaaaccggtggggcaggggacaggccttggtatggcaatcgttcgtgatattatagaaaacaaacaccatggaaaagtattgtttgattcggtcctgcatgaatatacttgtttccggtttatcattcctatcgcatga

SEQ ID NO: 1653 - DNA, 1323 bp, B.fragilis
acgaagcagataaattggtatgtagcgactttaatatcatcactatttgcaataaaattgaaaaaatatatgagaacatgtagtcctcgcctagcaaaagaaaaatactgcaccggatgtatggcttgcagtgatgcatgtacacatgatgctatcaagattgtggaaaagaactgtatgccatttgtgaaagtagatacccataaatgcatgaattgtcatttgtgtgaaaaagcatgtccgataataactcctgtaaaaaagaacagagctgaaaaaatgaatgtatatggaggttgggccaatgatgaacagacccgcattgatgcagcctccggaggtggtttttctggtttagcacaaagctttttccacctgcataaagaagataaagttgccgtcattggagctacactcgcaaacaatagagtatatcatcaattaatagagcaggaaaaggatattgtgttattaactaatagcaaatatatacaaagcgatactcaaggaatatataaagaagttatagagagactaaaaaccggatattggatattattttcagggtgtccatgtcaaatagcaggattatatggctttttaggtaaaaagagggatagtgaacggcttataacaattgaggttgtatgtcacggtattgccagttatgaagctcttgatcttcatttaaaatactataactcctcacgtatatatcgttttcgagataaacgacacggcacacaagattggaaacagtcgcaatgtactactattgaacagaatggagaagaaataaaattgaaacggaaggatgacatgttttacgctatttatgcaggatggatgctcgaccgaaagagttgtagcaattgccagtttgcggaaataaatagggtagcggatattacaatagcagatttttggggattacaggtaccagactattataaacagggtgtatcacttatcatagccaacaataacaaagcagataccatgataaaagcagcggatgcgatttatactttcaaagaatcactacgtacagcaattaatggaaatccgcatttatttacagggtacaaactaattcaattccatccaatagtgatgtggcctgacttcttccgaaagattcttcctaaacgaatacggttcaagacattaaccaacagaatgccatacaaactattttgggcactctataaattgggaacaatatatctggttaagtaccaaaagaaacaattaatcagtaaatttcagaaagatgataacctacttaaattgttaaataatgcaaatagggggggggggtaa

SEQ ID NO: 1654 - DNA, 999 bp, B.fragilis
cccccaaagatgaacaacaccaatcctttagtatcaatcatagtaccggtttataaagtagaacgctacatacaccgttcaatagacagcttattacgtcagacttataataatttagaaattatccttgtggatgacggaagtccagataattgtcctttcatttgcgataaatatgcaatgcaagataatcgtatccgtgtcatccataaatccaatggcggcctctctgatgcccgtaatgctgcactaaatgtaatgacaggacaatatgtcactttcgtagatagcgatgactatatcgcagacaacatgatcgagaaattcatcgaaacagtaaaactgtatcaatgtaatatggtagttgctggaatgaatataattgataaaaataatcaaatttatgattatcgcagaactctaacatctacactttctacaggcatcgatataacccgaaaactattaaaagatgtttttccttttaacttcgtttgtgctaaaatctttgaatcatccctttttgaagaaattcgttttcctgtaggtcgccattacgaagacactgctaccacatacaagcttacgcacaaatgtgaaagaatctattgtatcgctgattgcctctatttttatgaattggaacgtgaaggtaacattacctctgaactaaatacctccaaagccattaagagttacatagatggatgtttaaacagccaggaacaaatctttttttgtcaaaagcataaagacttttccgatttacttccagtgctaaccaagcgtttacaattatgggctctacttgcaatacaatctgctattagtttaggatataaagaatatatgttttattatcatcagataagaatatatatccgctcactctcttatacgcaacgaatgacgcaccttcaaattgcactaacatttcctataatttattactcactctatccactattgtcgagattgaagaagatgtataagaattaa

SEQ ID NO: 1655 - DNA, 237 bp, B.fragilis
atgaataatgtagccgaacatgcccgtgaacagaaagccgggatgaagtgcccgcaatgcggagcatttattgagacatcgatctttgaattattgacatccaatgccttgcagtgtccatcctgtcacttgcgtttgaacatagaccgcatgaagtcgaaagcagcttttgacgcattgcggaaagttcagaatgcgcaggagaatttggagagaaaaagcaagttcaacggttaa

SEQ ID NO: 1656 - DNA, 1218 bp, B.fragilis
ataagatacgtctctatatatggaaccattttgtatctaaatatatcagttaacgtgataacacttacttccaaatacgactgttgcgggtgtacagcctgtacctccgcttgtaataggggtgctattatcatgcaggaggatgaacaaggattcctttatccacatatcaacactacacaatgcatcgattgtggcctttgtaataaagtttgtcctgtgttccgatacgatgttataagcaataaaaaaaatgtaaatccccatattctcgctcttcatcatcataatgaaaaaacttggatatcctcctctagtggtggtgtatttgcctcccttacagactatgcccttcggcaagccggtgtaatattcggagctatatatgatgacaattttgtagtagttcatcgcagagcagaaacccaagaagacacactgaaattcagaggttccaaatatgtgcaaagtaatttaactggtatttatcaacaagttaagttttatctccaagagcaacgtttcgttctcttcagtggtactccttgccaagtggaagggctcaaaggatacttacagagatcctacgacaacctactcacagtagatatcctctgtcatggagtaccctcaccccgagtgtttcatgactacctcaattttattcgtcaaaactcagattttcacttcacaggtatttttatgaaagacaagacttttggttggggatatcagaattctcgccttttctttggcaagaatgccagccagttcaatacagtactttctcgtctttggaatgacatcttttatagccatctcacaacacgtccttcatgccatgcctgccgttttaccaactatctgcgccctggcgatatcactataggtgatttttggggaatcgagaaacatcatcctcagttcactgatagtagagggatctcacttattatgcttaataatactaaagctgaaatcgtatggaatcatataaaagatgacttcaattatctagaaagcaacatcaaagaatgcatacaacctaatctaaagtatcctgtacccgaaccagtcaacaaagctacattctggcaggattatgcttcaatgcctttctttcaaataatgaacaaatactataggatcacacatcaagatctcttgaaaaatcgcttttatatgattttactaactctcaaaaaacggtttacatga

SEQ ID NO: 1657 - DNA, 924 bp, B.fragilis
ttatcagtagttcgggacttactaacagtgccgctaaaaaacgcaaagctggaagctgccggtgcaggagccattgtcctgaaatcactatttgaagaacaaatcatgatggaagctgaccgtctgaggaatccatcatactatccggaaggaagtgattatctggctgaatatatccgtaatcataaattgacagaatatctggaactgattaaagaaagcaagaagatatgcaccattcctgttattgcaagtataaactgctataccgacgctgaatgggtagactttgcaaagcaaatagaagaagccggtgcagacgcactggaaataaacattcttgctctacaatcggacatccaatataaatacggctcatttgaacaacgtcacatcgatattctgagccacataaagaaaacaattcgcatcccggttattatgaaattgggcagtaactttaccaatccggtagccttgatcgatcaactttatgccaacggtgcagcagctgttgtccttttcaaccgtttctaccaaccggatattgacgtagagaagatggagcatacttcaggagacgtgttcagcaacgcatccgacctttcgacaaccctgcgttggataggtatctcttcttcactggtatctaaaattgattatgccgcttcaggaggaattcataaaccggacggaattgtaaaagctattttagcaggagcatcggccatcgaaatatgtagtgccatctaccagaacaccaatctgtttgtaggagaaatgaaccgcttccttagcgcatggatggagcggaaaggatttaagcacatctctcaattcaaaggtaagctgaacgctaaagatgtggaaggcatcaatatgtttgaacgtacccagttcttaaaatacttctctgagaaataa

SEQ ID NO: 1658 - DNA, 186 bp, B.fragilis
aatagaccagtttaccagtgtttttatgaaataacatacacttgtaaagtaatacttaatgatgttaaatattatggggtgcgtagggacaaatcgaagtttcatgttcttaattataatatatggttacttgtttatttattgtatgaaagtaaggaaatgcaatacatgattgattattcttaa

SEQ ID NO: 1659 - DNA, 363 bp, B.fragilis
aatttaaaagttttatatatgggtaaaaataggaatcattacagcttttttttgtattttgtctttatcatatttgtgcttttgggttgtcgacctgtccgggtacagatgccggacggaatgtatggaagatggaaatcttctgcaggccgtccggatattacattggggacagacagcatagggagcttcgctatagttcaccaccgtatttatgacggaaaaatttgtcctgtccgttatccgcttcatcttaattcacctactaaagggtatatccgtgcagaaggttgcatcctgttttattatgacagtttgaaatgtgttttatacttctctcccggaggtgattatacacaataa

SEQ ID NO: 1660 - DNA, 195 bp, B.fragilis
atcaatgaagtaacagattcattgaaaaaaccattaacaataattaccatggccgacttaaaaacaacttttgcgggattgactttgaaaaatcctgtaattatcagtagttcgggacttactaacagtgccgctaaaaaacgcaaagctggaagctgccggtgcaggagccattgtcctgaaatcactatttga

SEQ ID NO: 1661 - DNA, 1116 bp, B.fragilis
gcatcaatatttccaaaagacatttttttagtcatgaaagtttccattatagttccttgttactcagttgcatcaaaactaccccgatgtgtgcataatctattggctcaaactttcacagactgggaacttattttaatagatgatgggagtacagacaacacatgggatatttgcaatagctttacaaagaacaatgctcatattcatgccgtacacaaagaaaacggtggtgtcagttcagccagaaatacaggaattgagatagctaagggagagttcataacttttatcgattcagatgactatgtaaagccggactaccttcagaaattggtagaaggccaggaagcagacttagtattatgtggctttcgtagttccacgggaatagacttcacaccagaacctcaatacctcattggagatgaccttagtaaaaatatacaagccatcgtagagaatgactatttactttattccccttggtgcaaactctttcgtcgtgatattatccaaaaacaccaacaccgctttgatcccgaaattcgtttaggtgaggacactattttttgttataagtacctgctctattgctcttccataaaggtagtggcatcaaacagctacttttatgacggcgtgtggggtggctataaaaagtatgtactaacacgacaggaagtagaatatctagataaagcagaaattacgacgctgcatgatataaatcaacactttaactgtcggatagacctgacatatcgtggctatcatgtagccatgctaaaaggattatatgaaaaattcagagattacgacaccttcgagatgtatacccgcacacacgatgtattaccaccggagcatttttttgccaaccataaacttagttatattttttggggtatcgtggaactggaaacgctctatgttgacaaagaatattgtgcaggtaaactcttcatgcaacgtctacatcatttttttactataccaaccaatcagttactctcgtattcctacaagatgcgtttgatacattacttggtaaaaagcaaacattacacgatggcccatgtgctcttaatattcctttcaatcttaaagcattaa

SEQ ID NO: 1662 - DNA, 1398 bp, B.fragilis
ttgcaacaattcatcacagtggtggtcaattggctttttgattgcaaatatcaacatttaaatctaagaatcatgggaacaaagaaaaattttgtgctcgacacgaatgttattcttcacgactacaattgcctgaagaattttcaggagaatgatatttatcttccgattgttgttttggaagaattggataagttcaagaagggaaatgaacaaatcaattacaatgcacgtgagtttgtacgcgaactcgatttgataaccgacgacagtctgtttacccatggtgctcctttaggtgaggggttgggtaagttgtttattgtcactggcgattcggaggctcccaaggtacatgaatcgtttccggcccgtaaaccggatcatcagatattggcggtagccgaatatttggcccggaaatatccgaagatgaaaaatattctggtgaccaaggatgtcaaccttaggatgaaagcccgttccatcggtatactttgtgaggactacataaccgataaggtggtgaatgtcgatatttttgaaaagtcgaacgaggtgttcgaaaatatagaaccggatctgatcgaccgtatttattcgtccagagaggggttggatatcagtgaatttgactttaaagacatcatccgtcccaacgaatgttttattctgaagagcgatcgcagcagtgtgcttgcccgctacaatccttttacacatacggtctgccgggtgaataaaaccaagaattacggtatcgaacctcgcaatgcggaacagagttttgctttcgaaattctgaacgatccggatatcaagctggtggccttgacaggtaaagccggaacaggtaaaaccttgcttgcactggcggcagccttgggtaaactcacggaatacaagcagatcctgttggcccgtcctatcgtggctctttccaataaagatttaggattccttccgggagatgcaacagaaaaggtagctccttacatgcaacctctgttcgacaacctgaatgtgatcaaacgccaatttgcttctaactctaccgaagtgaagcggctggaagatatgcagaagagtgagcaactggttatcgaggcattggcattcattcgcggacgaagcctgagcgagacctattgtatcatcgatgaagcacaaaatttgactccacacgagattaaaaccattatcacccgtgccggagaaggtaccaagatggtatttaccggagatattcagcagatcgaccaaccttatctggatagtcagtccaatggcttggtgtatatgatcgatcgcatgaaagatcagaacctctttgcgcatgtcaacttggtgaaaggcgaacgtagtgaattgagcgaattggcaagtaacctgatgtga

SEQ ID NO: 1663 - DNA, 210 bp, B.fragilis
ccccaattttccgaccccgcaaagccacaattttataaacctcccttgattcatcaacctcgtgttaaaggacaaccttattttttgcgttcctctcggcaaaccctcactacttgttatctgggacccattaataacaacctctcttctgacaatcgctgttggcatttatcacacaattggaaaacaacctttcctaaacctttgggc

SEQ ID NO: 1664 - DNA, 507 bp, B.fragilis
tcgtggctatcctctccacaatcgccttattcggtttcatcctttggttattcaccctttaatcttaccgacagcgatatgaaaacgacagaccatttcaagagaacgatacagatgtatttggagcaacgtgcagcggaagatgcgctctttgccaaaaactaccgcaacccagccaagaacatagacgattgtgtgacctacattctgaactatgtgcagaaaagcggttgcaacggcttcacggacggagagatttacggacaagccgtacactactatgacgagaacgagatagaggtgggcaagcctatccagtgtcagatagccgtgaaccatgtggtggaactcaccgcagaggaaaaggcggaagcacgacagaacgctatccgacaataccaagacggattgatgcgcgaaatgcagaaccgcaacaagccgagaaccgccaccaaagcgaccgtccaagaagtacaacaaccctcattatttgatttaggcttatga

SEQ ID NO: 1665 - DNA, 645 bp, B.fragilis
gttgaaacatcaaatatgggcaaacaaaaattttacgttgtatgggatggagtcactcctggtatttatacctcctggaccgaatgtcagcttcaggtgaagggatatgacagtgccaaatataaatcttttgataaccgggaggaagcagaacgagctttcgctgcatcaccttatgcttatattggtaaaaatgcaaagaaaaaaataaccggaccttccactgagatgctaccggcagcagtcatagaaaacagcctcgctgtggacgctgcatgcagtggcaatccgggcccgatggagtatcgtggtgtccacgtggcaagccggcaagaaatttttcatttcggcccgatgaaaggtaccaacaatatcggcgagtttctggcactcgtacacggtcttgctttgctgaagcagaaagggttcgacatgccaatctatagcgacagtgcaaacgcaatcagttgggtgaaacaaaaaaaatgcaagacgaaactctcccgtacggcagaaactgaagccctgtttgtattgatagaacgcgcagaaaaatggcttaaagaaaataagtataccactcccatattgaaatgggaaaccagagaatggggagaaatcccggcagacttcggaagaaaatag

SEQ ID NO: 1666 - DNA, 636 bp, B.fragilis
aagaatcaatctaataaagaaaggagtatttttatgaaaaaatccttcgaagaggccctcaaacacagaaggacctattattcgataacaaaccagtctccggtttctgatgaggaaatagagcggattgtcaatttagctgtcactcatgtgccttctgctttcaactctcaatcgactcgtgtagtgctattgctgggtgagaatcataagaaattatggcatatcgtaaaagaaacattgcgaaagatcgttccaccggaagtttttaaaacgacggaagccaaaatcgacaactcttttgcaagcggatacggaactgttttattcttcgaagatcagtcggtcgttaagggattgcaggaagcattcagcagttataaggataacttccccgggtggtcgctgcagacttctgcgatgcatcagctggctgtatggacgatgttggaagatgtcggcttcggagcttctttgcaacattacaatccgctgatcgatgaagaagtacgccatacctggcatttgcctgaagagtggcatctgattgccgaaatgccgtttggacttccggtacagggacctggcgataaagattttaaagatttggatacccgggtcaaggtatttaaataa

SEQ ID NO: 1667 - DNA, 1221 bp, B.fragilis
gactgtgtgtccatgaatgtatcgggtgcaacggctctttggaccagactttctgtgaaaactgagtttggtacaaaagattatgttgtagatgtaaaaaaggatttgaaaaatatatcttctgattttaatgagcgttctttgcattctgttgtttgcatggagaagcagctttctgctgatactttgaatcggatttgggcagatagtttgagaatgcggcatattgtcgctaaaacctctgtacaggtagttagtgccgattcaagtaaatgtattcgttctgaagggagttgtgacaataattgttttgtatcgcccatttggattgcctatgtcgggaacgagtgtgaggtagaggttgccggttttttatcttctacttgttggtcggtgattcgatactcttcttcttcatttgtccttattgttggagtgacttttatactttttgcttttttctactatgtgtataaggtgaaaaaacatttgtctgattcggaggttgaagaagagcttctaaaggaaaggctggagaaggagagagagcggtatcaagatttagaagagaaacgcaggcaatatgaacaacaattgaatttgcttcaacaagaagaaaaaatgcggataagagaactgagtgatctacgggagaagcataaacaaaaagaagctcagattgaagtattgtcagtagagaagaaacgtagcaaagaacagcaaagtattcttgaaaaggaatgtcaagagggtatgctccaaataacgatgctttccgataaattggaaaaggaaaagatagaccggggagagcttcaacaaaagttggctgcatgcgaactgcaaatagcggaactgagaaaaataaaagaaatgttgggtgaagaattagtcatttataaactctgttcagggttgacttttgatcctcgaaatcatattttggattgtgccggaaaccggataaaactggatgctcagggtagccggcttttactcctttttttagaggcctctgaaaataaactatcatatgaagaactgcttgaaatgatgtgggctgatcgtcgaaaggataagaatcgtttatggacggctgtttctcgtttgcgtaaagctttagcgcctactcgtgttatcataaaggtgaaaaatgaaggcgggtatcagttagtgctgcctaaggagagtgatgacttctcgcagagagaactcttttga

SEQ ID NO: 1668 - DNA, 2145 bp, B.fragilis
catcccgtgtccaccactaaatccaaagtaacaattcataaaaaagtaatcagcatgaagacaatcattgcagaaaagccatccgtggcacgtgagatcgcccgcatcgtgggcgcgacaaagagagaggaaggatatttcgagggaggcgactgtgccgtgacatgggcattcggacaccttgtccagcttgctatgcccgacggctacggcatacgcggcttcgtccgtgacaacctgcccgtcatccccgaaaccttcacgctcattccccgtcaggaaaaaacggagaagggttacaaacccgacagcggcgtggtgtcgcagataaaaatcatcgcccgtcttttcaaggaaagcgagcagatcatcgtggcgaccgatgcaggacgcgaaggtgagcttatcttccgatacctctaccattatatcggatgtactacgcctttcgtacgcctgtggataagctcgctcaccgacaaggctatccgcgagggactgcgcaaccttgaagcgggaagcaagtatgacaacctctatcttactgccaaagcacggagcgaatccgactggcttgtgggcatcaacggcacgcaggcactctccatcgctgccggacacggcacatattccgtcggacgggtgcagacgcccacgttggcgatggtgtgcgtacgctattgggagaaccgccgcttcacggtggaaccgttctggcagctccatattgccactgacggtggcaacggcgaagtggtgaaattctcttcttctgagaaatggaaagagaaagagccggcgacggaactatacaataaggtaaaggaagcaggcacagccactgtcacgaaagcagaacgcaaggagaagacggaggacactccgcttctgtacgacctgaccacgctccaaaaggaagccaacgccaagcacggcttcacggcagaacagacgcttgaaatcgcacagaagctctacgagaagaaactcatcacctatccaagaacaggaagccgctacatcccagaagacgtgttcgtggaaatacccaagctgctcgccttcatcggcagcctgcccgaatggaaaggcaaagtcaatccgaaagccatgcctacacgccgcagcgtggacggtggcaaggtaacggaccaccacgccctgctcgtcacgggcgagaaaccgctgttcctctccaaagaagataataccgtctatcagatgattgccggacgcatgattgaggctttctctgaaaaatgcgtcaaagacaccgccactgttacggcggagtgtgccggagcggagttcgtggcaaaaggcagcatcatcaaacaagccgggtggcgtgccgtctatggcgaggaagagaaagaggaaaccatcatccccggctggcaggaaggcgacacgctgacactgaaagctgcctccatcacagagggcaagaccaagcctaaaccgctgcataccgaagccaccctgctgtccgctatggaaacggcaggcaaggagattgaggacgatgcgctgcgtcaggctttgaaggactgcggcattggcacgcctgctacccgtgcagcgattatcgaaacgcttttcaaacggggatacatggaacgctgcaagaagtcgcttgtacctaccgaaaaggggcttgccctctactcggtcgtgaagacgatgcgcatcgccgacgttgccatgacgggcgaatgggaaaaggagctggcacgcattgagcgcggggaactgcctgccgataccttccgcaaggagatagaggcgtacacgcaggaaattacctccgaactgctctcgtgcgacaagctgttcgcccgcagggattccggctgcaagtgtcccaagtgcggaacgggaagtatgcagttttacggcaaggtcgtccgctgcgacaacgcggagtgcgggctgcccgtgttccgcctgaaggcaaaccgtaccctcaccgatgacgagatcaaagacctgctcaccgacggacacacgaaactgctcaaaggcttcaagagcaagcagggcaagagcttcgatgccgtggttgcctttgacggggactacaacacgactttcgtgttccccgaaaggaaaacaaccaagaaattttcaggacggaagaaatag

SEQ ID NO: 1669 - DNA, 480 bp, B.fragilis
tttaccaatccactaaattccaaagtaatgaacaacaagaagaaaaacgaggggcaaaccgacttttcctactacggtctgtacctgctggactatctcagaacgaacaaatttgaacaagcgaccgacgaagccttcatccgtgaacgcgccgaccgtgccgccggaacgtatgaatgggcaatgctcgaaggctatcccgccgatggtgcgcaggaactggcgatgcgcacgctgctggaggggcttcactactccaagtacgccatcctccgcgaagtcgtagagaacgagttttccgatgacgtgccggaagcgaagcgtgaatcctttacccgaaaactgctgccacttgtcggaaacgtattctccatttatgacctctcggacgacaatttcgccctgtcgcccgattacgacctgctctacacggagctgacgggggctgtcgtcctttatatagaggaatatggcgtttaa

SEQ ID NO: 1670 - DNA, 333 bp, B.fragilis
tcgggtgatccgccgccggttgataaggtatcggggatggctccttgccgctcccaatttcatcagcccgtattcgccgtaccgggcgttcagcgcgaaggtctgccatacgaggacggaagacgatgccgcgccgaagccgatacatatccactggtcgatgccgaccatgtaaaggatgacgaacaggacgaagagagccagcagacctccgcagaagatgaagaggtactgagccttcagacccttgaactcgaccggacggccgatacccttgtttatcgggtattcagccatacgttatttattaaaggaagaatgagcgcaggatag

SEQ ID NO: 1671 - DNA, 903 bp, B.fragilis
aatatgatgttttttaaacgtacgtttaaaaaaacatatcaaaatcaaagaatgatgaaattagtacgaatgacaggcggattagggaatcaaatgttcatttacgccttctatatacaaatgaaaacaatatttccggagcttcggatagatatgtctgaaatgaagaaatataaattacataacggatatgaattggaagatgtattttcgatccgtccccaaacaatatctgcccataaatggcttaaaagagtaattgtgtatgcattcttttcgattatacgagaaaaatccgaagaagaattatccattcataaatacacacaacacaagagatggacattagtatattacaaaggattctttcaatctgaactcttcttcaaagaatcttcagataccataagagatattttttctttcaacacagaaaatgccaatttcagaacaaaagaatgggcaaagataattaaagaacaacgttcgagcgtatcaattcatatccgaagaggagattatacatcagctaaaaacaaaataaaatatggaaatatatgcacaaaagaatactatcaaaaggcaatctcaatcatactaaaaaaagaaccgaaagcattcttccatatcttttctgatgatgtggaatggacgaaagcacatttgaagatacatcatttaccccatcaatatatatcttggaataggggccctgacagttggcaggacatgatgttgatgagcctgtgtcgtcataatataatagccaacagcagtttcagttggtggggagcatggctaaatgcctataaggataaaactgttatcgcaccttcacgctggtcaaacgtcaagaagacacctcacatacttccggaaagctggatttcgatagatatataa

SEQ ID NO: 1672 - DNA, 903 bp, B.fragilis
ttaaataacccccataccactatgaaagtatcaattatcatcctgaattataatacctcccgattaaccctaaactgcattaacagtatacacaaatacctgcctaatggcacttacgaaataatagttgtcgacaatgccagccaggaaacagactatcaacaccttactgaaaatctttccggtcaggaaattactattatacgcaacaaaataaacagtggtttcggggcagggaatatggttggcgcaaacatagcccaagggaaatacctctgttttctaaacaatgacactgagctattagaggactgcattagcccattatgtagttacctgaaagaaaatcctcaaacaggatgcattacaccacagcaatacaacaaacacctgaaggcagtaccctcattcaatcatccaatcggtattctatatgagattttaggaaacgacatcccggaaagattatgtcccgcccgctaccccaaaagaaaaaagaaagtataccagtttcctatacatgcttcatggatcaacggagcatttatgatgtttccttcagaagtcttcttcaaaatcaaaggctttgatactaatatattcctctattatgaagagtatgatatctgtacaagattatcttatcacaactatcagtcaacggttctgccaacctatagatttttacacctccaaggtgaatctacaaaagtttatgcgttggcttacaaagaaaggtttatttcaaaattatatgtatataaaaagcattccaattttttattctatatcatatataaatggatcattataatcaaattatgtttccacttcagacgttggtatatattgcccaccataatcttaggcaaagggttgtctcaatcaatgcgtcataaatga

SEQ ID NO: 1673 - DNA, 507 bp, B.fragilis
aaggctttaccagagccgtcgcttgaaagtagtgtggattgcacgctacttttttgcaccttgcccaacgaaaggaaaaagactatgggtaaagttcagattcttgccgtcctcacgatggacgggtgtcattcttcagaattatatggcaaagcgtatgaggatttacgccttgaccgctgcgatattgacaaaataagggaaaacgcgctttaccatgtcacgccggactactccatctccatgttggacgaatggcggaaagacaatacaaacatctgctatctcgcagaagccactcccgataattcggactatatcaacgggctgttgcgtatgcgggtggtggatgagattatcctatataccgtgcctttcatatcgggaacgggacggcattttttcaagtcggcactgcccgaagcacgctggacactctcctcacaaaagagttattccaacggtgtgtaccggagcatctacacacgcatggaaaccatgaaatag

SEQ ID NO: 1674 - DNA, 3069 bp, B.fragilis
tcctccaaacccgatagaatgaaagaagcacttaccacgaaccaagttgtcattgtactcgtagagcaccctgttttgggactattactcgtaccgtacaccgtcggccgggccttggacaatacgttggaagtgatcgaacaggcttttcatgcttctcccgatgccctgaaaaaaatgaatgaagcggaacaaaaagctatcgacatagcttcacactatactgagaaatatttgatgggagtctattcacgtgagaagacagttcccaaattcctccgtaaactaaccgaggacagcaataaactaaagcagcaaatccgccctttcatcgagaaaaagctcttggaaatgctagaactgatatgtaacggacagcttccgttctatcaaaagccaagtggcagcaaacaactttatgaacaccacgcgtaccgcgtccatcctcacaacctaaaaactcatttttcattcaaagtaaccgaagaacacttcagttatcagttgcagtgctacgatgatgatactccggtttcattaatggagcagaaacctgtcgtcgtccttacctcaaatcctgccactctgctgctgggtatggatttatatacttttagccacatcgaagcctcacgtttgttacccttcactaaaaaagaacgtatcagcgcagatgcttcactaaccgaaaaatatatagataatatcataattcctctcgcacgttatcacgacatcagtatacaaggattaaaagtcgtcagagagaaacgtccgtgtaatgcttatctctatcttgaagatacgatttataacgatacattgttacggcttgattttcgttacggcgaacagtccttttcaccgcagccctccgatgaaaccaggaaatttgtctttcgtgagcaagaagaggaggaaatcgtcatacactatttccagcgtaattcaaccgctgaaagaaaagctgtacatctgcttcagaaagccggcttgcaatgcatcagtgactcccatttcaagctatcatccgcggctcccgaaaagaacattaccgaatggatcagccaccatcgccaaatgttgctcgaagagtttgtcttgtccagtgatacacaaaacaaaccgtactatcttcccgaaatccggatagaacagagttgtgaagacggtcccgattggtttgacctacacatcactgttgtcatcggcaatcagagaattcctttcagccgcttccgaaaaaacatactggaaggcaatagagaatatatcctccccgacggacgcattgtccttctacccgaagaatggttcagcaagtataccaaccttcttgaagcaggcaaagaatcagacaaaacgatccgtctaaaacgcccctttatcggtgtaatagaatctattttagaaaaagaccgacaaagcacaagcatcaaaacgctgctgagcaaagaaattcccgtacccatcgggcttaaggctaatcttcgctcttatcaacagaaaggcttttcatggttggcaaacctctatcttgaaggatttggcggatgcctggccgacgatatgggattgggcaagactttacagacactcgctctcctgcaatatgtctacaaaccgggaaatacaaccgaagcaattcgggaaacaatcgatttggaaaaagcggaaagcacttcggattgcctccctcaaaaacaagtattcttcgatgaaaagggacaattttcactctttcccatgcaaagcaaagaggaagaaaactcccggatcgccccccaagttccacaaattccggaaccggttcaaaagcaaaaccggatatcccccttacacggtaccctgatagtcgtacctacctcccttttacataattggaaacgtgaggcatctcgtttcaccaatctgtcaatgatggaatacaatggaagttcacccaacgaaattacccgattgaaaaaatatttcgaccgttatcatttgattttcactacttatggtacgatgcgcaacaacatagcaaccttaagccaatatacattcgaatgcattgtccttgacgagagtcaaaacattaaaaacagcgaatccctcacgtttcgttcggccatacagctacgcagcaaacacaggctgatcctgacaggaactcccatcgaaaattcactgaaagacctttgggcacaatttcattttcttcaacccgaacttttaggaaatgaaaccactttcagcaagcattttatcaatgccatccggcaaggagacgaacgaatgaaggatcgcttacgtcagctcatcacaccattcatcctacgcagaagtaagcaggaggtaaccccggaactgccatcattaaccgaagaagtagtttattgcgatatgacagaaagacaaaacgaactctatcaacatgaaaagaacagccttcggaacatcttactggaacagactgcagagaagggacaacaatctttcacggtactcaatggaatcctccgtctaagacaactctcctgtcatccgcaattggttttacccgatttcatcggtgattcgggtaaattatatcagattatagaaaccttcgaaacgctccgcagcgaaggacataaagttctgatcttctcttctttcgttaaacacctggaattagttgccggtgaatttcgtaaacgcaaatgggattacgccttcctgacaggctcttcaaccaatcgtccggaagaaatagcacgctttaaccgtgaccccaagatacaggcttttcttatctcactcaaagccggaggtgtaggcctcaacctgacacaggcagactatgtattcattatcgatccttggtggaacccggcagccgaatcacaggccatcgcccgcgcccaccgtatcggacaaaacaatcaggtgattgcttaccgttttatcactcaaggcagcatagaggagaaaattatacaactgcaagaagaaaagcgcaaactggccgaaacctttattacagataccgagcagcttccggcactaaccaaccgagagtgggcccgacttttaggatcatag

SEQ ID NO: 1675 - DNA, 1167 bp, B.fragilis
aagccggatacaaggtcatgctttatcaggacagagattgaaaacaataacaatcaacgactaacaaaaacaacaaccaaattttatttaccactaaaatccaaagtaatgagaaaagtaatcatcatgtttgccctcgctatggacatcgtaactgctaacgcgcaggagaacgtaaccgttggaacggacaacggaagtgaaccgacgaacgaagcgagagcagaggcaagctcgcttgactatgcctcgcaaggaggaggaaggcaaagccaacaaccgaccttgacaaaggaggtctatccgcagaagaaggcggacggcgacctgtatcacgggctgacgaagaagctgaccttcgaccgcatggtccctccgcacggcttggaagtgacctacgacaagaccgtccacgtcattttcccctcggaggtgcgctacgtcgatttaggctcgcccgacctgattgcgggcaaagccgacggagcggagaatgtcatccgcgtgaaggcaaccgtgaggaacttcccgaacgaaaccaatatgtccgtgataacggaggacgggagtttctataccttcaacgtgaaatatgcagccgaaccgctgctgctcaacgtggagatgtgcgacttcatccatgacggcgagaaggtgaactgtccgaacaacgcgcaggaaatctatctgaaggaactgggcagcgaaagcccgatgctggtgcgccttatcatgaagtccatccacaagcagaacaagcgcgaggtgaagcacatcggctgcaagcgattcggcatccagtacctgctgaaaggcatctacacgcataatgggttgctctatttccacacggagataaagaaccaaagcaacgtgcctttcgatgtggactacatcacatggaaaatcgtggacaagaaggtggcgaagcgtaccgccgtacaggagcagattatcctgccgctccgtgcgcagaattacgctacgctcgtgcctggcaagaagagcgaacgcacggtattcacgatggcgaaattcaccatccccgatgacaagtgtctcgtggtggaactcaacgagaagaacggaggtcgccaccaatctttcgtgattgagaacgaggacttggtgcgtgccaataccattaacgaacttcaagtgcgctga

SEQ ID NO: 1676 - DNA, 1251 bp, B.fragilis
tatgcagtcactatagacatgacaaaaaaatggcaatatttatgtagatgccttttagtattagtttttataggaggagttatccccgcaaaggcgcaactggtagagcgagtttgccgtaccgattataaaataagccccgaacgaaaaggagaacttcttctggagttggacaatatcagctttttcaaagacaatgaatttgccggtacagtgataaaaggctattcattgccgggactctggatacaacccaaatttgtatattatcctttgaagaatatcaaattggaaggaggagtccatatgttgtggtttagtggggcttatcgatatccgagtgtttcttatcaagacatagcactgtggaaaggtgaacaatatcagaaaggtgctcatcttttgccttttttccgggcacaaatatcgatgaaatcagtagacttgattttagggaatatatatggaggctccaatcatggactgattgcacctttgtataatccggagttgaatttgactgccgatccggagacgggttttcaggtattggcaggtgctccttggatcgatctggatgcttggattgattggcagagttttatctttcgggatgatactcatcaggaagcttttactgtcggattatctacacggttcaagttgaatgccccttcttcgactttccattgctatattcctttgcaaatattggcgcaacatcgcggaggcgagatcgacacgattcgtgagagttcagtacaaacgttgatgaacggtgccgtaggggcaggagtgacgtggaacatcgatcgccggattttgaagcgtgttaatgtagaacttgatgctgccggttattatcaacagaaaggtgagttatggccttatcataagggcattggagtctatagtagtgcttttgttgatttgggcaacttccgcgtaaagatggggcattggatctgcaacgatttcattacgatgtttggaattccctatttcggaacagtatctaccaagaaagagggtataacttatgataaaccgcaaactctgctctgttcgatagagtattcccgcatgttcgggaagcattatgcactgggattgaaggccgatgcatatcagtttttcccggggacaatgcggagtgccaatggagaattaacttctcccggtagcactaccagtttttctgtcggagtctatttccggattaatccatcatttttattgaagaatttttag

SEQ ID NO: 1677 - DNA, 1284 bp, B.fragilis
aattgtggaactttcaagagaaatgcaggaaaaatggtcgcaaaaatcagtgtaggaaactcgttgtatggcgcacttgcctacaacggggagaaaatcaacgaggcgaaagggcggcttctgacaaccaaccgcatctacaatgacggcacgggaacgatggaaatccatagggcgatggaggactttctcgctctgatgcccgttcggtcgaaggtggagaaaccggtggtgcatatctcactcaatccgcatcccgacgatattttgacggacacggagcttcagaatatcgcacgggagtatctggagaagatgggcttcggcaaccagccgtatctcgttttcaagcacgaggacatcgaccgccaccatctgcatattgtgacggtcagggtggacgagaatggcaggagcatagacacccggaacaatttttaccggagcaagcagataacacgcgaactggaacgaaagtacgggctacacgacgcggaacgcaagaaccgccgtcttgacacgccgctacacaaggtggacgcctctgcgggcgacgtaaagaagcaggcgggaaatatcgtcaaggctatcagcgggcagtaccgcttccagacgatgggcgaataccgcgcactcctttccttatataatatgacggtggaggaagcgcatggcaatgtgcgcggacgtgagtatcacgggctggtctattccgtcacggacgacaagggcaacaaggtcggcaatccgttcaagtcctcgctgttcgggaagtctgtgggctacgaagccgtgcagaagaagtttgcccgttccaagcaggagattaaggacaggaaacttgccgacatgacgaaacgcaccgtcctttccgtactggaaggcacgtatgacaaggagaagtttgtagccaccctcaaaggaaagggcatcgacaccgtactgcgctacacggaggaagggcgcatctatggagccacattcatcgaccaccgcacgggctgcgtgttgaacggctcacgcatgggcaaggaactttccgccaacgccttgcaggaacacttcacgctgccttatgccggacagccgccgattccgatctccgttccggtggaggaaccggagaacaggcaaggatattccggaggggaatacgaaagccattccagtggcatgaacctgtttgcccccgaaggttcggcagtggacgctgaagaggaagccttcatccgggcgatgcagcgcaagaagaaaaagaagaagcgcaagggcttggggacgtaa

SEQ ID NO: 1678 - DNA, 2514 bp, B.fragilis
aacgatcagacaattatggaaactttaaaagagaaattcgaagccctggcccatcgtatccaatcatccggaaaaccggctgccgcatggttccctcaatttacacctgtcactttgttgaacgccgaaaattggtgggaagcacttgctgtgtgcgaatatgccttggacacccatgaggacgaagcactgacagccggattttttgaattaatattcagtgcatacgattgtaacgtagaagtggatcttaatgaggaagagtatgcctactggtgggagaaagtgatcagtgtatgcgatcgtgtggctgtattcaacggtgccgggtggtcacagaaaggtgcacaatattcggaagcccgttatgggaaacgtgatctcagcctgttattcccttgctatgaaaaagcggcggaaatgggaagcccggaagcagaggcaaccgttgcttattggcgttatatgggtttctactgcgaacaggatagggcagaaggagagcgtcgatttgcagctttatcctcacccgaagctttgctatggggaaaatattaccgggcttatgccgagcagcacaccggcagtaaagagaaagccctgcttatgcgaaaagagttgcttgacgaacttcccgaaagccatcgcctgcgtgcccatgtatatgccgcgatgggcgacgcacttgatatagaagaaggaagtgtggctgaagaagcggcatgctatgagaagtcgctggaacttgttcctaatctatattctttaaaaaatctggcaactctctatttccgctatccggaactagggaagcaaaaagagctggcgtttgagttgtgggagaaagcctggcatgcaggtgtatggtctgcagctaatttccttggatataactatcaggaagaagagtggctcgatatgcctaaagccattgaatggctggagaaagggatgctttattgtgaatcatattgtgcctatgaattagcattgatctatctttataatgatgagtataagaatgtggaacgtgggttgatgtgcctgcagcgctgtgtcgacgacaattatgtagaagctatcgagacgcttgccaatgtttatttcaacggtgaattggtggaagagaatatctcgtatgcctgtcagttgttggagagagctatcgagctggggtccggtagtgcagcctatcgtatcggctggatgtatgagcgtggattgctttctgaagaaccggattatcagaaggctatggagtattatgaaaaagctgtgtctatggacaatgctgacgggtatgcacgggcggctctttatttggctaatggttattccggagttacggatgccgggaagtcaaaggcctattatgaaaaagcggcagagctgggttcatgttttgcaatggtagaattggcattcttatacgaaaatggtgaggtggtggaacaaagttatgagaaagctttcgacttgctccaaaaagctgccggacaggagtatccttatgcgatgtatcgtgtaggactttatttggataggggagtcatcggtgagccacggcccgaagaagcgtttgcatggtatgcaaaggcagccgaacggggagacggagatgcgatcttcgctcttgggcgttgctataagaatggaattggtacggaagagaatccggataaggctcttgaatggtttactaagggtgcagagaataacgaaccccgttgtcttacagaaatggggttggcttatgaatacggtagtgggatagaagagaatcctcatcaagctgttgaatatatgacaaaggctgccgaacaaaattatggttatgcccaatttaaaatgggagactactttttctttggttacggtgcctgtcccgaagataacaaacaagctgtggaatggtacgagaaggctgttgcaaatgatatacctttggctatgttgcgtatgggtgaatattacctttacgattatgacaaactgaacgagtcggagaaagctttcagctacttcaagaaagcggctgaagcagaatgttataatgaaggactgggaatctgctacgagatgggtatcggtgtggaagacaatgaaacagaggcattcaaatattatactttggctgcgggcagtggcaatgttatgagtatgtatcgcaccggattgtgttattacaacggagtaggtgtaaaacagaattatacagaagcttaccgatggtttaatgatgccgccggaaatgacaatgtggcttcgtattattatttaggtaagatgctgatgtatggcgaaggctgtgtgcccgatgcggaagcagggcttcaatggttgatgaaagctgctgagcataatagtgacaaggcgcagttcgaattgggcaatgcctatttgatgggcaatggagtagaggagaatgatgagatcgctatggagtggtttgagaaagcagccgaaaacggaaacgcgaaagccttgaaaattactggaagaagacaacgataa

SEQ ID NO: 1679 - DNA, 312 bp, B.fragilis
cataagaccgcaaggcgtttcgagcgaaaatctggtaaattgacactacggagacgattgcgtgatgcttatgctatgcctacgcatagcgtgcattcacgtactctccgtaaaaggctttaccagagccgtcgcttgaaagtagtgtggattgcacgctacttttttgcaccttgcccaacgaaaggaaaaagactatgggtaaagttcagattcttgccgtcctcacgatggacgggtgtcattcttcagaattatatggcaaagcgtatgaggatttacgccttgaccgctgcgatattgacaaaataa

SEQ ID NO: 1680 - DNA, 843 bp, B.fragilis
ttcacggacgcggatatgtatgtcaccgcttccgtacaggaacaggaaaacaattcatcaaccattaaaagcaatagaaccatgagtaatgaaatcttcgttgcattcgcaacacaaaagggaggtatcggaaaatcgaccgtcacggctcttgccgccagctacctccacaacgtgcaaggtcacaatgtcgccgtcatagattgcgacgccccgcaacacagcatccacgggctgcgcgaacgcgaaacgaaacttatcgacgagagcctctatttcaaggcactcgcgtgtgaccatttccgcaaaataaaaaagaacgcctatccggtcattgcaagcgacgccctcaacgcccttgacgatgccgaaaggatgcttgccgaagaagatgcgaaaccggacatcgtgttcttcgatatgccgggaacgctgaaaagcaacggtgtggtaaagaccctctcacagatggattacatcttcgcgcccatgagtgccgaccgctttgtcgtggaaagcaccctgcaattcgccgtgatgttccgtgacaacctcatgacgacggggcaggcgaaaacaaaagggctgtacctgttctggacgatggtggacggcagggagaagaacgggctgtacgacctgtatgaagatgtgattgccgaaatggggttgtcggtgttgtccacccgcctgcccgacagcaagaagttccggcgtgacctctcggaagagcgcaagagcgtattccgctctaccatcttcccgatggatgtgtcccttctgaaagggagcggtatccgtgagttctcggaagaaatcagccgtatcatcaaacctcaatga

SEQ ID NO: 1681 - DNA, 5856 bp, B.fragilis
aggaatatggcgtttaaccgtaaacaaaggctgcgggacaatatcgaggcgatacggacggcattcgtccttgacagggaacaacgcacccccaccgcacgcgaaaggctcctgttggagcgttattgcggtttcggtggactgaagtgcatactgaacccagcaaaggaactgacggatgccgtccattgggcgaaatctgacctcgaactgtttgccccgaccgtggaactgcacaagttactacgggagaatacaaaagatgatacggagtataagcagtgcatggatgccatgaagcaatccgttctgaccgctttctatactccgccggagataacaggcactattgcggacgtgctgcatgaacacggcatacgccccgaccgggtattggaaccgtcggcaggcgttggcgcatttgtggatgccgtattagagaacaagccggacgcggacatcatggcttttgagaaagacctgatgacgggcaagatattgagacacctgcatcccgaccagaaagtaaggatacagggatacgagaaaattgaaaagccgttcatgaaccattttgatctggctatctccaatatcccgtttggtgatgtggcggtgttcgacccggaatttaccaacagccatgatccagcaaggcactcggcggcgcggacgatacataactatttctttctgaaaagccttgatgcggtgcgtgaaggcggaatcgtggcgttcattacctcacaaggggtgttagatgccccgaccaatgagcctatacgcgagtatatgatgaaccacgccaatctggtgggtgttgcccgtctgccgaataacctctttacggaaaatgcgggtacggaggtaggcagtgatttgattatcctgcaaaagaacagcggaaagaacggggaactgtattataacgagaaactttttgtgcaaaccgaacagacccctatcggcacttccgtaaacggctatgtatggagcatcggttcgctttcccacacggatttgaccaaaagtaccgacccttacggaaagcctgcctataagctcatgcacagaggcgacaccgtacaactggcggaagacttacgggaacatctgaaaatagaactgcaccaactcgacagggaactctacgaaaaacacagcctgcattcggcgcaagtggaaagtacggataaaagtacgcctgaggaagtacagccgtctcctaaagtagaagcggtgacttctaccgctaatgtttttatcacagaagcggagaaaccgaaagttcaacccatagacgagaagccggagattgagccacgtcagacgaatcattcaaatgccgttcagctcactctgcttgacctttggggtatgcccatagaagaacctgccaaaaagaaaaaggcaactaaaaaggaaaacaaggcaaagagtgtaccatccaaaccgaagccgcaggttacggctgcacctcctattgaatccgtcaagcctgcaaccgaaagcaaggaggcaaagccggaaaatgccgggagacaaagcgacccagaagatatttatgccactttggactgggaaaccaatccgcccattaacggcttctatgaaacaatgatgagcctgacaccggaacggcgcaaggctctacggcttgaagcggaacggcacagacaggaacaactgaaaaagtcgggtgtcaaggacacgctgaatccagcctttgtgccttcgtcgggtaaccaggcggagcaaaaggaagcagcaaaacaacccaaagcacagccggaagcaactcccgttcctgttacggacaatagccaaagtgagaaagcaaccacttcactattccctgaatttgaaacgggaaagccgaaggaggaagtacccgaccttacgtcgcgtccctatcaccgcacgccggaaatgcacctgcgtgaaggttcgctggtggcaaacagggcacgcgacatcggttatctgaaggacattactccctacggtgcaactttccaaccgcttggactgacaggctaccaaaaagaaaaagcgttgctgtatgtatcgctccgtgacgcatacgagcggttgtaccgctatgaatcgaacagacacgaggcaaatgtcccgtggcgagagcatctaaacacctgttacgatgagtttgtcatgcgctacggcaacctcaacgccaagcagaacgtgaagttagtgatgatggacgcgggcgggcgtgacatcctttcgctggaacgggcggagaacgggaagtttgtcaaggcggacatcttcgagcgtcccgtttccttctccgtggagagccatgccaacgtcggctcacccgaagaagcactgtccgcgtcgctcaacaagttcggcactgtcgatctcgactatatgcgggagataaccgacagtacggcggaggatttgctcacagccctgcaagggcgcatctattacaatccgctcgtaaccggttacgagattaaggaccgctttattgccggaaacgtgatagagaaagcggaacgcatagaggcttggatgggcgaaaaccccgaaagtgaacgtatgccggaggtgaagcaggcgttggaggctctgaaagatgccgaaccgccgcgcatcgcttttgaagaccttgatttcaatttcggggaacgctggattccgacgggtgtctatgccgcctacatgagccggctgttcgacacggaggtgaaaatcgcctactctgcaagcatggacgagttttcggtggcgtgcggctaccgcaccatgaaaatcacggacgagtttctggtgaaggggtattaccgtaactatgacggcatgcaccttctgaaacacgccctgcacaacacctgtcccgacatgatgaagtccatcggcagggacgagcatggcaacgacatcaaggtgcgcgacagcgagggaatacagctcgccaacgccaagattgacgagatacgaaacggcttctccgaatggctcgaagagcagtcgccacagttcaaggagcggctgacgacgatgtataaccgcaagttcaactgtttcgtgcgcccgaagtatgacggctcgcatcagacttttcccgacctcaatctgaaagggctggcaagccggggcatcaggagcgtctatccctcgcagatggattgcgtctggatgctgaaacagaacggcggcggaatttgtgaccacgaggttggaaccggcaagacgctgataatgtgcatcgccgcgcatgaaatgaagcgtctgaacttggcgcacaagccgatgattatcgggctgaaagccaatgttgcggagattgccgccacctatcaagcggcatatcccaacgcgaggattctgtacgcttcggagaaagacttttcgaccgccaaccgcgtgcgtttcttcaacaacatcaagaacaacgactacgattgtgtcattatgtcgcacgaccagttcggcaagataccgcagtcgccggagttgcagcagcgcatcctgcaagcggagcttgacacggtggaggaaaacctcgaagtgctgcgccagcagggaaagaacgtatcgcgggcgatgctgaaaggtctggagaagcgcaagcataaccttgaagcgaaattggagaaggtggaacacgccataaagtcacgcacggacgacgtggtggacttcaagcagatgggcatcgaccacattttcattgatgaatcgcaccagttcaagaatctgactttcaacacgcgccacgaccgtgtggcgggattggggaacagcgagggaagccagaaggcactgaacatgctctttgctatccgcaccatacaggagcgcacgggcaaggacttgggggcgaccttcctctccggcacgactatcagcaactcgctgactgagctgtacctgctgttcaagtacctgcgcccgaaggagctggaacggcaggacattcgatgttttgatgcgtggtcggcgatatttgccaagaagacaacggattttgagttcaacgtgacgaacaacgtggtgcagaaggagcgtttccgctacttcatcaaagtgccggagcttgccgccttctataatgaaatcacggactaccgcacggcggaggatgtgggcgtggaccgtcccaacaaaaacgagatactgcaccacataccgcccacgccggagcaggaggacttcatacagaagctgatgcaattcgccaagacgggcgacgccaccctgttgggcagactgccgctttcggaaacggaggaaaaggcgaagatgcttatcgccacggactatgcccggaagatggcactcgacatgcgcatgatagacccgcattacgaagaccaccccgacaacaaggcgagccactgtgccaaaataatcgcggagtattatcaaaaatacgacgcgcagaaaggcacgcagttcgttttctctgacttggggacttaccagccgggcgatgggtggaacgtctattcggaaatcaagcgcaaactgacggaggactacggcataccgccaagcgaggtgcgcttcattcaggagtgcaagaccgacaaggctcggaaggcggtgatagatgccatgaacgccgggacggtgcgtgtgctgttcggctccacctccatgctcggaacgggtgtgaacgcacagaaacggtgtgtggcaattcatcatcttgatacgccgtggcgaccgtccgacctgcaacagcgtgacggacggggagttagagcaggcaacgagatagccaagcatttcgccgggaacaacgtggacgtaataatctacgcggtggaaaaatcactggacagttacaagttcaacctcctgcactgcaagcagactttcatcagccagcttaaaagcggtgctatggaagcgcgtaccatcgacgagggggcaatggacgagaaatcgggcatgaacttctcggaatatatggcgttgctatccggcaacaccgacctgctggacaaggcgaaactggaaaaacgtatcgcctcgctcgaaggggaacgcaagtcgttcaacaagggcaagcgtgattcggagttcaagctggaatcgaagacccgcgagctgggcaacaacacagctttcatagatgccatgacggaggactggaaccgcttcctctctgtggtgcagaccgacaaggagggcaatcaccttaatataataaaggtggacggagtggattccgccgatgagaaagtcatcggaaagcgtttgcaggagatagccaagaatgccacgaccggagggttgtacacgcaggttggagagttttacggtttcccgataaaggtggtcagcgaaaggatactcaaagagggattggagtttaccgacaaccgcttcgtggtcgaggggaactacaagtacacctacaacaacgggcatctggcgctggctgacccgttggccgccgcccgcaacttcctcaacgcgattgagagaatcccctccatcatcgaccagtataaagcgaagaatgaggtcttggaacgtgagataccgcagttgcaggagatagcaggcaaggtgtggaagaaggaggaagaactgaaacagttgaagtccgaacttgccgcccttgaccgcaagatacagctggaacttgcgccgcctacacccgaaatcaccgaaaaggagcatgaagggcaacaggtcaaaccggaagcgaaaggtgtgcgaaacggtatcaggcaatatcccgaagatacatcaccgcaaatacgcaatccatcggaaagtattatcgccaatcacaccataactgggcatccggggctgtatgccaaggaggaaacccggtccaaaggattgaaaatataa

SEQ ID NO: 1682 - DNA, 1353 bp, B.fragilis
  unsure (1196),(1224): Identity of nucleotide sequences at the above locations are unknown.
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctncgtacctgccaagtggatcatgactgcnaggcaatacgtgctgaatatctacacagagaaccgagcttatgcaaaacccttcaaaacagaatttcgattagaatcctttcttttccggttgaatctgcgtattacctcaagtcgcatcgtggggtaa

SEQ ID NO: 1683 - DNA, 1437 bp, B.fragilis
taccttatttatatggaacagacgaagaatgaacccaaaaatgagaacaaggcggctcccgacaacgggaaacccaagaaccgacgccaagctgagagccatcaagcctgcttgaatggccaaggcgcgaaggaggaaggcaaagccaaagagcgcaagccgctgaccgaagcccaaaggttgaaacgtcagaaaatgatagtgctgcccgctatggtactggtatttatcggggcgatgtggctgatattcgccccatcttccgacaaggagcagcaaccggggacgggtggttacaatatcgaaatgcccgatgctgacaaggcgaaccgccagatcatcggcgacaaggcgaaagcctatgagcagggagcgatggaggaacggcaagagaaccgcagccgcgccatgcaagaactgggagatatgttcgaccgcgaggtggcggaaacggacggtggcagggacttcgaccttgccaatcccggaaatgcggaagaagcaacatcaacatcatccgctccgaaaaccatccaatcctccgcagccgcctaccgtgacctcaatgccacgctcggcaacttctatgagcagccgaagaacgacaacacggaaatggacgaattgttggagcgtatcgcctcgctggaatcggaactggagagcgagaaaggcaaggcgtccgctatggatgaccaagtggcactcatggagaagtcctacgagctggcggcgaagtacatgggcggtcagaacaatggcaagccggaaccggtgcaggcggcagagccttatctcgtacagaaaaccggaaagaacacggctgcacctgtcaggcaggtgacgcatcaggtggtatcctcgctctcacagccgatgagcaacgccgagtttgtcgcctccttctcgcaggagcgcaaccgcagtttcaatacggcggtggggggcacgaccgtatcggacaaaaacaccatatcggcgtgtatctatggggcgcagagcgtaaccgacgggcaagctgtcaaactccgcttattggagccaatggcggtggtagacagaatcataccacgcaacgcagtggtggtaggcacggcaaagatacagggcgaacggctcgacatcggaatcacgtcgttggaatatgacggcactatcattccggtggaactctcggtgtatgacacggacgggcagcccggtatcttcattccgaactctatggaaatgaatgccgtcagggaggttgccgccaacatgggcggctcgctgggcagcagcatcaatatatccaccaacgcaggggcgcagctcgcctccgacttgggcaaggggctgatacaaggcacgagccagtatatcaccaagaagatgcgtaccgtcaaggtgcatctgaaagccggatacaaggtcatgctttatcaggacagagattga

SEQ ID NO: 1684 - DNA, 1008 bp, B.fragilis
cctatgaatttcgacaaccttcaccagattctgcgctcgctctacgagcagatgatgccgctgtgcggggacatggcgggtgtggcgaaaggcatcgccgggttgggcgcattgttctacgtcgcctaccgggtgtggcagtcgctggcgagagccgaaccgatagacgtgttccccatgctccgcccgttcgccatcggtctgtgcatcatgttcttcccgactgtggtgttgggcacgataaacagcatcatgtcgcccgtcgtgcagggtacggcaaagatgctggagacggaaacgctggacatgaaccgataccgtgagcagaaggacaaactggaatacgaggcgatgatgcgcaaccccgaaaccgcctaccttgtgtcaaacgaggagtttgacaaacagctggaggaactgggctggtcgcccggcgacatggtaacaatggcgggaatgtatatcgaacgtgggatgtacaacatgaagaaaggcatccgcgacttcttccgcgagatactggaactgatgttccaagccgccgcactcgtgatagataccatccgcacgttcttcctcgtggtgctggcgatactcggtccgatagccttcgccatatcggtgtgggacggcttccaaagcacgctcacacagtggatatgccgctacatacaggtctatctgtggctgcccgtatcggatatgttcagcaccatactggcgaagatccaagtgctgatgctgcaaagcgacatcgaacggatgcaggctgacccgaacttctcgctggattcgagcgacggggtgtacatcgtcttcatgataatcggcatcatcggctatttcaccatccccacggtagcaggctggattatccaagccggaggcatgggaagctacggtcgcaacgtgaaccagacggcaggacgagccggaagcatggcgggcagcgtggcgggtgcaaccgcaggaaacgtggtcggacgtgccgggaaactgctgaaataa

SEQ ID NO: 1685 - DNA, 1128 bp, B.fragilis
atcgaactctatttactgactgaattacaagaatgggaaattatgaactatattgcaatagtctgttggatgcttttcgggagcgtcctccgcctttgcgcccagacgtgtggcgccacctatattaccgagttccaatatgatctgaagaagaggacgaactggtgcaacctgttaagattggacgcatacgtgcccatcggtacgaagggaatcttggagtttgcttcgatacacgtatataagacgcgtccggaacggatcattaatgacctgcaaaccttctcgaatattgaagaggataatttaccttgtgccattgctgtgctgggatatacccggcttatcggaaatatcactttgtttgccgggattcgcaatctgaatgaagattatttcacaactccttgtatgtcactgtttacaaacagttcgtgcgggatattccctactttgtccgctaactatccgatagccaattatcctctggctgcattatgtctcgattataagatgacgctgggccggttcggtattgaaagcagtctgtacaacggtaaagggtacaacggatggagtaaaggtaaacatccgttcacattcaatccccgcaaggacggagtattcagtataacggaaattaattatcaaacagaatatggaaagtgttttggcggtttctctctacatactaacggtgatatgcctgatgtggctggagagtggaagacccgggaaagggaaaagaaagtctccccgaagatgatgtttgcctggtgggggtatgcagaacgaaagttatggagtagagttcgtcaggaggtaaacctgttagtacaatacacccgtacttcttctgtgttcagtgaatgcagaaattatatgggagcaggtgtgacgtggatttatgttccgggtggtcagaagcggcatgaggcgggcttgttcctgtctgccgctcagttcaaatcgtgtaatgaagttgccggagaagtgacatatcgttattcgtttaatcgggatacatatatacagccggcaatacatctgataaagaatggaggagggcttcatgaagtttttctgataaggatggggtatatattgaatggtggaagagtcagatag

SEQ ID NO: 1686 - DNA, 1284 bp, B.fragilis
cgaaggattcttcaccgactaattttgaacctaaaaaaattaaggacgatgaagagtacattttcagttatctactacctcaaacgtcaggtagtgaaaaaggacgggacagtacccgtcatgggacgtatcacggtggacggaagccagacacagttcagctgcaaactgaccgtcgatcccaagctgtgggataccaaaggtggacgtgtcacgggcagaagcacggctgcactcgaaacgaaccgtatgctcgacaagatgcgcgtacgcatcaacaagcactatcaggaaatcatggagcgtgacaacttcgtcactgcggaaaaggtgaaaaacgcctttctcggactggaacaccgctaccacacgctgttgcaggtgttccggcaacacaacgaggactatgccaagcaggtggaggcaggcatgaaagccaaaggcacgtttgacaagtacaagattgtttacaagcacctgcaagagtttctcaccatccgctaccatgtgaaggacattgccctgaaagagcttacacccgctttcatttccgattttgaaatgttcctgcgcacggacaaacattgctgcaccaacaccgtgtggctgtatgtctgcccgcttcggacgatggtgttcatcgccatcaacaatgagtggctcacgcgcgacccgttccgcgagtatgaaatcaagaaggaggaaacgacccgcagctttctgacgaaagatgaaatccgcctgctgatggaaggtaagctgaagaatgcgaagcaggaactgtatcgtgatttatacctgttctgtgccttcacgggcttgtcgttcgccgatatgcgcaacctgacggaagagaatatccgcacctactttgacgaacacgagtggataaacatcaaccgccagaagacgggtgtggtgtccaacatccgtatgcttgacatagcgaagcgcatcatcgacaaataccgtgggctatgcgaaaacggcaggattttccctgttccccactacaacacgtgccttgccggaatccgtgccgtcgccaagcgttgcggtatcaccaagcatatcacatggcatcaaagccgtcacacggcagccacgacggtgttcctctccaacggcgtacccatcgaaacggtcagttccatgctgggacacaagagcataaagacaacgcagatatacgcgaaaataaccaaagagaagctcaatcaagacatggagcaccttgccgcaagattgaaccaaatcgaagaatttgcgggttgcaccatctaa

SEQ ID NO: 1687 - DNA, 186 bp, B.fragilis
acttcgggctatcgttccgagataggtatcgttacccgtcccgaaaacgattcctttggcagatccgctgataacagtggaacccatgtagcagatattgtcaagctcgatgacgcttccgtgactgtgtctcctaccgtttatttcaggaaatttctctactggatcggactcaccggtaagtga

SEQ ID NO: 1688 - DNA, 255 bp, B.fragilis
ggttgctctctgaaatacgagaatacagccaatacaaaaatggcaaagcagccaattgcttttaaaaactttttcatatactcggttgttttagtaacacataacaaatatagacgattttttctatctattaagaaaacgttccttactaaaacttacaagttgaaaatcaataaaatgcctccttacaagaacttacatcaaaagagttctctctgcgagaagtcatcactctccttaggcagcactaactga

SEQ ID NO: 1689 - DNA, 345 bp, B.fragilis
aatccacctctgcaccacttcatagatggaatactcggctgcttgccctgccttgtatcgggacttgacgaagaagaagcgtatcacttggtactgcttgctggtcgtgacaatggagaagtattcgttctcgctgaaaacgctctttcgggtgcgcaacgcttccaactgcataccgcaatgggggcaggtacatccgcaaatggtgtccgcaaggtcgtggtcgctcttccacgaatgtccgcactcggtacagatattcgtgccgtccgccctcttgattgcgtaatgcttgaagcaatgacggaaagcgtatgccttttgcgtggcggtcaatctcggtag

SEQ ID NO: 1690 - DNA, 201 bp, B.fragilis
ctccgggatttgacgggaaagcaaggtcaagcctcctgttttcgggaaaaatctccagccctgcgggtagtatttttcccgaaaaaccttgcattccctaatccctacctttttaagcacccgaaacgaaaacgaccgatgcgacagaaagacgcattaaaaaaaatgtcggataaacgagaggcagataagatagtttga

SEQ ID NO: 1691 - DNA, 1599 bp, B.fragilis
aacatttttcaaatggcaaagaaaaaaagcgaaaaggacgtgctgatagtccgtgacgagaagacgggcgaaatcagcgtggtagccgggctggatgccgacggttcccccaagcgtacccccgcgaaagcggagaacgcgcagagtttcctgcaattcgaccgccacggcgatgtgctggacaacttcttcaaaaacttcttccggcagtgcaaggaacccagccgcttcggtttctaccgtgtcgcagcagaccaagccgacaaactgatggaggtgatgaaagacctgctgaaagaccccgaagccaacaaggaactgcttgcgccccacaaggtggacacttccggctacgaaaagcaggtgaaggaagaacagaccgccggaaagacggagcagacggaacaaaagcaggaagagcagcccaaagaaaaccaaaaacaggaagaaatggaaaagaagcaggaaagcccgcaacagacgcagggcagacagggctaccagcccatcgacgagagcaaaatcaactggcaggagctggaagagaaatggggcgtgaaacatgacgaccttgaaaagtccggtgaccttcagaagatgctcaactacggcaagtccgatttggtgaaagtgtcgcccaagttcggcggcgaggcttttgaactggatgcccgcctttccttcaagaaggacggtgaaggcaatgtcagcctcgtgccgcacttcatccgcaaggagcagaaactcgatgaatacaaggaacacaagttttcggacgaagaccgtaagaacctgcgcgaaacgggcaacctcggcagggtcgtggacatcgtggacagggaaacgggtgaaatcatcccctcgttcatcagcatagaccgcaagacgaatgaaatcacggacattccggcaaacaaggtgcgcataccggatcgcatcggaaagacggaaatcaccaagcaggagcaggatatgctgcgtgccgggctgcccgtgcgcgacaagctcatcgaacgcaacgacggcaggaagttcgtcaccacacttcaagtgaacgtcgagcagcgaggcgtggagttcgtaccgggaaccggcaggtcgccgcgtaccgcccaaacgcaggaagccaagaacaatcccacgcagggacaggctcagggcatggaaaattccgcagccccacagaaagagcaacgccgcaacacgtggacgaacgccgacggcagcatccgccccatcagtaaatggagcggcgtgaacttcaccgaccaacagaaagccgattacgcggcaggcaaagctatcaaactggagaacgtgaccgacaagcaaggtttccacgccacgatgtacatcaagttcaacccggagaagggacgtccgtaccgctacgacaccaaccccgacaacgcgcagaaggtcgccccgtccaacgagagccgcacacaggtggcggtgaacagcgaaggaaagaccaacgaggcgaccaagaacctgaaagagccgttgcagaaagggcagaccgctccgaaagacgacaaacagcaaaagctgcaggagaagcctcagaagaaaatcatcaagggcatgaagatgtaa

SEQ ID NO: 1692 - DNA, 2358 bp, B.fragilis
acttttattcatgttccaaaaatcaatgtcatcaaaataatggagcggtcaggaaatttctataaggcaatacagttgggatatatacttatctccattcttatcggatgtatggcatataatagcctctatgaatggcaggagatagaagcattagaacttggcaataaaaaaatagacgagctccgaaaagaaataaacaatatcaatattcaaatgataaaattttctctattgggtgaaacaatactggaatggaacgataaagatatcgagcattaccatgcacggcgtatggcaatggacagtatgctctgccgtttcaaggccacctatccagcagagcgcatcgatagtgtgcgcagtcttttagaggataaggaacgacagatgttccagatagtccggttaatggatgaacaacaatctattaacaagaagatagccaatcaaattccggttattgtgcagaaaagtgtgcaggaacagtccaaaaagccaaaacgaaaaggtttcttgggcatctttggcaaaaaagagggaacgaagccaacgacaacaacgactacgctccgttcatccaatagaaacatggtcaacgaacagaaagcgcagagccgtcgattgtcagaacaagccgatagtcttgctgcccgtaatgcagaacttaacagacaactgcaaggattgatttgccaaatcgaaaagaaggtacaatctgatttacaaaatagagaaagcgagataacagcgatgcgtaaaaaatcatttatgcagataggcggcttgatgggatttgttcttttgctgttggtcatttcctatatcatcatacaccgtgatgcaaagaacattaaacgatacaaacgcaagacaacggatttgatcgagcaattggaacagtccgtgcaacaaaatgaggtactcataacctcccgaaagaaagcggtacatactattacccatgagttgcgtacaccactgacggcaataactggctataccgaacttttgcggaaagaatgcaatagcggtaataatgggcaatatatccgaaatatactgcaatcctccgaccgtatgcgggatatgctcaacactttgcttgacttcttccgcctggacaacggcaaggaacagccccgtctgtcaccctgccggatttctgcaatcacgcacacacttgaaacggagttcattcctgttgcagtgaacaaagggttgtccttgtccgtgaagactggacacgatgccattgtattgaccgacaaagagcgaataatacaaatcgggaataacctgctgtcaaacgcagtcaagttcacagaagaaggcggtgtttctttgattactgaatatgataatggagttctgacactggtcgttgaagatacaggtacaggcatgacagaagaggaacagaaacaagcgttcggtgcgtttgaacgtctatcaaatgccgccgcaaaggagggtttcgggcttgggcttgccataatgcgtaatattgtgtcgatgcttggcggaacaatccgtttggacagcaagaaagggaaaggcagtcgtttcacagttgaaatttctatgcaggaagctgaagaacagcttggatatacaagcaatacacctgtttatcataacaataaattccatgatgttgtcgccattgacaatgatgaggtattacttctgatgctgaaagagatgtactcccaagaaggaatacactgcgacacttgcaccgatgctgcggaactgatggaaatgatacgccagaaagaatacagcctgttgctgacagacttgaatatgcccggtataaacggtttcgaattactggaactgttgcgttcgtccaacgtgggcaattcaccaacaatcccggtggttgtggcaaccgcttcgggcagttgtaacaaaggggaactattggcaaaaggctttgccggatgcctgttcaagccgttctccatatcggagttgatggaggtttccgacaggtgtgccataaaagaaacaccggacgggaaaccggatttttcagctttgctgtcttacggcaatgaagccgttatgctggaaaagttgatgacggaaactgaaaaagagatgcagacaatacgggaagcggcaacagaaaaagacctgcaaaagctggattccctgacacaccacctgcgcagctcgtgggaggtgctacgtgccgaccaaccgctaaatgtactttacagattgcttcatggcgatgtactcccggatggtgaagcgttaagccatgccgtgactgccgtgctggataagggagcggaaataatccggttggcagaagaggaaaggagaaaatacgaagatggataa

SEQ ID NO: 1693 - DNA, 417 bp, B.fragilis
aaacagattcatcaactaaaaaagaaaatgcgtatgagtatatcaagaacgaaaatgctgcaagtcagcaagtgtttaatcggactggcagtcatgatgctgcaatcctgtgatgtagcggacaaccgccgcgacctactttgcggaaactgggagagcgtggagggaaagcccgacgtgcttatctacaaggagggcgaagcctataaggtgacggtgttcaagcggagcggtctgcgccgtaagctgaaaccggaaacctatctcttgcaggaagaaaacggcaacctgtttatgaacaccggattccgtatcgacgtgtcctacaacgaagcgacggacatcctgaccttctcgcccaacggggactatgtgcgcgtgaacccgaaaccggatcatccgataggcgagcaataa

SEQ ID NO: 1694 - DNA, 402 bp, B.fragilis
tttgaaactcaactccctcagctcttgaatccgcataaaaaaataaaaatcaaaaacagaacagatatgggaacaacaatggcaacaaaattcgtggcttgggaagtgccgacattggaagctctgaaaggcagtaaggtttacattcttcgtgaaaaactgaacaacggaggacagatgaaccgagaggaaaaggattggcttacacgcaacgtgaacagcaacacctatttcaagagcgcagtccccttgcaaggctggaggtttgacttctctgatgtactccgcacgtttattgtgtgccaatacggacattggacggaatacaaggcaacggacaagaccggacttcgcagatacctatacggcaggatagacaacattgtagaacttgaaaaatag

SEQ ID NO: 1695 - DNA, 525 bp, B.fragilis
cttaaaaatcaaatgacaatgaacatactgaacaacaagaacaagagaatatcaatcttcaaggcgttggcactctgcctgttcgctgccgtatcgctcacgctcgtgtcgtgtgacgatgacatggacatccagcaatcctatcccttcacggtggaaatcatgcccgtacccaacaaggtaacgaaggggcagacggtggaaatccgctgtgaactgaaaaagacgggcgattatgccaacaccctctataccatccggtatttccagttcgagggggaaggcacgctgaaaatggacaacggcatcacgttcctgcccaacgaccgctacctgctcgaaaacgagaagttccggctgtactacacggcggcgggtgaggaagcgcacaacttcatcgtggtggtggaggacaatttcgacaactcctacgagctggaatttgacttcaacaaccgtaacgtgaaggatgacggggctatctctgttgtccccatcggaaacttcaaacccctcacacgatga

SEQ ID NO: 1696 - DNA, 453 bp, B.fragilis
ggattaaaacacttatctatatatggatcgggaaataccacttttacaaatggaataaaaagccatgatgaactgcaaatgtctatctatggctcgggaaacatcagcggaaacagtttctcatgcacaaaactggcagcacgtatttacggttcaggaaatgtcaacctgaaaagaatcagtacatccgacacccaagtaaacatttccggctcgggaaatgtactgctagacggcaaatcgaccgaggccgaatatcacattgccggttcgggagacattaatgctaccgaattaaaagtagagaatgtcaatgcacgtattagcggttcgggcagtataagatgttacgccacagaaaatctgacaggaggagtcagtggcagtggaaacgtagcctataaaggcaacccgcaaataaacttttctaaaagaggactacagaaactctaa

SEQ ID NO: 1697 - DNA, 1302 bp, B.fragilis
tttcttatgcaacagaataattcagaaaaatggaactttttgtcaaataaaaagttattttgggggactattatagttatccttttcctctttcttttgtccgcttggctattcttctggaatagagaaagacattttttcaacgataattatgtattagataatgctctatggggtacattgggagattttgttggtggcttcattggttctatcttagcttttataggcgttattgtgacatgccagatttttatagagcaacgtcagcaaactatagatttaaacgaagagcaaaaaaggataacgtcaaattctcaaaagtcacaaataaatcaatctgaaatacagcgattcaattcgctattttttgagcttatagatttgcataggacgcaggtggattatttgatgaagatgcctttagttggttttgaagcagaaaactcaaaagaaacaaacttttttgatagatttatggaagagttgcatagcaactcgaatgtaaacagtagctatgcaagagcatttattgttgccaagaggaaatatctccaactatatttgagcaacagtactattttagcaccatattttagagtattgtatcggttgtttgaacttattgacaaagcaaatattgaagaaaaggagaaagttaggtatgcaaaaatcgctcgtgctcagttatccgagagtgaactttttattctaagatataatagtgcaaacctttacggagataattttattgagtacattaataaatttagacttctaaaacacctgccacttttatcattattggaattcaagaatatacgaaatgttattgccgaaggagattctttatatcaatattcaataaatatgcttttcttctctgtttggaaaagaatatataatatcacagtggggcatgaagacaggaccaatgattttgttcaattatatgatgaaagaaaaagatataaatttgaattaaagatgccaaagaaacaccgaacagccttatatctaacaattgatacaagccgtccaaacagagaccctctactaaaatgtttcaggaactttaatgaatctgattttgggaaacttttgactaatttccttttggagatatataaatactcaaatttttcaagatacaacaaagacgaaaatatagaatatcataagaaagtatttcacgatggttctgttactaaaattgtatgttggattttaaatacagaaaataagctgttaagggtatctcatccaagtagagataaattttacgggatttcagaagattaa

SEQ ID NO: 1698 - DNA, 1161 bp, B.fragilis
cccaatatgcaagaaactaatagtaaaattaacaagtatgattacttaattgtaggagctggtttattcggatctgtattcgcacatgaagcacataaaaggaataagcgctgtttagtacttgagaaacgcccatggactggcggtaatatttattgtgaaaatatcaatgagatacatgttcataaatatggtgcacatatttttcacactgataaaaaaaagatatgggactatgtaaatagtttggttgaattcaaccaatttatcaattcccccttggcttcttctggaggtaaattatataatcttccgtttaatatgaatactttttatcaattatggggtgtacagacccctatggaagcagaaataaaattagaagaacagcgtcacccatatcgtatcatcacaaatccacaaaatttagaagaacaagctttaaaaatatgcggaagtgacatctattatcgcttaataaaaggttatacagaaaagcagtggggaagagccgcaactaaactacctgccttcatcgttaaacggatacctttccgatttacttttgataataactacttcaacgacccatatcaaggcataccaattggaggatataaccgattaataaatgcactacttgaaggaatcgaagtaaagactaacataaactatctggaaaatcgcaacaagtgggattctattgcagaaaaagtactttttacagggtgcattgatgaatatttcaatttttgttatggaaaacttgaatatagaagtttacgatttgaaactcactgccttaatgatatatccaactatcagggaaatgcagttattaattattgtgacagcaatattccatacacacgtgtgatagaacataagcattttgaatttggtacacagaactctacaattataacatatgagttccctgaagaattaagcataggcaaggagccatattacccaattaatgacgaaaaaaatacaactatttttagaaaatatcaaactctagccgagactaataaaaaagttcttttaggcggacgattagctcaatacacatatgcagatatggatgatacagtagaagcagctttatccctttggaacaaagaactccaaaattcttctcaaacaaaattaatctaa

SEQ ID NO: 1699 - DNA, 741 bp, B.fragilis
aagagaacgcacatgaatggaacaataagcatgactgacattctgctggccgtatcggtcggctgtaacctgtggttcctgttcctgctgctctacgaccgcatcatggaaacgagattcgtccgcttccttaaaggcattgccggactgtggaggtcgctggacggcatggcggcaaagcaggaaacggtacgggaggcatctcccgcagaaacatcggacatcatcggcaagagccgtttcaggatggcatcaacccggacaaccgctgccataccgacgcaggaagccgccacttcggaaaaaggcattgagctgtcggaggaagaggctacttttgacgacggaaacacggaaaccgtgtcccacccggcacaagtcccggaggaaaaactcgatgaaaccttcacgagcatcccgccttcggaactggagttcggggaggatgaaccggaggacggaacgcccgacacaccaagagctacgggaagcagttttgacgagatagacgatgcggtcagagctgccaagaacccggaagcgacaacggcagaacgggaacgtgcggcaaaggtcttctccgatatggaaggaacggaactgtacgagaaactgatgtccggctcgacggaactgagcatccgcatcaaggggcttatcgaagtccggctgaagaaaccgaaaaaggaatttaccgtacccgacaacattgacgagttcaatattcgggactatgtataa

SEQ ID NO: 1700 - DNA, 252 bp, B.fragilis; identical to SEQ ID NO: 860

SEQ ID NO: 1701 - DNA, 1359 bp, B.fragilis
tccggttggcagaagaggaaaggagaaaatacgaagatggataagacaacaataattgtggtagaagacaatatcgtgtactgcgagtttgtctgcaacatgctggcgcgggagggctaccgcaccgtgaaggcttaccacctctcaaccgcgaagaaacatctacaacaggcgacagataatgacatcgtggttgccgacctgcgcctgcctgacggtaacggcattgaccttttgcgctggatgcgaaaggagggaaagatgcagcccttcatcattatgaccgactacgccgaagttaataccgccgtggaaagcatgaaactcggctcgatagactatattcccaaacagcttgtggaggataaacttgtccccctgatccgttccatactgaaagaacgtcaggcaggacaacgccgtatgcctgtgttcgcccgtgacggttccgcatttcagaaaatcatgcaccgtataaggctggtagccgctaccgatatgagcgtgatgatattcggagagaacggcacgggtaaggaacatattgcccaccacctgcacgacaagagcaagcgggcagtcaagccattcgtggcggtggactgcggttcactcaccaaagagcttgcgccctcggccttcttcggacacgtcaagggagcgtttacaggagcagattgtgccaagaaaggatatttccatgaggcggaaggcggcacgctgtttctggacgaggtaggaaacctcgcgttggaaacccaacagatgttgctccgcgccatacaggagaggcggtatcgcccggtcggagacaaggcagacaggagtttcaatgtccgcatcatcgccgccaccaacgaggatctggaagcggcagtgagtgaaaagcgttttcggcaggatcttctgtaccgcctgcacgacttcgggataaccgttcctccgttgcgtgactgtcaggaagacatcatgccgctggcggaatttttccgtgaggcagcgaacaaagaactggaatgcgacgttatcggatttgacggggaagcccgtaaaacattgttgacccatgtttggccgggcaatgtccgtgagcttcgacagaaaatcatgggtgcggtgttacaggcgcagaccggacttgtcacgaaagaacatctggaacttgccgtgacgaaaccgacttcacccgtcagcttcgccctgcgtaacgacgcggaagataaggaacggattttgcgtgcgttaaagcaagcgaacgggaaccgcaaggttgccgccgaactgctcggaataggacgtacaacgctgtacagcaagttggaagagtatgggttgaaatacaaattcaggcaatcatag

SEQ ID NO: 1702 - DNA, 1302 bp, B.fragilis
tttttatttaatatttgttatatgagaagtctgtttttaatattctttttttgctatgtaactgggaaagcccaggacagagcgtgtgtcgtgagtgaaaaggatagcattcctctttcaaatgtatatatctgtttgaaagataggagagtcatagctatcagtgatgaaaagggggtgttctcattagagaaatatgattcgttgtcattgaatgatactttatatttttctcatattaattatttgcacaagaaattgtcttatggtgatttaattaaaaatagatgtaccgtttttttgatagagaataatcgggttttggaagaagtatctatttttagcaataggcatttaaatcgctttttgcattatgaaatattgtctccattgaaaagaggagtctattcgtttgcttcggtcttggtagatgggcagatttatattgtaggagggagtacatcgtgcggcccctttcagagtaatatacgttctactttattttgggaaaaatatagtaacatgatgtatagatatgatatcaagcaagataagtgggagacgatcaggcataagtttagagaaagggcatatcatacggcgggttattatgatggaaaaatttttattttagggggaaagagattatctgaaaccagaattgttgattatctggataatgcaatagaaatatatgatattaagcgtgataccgtctggacagattatactaatccgcatcaagcgactttattgggatccgttgtgtataaagacaatatgattgttttaggcggtgttaaaaaggttttgcaaaataatgaaggagtctattcggatgaaatgcatttatggaatttaaaatccggctactggtatgagttgggaaaaatgccgattaggcaagctcctgaaacaattctggttgatcattgtatttatttaatcggaaatcgtaacggtggcggctggagtattgaatgttataacttattgacaggcgcatggaccaatgccggacatttgttatatcggcttggctggcccagtttggcttatcataatgatataatttatatttttgaacaaggtgttgtacagacgtttaatataaaaagcaggcaagttcgttcgtatatgatagatctgaaattgaaatctccagctttgtattactttgatgggaaattatatattttgggcggattttatatgggagatccttcgcgcaatgtatatagtgttgatctgaaggaatttgataaaacagaagtcgattattattataacaatgtaagatga

SEQ ID NO: 1703 - DNA, 258 bp, B.fragilis
cacagagttaaaacttgttctttggatgtgaataagaagttctttaaatgcaaaaggcttgttatttgcgcacaagaacctgccaacctgcaaaagacgttaacaatgttaattgaagaaaggtataaagatgaagataccggttcagacgacgtaaattcacttccgaagcttgagttatcttattcagccgatgtctgttttttcttattaaagcaagcaaaaaggacaataatcaacttgaaaataaagaaataa

SEQ ID NO: 1704 - DNA, 234 bp, B.fragilis
cacttctataatgtagtaaaatgggtgtacacaaagtatgtcctactttatccattaaaatgctctaaatttcatttatgtgcaaaggtacaaattctattttatattctacttatttccatatacagatacttatatgggtctatagacaacatacaactatctatgactgttatcgcagattgggtcacaggtttctttgctactttctttgtccgccatcatgctcactga

SEQ ID NO: 1705 - DNA, 2826 bp, B.fragilis
atacccgataaacaagggtatcggccgtccggtcgagttcaagggtctgaaggctcagtacctcttcatcttctgcggaggtctgctggctctcttcgtcctgttcgtcatcctttacatggtcggcatcgaccagtggatatgtatcggcttcggcgcggcatcgtcttccgtcctcgtatggcagaccttcgcgctgaacgcccggtacggcgaatacgggctgatgaaattgggagcggcaaggagccatccccgataccttatcaaccggcggcggatcacccgattattcaaacggcaacgaaaggaagaaacgacatgagaaatacatccaaaatgacaacactggaaaacaagttcccgctgctggctgttgagcatggctgcatcatctccaaagacgccgacatcacggtggctttcgaggtggaactgccggagctttacaccgtgacggatgcggagtacgaggcgatacacggctgctggtgcaaggctatcaaggtgctgccggacttctgcgtcgtgcataagcaggactggttcatcaaggagaaatacaagccggagttacagaaagacgacatgagttttctgagccgctcctttgaacgccatttcaacgagcgtccgtacctgaaacacacctgctacctctacctgaccaagacgacaaaggaacgtaaccggatgcagagcaacttcagtacgctgtgccgggggcatatcatcccgaaagaactggacaaggaaaccgccgggaagttcatggaggccgccgaacagttcgagcgtatcatgaacgacagcggctttgtcaggctgcgccgcctctccaccgatgagattgtaggcacggagaaatctaccgggctgatagagcgttacttctcgctcatgcccgaaggcgacacgaccttgcaggacatcgacctctcggcaaaagaaatgcgcatcggtgacaaccgcctgtgcctgcacaccctctccgatgcggaggatatgcccggaaaggtggctaccgacatccgctacgagaaactctccaccgaccgctcggactgccgcctttccttcgcctcccccgtggggctgctgctctcctgcaaccacatctacaaccagtatgtgattatcgacaacagtgaggaaaatttgcagaagttcgagaagtccgcgaggaatatgcagtcgctatcccgatacagccggagcaacagcatcaaccgcgaatggatagaccagtacctgaacgaagcccattcctacgggctgacctcggtacgggcgcacttcaacgtcatggcgtggagcgatgacgcggaggaactgaagcatataaagaacgatgtaggcagccagctggcaagcatggagtgcgtgccgcgccacaacaccatcgactgcccgacgctctactgggcggcgatgcccggcaacgcggcggacttcccggcggaagagagtttccataccttcatcgagcaggcggtgtgccttttcacggaggaaaccaactaccgcagttcgctctcgcccttcggtatcaagatggtggacaggcttacgggaaaaccgttgcacctcgacatcagcgacctgccgatgaagcggggcatcacgaccaaccgcaacaagttcgtgttgggtccttcgggcagcggcaaatccttctttatgaaccacctcgtgaggcaatactacgagcagggtacgcacgtggtactggtggatacgggaaactcctatcagggcttgtgcgagatgatccggcgcaagacaaacggggcggacggcgtgtacttcacctacacggaggagaaaccgatttcgttcaatccgttttacaccgatgattacgtgttcgacgtggagaaaaaggacagcatcaagacgctgctgctgacactctggaagtcggaggacgacaaagttacgaaaacggagagcggcgaactgggcagtgcggtgaacgcatacatcgagcgtatcagggctgaccggagcatcgtcccctcgttcaacaccttctatgagtatatgcgcgacgactaccgctgcgaactggcggaacgtgagataaaggtggagaagtccgatttcaacatcgacaatatgctcaccaccatgcggcagtattaccggggcggacgctacgacttcctgctcaactccacggagaacatcgacctgctcggcaagcggttcatcgtcttcgagattgattcgataaaggaaaatcgcgagcttttcccggtcgtgaccatcattatcatggaagccttcatcaacaagatgcgccgattgaaaggcgtaaggaaacagctgatagtggaagaggcttggaaggctctctcttcggcgaacatggctgagtacctgcgctatatgtacaaaaccgtgcgcaagtattacggggaggcaatcgtggtgacgcaggaggtggacgacatcatttcctcgcccgtggtcaaggagagcatcatcaataactccgactgcaagatactccttgaccagcggaagtacatgaacaagtttgatgccatacagtccctgttggggcttacggagaaagagaagtcgcagatactctccatcaacatggcaaacaacccgtcaaggctctataaggaagtgtggataggactgggcggcacgcagtcggcggtctatgccaccgaagttagtgctgaagagtatctggcgtacaccaccgaagaaactgaaaaagtagaggtataccgtctggcggagcagctgggcggcgacatcgaagccgccatccggcagcttgccgaaaggcggagaaaaaaggagtaa

SEQ ID NO: 1706 - DNA, 441 bp, B.fragilis
atccaaagtaatatgagtgaaaaaagaagaaacaaaggcgggagaaatcccaaactcgatccggcggtgttccgctacaccgtccgtttcagcgaggaggaacacaaccgtttcctctccatgttcgagaagtcgggcgtttacgccaaatcagtttttctgaaggcgcacttcttcggacagccgttcaaggtgctgaaagtggacaagacgctggtggattactacaccaaactgtccgattttcatgcgcagttccgcgcgataggtacaaattacaaccaagttgtgaaggaactgaggctgcatttttccgagaaaaaggcgatggcgttgctttacaagctggaacaacagaccgtagaacttgtgaaactgagccgtaaaattgtggaactttcaagagaaatgcaggaaaaatggtcgcaaaaatcagtgtag

SEQ ID NO: 1707 - DNA, 285 bp, B.fragilis
aaatgtataaaaattatgggtaagaaaatcttcgcgaccttgatagtcgctgtagtcgcaacttttgcaggctacaatatatatcagtcacagagagcgaaaaatacaatgtcggaattggcgatggctaatgtggaagcattggctgatattaatgaaacagattcttctgggcaaacattatattgttgcggtaatgaagatacatgcgctaaaggagaagatgaggatactggcgaagagtttatcattcatggtgtactatctagtaaaaaatgtaaataa

SEQ ID NO: 1708 - DNA, 942 bp, B.fragilis
agattgataaaactctattctcctatgatacatatagcatgtaatattgactctaattttacggtacactgtgcagtgactttggtttcactgttcgaaaataaccgtgaatctgagttttgtatccatattgtggcctctacactgccttctgaagataaggaagtactaaaaacaatcgcaggtcgttatggcaatgaagtacgcttttactttcctccggaagacttgttgcataatttttctatcaagaagtttggtaagcgcatttctatggctacttattaccgttgtatgttctcagccattttaccggaagaggtggataaagtgctttatctggattgtgatattgttattcttggagatatatcagagtattggaatacagatatgagtaattattcggttgcttgtgtcgaagatatcggcagtaatgaagatgaacgttatgatatcttgaaatatgataagtcattctcttattttaatgcgggagtactacttatcaatttgcgctattggcgtgagcataaaatagatgaacaatgtgaacagtattttttacgatatcccgagcgtatccgctttaatgaccaggatcttttgaatgctgttctgcatgaatctaaactttttgttcccttaaaatggaatatgcaggatggtttctatcgttatggggcggataaaggagtgaaagataagaagcaattgcatcaacaattgctccatcctgttatcctgcattatactaataaaaaaccctggaattatgatagcatgcatcctttgaaaggagaatactttaagtatctggatatgactccctggaaaggcaaacggcctttatctacttttaaagctcgtttgtcctggtggttgaagtcgcttccttatgcactgcggctccgtaagcccaagtatgtaaatttaatttaa

SEQ ID NO: 1709 - DNA, 597 bp, B.fragilis
tggctcgcaaacgaaagactattgccatatgtggtaagtgttacaaaaaactcagtaacaatgaatagattgatattattagtagaaagccggatacgcggagacgtgtacgtccggtttgggggcgagcttccgaaaacccaccgtagtaatacggcagggcgttggatgcttagcctaccactcaaatccgtgaacaatctggtaaaggacgcccggaaggtgcagcagaccatcctgatggtgggtgacatcaccgacacctatgtgaccagcttccagaggatgatgcgtgacgacaacttcacggtggaggaactgggagccatcgctttcggctacaccaagctgttggaggaatccaacgacgtgctgacggaactgaagaacgtggtgaatatcaccacgctctccatgacggacaaggagcgcatggatgtggtggaacgctgctactccaagatgaagcgttaccgcaacctcgtgagctattacaccaacaagaacatcagcgtgagctacctgcgggcaaagaagaagaacgaccttgaccgcatcatggggctgtacgggaacatgaacgaaagatactggtag

SEQ ID NO: 1710 - DNA, 810 bp, B.fragilis
aaacacaaaaacatgaaaactcgggcattacgaagctatctatgctttactttactggctacagcctttctgctgggactagccggctgtgataaggaggaatccgaaccgttaagaattggagacgattcatttaataatattgaaaatggtgtctggactgcttattatccgaatacaaatcagacgtctatcaccatttatggaggagtaaaaccctataccgtaagtagcaattctgatatcctaaaagtgaatatggataagctttcggatgctttcaactacgaaacactgggcgttggtgatgcggaagtgactattaccgatgcgaaaggtgaatccgtcggtttaaaagtgaaaatagattatcggtctgataaaatgaagatcgttaagctggatgcttatgtgaaaggcgataagatgacggtggctgcacaaaaggaactgaaagaaaaagccttggcttccattcctgtaaaagcaggaggcggttatcagtttatatatacaaaggatcaagggggaattgtatatgtctatccggataaatacggtgagaaatataaagaagggactttcacccgtagttctcttgcggttgggaatagttcatatcggaaatatgaaataaagttggatggtatggaaaggacatatattgttcagagatattatccgtcgaagacacgaagtgtggctatggtgccttatggcttttatgaggatctcctagatcagtttacagatgactatcccgaagtggaaagtgtatacaccatgcaggttgtcagtgcggttttctga

SEQ ID NO: 1711 - DNA, 243 bp, B.fragilis
tatatgaaaaaatatatatatgcgttcttttttgcttctttgattattgtcgctttgggattaaaggcaaagataaagagtgatactgaattttcggaacttactttaagtaatattgaggctttaggaatggaagaaaccgatggggctaaagactattggtgttgtggaaatgaggatgtttgtgcagagggacctcactataaaataaaaggaaaacttaaagagaatccttgtaaatga

SEQ ID NO: 1712 - DNA, 900 bp, B.fragilis
tcttcaagaaatacgctgaataaagtcgtgttacgtaataaaatagataagataagactcctgttctgcaaggatagagagtcttattcttgtttttaccgtatactcgggttctatccccgcaacatcaggctgtacgagcaggctctactgcataaatcaacggcagtacgttcggaaaaaggacgtccgttgaacaatgaacgcctggaattcctcggtgacgccatccttgacgccatcgtaggagatattgtctatcaacacttcgaaggtaaaagggaaggattcctgaccaatacacgttctaaaatcgttcaacgtgagactttgaacaaactggctgtcgaaataggcttggataaactcatcaaatattcgacacgctcttcctcccacaacagctacatgtatggcaatgcatttgaggccttcatcggtgcaatttatcttgaccgcggatatgaatgctgcaaacagttcatggaaagaagaatcatcgaaccttatatcgatttggataaactttcacgtaaggaggtcaacttcaagtcaaaattgattgaatggagtcaaaaaaacaagatggaagtttctttcgaattgattgagcagtccctcgacaaagaaaataatcctgtattccagacagaagtgcgaatcgaaggcatactcggtggatcaggaacaggatactctaaaaaagaatcccaacagaatgcagcacagatgaccctcaaaaagattaaaggagatcctgagtttatggcaagtgtacaagaagccaaaacacagaataatgtacctgcagaagatacgactcccgaatcagaaatgtctctgaccgcagaaaatcaacagatcgacgaaattatatcaaccgaagagatcagtgtgtaa

SEQ ID NO: 1713 - DNA, 306 bp, B.fragilis
aatgttttgaatatggaaattgtatctatcgagaaaaagaccttcgagatgatggtggcatccttcaacgccctctcggagaaggttgccgccctgaggcgcaagagcgacggagggcggctggaaaggtggctcacgggcgaggaagtctgcgggcagttgagaatcagcccgcgcacgttgcagacgttgcgcgacaagcggcttatcggctactcgcagataaaccgcaggttctattacaagccggaagaagtcagaaggctgattccgcttatcggcacgctctatcccggcggcaggtaa

SEQ ID NO: 1714 - DNA, 1914 bp, B.fragilis
aaacaactgaataacagaaaaatgagaaagtggcgtattgaagattctgaagaactttacaacatcacaggttgggggacttcatactttggtattaatgacaagggtcatgttgttgttacaccgcggaaagatggcgtagccgtcgatttgaaagaattggtcgacgagttgcagttgcgtgatgtagcggctccgatgctcgtacgttttccggatattttggataaccgtattgaaaagactgcctattgttttaaacaggcatctgaagaatatggatataaagcccagaattttatcatctatccgattaaagtgaaccagatgcgcccggttgttgaagaaataatcagccacggcaagaaatttaatctgggacttgaagccggttccaaaccggaattgcatgctgtaattgccgtcaataccgattctgactctcttattatctgtaatggatataaagacgaaagctatatcgagcttgctttgctggcacaaaaaatgggtaagcgcattttcttggtcgttgagaaaatgaatgaactgaaactgattgcccgcatggcaaaacagttgaatgtgcagcctaatatcggtatccgtatcaaactggcttcttcgggaagcggcaagtgggaggagtccggaggggatgccagcaagtttggtttgacttccagcgaactgctcgaagcactcgatttcctcgagagtaagggaatgaaggactgcctgaaactgatccatttccatatcggcagccaagtgacaaagatacgtcgcatcaaaacagcattgcgggaagcctctcaattttatgtgcagcttcatgcaatgggattcaatgttgaatttgttgatattggcggagggcttggagtcgattatgacggaacccgttcgtcaagcagcgagagtagcgtgaactactctattcaggagtatgtcaacgactctatttctacgttggtagatgccagtgataaaaacggtattccccatcctaatatcatcacggagagtggccgggctttgacagcacatcattctgtgttgattttcgaggtgctcgaaacggctactttacctcaatgggatgatgaagaagagattgctccggatgcacacgaactggtacaagaactttatggtatctgggatacgctgaaccagaataagatgctcgaggcgtggcatgatgcccagcagatacgtgaagaagcacttgacttgttcagtcatggaattgtggacctgaaaacgcgtgctcagatcgaacgtctttattggtcaattactcgcgaaatcaatcaaatagccggtgggttgaaacatgcccccgatgaattccgtggattgtccaagttgttggccgataaatatttctgtaatttttcacttttccaatcactgccggattcttgggcaatcgaccagatttttccgattatgcccattcagcgtctggatgagaagccggatcgttcggccactttgcaagatataacctgtgattccgatgggaaaatagccaattttatctctaccaggaatgtggcacactatatgccggttcatagcttgaagcagaaagagccttattatgttgcggtattcttggtaggagcttatcaggaaattctgggggatatgcataacttgtttggagatacaaatgcagtacacgtttctgtcaatgagaagggatataacattgaacagattattgatggtgagacggttgccgaagtgcttgactatgtacaatatagcccgaagaaactggttcgaaccctggaaacatgggtgacaaagtccgttaaagaaggaaaaatttcggtagaagaaggtaaagaattcctttccaactatcgttcgggattgtatggatacacttatcttgaataa

SEQ ID NO: 1715 - DNA, 1467 bp, B.fragilis
cttattatgaaaaaactattttattggattctttcatctattgttttgttttcgtgttctgaaacagaattattggataattctattgatgatcaattgattacaactcgtgcttccggtgatgggctttatgatgtgcttggttatggatatgatattacaaaggagtatttgcaccctatgtcagtttgtaatcctgttttagatatagagaaatataagcaggattatggagagcgacttgtgacaggtactcctagtttcggaggagatcaaatgtattatggatattctgcatttgactatctaaaagatatgacgaaagagactaaagcttcgctccaagtaagtgataccgcaaaacaagctgcatattcgggatcaattgctggaggaacctattttaaatcagcgtattcttattcatctaaatattcatttgcaagtattgatgctgtaagaaagttgaagtatatcagaattaatgatgaaaaaagtcggttaatgaactatctgtcaagtagttttaaagaagatttgaacaggctgccagcagaaaaattagttaagaggtatggaactcacgtattgaccaactttacaataggaggtcgttacaaattactttttagatctgtgattacaaatacaacggaaaattctgtaaaaagaaaaactattgcttctggattaaaggcacttgtgggtgatataggaataggcgttaattttgatcggaatgttgaaacttcggaaacattaacacgtgagaataaacatcgaatgctttatgttcttttttatggaggtacaggaactagcttggtttatgatttggagaaaggattgccaacaagaattgatatacagcactgggaatcaactgttaatttaactaacgctaatttgacagatataaattgggaagaaacttatccgatatatgagtttatacaggatcctcagaagagagcagaagtgaaaaatgctgttgatcaatatattgcagggcagcaaatcaaagtattggaactgagacctatgtataggatgcatagcaaacgtcaaaaaaatactttttatgtatttacgaaatctgatgctgattatatttctaaaaaatggggagatgaatcgaacggtattgatggatatatctgtgtaaatcccgagcctaatacaaaaccaatgtatagcctctttagtaaaagaagtgaaaacactttttatgtgtatgataaggccgaggtagattatatcgtacataaatggggagatacattttatgggcttgatggttatatgttaactaaaccggaagataatactaaaccggtctattgtttacatagtaatagggctaaaaatactttttttgtatttgataaaggagaagcagatcgaattgtgagagaattcggggatacttataaagggcttgttggctatttttacgatgcggattaa

SEQ ID NO: 1716 - DNA, 1053 bp, B.fragilis
ccaatcatgaaagtaattgtagataacaaaataccttacatcagagaagctatcgaacaaatagcggacgaagtaatatacgcccccggaaaagattttacgcctgaactagtgcaagatgccgatgcgttaatcatccgtacacgcacccgttgtgatcgttcactgcttgccggaagcaaagtaaagttcatcgcaactgccacgatcggattcgaccacatcgatacggcttattgccgtgaagccggcatcacatggactaatgctccgggatgtaattcggcttccgtagcacagtatatccaatccgcactatttatcttacagcagacccgtggtatgaaattgaatcaaatgaccatcggtattgtaggtgtgggaaatgtaggaagcaaagtagctgatgtagcacgaaaattaggaatacaagtgatgctgaatgaccttccgagagaagagagagaagaaagtacaatgttcgcttctttaaaaagtatagccgaaaaatgcgatattatcactttccatgtacctttatataaggaggggaaatataaaacgtatcatttggcggacaagcatttcttccattcgctgaaaaaaggagcggtaatcatgaacacttcacgcggtgaagtcatcgaaacagaagcgctgcttgaagctctccggtccggcattctgtctgatgctgtcattgacgtatgggaacatgaaccggatatcgaccttgaactgctggagaaagtaattataggtactccccacatcgccggatattcagcggacgggaaagcaaatgcaacccgaatgtcactcgaagccttatgccggttcttcctgatagaaaccgactatcggattactcctccggaaccgaagaataaactgatttctactgcaacttatgaagaggcatcccttatgatttacgatcctcgcagagacagtgatgccctgaaatctcacccggggctcttcgaacaacttcggggagactatcctttaagaagagaggaaggtgcgtatcggatcgtaataactaaataa

SEQ ID NO: 1717 - DNA, 624 bp, B.fragilis
caggacatgaattattttttattggcggaaaccgatttcttccgccggataaacgaagccggggactgcaatatggaaaaagcatacacggttttcgccacccaagtgattgaactgtgtatcggcagcccggacacgaaccggaccatcatcgcattggcttacatcgaaatcgagttacagcatcatcccgtgcataaccttcccgaagaaaagaaggaaatagccaactatgtcagcaaggctctctctttcgtaaggaagatgcagaagtttcttgccgctccccaagtgccgccactaatccctatccaaacatccaccgacaacacaaacgataataccgcctcacccttgcaatggacaggcaacgccatcgacctcgtggagctgatatacggcatcaacgagatgggctgtatcaacaacggcaatatgccgctcaaacagcttgccccacttctgtacaagatattcggtgtggaatcaaaggactgctaccgtttctacatcgacatcaaacgccggaagaacgagagtcgcacctatttccttgacaaaatgcaggaaaaactgaacgagaagatgctccgtgacgaagagatggagcgcatgagaagatag

SEQ ID NO: 1718 - DNA, 792 bp, B.fragilis
tttgtaatgaaagaaaagatgaaggaaaaactgacagtcattaaagtcggaggtaagattgtagaagaagaagctacattaaatcagttgttgaatgattttgcagccattgaagggcataaagtgctggtgcatggaggcggacgttcggcaacgaaaatagccgcgcaactgggtatagacagcaaaatggttaatggacgccgtatcactgatgctgagacattgaaggtggtgactatggtttatggcgggctggtgaacaaaaatatcgtagccggattgcaagctcgcggtgtcaatgctttgggattgaccggggcggatatgaatgtaatccgttcaatgaagcgtcctgtgaaagaggttgattatggttttgtcggggatgtagagcgtgtggattctacgctactttccgatctgattcataaaggtgttgttcctgtgatggcgccgttgacgcatgacggacaagggaatatgctcaatacgaatgcagataccattgccggagaaacagcaaaagccctttctgctatttttgatgtgactttggtttattgtttcgaaaagaaaggcgtgcttcgtgatgaaaatgacgatgagagtgtcatcccccaaattaatcatgccgagtttcaacgctacattgccgagggggttattcagggaggaatgataccgaagcttgaaaattcttttgaggcaattaatgcaggtgtgtctgaggttgtaattaccttagcatcagctattcatacagatgggggaactcggataaaaaaataa

SEQ ID NO: 1719 - DNA, 1518 bp, B.fragilis
agagcaatgaatattacaaagattataagcaaagtttttgattcccgtttaaaagcaatagatctttacgatacacaagccggagaaatacaacaccgggtattgactcgtctggtgaaacaagcagaaaataccgaatggggaaagaagtacgattataaatctatccgcaattacgaagactttaaaaatcgcctccccatacaaacctacgaagaagttaaaccttatgtagagcgtctccgcgcgggcgaacaaaacttgttgtggccttcggagatacgctggtttgccaaatcttcgggtacaacaaacgataagagtaaattcctcccggtcagcaaggaagccttggaggatattcattaccggggcggaaaagatgcagctgcaatctactttcgcatgaaccccgaaagtcgtttcttttccggtaaaggattaattctgggaggtagccacagcccgaacctcaactccaaccacagcctggtgggcgacctttcggccatattgattcaaaatgtcagtccactgatcaacctgatacgcgtgccaagcaaacaaatcgcgttaatggacgaatgggaggctaagattgaagctatcgccaacagtaccataccggtggatgtgaccaacctttccggtgttccttcctggatgctggtactcatcaaacgtatccttgagaaaacaggcaaacaaaccttagaagaggtatggcccaatctggaagtatttttccacggcggtgtggcttttaccccctaccgcgaacaatacagacaagtcattcattcttctaaaatgcattatgtcgaaacttataatgcatcggaaggctatttcggcacacagaatgacctttccgacccgtctatgctattgatgatcgactatggtgttttctacgagtttattcctttggaggatgtagaaaaagaaaatccccgtacttattgcctggaagaagtagaattaaataagaactatgcaatggtgatttccacctcttgtggattatggcgctatatgattggggatacagtaaaattcacccgaaagaatccgtataaattcgtcattaccggacgtaccaagcacttcatcaacgcattcggcgaagagctaatcgtagataatgccgagaaaggacttgccaaagcctgcgccgaaacaggagctcaggtcagcgaatattctgctgctcccgtatttatggatgcaaatgccaaatgccgtcatcaatggcttattgaatttgccaaaatgcccgattccatcgagaaattcgcaatgatactggatgctaccctgaaagaggtcaattcggattatgaagcaaaacgatggaaagatattgctctccagccattagaggtaattgtagcacgcaagggcctctttcatgactggcttgcgaagaaaggaaaattaggcggtcagcataaagttccaagactaagcaatacaagagattatattgaagaaatgattgctttgaatgaacggtga

SEQ ID NO: 1720 - DNA, 522 bp, B.fragilis
agattgatgaatatggattataagtatatagaacagcttttagagcgatactggcaatgtgagacttctctggaagaagaatcggaattgcgctctttcttttcggaggaagaggtgcctgctcatttgctccgttacaaagaactgtttgtttatcagactgttcaacaggaggcagggctgggaaaagactttgatgcacgtattctggctcaggtagaggcacctgtggtaaaagcaaaacatctgacaatggtcggaagatttatgcctttatttaaggctgctgccgtggttgcattgattttatcattgggcaatgtagcacaacatacattctttgccgaagaggctttggattataattatgatgcttacaaggacacatacgacgatcccgaagtggcttacaaacaagtttcttctgcgttgatgatgttgtctgaaggtataaataaatcgcaggatcaggtcgtaagagacagtgtaaaggtcgaaccggttcgtgtgatgaaggaataa

SEQ ID NO: 1721 - DNA, 411 bp, B.fragilis
accaaatcgaagaatttgcgggttgcaccatctaaaaaaagagaagccatgaaacgtgacataatcattatagaggacaaggccgtcagcgtaaccggtaacgagatatggatgaccgccggagaaatcgccggactgttccacacgggtgtcccgacagtgaacgccgccatcaaagccatcctcaaagcggatgtgttgagtgactacgaagtatgccgctacattcagcttgaaaacggtctgtatgcggatgtttactcgcttgagatcatcatccccatcgctttcagattgaacacctactgcacgcacgtgttccgcacgtggctggtgggtaaagctctctcgaaagaaaagcgacaggcatacgtgatgttcatacagaacgggaaagccgggtattgctga

SEQ ID NO: 1722 - DNA, 1800 bp, B.fragilis
caccctcagaataaaagtatggatattcaattatcagcacaacaacaagctgttgttgattgtaacgagccgagaattgtcgtgaaagcttgtccgggaagtggaaagactttctctgtggctgcgcgtatggcaaaacttttacaagagaataatctatcgagacatcaaggaattgcagccatatcttttaccaacaccgcatgtgaggttatacaaaaagaacttaaagagacattcggttgtcgaaatatagattatccttcatttatagggacgattgatagttttataaatacgtacatatttttgccttatgctcatttagtcatgggatgcaattatcgtcctgaaatagtaggaaccacgtttaacaaatggttcgattatgatccgacccaaacaagatatattagaggtaagctcggtgaacgaataattacatctcgtgatgccaactactatttcgatctcatatcgtttgggcttaatgatcaattattgcgattggccccatatcaggcatatcatttcggaaaagcagattgggataatcccaataagaaagatggttcacccaaaaaggttatatctgaattgaaagaaatgaaatggaaacatttcaatgcaggcaaggtcaatcaggcagatgcaatatattttacattcagaatattagataaatatccttcaatagcacaaaatattgttcgtcgattcccgattttaataattgatgaagctcaagacacaacagagttgcaaatggctataattgataaattatctcagtgcggagcagaatctattatgttgattggggatcctgaccaagctatttttgaatggaatactgccaatccacatttatttatggagaaatacaatagtccagattggcattcattagatctgtcggaaaatagacgtagctccgaaaaaatatgtcaattagctaatcatttctctggaaatgaaatgtgttcaatagcaagcgacaaagattacacagacgagccatgtattaaaggtcatctcgacactccagaatcagtcaatcaaattacgaatcatttcatcgaaaaatgcaatgagatgggattggatgaatctgaatatgcagttgtatttcgaggacaaaagtttggcgagacaaactttggattagtaaacaatgataattcatcaaaacagaatagtccgtggataaacgggcattacggcgttagagatattgtatatggaaaatatttgattgatcatgggaaatatactgacggactatctcttatagaaaaaggctgctataaaatcacaaagcgagttcggtatgtttcctcaagtactatgcgaagagaaatagcggaagtagggtttagaagacatagagcagagatgtttgattttattcaaaaattaccttcaacgaatgatacactgtctaattggattacgaaacttcaacaaatgggcataaatctaactgttgatttgggaaaggctaatgtccgtattgaatccctttttagaacagtaaatcatcaatttcggcaagaacgaccttacctgaaaacaattcattcggtaaaaggtatgacattagaggctattttagtatttctgtctaaaaaagctgtccacacgaactatacaacgattttgaataatcctgcaaagtattctgttgacaataatgaagaactccgcattgtgtatgttgcatgtacacgacctaagaaattgttatggatagccgttccatcagacgatattgattgttggagaaataaattgttctaa

SEQ ID NO: 1723 - DNA, 1470 bp, B.fragilis
ataaaatttgatggtatgacaaagccgttagtatcagtcgttattcctgtatataatatggaggagtttctggaggagacactggactctgtcctgtcttctgattatccgaactttgaggttattgtgatggatgatggttcgaaagaccgttctctcgaaatagccgaaagctataagtcccggtatgaaaatgtaagggtttacacacaagtaaatagtggcgttgctacggctcgtaatcatgctatttctaaagcaggtggagtatatattttaccggtcgatgctgataatcgtattagtaaagaattgattcattctgctgtagatatactggagtcggagccggaagtaaaagtggtctgtccacgtgccgagtttttcggagaccgttcgggcgaatgggtattaccacctttctcgctatcattgcttgctcgtaaaaatatgatggatacttgtgctgtttaccgtaagtccgaatgggaaagaattggaggatactgtgcggagatcgtggctcgtgaagattgggaattttggatctcaatgttaaaggatggaggaaaggttgtaaagttaccggaaataggtttgttttatcgggtgcgcgaacagtctaaacgtgttactgaccgtttgctaaaaaagcatgtgattgacgttctaaatagacgacatcctgatttctttgagcgggaattgggagggccgttacgttatcagcgttcctggtcaaggttaatcaatcggatttcccgaataatccaccctcggagagtcttcgttggagatgattttcaggacttatcttcttttgtacgtgtattacctgtgcattttgagaatggaggaacgttgatatatgaaggaagaaataaattgaaagagtttgaaatacatggtagaaagttgatagtgaagtcatatcagcttcctcacctaattaatcgagttgtttataattcttttcgtgcctctaaagcccgccgttcttatcaatacgcacagatgctgcgtaaagcaggtattggctctcctgctcctgttggattttattctacgggaacatggttgttgtttggccgtagctactttgtgagcctaaagtccgaatgtccttatacgtatcgtaatctgttagaggagacttttaccggtgacaaagaaaaggtgttacgtgctatagcccgtaccacagcagctttacacgaaaacggttttctacataaagattactcgggagggaacattctttttagggaaacggataaaggcattgaagtggaaatcattgatttaaaccgcatgcgttttggtaaagtcgacatagaaaccggttgtaagaactttgagcgcttgcccggaacacacgagatgtttgttatcttggcagatgaatatgccaaagtgaggggattcgatgccgatagatgtctggaactgattgagaagagtcatttatga

SEQ ID NO: 1724 - DNA, 1032 bp, B.fragilis
ctgtttaatgatatgaatgatagtcttttatataaactttccagtggcaagcctcctaagtttatttattttataagtaatactttgaatatgcttattccgaatgctttttatcggtataagttgaaaagtacattggctcaattacagtatcgttcggataaagactatatcgaagagagggtgaattattataataagctgtcttctccttcttctttgccggaaaagtcttttataaagaatgaatttcggtatttgatctttttaggaactcttgcggacaataaaaaatctctttttcataccgcatatttttttgataccagggaatatacccgttggtttaaacaatctcttcggtggggatattgcccgggcgatgtatatttcactccggaattcccgtctattgtgaaaagccgtttactgaccgattccaatgataactctgttgttatgaaactggataagttcaggcattttatgtttgtaaatgatacaatgcctttttcttctaaaaaggatatggttatcttcagagggaaaatacgacgaagccgtacccgtaaattatttttagagatgtatatggaccatccgatgtgtgactgtggagtcgttggtaaggatgagggagtaccggacgcatggatgactcctaaaaaaacgattcgtcagcatttggattataagttcattatggcattggaggggaatgatgttgcatcaaatctgaaatgggtaatgtcttctaactcgatagcagtgatgccgcgtcccacttgcgaaacttggtttatggaaggaaaattgattcctaactatcattatattgagattaaacccgattttacggatttggaggaacggttgaagcattacatcgaacatccggaagaggctcaacaaatcatagagcatgctcatgaatatgtggctcagttcagaaatcctcgtcgtgaaaagttaatatcgctgttggttctggataaatattttcggatgacaggtcaaaatattgaagattga

SEQ ID NO: 1725 - DNA, 1977 bp, B.fragilis
aaggtgcgtttcgacaatgcatctattgtagtatattattgcttaatccaaatgaatattataaatttaggaattcttgctcacattgatgcaggaaaaacttccgtaaccgagaatctgctgtttgccagtggagcaacggaaaagtgcggccgtgtggataatggtgacaccataacagactctatggatatagagaaacgtagaggaattactgttcgggcttctacgacatctattatctggaatggagtgaaatgcaatatcattgacactccgggacacatggattttattgcggaagtggagcggacattcaaaatgcttgatggagcagtcctcatcttatccgcaaaggaaggcatacaagcgcaaacaaagttgctgttcaatactttacaaaaactgcaaatcccgacaattatatttatcaataaaattgaccgtgacggtgtgaatttagagcgtttgtatctggatataaaaacaaatctgtctcaagatgtcctgtttatgcaaactgttgtcgatggattggtttatccgatttgctcccaaacatatataaaggaagaatacaaagaatttgtatgcaaccatgacgacaatatattagaacgatatttggcggatagcgaaatttcaccggctgattattggaatacgataatcgatcttgtggcaaaagccaaagtctatccggtactacatggatcagcaatgttcaatatcggtatcaatgagttgttggacgccatctcttcttttatacttcctccagaatcagtctcaaacagactttcagcttatctctataagatagagcatgaccccaaaggacataaaagaagttttctaaaaataattgacggaagtctgagacttcgagacattgtaagaatcaacgattcggaaaaattcatcaagattaaaaatctaaagactatttatcagggcagagagataaatgttgatgaagtgggggccaatgatatcgcgattgtagaagatatggaagattttcgaatcggagattatttaggtactaaaccttgtttgattcaagggttatctcatcagcatcccgctctcaaatcctccgtccggccagacaggtccgaagagagaagcaaggtgatatccgctctgaatacattgtggattgaagacccgtctttgtccttttccataaactcatatagtgatgaattggaaatctcgttatatggtttgacacaaaaggaaatcatacagacattgctggaagaacgattttccgtaaaggtccattttgatgagatcaagactatctacaaagaacgacctgtaaaaaaggtcaataagattattcagatcgaagtgccacccaacccttactgggccacaatagggctgacgcttgaacccttgccgttagggacagggttgcaaatcgaaagtgacatctcctatggttatctgaaccattcttttcaaaatgccgtttttgaagggattcgtatgtcttgccaatctggtttacatggatgggaagtgactgatctgaaagtaacttttactcaagccgagtattatagcccggtaagtacacctgctgatttcagacagctgaccccttatgtcttcaggctggccttgcaacagtcaggtgtggacattctcgaaccgatgctctattttgagttgcagataccccaagcggcaagttccaaagctattacagatttgcaaaaaatgatgtctgagattgaagacatcagttgcaataatgagtggtgtcatattaaagggaaagttccattaaatacaagtaaagactacgcctcagaagtaagttcatacactaagggcttaggcgtttttatggtcaagccatgcgggtatcaaataacaaaaggcgattattctgataatatccgcatgaacgaaaaagataaacttttattcatgttccaaaaatcaatgtcatcaaaataa

SEQ ID NO: 1726 - DNA, 2112 bp, B.fragilis
agaggaagccttcatccgggcgatgcagcgcaagaagaaaaagaagaagcgcaagggcttggggacgtaatcaggagtatcaacaatcaaaaaaatcaatgtatgtcacagcaagaagacgatttgagggcattggcgaaaatcatggattttctgcgtgccgtgagtattattttagtggtcatgaacgtgtattggttctgctatgaagccatccggctttggggtgtggacatcggcgtggtggacagaatactgatgaacttcaaccgcacggcggggctgttccgttccatcctgtacactaaactgtttgccgttctcctgcttgccctgtcctgtctggggacaaagggcgtgaagggtgagaaaatcacttggggacgaatttggacggctcttgccgttggcttcgtgctgttcttcctcaactggtggatactggcattgccgctgccgatagaggcggtgacgggactgtatatcctgaccgttggcgcaggctatgtctgcctgctgatgggcggtctgtggatgagccgcctgttgaagcacaatctcatggacgatgtgtttaacaacgagaatgagagcttcatgcaggaaacacggctcatagaaagtgagtattcggtcaatctgccgacacggttttactacaaaaagcgttggaataacggctggatcaatgtcgtgaatccctttagggcttccattgtattgggtacgccgggcagcggcaaatcctacgcagtggtaaataatttcatcaagcagcagattgaaaagggcttctcgatgtatgtgtacgacttcaaattcagtgacttgtccacgatagcctacaatcatctgctgaaccacccggagggctacaaggtgaaaccgaagttctatgtgataaacttcgacgacccgagacgctcacaccgttgcaatcccatccacccggatttcatggaggacattacggacgcttacgagagtgcgtacaccattatgctcaacttaaataaaagttgggtgcaaaagcagggcgacttttttgtggaatcgcccatcatcctcttcgcggctatcatctggtatctcaaaattttccggaatggcaagtattgcacgttcccccatgccattgagtttttgaaccgccgctatgaggatattttcccgattctgacctcttacccggaactggaaaactacctttctccgttcatggacgcatggctcggaggtgctgcggagcagttgatgggacagattgcgtcggctaagattccgctctcgcgcatgatttccccgcaactctattgggtaatgtcggacagcgagtttacgctggacataaacaatcccgaagagccgaaaatcctgtgcgtgggtaacaatcccgaccgtcagaatatttacggtgcggctctcggtctgtataactcccgtatcgtaaagctcatcaacaagaaggggatgctgaagtcgtcggttattatagatgaactaccgacgatatatttcaaggggctggacaaccttatcgccaccgcacgaagcaacaaggttgccgtgtgtctgggctttcaggatttcagccagttggtacgcgactatggcgataaggaagccaaagtcgtgatgaacaccgtcggcaatatcttctccgggcaggtggtaggcgaaactgccaagacgctatccgaacgcttcggaaaggtcttgcagaaacggcagtccatatccatcaaccggcaggatgtttccacctccatcaatacgcagatggacgcgcttatcccgccaagcaagatttccggcttgacgcagggtatgtttgtcggttctgtgtccgataacttcaacgagcgtatcgaacagaagatttttcactgcgagattgtcgtggatgcagagaaggtgaaacgcgaggaaaaagcctacaagaagatacccgtcattaccgacttcacggacgaaaacggtaacgaccgcatgaaggaaacggtgcaggagaattacaggcgaatcaaggaggaagtcaagcagattgttcaggaggaactggaacggattgccaacgacgaaaatctgaaacatctgttacagcagaaataa

SEQ ID NO: 1727 - DNA, 750 bp, B.fragilis
gcagtgggagaagattataaaacccgtatcttgcgaaatggttactcgttgcgtacgtactatcatcgtctgtctgtggagtataccaaaatgagggaatacgcgaaagctaaagaatgcattgataaaatgttggcggaaaaaatggatgatctgacttgtgaggcatgcgaactgaattttatgttggattattatcttgaaaccgggcagtttgaggaagcttataatcgtgcccaacctttaattactagacaggtctcttgttatgaagctaacctgagagcctatatgaagttggcttattatgcctgtaaagccgggaagccggaaattgctgccgatatgtgtgcacgggctgaagaagctttggttgggagagaaaaagatgaatatttgttgctatatctcgggttgtttattgcctattattttatgacccatccggatcggggctgggagtatgcagagcgttgtattccctggagcctgaatactaatatgcagaaaaaatatcgtttttcgtgtgatatggtagaggctttgagttatgaatcccatgaagaagtcagtttgtccctgccggaagaatttccgctttaccgggcagacggaatatactcagttgctgcattgcgtgattatttttataaacaagctacccaattggcaagcttgtatgacacacgtaacggaaataacggatatcaggaacgattatttaatgtcaatttaattggcaacctgtag

SEQ ID NO: 1728 - DNA, 702 bp, B.fragilis
ttcttgttggatatattgagtatgcgtattttatatgttttgttttttcttttgactttaaactcatgtcaaaaagtgaaagaaaaagaagttgtcaggctgatgaaagagtggaatagaaaagaagttctttttcctgatgatttgctatttactgtattggaaaaagatacattaaaggagattcctaagagtgattatactataattacttatgttgattctattggttgtacgagttgcaaattgaaattgcagaactggcttcttcttgaaagaaaattgagaagcataacaaataaaagggtctcttgtctatttgttatacatcccaagagtaaaaaagaggttaactatattttacaggagaatcattttgattgtcctgtctgcattgatgattctgatatattcaataagttgaataaatttcctgcaaatattatgtatcagacatttttacttgatgcgggcaataaagtagtggctattggaaatcccattcataatgatagaataaagaaattatacttggatattatttctggaaataagatgacttctaaaaagggaagtatgcaaacagaaataactgtttctgaaacattatttgattttgggaaaatttcgtttaaagaatcacaaaagtgtatttttatgttacaaagttactacaaaaaagtggaatgcggaagaatgtag

SEQ ID NO: 1729 - DNA, 1800 bp, B.fragilis
aaattactggaagaagacaacgataaaaacagaatggaaaaagaaggtaataatctgtttcaggtcaatcttaaaggtatgattgccctgttgtcagagcatatttatagtaatccgaatacttttgtccgggagttattgcaaaatagtgtggatgccatcactgcattgcacaacatcgatgaaaattactccggacgtattgatgtcttcctgaatggggatggctcgatggtctttcaggacaatggaatcggactgaaggaagaggaggtataccgtttcctcacagtgataggtgaaagttcaaagagagacactcccgatgccgacgattttatcggtcggtttggtatcggcttgttgtcttgttttgtggtgaccaatgaaatcagggtagagagccggtcggcaatggggggaaatcctgtttgctggtgcggaaaggtggacggtacttatcagactactttccccgatgaagagtgggagatcggttcaagggttgtgttgaggcctaaaaatgaatgggctcatctgttcgaatacgaagtgtttaaaaagatattggtaaattatggagaagtcttgccatatcctgtctatttacatcgtggagaagaagaagagttggttaataccccatcacccgtctggcttgatccgaaagctacccggaaagagttattggattatgggacaaaggtcttccaatcgtctgccctggatgcatttcctatacggacagagcatggacggatagaaggtgtactctatgtattgcctttccgtacgcaattctctgtgcgtaattcgcataaagtatatctgaagcggatgttgcttagtgaggacgattgcaatctgttgccttcttgggcattttttattcgttgcctggtgaatgccgacggactgctttccacagcctcccgcgaatcatttgtcagcaacgattcattgaaagatgcccggaaagagattggggtcgctatcaaggaatatctccgggctttggtgcagaacaatcggtccgtttttaataaaatactggatgttcatcactttcacattaaagccattgcttcggaagataatgagttacttcgtctgtttatggattatcttccgtttgagacgaataagggaataagaagtttcggtagtatccgttcgtcaaataatactatttattatacacgcaatctggaagatttcaggcaagtgcgcagaatagccggtgcacaaggcaggctggtagttaatgctgcttatacattcgatgaaacgttgctgaaaaaatatatccggcttaatcaagaactgtctttagaggagatttcacctgcccgtctgttggaagagtttgccgaagtagaaggcaataaagagcaccggtcttttgaaacgaaagccagtgaacttttgaaacgttttgggtgtatttgccggttgaagcatttcactccggtggatactccggttatattcgtagccgaagaaaaagaagagaacagtaaagtcgccaataatccgttggcggcggtattgggctcggtaaatgccaaaaaacgtttgccacccacattgactttcaatgccgacaatgagatggtgcagacattgctgagaatccagggagacaacaagttgtttcagcatgttgtgcacattctgtatgtacaatcgcttttgcaaggaaaatatcctgtgaacagtgaggagatggaacttttcaatcactctctttctgaattgatgactgccaaaatgaatgattttataaactttctcaattaa

SEQ ID NO: 1730 - DNA, 630 bp, B.fragilis
ataacaatggaatttaagtcacttaaaaacatcgaatcatcgttcaggcagatacgcctgttcggtatcgtcttcctctcgctgtgcgccgtgataacggtatggagcgtgtggagttcctaccgcttcgcggagcggcaacgggaaaagatttacgtgctggacaacggcaagtcgctgatgctggctctctcgcaggacttgtcgcaaaaccgtccggcggaggcaagggaacacgtgcgccgcttccacgagctgttcttcacgctctcacccgaaaagagcgcgatagagcataacgtgaaacgcgccctgctgctggcagacaaaagcgtgtacaactactattcggacttcgccgagaaggggtactacaaccgcatcatcgccgggaacatcaaccaagtgctgaaagtggacagcgtggtgtgcgacttcaacggctatccctaccgtgccgtgacctacgccacgcagaagatcatccggcaaagcaacgtcaccgagcgcagcctcgtgacgacgtgccgcctcttgaactcgtcccgttcggacgacaatcccaacggtttcaccatcgagggattcaccatcatcgagaacaaggatttacaaaccatcaaaaggtaa

SEQ ID NO: 1731 - DNA, 1839 bp, B.fragilis
gtaatgaaggaattttttcaacttatgaagcgttttgtaccaccttacaaaaaatatgtaatatgggcgttggtacttaatctattatcggctattctgaatatattttctttttctttgatagctcccattctacaaatattatttaaagttgataaagatgtatatgaatttatcccatgggatacggttacaataagtaccaaggatcttctgataaataatttttattactacgtttcagctatgattcaggccaatggagcttcttttaccttgatgatattgggcctttttttagtggtaatgactttttttaaaacattttgctattttgcatcgtcagctgtgatgattcctttacgtactggggtagtacgagatattagagtaatggtttatgacaaggtccttcgcttaccacttggctttttctccgaagagcgaaagggggatattatagctcgtatgagtggagatgtgggagaaatagagaactcagtgactagttcattggatatgttagtaaagaatccgattttgataatcgcttattttactacgttgcttgtcataagttggcaattaactctttttactttgttggttgtgccattgatgggatgggtgatgggtactgtaggcaaaaaattgaaacgacagtcgcttgaggctcaagcaaaatggagtgatacgatgtcacagcttgaggaaacattagggggacttcgtatcatcaaagctttcatagcagagaataagatgataaatcgtttcttgaaatgcagtaatgagtttcgggatgctactaataaagtcgcaactcgtcaggcattggcacatccgatgagtgaatttttgggtacaacgatgattgtaattgtgctttggtttggtggttcgctgatcttgagtagtcattcttcaattgatgcttctacatttatggtatatttgacgattctttatagcgttatcaatcccttgaaggaattttcgaaagccggatataatatccctaagggactggcttctatggagcgtgtcgataagatactgaaagcagaaaataagattgtggagattccgaacccgaaaccgttgaatgggttggaagagcaagtcgagttcaaagatatttctttcagttatgatgggaagaaagaagtacttcaacatattaacctgactgtacccaaaggtaaaaccattgctttggttgggcagtccggttcaggaaagtctacgttggtagatttattgccacgctatcacgatgtgcaggaagggacgattactatagacggagtcaatatcaaggatgttcgtatctctgatttgcgcagcctgataggaaatgtcaatcaggaagctattttgttcaatgatacattcttcaataatattgctttcggcgttgagaacgcgactatggagcaggtgattgaggccgccaaaatagccaatgcacacgattttatcatggagaaagaagacggttaccatactaatatcggtgaccggggcagcaagctctccgggggccaacgccagcgcatcagcatagcccgtgccatcttgaagaatcctcccattttgattcttgacgaggctacttccgctttggatactgagtcagagcgtttggtacaggaagcgctggagcgtttgatgaaaacacgtacgacgattgctattgcccaccgcctctctaccatcaaaaatgcagatgaaatttgtgtgctgtacgaaggggaaattgtagaacgcggaaaacacgaagaattattggctaaaaacggatattataaacgactgaatgatatgcagtcactatag

SEQ ID NO: 1732 - DNA, 408 bp, B.fragilis
attttacgggatttcagaagattaaatagatttatgaacttatttcatagtagaatctccacaaaatccattcagtcgtatctaaactttagaaattacttgggattttgtggagattctatttatgtacaaatgatagcttttcttagatacttagggtatatacagcagcgcaaactccgcctttctccgtttgagcagcatggcatggcgtttacccttgtagttgcagaaagcgatatactcccgataaatgttcctgtcacccgcctccagtttccggatcagcgtgcttttgggtattttcccgttccccaacagacggtatggaccgacattgtaggcgagcgtggcaaggagcagactatctttcccgaactgccggaacattgcgcagaactttcgtag

SEQ ID NO: 1733 - DNA, 360 bp, B.fragilis
ttttataaactttctcaattaaacgaaagcatgaaatatacacttgaaatacaaaaattactgttgcaggcacaaaacgacaacctgcatccccgcgaaaaggccaatttgctgagagaagctattcgcattgcagacgagaatgaagatgtacaatgggctgtggagatgagattggatcttatttacgagctaaatctcctttcggctgatgctgaagaaattgctgtgttttctaaaatcctggacagttatgaaaatcataaggaccagataaatgaagatgatattttatggaaatataaatggatatggtcttgtacattcgatcttcccagcataccgatggaacaggtatag

SEQ ID NO: 1734 - DNA, 1425 bp, B.fragilis
cgggttgtttgccatgttgatggagagtatctgcgacttctctttctccgtaagccccaacagggactgtatggcatcaaacttgttcatgtacttccgctggtcaaggagtatcttgcagtcggagttattgatgatgctctccttgaccacgggcgaggaaatgatgtcgtccacctcctgcgtcaccacgattgcctccccgtaatacttgcgcacggttttgtacatatagcgcaggtactcagccatgttcgccgaagagagagccttccaagcctcttccactatcagctgtttccttacgcctttcaatcggcgcatcttgttgatgaaggcttccatgataatgatggtcacgaccgggaaaagctcgcgattttcctttatcgaatcaatctcgaagacgatgaaccgcttgccgagcaggtcgatgttctccgtggagttgagcaggaagtcgtagcgtccgccccggtaatactgccgcatggtggtgagcatattgtcgatgttgaaatcggacttctccacctttatctcacgttccgccagttcgcagcggtagtcgtcgcgcatatactcatagaaggtgttgaacgaggggacgatgctccggtcagccctgatacgctcgatgtatgcgttcaccgcactgcccagttcgccgctctccgttttcgtaactttgtcgtcctccgacttccagagtgtcagcagcagcgtcttgatgctgtcctttttctccacgtcgaacacgtaatcatcggtgtaaaacggattgaacgaaatcggtttctcctccgtgtaggtgaagtacacgccgtccgccccgtttgtcttgcgccggatcatctcgcacaagccctgataggagtttcccgtatccaccagtaccacgtgcgtaccctgctcgtagtattgcctcacgaggtggttcataaagaaggatttgccgctgcccgaaggacccaacacgaacttgttgcggttggtcgtgatgccccgcttcatcggcaggtcgctgatgtcgaggtgcaacggttttcccgtaagcctgtccaccatcttgataccgaagggcgagagcgaactgcggtagttggtttcctccgtgaaaaggcacaccgcctgctcgatgaaggtatggaaactctcttccgccgggaagtccgccgcgttgccgggcatcgccgcccagtagagcgtcgggcagtcgatggtgttgtggcgcggcacgcactccatgcttgccagctggctgcctacatcgttctttatatgcttcagttcctccgcgtcatcgctccacgccatgacgttgaagtgcgcccgtaccgaggtcagcccgtaggaatgggcttcgttcaggtactggtctatccattcgcggttgatgctgttgctccggctgtatcgggatag

SEQ ID NO: 1735 - DNA, 354 bp, B.fragilis
cgtatggaactgcttacccgaaacaatttcgagagctggatgcagaaactgatggaacggcttgaccgtcaggacgaactgctgctctccttgcagccgtccggcaaagccccgaacccgatagaacgtatcaggatgttcgacaaccaagacctctgtatgctgctccagatcagcaagcgcaccttgcaacgttaccgcagcatcggcgcgttgccgtataagacgctcggcaaaaagacctattacagcgaggaggacgtgctgacgttcctttccggacacgtaaaggacttcaaaaaagaagatatagccttctacaaggctcgtatccataatttctttcaaaaataa

SEQ ID NO: 1736 - DNA, 1230 bp, B.fragilis
gattggagttgtaaaaatcgccatttcatagtctgttttttatataaaattcgccaattaaaaaaatatgattatctttgcactataatttatcaaggtatggagacagtaaatagaatacttcaagagaagattacagcacgaatcgcgcctaataaagcagtattgatttttggtgctcgccgtgttggtaaaacggtaatgatgcgtaaaattgtggacaactattcaggtaggacgatgatgctcaacggcgaagactacgatacattagcactgttggagaatcgctcaattgccaattatcggcatttattggatggtatcgatttgctggctattgatgaggcacagaatataccacaaatcggtagtattctgaagttgatagttgatgaaataccgggaataagtgtcttggcaagtggctcatcgtcattcgatttactgaataagactggtgaaccgttggttggtcgcagtacgcaatttctacttacccctttttcgcaacgggaaatagcgcaaatagaaaccccatttgaaactcgtcagaatctcgaagcccgtttaatttacggttcatatcctgaagtagtaatgatggagaactatgaacgaaaaacagactacctacgcgatattgttggtgcatacctgcttaaagatatcttagcaattgacggcctaaaaaattcgagtaagatgcgcgatttgctacgattgatagcttttcagttgggcagcgaagtttcttacgatgagttaggtaaacagctcggtatgagcaaaacgacggttgaaaaatatcttgacctcttggaaaaagtattcgttatatatcgtcttggggcttactcgcgtaaccttcgcaaggaggtgacaaaagccggaaagtggtatttctacgataatggcattcgaaatgcgattataggtgctttttcaccattggccattcgacaggacgtcggtgcattgtgggagaactacatcatcggagagcgtcgtaaggcgaatttcaacgaaggactgcataaggagttctatttctggcgcacttacgataagcaagaaatagacttgatcgaagagtgtgcagacagtttgacggctttggagttcaaatggggaaacaagatgcccaatgctccgaaagtgtttcaagaagcatatccccatgccgagttccatgttgtaaacagggagaattatttggagtttgtataa

SEQ ID NO: 1737 - DNA, 891 bp, B.fragilis
ctaacgcactgcatggaacggacggaaatcgacgccatgaggcagataccccttgcggacttcctcgcacggttaggacatgagcctgtccgaagaagcggcaacgagttgtggtatcgtgcgccataccgcaatgagcgcacgccctctttccgtgtgaacgtggcaaaacagctttggtacgacttcggaacgggcaagggcggtgacatcttcacgcttgccggggagtttatcggaagcaacgacttcatggaacaagtgaagttcatagcggaaaccgccaatatgcctatgcctgttcccgaagtgagtaaaccgactttcctgcctaaaccatcagaacctgcctttgaaggagtggaagccgtccctctgcttcgttctccactgacggactatctggcggaacggggcatttcttacgacatagcatcccggtattgctgccgactgaattatggagtgcgtggcaagcggtatttcgccgtcggtttcccgaacgtgacgggtggatatgagatccgcagccgcttcttcaaaggatgcgtgcctccgaaggatgtgtcgctggtcaaggcggaaggctctccggctgacgtgtgtagcgtatttgaaggattcatggacttcctttccgctgccacgctcggattggaaaagggtgactgcctcgtattgaactctgttgccaacgtggaaaaggcaatgaagcatttggacggctacgggtgcatagactgttatctcgaccatgacgaagccggacggcgcacgttgaaaacgctgaaaggacattatggggaacgtatctatgaccgttccgctctctatgacggttgcaaggacttgaacgagtatctgcaactgacaacccaaaaagaacaataa

SEQ ID NO: 1738 - DNA, 534 bp, B.fragilis
cgctgtccccgtgaacacatatcgtttcccgctgaaaggctgtatgttgcgccgtctgtccgggttacggagccatttccgataaaaatcttacgtgagacacgtagtgagctgttaaggccccttttgtttattgccgaattttgccgcagaaaccaaaagaaaggactgaatatgaaagtaataacgatggaaagttccgctttcaccgtattgacggaacagatagccgagatagcggcacacgtgcgtgccgtttccggcgaaagaaaggaaaaattcgcagacaggttgctcaacacccgtgaggcggcgcacctgttgaacgtgagtacccgcaccctccagcgtatgcgcagcgagcatcgcatcggctatgtggtgctgcgcggcaagtgccgttaccgccagtcagaaatcgaccgcctgcttgcggactgcaccatagttgaggatgcggcaacacctacggaactgaaacgcaaccatacgctgcgcacgggcggcagcaaacccaaaggaaggaggacgtga

SEQ ID NO: 1739 - DNA, 801 bp, B.fragilis
agatgtcaccgcccttgcccgttccgaagtcgtaccaaagctgttttgccacgttcacacggaaagagggcgtgcgctcattgcggtatggcgcacgataccacaactcgttgccgcttcttcggacaggctcatgtcctaaccgtgcgaggaagtccgcaaggggtatctgcctcatggcgtcgatttccgtccgttccatgcagtgcgttagttaatgataaacttgatgcccacgccccactgcgtatgaaacttcctcgtgtcgccaccccacaggcaacgctcccggagattggcaagcagggcgatacggtcagccacgtaaaactccacatcgagcgtcagcgcaccgccgtagatgaaggcatcccggtcatggagcatggagccgtcatgcagtaccttttcgccccagttcaccgattcatatccggcaagagccgaagcacctgcatagacgaatacgattttacgggcatcggagagtatcttgaagtagtatccgccctccgccgtgaactgcgccacgggtatcttcccgtccttgtaagggttgttcttcaacaggtattcgccgccaaacatccatttgttcccctttttcgtgtaggtggaaagagccgccccgaaactgtacccgccgtcgttgccgccgggattgaagccgtccgccatgttcgccctgacctcgatgccctgcatcttcggcaggcatcgctgggcgtgcgcctgccccgtacacagggcaagcgacgcgatgattattgcgatgtactttctcatggtcagcgcacttga

SEQ ID NO: 1740 - DNA, 207 bp, B.fragilis
agaccgtgccggattttttgctttttggtcgcgatttttgccaatactattcatgtgcgcataccgaaaacagagtgtaaaatttcaaaattgacaggacatgaattattttttattggcggaaaccgatttcttccgccggataaacgaagccggggactgcaatatggaaaaagcatacacggttttcgccacccaagtgattga

SEQ ID NO: 1741 - DNA, 2424 bp, B.fragilis
ttccgtcgccggctctttctctttccatttctcagaagaagagaatttcaccacttcgccgttgccaccgtcagtggcaatatggagctgccagaacggttccaccgtgaagcggcggttctcccaatagcgtacgcacaccatcgccaacgtgggcgtctgcacccgtccgacggaatatgtgccgtgtccggcagcgatggagagtgcctgcgtgccgttgatgcccacaagccagtcggattcgctccgtgctttggcagtaagatagaggttgtcatacttgcttcccgcttcaaggttgcgcagtccctcgcggatagccttgtcggtgagcgagcttatccacaggcgtacgaaaggcgtagtacatccgatataatggtagaggtatcggaagataagctcaccttcgcgtcctgcatcggtcgccacgatgatctgctcgctttccttgaaaagacgggcgatgatttttatctgcgacaccacgccgctgtcgggtttgtaacccttctccgttttttcctgacggggaatgagcgtgaaggtttcggggatgacgggcaggttgtcacggacgaagccgcgtatgccgtagccgtcgggcatagcaagctggacaaggtgtccgaatgcccatgtcacggcacagtcgcctccctcgaaatatccttcctctctctttgtcgcgcccacgatgcgggcgatctcacgtgccacggatggcttttctgcaatgattgtcttcatgctgattacttttttatgaattgttactttggatttagtggtggacacgggatgttacatcttcatgcccttgatgattttcttctgaggcttctcctgcagcttttgctgtttgtcgtctttcggagcggtctgccctttctgcaacggctctttcaggttcttggtcgcctcgttggtctttccttcgctgttcaccgccacctgtgtgcggctctcgttggacggggcgaccttctgcgcgttgtcggggttggtgtcgtagcggtacggacgtcccttctccgggttgaacttgatgtacatcgtggcgtggaaaccttgcttgtcggtcacgttctccagtttgatagctttgcctgccgcgtaatcggctttctgttggtcggtgaagttcacgccgctccatttactgatggggcggatgctgccgtcggcgttcgtccacgtgttgcggcgttgctctttctgtggggctgcggaattttccatgccctgagcctgtccctgcgtgggattgttcttggcttcctgcgtttgggcggtacgcggcgacctgccggttcccggtacgaactccacgcctcgctgctcgacgttcacttgaagtgtggtgacgaacttcctgccgtcgttgcgttcgatgagcttgtcgcgcacgggcagcccggcacgcagcatatcctgctcctgcttggtgatttccgtctttccgatgcgatccggtatgcgcaccttgtttgccggaatgtccgtgatttcattcgtcttgcggtctatgctgatgaacgaggggatgatttcacccgtttccctgtccacgatgtccacgaccctgccgaggttgcccgtttcgcgcaggttcttacggtcttcgtccgaaaacttgtgttccttgtattcatcgagtttctgctccttgcggatgaagtgcggcacgaggctgacattgccttcaccgtccttcttgaaggaaaggcgggcatccagttcaaaagcctcgccgccgaacttgggcgacactttcaccaaatcggacttgccgtagttgagcatcttctgaaggtcaccggacttttcaaggtcgtcatgtttcacgccccatttctcttccagctcctgccagttgattttgctctcgtcgatgggctggtagccctgtctgccctgcgtctgttgcgggctttcctgcttcttttccatttcttcctgtttttggttttctttgggctgctcttcctgcttttgttccgtctgctccgtctttccggcggtctgttcttccttcacctgcttttcgtagccggaagtgtccaccttgtggggcgcaagcagttccttgttggcttcggggtctttcagcaggtctttcatcacctccatcagtttgtcggcttggtctgctgcgacacggtagaaaccgaagcggctgggttccttgcactgccggaagaagtttttgaagaagttgtccagcacatcgccgtggcggtcgaattgcaggaaactctgcgcgttctccgctttcgcgggggtacgcttgggggaaccgtcggcatccagcccggctaccacgctgatttcgcccgtcttctcgtcacggactatcagcacgtccttttcgctttttttctttgccatttgaaaaatgttttaatgggttatttttga

SEQ ID NO: 1742 - DNA, 225 bp, B.fragilis
tctaagattagcttcctcacctcacggatggactcttcgggtgaaagccgggatacttccttttttgtcaactataaaagagggcttacacttccgaaaactgaattagattctatgagtaaaagaaaacttaccaccaaattcgaagaagaaccccaaaaaatcatttcgatcttccatcttacaccctctgtttttcaggcaatacttcggataccctactga

SEQ ID NO: 1743 - DNA, 1962 bp, B.fragilis
gcaagaaatagacttgatcgaagagtgtgcagacagtttgacggctttggagttcaaatggggaaacaagatgcccaatgctccgaaagtgtttcaagaagcatatccccatgccgagttccatgttgtaaacagggagaattatttggagtttgtataaaaacaaaaaaatatagaaacatgtatttgagtagtttgcatatcagacagtttagagtatttgatgatattactctctatttcaagaatggaataaatattctgataggagaaaataattcaggtaagactgcaattatagatgctctgcgcatatgtctcggatgtggaaaaccagacaattatatctatattcaagaaagcgatttgcacgtcaattccacagttccaactgaaaacaatacgacaatacaatttgacttgacatttgaatttggagatgctctgattgaaagagaatgtttctatgatttcatatcgcaagataaagaagatccagccaagcaaacaatacaattacatttgaaattcatccaagaaaataatgggaagaaaaaatatttcaaacggatgatatggggtggagataatgaaggacagcaggttccttacgaatctttgcaagaaatcttttatacatatttaagtccactaagagatgctgtaagctgtctacgtccttattcttacgacaataagacatctcaattatttaatcaacttacaaaatacaataaaggagaggaagagattgagttaaatgaagaaagaaaagatttgctcgctaaaaacttgtaccatgtttttgaagatgacgcttcggattggaaacatattctaacaacaggaaaaagtaaggtcaacgcccatcttgaagggacgggaataactcgcaaacatcctaatatagaaatgcgttatgttgggcggaaattttccgatgtggtacgaggtgtcgaattaaaatgtccggtgtacaaaacgatcgaggatggtcaagaacaaaaatattttgaattgtatcaaaatggattgggcgaaaataatcttatttttacgtctgtggtgttaggtgaccttatcaatagatgcgaagataatgcgctggaaatctataatgcattgctggtagaagaacccgaagcacatttgcatccacaatatcagaatacgttttttgaatatctgaatgaactacaaagcaaaggacttcaagtatttgtaacatcgcactctccgacgattacggcgaaatcggatgttaataatatttcggttttacaacgaaaacaaaacatcgtacaatcattttcatttggtaaattaacggaaagtgattatccggctgagagcaaacggcatctgcgaaagtttttagatacaacaaaagcacagttattttttgctaacggtgtattattggtagaaggtgtcgcagaagcgattattataccaattcttgctaaaaaatttctctctgagaaaatagacttgtgtaaaagtggaatcgaattagttaatattggaggggtcgcattcaatcattttgggttattattcaacaatgatgatgagagcaagcgacttttgtcaaaatgtgcgattattacagacagcgatcccgaagaagataaagacaaatccgacagagcgcaaaaagctaaagatttagagggacaaaacctgaaagtatgtttggctccacatacccttgaatatgacttgtttgagcaatcggaacacaacaagagtataatgcgagatgtatatcgaaaaatgcacgctcaaacaaatgatttaagaggtgattttaatgcctctactttaatgaaaaaactcaaatctaataaggataaagcggaatttgccttacaactctgtgatagattagaaactgaagtagcgttcgatgtacctgattatataaaggatgctattttgtttgtagcaccctcagaataa

SEQ ID NO: 1744 - DNA, 543 bp, B.fragilis
cttttcaccagctcatccgtcaacttaatagagatgcaagaaatcagcttccgagacgacatattgccattgaaggataaactctttcgtttggcactccgaatcactttcgacagggccgaagcagaggatgttgttcaggatacgatgattagagtgtggaataaacgtgaagagtggacacaattcggatctatagaggcatattgcctgactgtagcaaaaaatctggctatagacagaagccaaaaaaaagaagctcagaatgtagaactcacacctgaaatggaagaagaatccgaaatatccgggccttatgatcaattggtcaataatgaacggatgtcgattatccatcgtctgattaacgaacttcctgagaagcaacggctcattatgcagttgagggatatagaaggagagagctataaagaaatagcaaaaatcttgaatctgacagaggaacaggtaaaagtgaatcttttcagagcaagacaaaaggtaaaacaaaggtatttagagattgatgaatatggattataa

SEQ ID NO: 1745 - DNA, 300 bp, B.fragilis
gttttagtaaggaacgttttcttaatagatagaaaaaatcgtctatatttgttatgtgttactaaaacaaccgagtatatgaaaaagtttttaaaagcaattggctgctttgccatttttgtattggctgtattctcgtatttcagagagcaaccttataagttggattctttgtcgttacagaatgttgaagcattggctgaaggtgaggaatatacacatatttcttgtataggtgtaggctctttggattgtcctgttaatcatagtggtgtgaagtatatatttaaaggatattaa

SEQ ID NO: 1746 - DNA, 597 bp, B.fragilis
cgaacttcaagtgcgctgaccatgagaaagtacatcgcaataatcatcgcgtcgcttgccctgtgtacggggcaggcgcacgcccagcgatgcctgccgaagatgcagggcatcgaggtcagggcgaacatggcggacggcttcaatcccggcggcaacgacggcgggtacagtttcggggcggctctttccacctacacgaaaaaggggaacaaatggatgtttggcggcgaatacctgttgaagaacaacccttacaaggacgggaagatacccgtggcgcagttcacggcggagggcggatactacttcaagatactctccgatgcccgtaaaatcgtattcgtctatgcaggtgcttcggctcttgccggatatgaatcggtgaactggggcgaaaaggtactgcatgacggctccatgctccatgaccgggatgccttcatctacggcggtgcgctgacgctcgatgtggagttttacgtggctgaccgtatcgccctgcttgccaatctccgggagcgttgcctgtggggtggcgacacgaggaagtttcatacgcagtggggcgtgggcatcaagtttatcattaactaa

SEQ ID NO: 1747 - DNA, 819 bp, B.fragilis
gaaataaaaagcaggaaagattggctatatggaaaatattgcatagatttgcccggtaatgcgcattacgataagtttgaacttagacaatttatattcataatgaagtgtatccacattattactccggtaaaagattctatcgagttgacgttgcaaacggctgaagctattttaaaatcagatttcaccgttccttttcattacactatttacaatgacttcagcaccgatgaaaatacgaaacaattgaaggaggcatcccttaagatgggatttgaattggtcaatctgtccgagatcacttctcatccttctcccaattatttgctggtgctccagatggcacaagagaaggccattgccgccgaagcgggattgttgatcgtggaatctgacgtgattgtgaagaaacatactttacagtctctttttgatggtgcgcaggctcgcaaagattgcggtatagctgccgcggtgacagtagatgaacatgaggcgatcaattatccctatttatatgcaaaaggcaaagagaatcaagtcttcccggagaagaagcatcttagcttctgctgctctttgctgacgactgactttttacgtgcttttgatttccattctctgaacccggagaagaactggtttgatgtgaccatttctcatcaggctcttgaaaagggttttgttaactatctgtttactaccttgactgtttggcaccgtccgcatagtagccgtccgtggaaacagttgaaatatactaatccgcttaaatattactggttgaaatttactaaaggattagataaaatttga

SEQ ID NO: 1748 - DNA, 351 bp, B.fragilis
atcaggaaaagaatcagaaaaacaggaagtccgcaccatgacggcggaagtatgcttgcccaagtgcaggcgagtgtggaaatcctgtcgcccgtgccggtaagcggcaaatgcggcgaaaaggactatgacgggcttttcatccgtgaacccgaagtaaaggcacgcgaggggaagatggcatacgtgcgcccggagtaccacgaccgcatcatgcgcatcacccgcgttatcgggcatgacaggctttcgctgtccgcctacatcgaccatgtgcttacgcaccacttcaaccagtgcgaagaggcgataaagagcctttacgccaggaattacgatgcagtattctaa

SEQ ID NO: 1749 - DNA, 1884 bp, B.fragilis
gcaggggaaagccctgtacatggcgaagggaagcagctaataattttaatgcaaataacggaaaatgtgagagacattatgagaagtccagagtatgtattaaacagtctaacggaacacagtgaaaatttgaattacaagtttgaacgcttgtaccgtatctttttcaatgaggaaatgtattacgttgcctaccaacgcatatatgcgaaaccgggcaatatgacagcaggtgcagatgggaaaaccattgaccaaatgagcctgaaccgaattgaacaactgataacatcgttgaaagatgagagttatcagccccaaccctcaaaacggatgtatatcccaaagaaaaatgggaaaatgcgtccattaggtgtaccagcttttaatgataaattattgcaggaagtggtcagaatgatattggaagccatctatgaaagacagtttgaaaaaacgtcacatggcttccgacctctaagaagctgccacactgccttgtctgatattcagaagacattttcgggcgtgaaatggttcgtagaaggtgatattaagggatttttcgacaatatcaatcatgagatactgataggtattctgaaagaacgtatcgctgacgaaagatttattcgcttgattagaaaatttctgaatgcaggatatatcgaagactggaactttcataactcctacagcggaacaccgcaaggcggaattgtcagccctatcttggcaaacatataccttgataagttggataaattcatgaaggaatacactggaaaatttgataaggggaaagaacggaaaagaactaaacaggtagtatcacttgaaggcaaacgacaccgtattctgaaaaagttgaaagtggtaaaagacaaaagtgaaaggtcagaattgataagacaatataaggcttatcaaaaagaaggtttgcagtattctgatggtgacgaaatggatatgaactacagaaaactcaaatatgtgagatatgcggatgattttctaattggaattattggcagtaaacaagatgctatcatcatcaaagaggacataaagaacttcctctatgaaaagttagctcttacactgtctgatgagaaaacacttatcacccatgctgaaaacgctgcaaaatttctcggatatgagatttttgtaaggaaatccaatgacaccaaaagaagcaaatacggagtactaagacgtgtcttcaataagaggatacaattggcacttggaaaggatacgtttaagaaaaagttgctcgaatatcgtgttttagaaataaagatacacaacggcaaggagtattggaaagcaaaatcccgtcccaaactttcaaacaacaatgactttgagatacttgacaggtacaacaaggaaataaagggcatttacaattactattgtttggctaataattgtagtagtctgtcaaaacttgggtatatcatgaaatatagtatgtacaaaacatttgcgcagaaatatcggacaacgatgtcgcaaatccgaaaaaagtacaccaagaatggacttttttcagttagatactatttaaagaacggtactgccaaagacttgaccttttatcatggtgggttcaaaaagaaaaatccaatgaacattaaggatttagacaacttgcccaaattcacatatcatcctacaaacacaagtcttatagataggctgaaagcggaaaaatgtgaattatgtggagcagtcgataagttagtgatgcaccatgtgagaaaattaaaaaatcttcaagggaaaactacctgcgaaaaacaaatgatggctcgcaaacgaaagactattgccatatgtggtaagtgttacaaaaaactcagtaacaatgaatag

SEQ ID NO: 1750 - DNA, 483 bp, B.fragilis
gttctcggaagaaatcagccgtatcatcaaacctcaatgagcatgggcagcaggaaagtgaacaccgaaggcattgacgaggaactgttgatagcctccatcggcagacgcaagcaggacgggaccctgtaccgcgcacaggagccgcccgtacctgcccccgaagaagagagcgtcccggaaacggaaccgccgcccacggcatccccgtcaagggagaaggtgcagaaagacaccgcccgccgcaaacggcaggaggacgactattccggtctgttccttcgccgcaacgagataaagacacgccagtgcgtctatatcagccgcgacgtacacagcaagattcttaaaatcgtgaacgacatcgccggacgggaaatctcggtaggcggctacgtggacaccgtgctgcgccaacatctggaacagcacaaggagaaaataaacgaactgtacaagaaccaacgtgaagacttaatatga

SEQ ID NO: 1751 - DNA, 1320 bp, B.fragilis
aaatttcttggttgttttcctttcggggaacacgaaagtcgtgttgtagtccccgtcaaaggcaaccacggcatcgaagctcttgccctgcttgctcttgaagcctttgagcagtttcgtgtgtccgtcggtgagcaggtctttgatctcgtcatcggtgagggtacggtttgccttcaggcggaacacgggcagcccgcactccgcgttgtcgcagcggacgaccttgccgtaaaactgcatacttcccgttccgcacttgggacacttgcagccggaatccctgcgggcgaacagcttgtcgcacgagagcagttcggaggtaatttcctgcgtgtacgcctctatctccttgcggaaggtatcggcaggcagttccccgcgctcaatgcgtgccagctccttttcccattcgcccgtcatggcaacgtcggcgatgcgcatcgtcttcacgaccgagtagagggcaagccccttttcggtaggtacaagcgacttcttgcagcgttccatgtatccccgtttgaaaagcgtttcgataatcgctgcacgggtagcaggcgtgccaatgccgcagtccttcaaagcctgacgcagcgcatcgtcctcaatctccttgcctgccgtttccatagcggacagcagggtggcttcggtatgcagcggtttaggcttggtcttgccctctgtgatggaggcagctttcagtgtcagcgtgtcgccttcctgccagccggggatgatggtttcctctttctcttcctcgccatagacggcacgccacccggcttgtttgatgatgctgccttttgccacgaactccgctccggcacactccgccgtaacagtggcggtgtctttgacgcatttttcagagaaagcctcaatcatgcgtccggcaatcatctgatagacggtattatcttctttggagaggaacagcggtttctcgcccgtgacgagcagggcgtggtggtccgttaccttgccaccgtccacgctgcggcgtgtaggcatggctttcggattgactttgcctttccattcgggcaggctgccgatgaaggcgagcagcttgggtatttccacgaacacgtcttctgggatgtagcggcttcctgttcttggataggtgatgagtttcttctcgtagagcttctgtgcgatttcaagcgtctgttctgccgtgaagccgtgcttggcgttggcttccttttggagcgtggtcaggtcgtacagaagcggagtgtcctccgtcttctccttgcgttctgctttcgtgacagtggctgtgcctgcttcctttaccttattgtatag

SEQ ID NO: 1752 - DNA, 540 bp, B.fragilis
ccccgaaatggtgatgcagaacagagttttgtcagtacatttctaaccatcaaaagcaacgattatggcaacacgaatgaccatcaacggagtaagtacctgcacgaaagcagggacagagaaatacgagaagttccaaacgggtatcggcagacgcaagcggacacttgtgcaatacgactaccgccacacggacggggaattattctcttgtgtgaaacccacgttggacgagtgccgaaccgcacgggacaagtggctgacggcaaaaagaggaaaggaggacaagcgatgaacgaatcaggctaccaaacgctgatagtcaagttcagcaagcccatcacggaattggacggcatctttgacgatgccgaagcgtggggagttgaaacccttaaaggatgggtagaggactatgagagcagtcggtttaccgccattgacacccacacggcagtcataacgagcgagtacaatatggagtgtgtgaaaacatggttggaaaggaacacccccatagccgagaaaacagaattttga

SEQ ID NO: 1753 - DNA, 459 bp, B.fragilis
cacccacacggcagtcataacgagcgagtacaatatggagtgtgtgaaaacatggttggaaaggaacacccccatagccgagaaaacagaattttgaacattcgggcggtgtccgcaccgcccgaacatagcacccaaagaagaatgaatatgatagcaaagacaattttggagcagataggtggcagacgctttgccgccatgacgggaagcaaagacttcatagacatgggcaacggcttacgcatgagccttgcgaggaacaagacgagtgccaaccgccttgacatcatctatgatgcaggggcagacctctacaatatgcgcttctaccgcaggacgttcagcaaaaagacattcgagtgcaagacgaaagacatcgaaacgcacgagaggatatattgtgatatgctggaagaaatgttcacgatggtaacgggactttacacccgtttttga

SEQ ID NO: 1754 - DNA, 1293 bp, B.fragilis
tttaggcttatgaaaccgagaacacagatacagcaggaagtcgcacatctgagcaagcgactaccgagattgaccgccacgcaaaaggcatacgctttccgtcattgcttcaagcattacgcaatcaagagggcggacggcacgaatatctgtaccgagtgcggacattcgtggaagagcgaccacgaccttgcggacaccatttgcggatgtacctgcccccattgcggtatgcagttggaagcgttgcgcacccgaaagagcgttttcagcgagaacgaatacttctccattgtcacgaccagcaagcagtaccaagtgatacgcttcttcttcgtcaagtcccgatacaaggcagggcaagcagccgagtattccatctatgaagtggtgcagaggtggatttcacccgatggaaagacaacgaccgttgcccgactgcgtggtatgtcaatgttgtattatgaccaatggtctgaatacagcgacatggaggtgcgcaagaacaacggacttcacgcatacgatataacacctatgtgtacctatccccgacagcgtttcatccccgaattgaaacgtaacggtttcaagggggactaccacaacacactgccgtatgaccttttcacggctatcctttccgacagccgaaccgaaacactcttgaaggcagggcaatacgccatgttgcgccactatatccgcagttcctttgacatgggacggtattgggcatccgtcaagatttgcatccgcaacggctacaccatttcggacggctccgtatggtgcgacaccattgacctcctgcggcatttcggcaaggacacgaacagcccgaaatacgtctgccctgccaacctcaaagcggaacacgacaagttggtggcaaagcgcaatctgcaaagggaacgtgagcggacggaacagcaacggcaaaaggcgattgaggacgagaagaactatctgaaagccaaaggcatcttcttcggacttgtgttctccgacagccttatctgcatcaaggtcatagagagcgtgaaggaaatggaagaggaaggacggataatgcaccattgtgtgggcggttatcacaacaaggcaaactcccttatcctatccgccaccattgacggcaaacggattgaaacgatagaggtgtcactgaaaacgctgaaagtggtacagagcagaggggtatgcaattccaataccgagtaccacgaccgcatcatccggcttgtggaggacaatgccggacttatccgtcagcggatgaacgcagcataa

SEQ ID NO: 1755 - DNA, 282 bp, B.fragilis
tatcaacctataataaagaataatatggacgtaagatttgaaagcatggtttgcttgtgggacgataaaatccccacgatgttccttgaatttatgaacctcctcactttttgtcagagtgaggagcagttaagggcgggtgtaaaagacttttccgagaagcacgaacttgacaagttcttcctttacggcttcggctcacaccatttctacctgcaccaacgctatacgagtaaccccgaaatggtgatgcagaacagagttttgtcagtacatttctaa

SEQ ID NO: 1756 - DNA, 699 bp, B.fragilis
aaaagactctttatgtacagcatactaatcattgaagacgaacagcgggtggccgatttgcttcgcgccggtttggaagagaacggttacaactgtctggtagcttacgatggagctatgggactgagaatgttccgtgcaaatacgttcgaccttgtcatttcggacattgtgctccccaagatggacggatttgaattgtgcaaagagattcgggctgctaaccctgccattcctatcctgatgctcaccgcattgggcagtacggacgacaaactggatgggtttgatgccggagcggatgattacatggtgaaacccttcgacttcagggagctgtatgcccgtatccgagttcttctgaaacgaaaacttgcagtagtgactgatgtggaggaagagttaaattatgcagacttatccgtaaacctgttggacaagagcgtaaagagggcgggacgggacattaagctctctcccaaagaatacaacctgctggtatatatgatcgagaatgcagagaaagttgtcagccggatggatatagccgacaaagtgtggaacacgcactttgacacgggtacgaacttcattgatgtctatatcaactatctccgtaagaaaatagaccgtgacttcgatactaaactcatacacacaaagacaggcatgggatttattctcaccgataagttatga

SEQ ID NO: 1757 - DNA, 1104 bp, B.fragilis
ttttgcggtatgatggaaaaaaacaaacgagtcttgttgggaatgagtggcggtacagacagttctgtggctgctatgttattgcttgaagccggttatgaagtaacaggggttacttttcgtttttatgagttcaacggttctactgaatatttggaggatgcccgtgcgttagctgctcgtttgggtatcggtcatattacgtatgacgctcgcaaagtttttcaagaacagattatagattacttcattgatgaatatatgtccggtcatactccggtgccctgtactctttgcaataatcagttgaaatggcccttgttggcaaaaatcgccgatgaaatgggcattttttatttggctacgggacattacgtgagaaaacagtgggtagatgggaattattatattgcacctgctgaggatgtggataaggatcagtccttcttcctgtgggggttaaagcaagagattctgcaacgcatgttactcccgatgggtggaatgactaagtctgaagcacgtgcttatgccgccgggaggggatttgaaaagatctcgaaaaagaaagatagtatcggtgtttgtttttgtccgctcgattatcgtagctttctgaagaaatgtctttgtgatgagtccggagataagaaccgtaacatatacagaaaagtagagagaggacgattcctcgatgaaagcggcaattttatagcttggcacgagggatatcctttttatacgattggccaacgtagaggattgggcattcagttgaatcgtgctgttttcgtaaaagaaatccatccggaaacgaatgaagtggtattggcatccttgaaatcacttgagaaatcagaaatgtggctgaaagattggaacatagtggatgaatctcgtctgttgggctgtgatgatgtcatagtgaaaatacggtatcggaaacaagaaaaccattgttcggttacaatcactcctgaagggttgctacacatacgattgcacgaacctttatctgctattgcagaaggacaagctgccgctttttacaaagacggtttgttgttgggaggagggatcataacgatgagcgatcaacgatga

SEQ ID NO: 1758 - DNA, 573 bp, B.fragilis
atatctatctttgtgcgaaaatgccgtttgcttatgatccgtatatttctgaccggctatatgggagccggaaaaaccacgttaggaaaggctctcgcacgagaactgcacatcccatttatcgatttggactggtatattgaagagcgttttcacaaaacggtcggagagttgttttctgaacggggagaagccagttttagggaacttgaaaagaacatgctacatgaagtaggtgagtttgaggatgtggtgatctctacaggaggaggggcgccttgctttttcgataacatggagtatatgaatcgggtggggactaccgtctttctggatgtagaccccaaggtattgtttagccggttgcgggttgccaaacaacagcgccctatattgcaggggaagaaagatgacgaactacttgattttatcgtacaggcactcgaaaaacgtgcgcctttttatcgtcaggctaattatatctattgtgcagacaaactggaagaccgtagtcagattgaaacatccgtgcaacaactgcgtaaacttttgaacttacatatagcaagctaa

SEQ ID NO: 1759 - DNA, 1278 bp, B.fragilis
ttcgatttcatcagtatggaattaaagagagttgtagtaacaggtctgggcgccattactcctgttggcaataatgtcccggaattctgggagaacctcgtgaacggggttagtggagcaggacctattactcatttcgatgcatcgcaattcaagactcaatttgcatgtgaagttaaaggcttcgatgcaactcaatatatcgaccgcaaagaggctcgtaaaatggacctgtacacacagtatgccgttgccgttgccaaagaagcagttgcagactcgggtcttgatatcgaaaatgaggatttaaacagaatcggcgttatttttggtgccggtataggtggtatacgtacatttgaggaggaaacgagtaattacgcccttcacaaagaaaacggtcctaagtacaatccgttcttcatccctaagatgatttcagatattgctgccggacagatttctattatgtatggcttccacggcccgaactacgcaacttgttctgcatgtgcaacttctactaacgccatcgccgatgcattcaacctgatccgtctgggtaaggcaaacgtgattgtatccggtggttcggaagccgctatcgcagctgccggtgtaggaggtttcaatgctatgcatgcattgtcaactcgtaacgacgaaccacaatctgcatctcgtccgttcagtgcaagccgtgacggctttgtaatgggtgaaggtggtggatgtttgattcttgaagaactggaacatgcaaaagcccgtggcgcaaaaatctatgcagaagttgccggcgtaggtatgtctgctgatgctcaccacctgacagcatctcatccggagggactcggtgcaaaattggtgatgaagaatgccctggaagacgcagagatgagtcctgaagaagtggattacatcaatgttcatggaacatctactccggtcggagatatatcggaagccaaagcaatcaaagaagtatttggtgaacatgcttttgagttgaatatcagttcaaccaaatcaatgacaggtcacttgttgggcgctgccggtgcggtagaatcaattgcaagtatcctggctattaagaacggcatcgttcctccgactatcaatcatgccgaaggtgacaatgacgagaacattgactataatcttaatttcacgttcaacaaagcacagaaacgcgaaattaatgttgccctttcgaatacattcggattcggcggtcacaatgcttgtgtaatcttcaagaaatacgctgaataa

SEQ ID NO: 1760 - DNA, 270 bp, B.fragilis
catacgttcatttccaataaaatacactcttttcgtaacttcacattacaaaatactggtaaggctttactagttattgatgatgtgaatacttcttgcggttgtacttctgtacagtattctaaagaacctgtcaaacctggggagtctttaagaataactgtgatctataaagcggatcatccggaacactttaggaaaactattacaatatattgtaatgttcctacttctcctctgcaattgaaaataactggaaatgctgaataa

SEQ ID NO: 1761 - DNA, 936 bp, B.fragilis
tttaacctaatagacttaattatgaatgtagattgtgtgatagttacttacaataggctatctttgttaaaagagtgtattactgcagtgaagggccaatcatatcctgcacgcaagatctatgttatagataataactctactgatgggacgttggagtttcttgaaaaattttcacaagattctcaggtgaaagttattaacttgactgaaaatatagggggagcaggtggtttctcccgaggtattaaagaggctgtaatggctggtgctgattgggtttgggttatggatgatgatacaataccttatagtgatgcgctggagaaaatgctgaaaacaattgatttgacaaaaaatgtaggctatgtttgtagtaaagtactttggaccgatgaaaccccgcatcgtatgaacatgcctggttattctatcggtacacagaaaggagttttatataatgcattttcaaatagggatactcctgcttttttaattcatcatgcctcttttgtttcattgttagtaaatgcaaaagccgtgaagagtgccggtttacctatttctgagtttttcatttggggtgatgatatagaatacactatgcgtatatcttcattgggatatattggcttttatgtagataatagtattgtattgcataagactcctactaattatcagccatatcctgatacggctcctactaatacagcatggaagttttattaccaagcacgtaatactgcgtatttgaaaagaagaaagacgaaaaatagattatgttttttgttatctattataaataaatatagagtgtatatacatcgtattaataaacgaaaaactaatgataaattgatatttaagaagtatgtaagaaaaggatgttgggacggattaacctttaatcctcaaatagaatatttaccataa

SEQ ID NO: 1762 - DNA, 192 bp, B.fragilis
attttatcctttctgcaagtatctgtaggatggcaactgcattttttttctttttgggcagcccttattaaaatttattcttattttaggttatatacattcatgtccatttatgtaaaaaatcctgctgaccttgtttatgtcttgtcagtcaccatttgcaaaaccatatttgaccctcaaagaggctga

SEQ ID NO: 1763 - DNA, 489 bp, B.fragilis
aggaataaaataatgaagagcgttcttttaatgtgctggatggcattgctgtctgtggctgtttcggcccaggactttgattcacgtttcatggctgaacatcaggcagattccaatctgacttgtgttacgatcagtccgaaaatgatggaggagattatgaaaagcgatgctgaaaaagataaggaggtgctggatatgatctctaatctcaaaagcatgcaggtgcttacttctgatgtggaaggaaaaaagtatttcaatgcagctttgaaggtggtagagaagaattccggtcggtttgaatcgtttctttcttttaaggacaaatctgagaattgtcagattatggttcgtaagaaaaaaagtacgattgttgaactggtgatgttgatgcacgaaaagaatcactttgctgtggtaaactttacggggaatatgagtccggagtttattgcacaaataaaaagacattttcatttgctttaa

SEQ ID NO: 1764 - DNA, 1371 bp, B.fragilis
gttatgaaaataagaagtatccttaccattaaatatgcaggtatcacggccactatctttctcgtgtttatggccactatctattgtgtgaacgaacatctgcgcagtgattctttttatcgtagcctgcgaagcgaagctatcactaaagcccatctgtttcttaacaatcaggttgatgtagaaaccatgcagtcgatatatctcaataatcgtcagttcattgatgaggtggaagtagctgtatacactcccgatttccggatactctaccacgatgcgttgcacaacgatatcattaaggagactcccggaatgatcgatgagattgtccggaaaaaggagatcgacttccgtacaggagactatcaggggatagggattttatatgagttcgggggtaaaaattatgtggtgacagctgccgcttacgaccgttacggacatattaatcaggtcataatgacgcggctgcttctccttttatctatcggcggactgagtgtgctcgtcattgtgggttatatgcttgccaaaagttcacttgcccctatccgtagcatcgtacgtaaagccgagggtatcaccgtcactcaaatcgacgaacggttgcctgtcaagaacgagcatgatgaactgggagaactagcccttgccttcaatgcactgctggacagggtggaaaagactttcaatgatcagcggatgtttgtgagcaatgtatcacacgaacttcgtacacctatggcggcactgtcggcagaacttgacttggcgctgcaaaaggaacgtactgtcacacaatatcaaaattcaatacacaatgcgttacaagattcccagcgtgtcattgaactgatagatggcttgttgaaccttgccaaagcggattattatcccgagcaaatcaagaaagaggaaatccggctggatgaattgctgttggatgccaatgagcttgtgctcaaagcccatccggattatcacatagaactgattttcgagcaggaggcagatgatgaccgtgtgttgactgtgatcgggaatccgtatctgcttaccactgcttttgtgaacctcatagagaataactgcaagtattctgataaccggacgtcgtttatccagatctcattctgtgatcagtggaccatcgtaagtttatccgacaacggtgccgggatgtccgaaacggataaggagaacttgttcaagctcttctaccgcggagagaataaaaaccaggctcagggacatggtatcggaatgacgcttacaaagaagatactcaccctccataagagtgagatctcggtgtattcacaccaaggagagggcactacctttgtggtaaggtttcatcatttataa

SEQ ID NO: 1765 - DNA, 2664 bp, B.fragilis
agcgcaaagattatgatttggagaaagaaagaaaaaaagaaagcgcagtatcaatttaattccgaacgggtattcctggttgccacacaacctgctaagactgcatattcttatttccagacttcgagtgtgggactgagtgaagaagagatcgggcaacgacaatccgcctatggtaaaaatgaaatctcacgagagcaaaagaagaatccactcgtacttttcatccgtacgttcatcaatccgtttatcggtgtgttgacggcgctggctgtcatctctctggtcatcgatgtagtaatggcccgtcctgaagaccgtgagtggacggctgttctgattattatctcgatggtagtttgcagtgccattctccgcttctggcaggagtggaaagcaagtgaagctactgactcattgatgaagatggtcaaaaatacctgtttcgtaaagcggttttcgggaagtgaggaggttgatattacggaattggtaccgggtgatgttgtttgccttgctgccggtgacatgattccggcagacatccgcatcattgaatcgaaggatctgtttgtcagccaggcatcacttaccggtgagtccgatccagtagagaaatttcctgaaataaacggtaggagacacagtcacggaagcgtcatcgagcttgacaatatctgctacatgggttccactgttatcagcggatctgccaaaggaatcgttttcgggacgggtaacgatacctatctcggaacgatagcccgaagtttagtgggtgaacgtgcgactaccgctttcgacaagggaatcagtaaggtcagtttcttactgatacgctttatgctggtgatggttccattcgtcttctttgtcaacggtttcacaaaaggcgattggttcgaggcattcatatttgccttatcggtggctgtgggattgactcctgagatgcttccgatgatagtcacagcaaacctctcgaaaggtgctgtatcaatgtcgaagaaaaaaacggtcgtgaagaatctcaatgccatccagaacttcggggccatgaacattctttgtaccgacaagaccggtacgctgacctgcgataaaatcgtattggagaagtatatcaatgcggacggcagcgatgatcattcccgaaggatattgcgccacgcattccttaacagttactttcagacaggtctcaagaacctgatggacaaagctatccttgcccacgtacgcgaagaaaatctggaacatctgacggaaggttacacgaagatagatgagataccgtttgatttcagtcgacgtcggatgtcggtagttattgaagatcagcagggaaaaaggcaaatcatcacgaagggagctgtggaggagatgctgaatatttgctctcatgccgagttcaacggtcaggtatatgaattgaccgataaactcagaagtaaggcaaagagaatcagtgatgatatgaatcgtaacgggatgcgggtacttgccatcgcacaaaaaagctttatcagcaaggcacgggactttgccgtcaccgacgaggacgagatggtacttattggttacctggcgtttcttgatccccccaagccctcttctgccgaggctatccgccaattgcgcgaatatggtatcgaggttaagatactttccggtgataatgatgtaatcgtgagcgccattgcccggcagataggcattgatacgtgccattcggtaacaggggttgagcttgaaggcaaggacggggaagaattacgtgaaatagtgggacaagccactctcttttccaggctgacgcctttgcagaagagcgagataatcatgattcttcagcaaaatggcaacacggtaggatttttgggtgacggggtgaatgatgccggagcattgaggcagtcggacattggtatttccgtagattctgccgtggacattgcgaaggagagtgccgatatcattcttttggacaaagatttgagtgtgctcaaagagggtgtcttggaagggcgtaagacctttggcaatatcaccaaatacataaagatgaccgccagttccaatttcggcaatatgttcagtgtgatgttcgccagtgcatttctgccgtttctgcccatgttgccgatacatctgctcattcagaaccttttgtatgatatctcgcaaactaccattccgtttgaccggatggatgccgagtttctgaagcaaccccagaagtgggacgcatccgatctgagtcggtttatgatttacatcgggccgataagttccgttttcgatattgccacctattgtttgatgtggtacgtgtttgcctgtaattcacctgagcaccagactctctttcagtccggttggtttgtcgagggattattgtcacagacattgatcgtacatatgatcaggactcgtaagataccgttttttcagagtcgtgccacctggccggtgctggggttgaccttcctgatcatggcaatgggcatagctattcctttcacatcgtttggcctgtcgataggacttgaaccgttaccgttgagttacttcccctggctggtgcttatcttggtatcctactgtgttcttacacaatttatgaagagctggtatattcgaagattttcgaaatggttataa

SEQ ID NO: 1766 - DNA, 189 bp, B.fragilis
ttggcacacgttcgttcaaaatccttttgtacgatggtgtgccgacgaataaagccgcttttacggaaaaacttgtatgagatagaaaaaatcagggagattcatatcaaaatctcccgttttattgttacttttgcatacgaagagttctttgaaggttacgcaatgcgcagaagaataatgcagtag

SEQ ID NO: 1767 - DNA, 195 bp, B.fragilis
tttatattttttaaagattttgcaaatatatgctattcaaaccaaaaacacaagcaattatataatttaataaaaaatggattaattcattataattatctcagaatatattacatattatcatttaaagaaataaattgtattataatcgagagaaatgcatatctttgcaacgagagagatacaagcaagtaa

SEQ ID NO: 1768 - DNA, 1317 bp, B.fragilis
ctttatggcgtgttccaccttctccaatttcgcttcaaggttatgcttgcgcttctccagacctttcagcatcgcccgcgatacgttctttccctgctggcgcagcacttcgaggttttcctccaccgtgtcaagctccgcttgcaggatgcgctgctgcaactccggcgactgcggtatcttgccgaactggtcgtgcgacataatgacacaatcgtagtcgttgttcttgatgttgttgaagaaacgcacgcggttggcggtcgaaaagtctttctccgaagcgtacagaatcctcgcgttgggatatgccgcttgataggtggcggcaatctccgcaacattggctttcagcccgataatcatcggcttgtgcgccaagttcagacgcttcatttcatgcgcggcgatgcacattatcagcgtcttgccggttccaacctcgtggtcacaaattccgccgccgttctgtttcagcatccagacgcaatccatctgcgagggatagacgctcctgatgccccggcttgccagccctttcagattgaggtcgggaaaagtctgatgcgagccgtcatacttcgggcgcacgaaacagttgaacttgcggttatacatcgtcgtcagccgctccttgaactgtggcgactgctcttcgagccattcggagaagccgtttcgtatctcgtcaatcttggcgttggcgagctgtattccctcgctgtcgcgcaccttgatgtcgttgccatgctcgtccctgccgatggacttcatcatgtcgggacaggtgttgtgcagggcgtgtttcagaaggtgcatgccgtcatagttacggtaataccccttcaccagaaactcgtccgtgattttcatggtgcggtagccgcacgccaccgaaaactcgtccatgcttgcagagtaggcgattttcacctccgtgtcgaacagccggctcatgtaggcggcatagacacccgtcggaatccagcgttccccgaaattgaaatcaaggtcttcaaaagcgatgcgcggcggttcggcatctttcagagcctccaacgcctgcttcacctccggcatacgttcactttcggggttttcgcccatccaagcctctatgcgttccgctttctctatcacgtttccggcaataaagcggtccttaatctcgtaaccggttacgagcggattgtaatagatgcgcccttgcagggctgtgagcaaatcctccgccgtactgtcggttatctcccgcatatagtcgagatcgacagtgccgaacttgttgagcgacgcggacagtgcttcttcgggtga

SEQ ID NO: 1769 - DNA, 381 bp, B.fragilis
agtaatcaagtatcaaccgcccgaaaaaggactatccaccctttcaacggcacaaaacaagaacagtttatgaacaagaacatcagacaaaagttaatcatctctgcggcacttatgattgccgcaaccgcctccgcatttgcgcagggaaacggtctggcaggtatcaacgaagccacctctatggtgagttcgtatttcgaccccggcacgaaacttatctatgccatcggcgcggtggtcgggcttatcggcggcgtgaaagtctatggcaagttttcgtccggcgacccggacacctcgaaaaccgctgcctcgtggttcggtgcgtgcatttttttaattgtagctgcgactatcctgcgctcattcttcctttaa

SEQ ID NO: 1770 - DNA, 249 bp, B.fragilis
aaacttaaagttatgtctgaaattgcatcaagagtgaaagcgattatcgtcgataaattgggcgtagaagaatcagaagttacagaaacagcaagcttcactaacgacctgggagctgattctcttgacactgtagaacttatcatggaattcgaaaaagaattcggtatctctattcctgatgaccaagctgaaaagattggcacagtacaggatgctgtagcttacatcgaagaacacgctaagtaa

SEQ ID NO: 1771 - DNA, 1056 bp, B.fragilis
cttttttcttttaaatacgtaatattcaataaaaaaagagcagcaatgaagatcggaattcttacatcaggcggcgattgccccggtataaacgctacaattcgtggggtatgcaaaacagctattaatcattacgggatggaagttgtagggattcacagtggttttcagggactgttgacgaaagaagtagaatcgtttactgaaaaatctttgtccggattgttgaatttaggcggtaccatgctgggaacttcgcgggagaaaccgtttcgtaagcaaggcattatctcggatgtagataaacctgcgttaatacaacgtaatattgcagaattgggtcttgattgtgtagtgtgtatcggggggaatggtacacagaaaaccgctgcaaagtttgctgcgatgggaatcaatattgtttctgtgcccaaaacgatcgataacgatatctggggtaccgatatctctttcggattcgactcggcagtgagtattgctacggatgctattgaccggcttcattccacggcgagttcgcacaaaagggtgatggtgatcgaggtgatgggacataaagccggttggattgctttatattcgggcatggcaggtggaggcgatgttattctggtaccggagataccttacaatattaaaaatataggagatacgattttaaatcgcttgaagaaaggaaaaccctattcgattgtagtggttgccgagggcatccagaccgatggacgtaaacgtgctgccgaatatattgctcaggagattgaatatgaaacgggtattgagacacgtgaaactgtattaggttatattcagcgtggtgggtcgcctacacctttcgaccgtaacttgtctacccgtatgggaggacatgcaacagaactgatcgctaatggacagttcggtcgtatgattgctttgaaaggggatgagatatcttctgttgcattagaggaggtagccggaaagttgaagttggtgaccgaggaacacgatcttgtggtgcagggacgccggatgggaatctgctttggataa

SEQ ID NO: 1772 - DNA, 1176 bp, B.fragilis
tacagtttattttacctcattctggttatggttaagaaaatactggttgataaatatgatctttttgttttatccagtcttattcattatttaataaacttattatatatgtgtgaaataagatttcttttatttatattatttatggggtgcttatgtgcttgtgggcgcgttgacttaaaatctcccaagaccttgttctctagcgtatcagagatatcagaagttgaatggagtatagaagctgattctttagctagagttgaaggtatacaatgtaatgattctgttttattggtctttgatttttattcaggtaagagttactctttatttgatatttattcaggtaagatgatatctcgtttaggctcgattgggcagggaagggatgaaataccattaggcgtttttggatatattgagaataatagattttatatttactatgatcagacaggttatattggcaaatttaatctcgattcttgttctgttattcttgactgtccacctgtttgtctcgctaagtataaaatacccggagctcagatttctaaaatcgcagtagtgaatgatagcctttttttaggggcaggtacttacaacgcagaatatcaatatctactttttgataataaaagtaatgtaattgattctgcggtgactatatataattcgaatgaagcgaacttaaatatatatcataaatttttgtctaatcagggacgattaaggaaacgtccaggaaaatctcaatttgtatattcaataaacaattcatctaacattgattttttcgaaattaaaaacaataagattaatttgattaaatctttgcgatttaataatccggaatatacacctacccaagatggtgattatagcagggttcttttttcagacaacaatgttattggttatattgatataggtgttacagataaatatgtatatacattatatacaaataagaaaatatgtgataataatacttataatgatctaagttcaaccactgtattggtttttgattggaatggaaatcctgtgaaacaatatgagttatcaaaagaggcatattatattactatagataaaacattacaaagaatgtacgcagtggtgagaaagccagatatgggttggactattgtatgctatgctatagattaa

SEQ ID NO: 1773 - DNA, 624 bp, B.fragilis
atgcaatcttttgcacatttttcactgttttgtgcactaaaaggtctgattatgggaaaaaacatcgctatttttgcttccggctccggtacaaatgctgaaaacattatccggtatttcgaaaaaaatgcttctgttagagtgagattggttctttctaacaggaaagatgcgtatgttttggagcgtgcatgtcgtttaggagtgccttatagggcttttccgaagtctgattgggaagctgcggagtccatcttggatttgctgcgtaaatatcagatagactttattgtgctggccggttttctgttacgtattccggatgcacttttgcatgcttatcctgataaaattataaatattcaccctgcacttttacctaaatttggcggaaaagggatgtatggtgaccgggtacatgaggcggtggtaatggcaggtgagtccgaaagtgggattactatacattatatagatgagcattacgatgagggaagtactgtttttcaggcaaaatgcccggtacttcccggagatacccctgcggatgtggctaaaaaagttcatgcattggaatatgaatggttccccaagatcatagagcgcgttgtaaacagcttataa

SEQ ID NO: 1774 - DNA, 243 bp, B.fragilis
cccgtactttcgttccagttcgcgtgttatctgcttgctccggtaaaaattgttccgggtgtctatgctcctgccattctcgtccaccctgaccgtcacaatatgcagatggtggcggtcgatgtcctcgtgcttgaaaacgagatacggctggttgccgaagcccatcttctccagatactcccgtgcgatattctgaagctccgtgtccgtcaaaatatcgtcgggatgcggattgagtga

SEQ ID NO: 1775 - DNA, 336 bp, B.fragilis
tcttattattcacccactgaatccaaagttatgatgaacgagaacaacgatgtttttacactggagaacgagccgcttgccaccgtggtacagaatatgcgcaaaggctctaaatggctctccacatttttggaaagttaccgtccgccgctggacggggaacgttacctgacggacagagaggtggcggagctgctccgtgtgagccgccgtaccttgcaggaataccgcaacaacagagtgctgccttttatccttttaggaggaaaggtgctttaccccgaatcgggattgcgtgaactgttggaggcgaattaccgcaagccgctggaataa

SEQ ID NO: 1776 - DNA, 206 bp, B.fragilis
ttgacaccaccgctgttgcttccacccctcgtggcgaacacggtttctgtggcggttttaccacattctccactttggccaacgacagtctgagtttgctgaaaggaggtttttatggcatattcaccttttatgtattcatcagcatattgcttggacttttggctgtattggccggaggatatcttggcgaacaatttaaataa

SEQ ID NO: 1777 - DNA, 654 bp, B.fragilis
catccgggaattggttcaggcaaaattgggttcctggttgaaggaaattgtcatgaaaaaaaaaagcttgcaaacattttaaatccgggccaaccgaacaggttggttctacaatacattttttgtctgaaagatatgaagccggaagagattaacgggcatcaagtcggaactcattccattcttgttaggaaatgggaggcaagtgcatggtcttgtcatccagagacaaagacgcaacagtgcgaccttgacctgtgggaaggcgaaaacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 1778 - DNA, 1797 bp, B.fragilis
ctgatgaaaccgggtcgcccgttatcggagccaatattaaggagaaagaaacccggaaacggaacgattaccgacatcaacggtaatttcagcctttctgtaggaactaagagtacgattatcatttcatatatcggatatatcactaaagaagttccggtaggtaataatacctcacttactgtccagttggccgaaaatacgaaacaactcgacgaagttgtggtgacggccttgggtatcaagcgcgaggaaaaagctctgggctatgccgtgcaaaaggtagacggtgacaaactggctgctgtcaagaccgtgaatgtagctacatcgctgaccggtaagattgccggattgaatgtaaaaaacagtacggagttcaatacttcaccttcactttcgttgcgtgcatctgctcctttgctggttatcgacggagtgccttatggtaacgtaggattaaatgatatagctgctgatgatatcgagtcggtcgatgtcttgaaaggagctacggcttcggccctgtatggtgcacgtggaggagccggtgcggtgatgattactaccaaaaaaggaaaagaagagggactgaatgtgactgtgaatagcagtacgatgtttgcggccggatatctgagaaagccggaagtgcaaacgtcatacagttccggatcacagggtacctattctaccggaggatatgtatggggagataagctggacatcgggcgtacggcattgcagtatgatccgtatacgcacgaatgggtagacatgcctttggtatcgaaaggcaaaaacaatctgaagaacttccaggagctgagtatggtgacaaacaacaatgtaagtgtctctcagaaaggtaaatatggaagtgtacgcacttcattgacccatgtgtataataaaggacagtatccgaaccagaaactgaataagatcacttattcggtgtcgggtgatatgaagtggaagaaattctcttttgacggaggattgacttataataagcgcttttatcccaatgacatgggagccggatacggtggtagcggattcctttataacctgttggtatggtcgggtgccgaatatgatatacgcgactataagaactactggatcaagcaggacgaacagcagaactggatgaacgatgtgtggtatgataatccttattatctggctcatgaaatgacttcatccaatgactacgataaagtaaacacttacttgtccggtaaatatgacatcatgccttggttgaacttttcgatgagagccggtgccgatgcttatgccagccgtacggaaaagaaaaacgcaatgagcgcccgcggcggatgggacaagaacggatacttctatacatccaaatccaccggattcagtttcaatggtgacgctttgctgtctgccaatcacagcttcggtgattttgctatcgacggttttgtcggaggtacgatctactattattatgatgacgctatttcatcgaatacccgtaacggattgagtattccgggatattattcattaaaagcatcggttgacccaattgcctcttcaagttcatacaagcagaaacaggtaaactctatttatggaaaattctcagcttcatggaagagtactgtgtttgtggatgtaacggcacgtaatgactggtcgtctactttgccttcggagactcgttcttacttttatccggctgtatcgggaagtatcattatgtcgcagttactaaagatgcccgagtcttcaccacggggctggaaggatcggcgt

SEQ ID NO: 1779 - DNA, 291 bp, B.fragilis
aatcatttttattactactatgacagcacgctctccctaaaacaaaaaaacatacaggaagatattggcgtatctacctgtatgaaagtccaccgtcagtttgtttggcgacaaactgtgcggcaaatagaattttttaaatcaaaatcactacaaatctatgacaatttacttaaacttccaatttttcgggaggcagaatacattttcgctcttgaaaaaaatacctttgtgtatgaaactatcagcaataatgttgtttgtctttgccagcatggcatttgcggctaa

SEQ ID NO: 1780 - DNA, 414 bp, B.fragilis
aattttttaaatcaaaatcactacaaatctatgacaatttacttaaacttccaatttttcgggaggcagaatacattttcgctcttgaaaaaaatacctttgtgtatgaaactatcagcaataatgttgtttgtctttgccagcatggcatttgcggctaaaggttatagccagtcagtacgtgtgactttaaatgtcaacaacagtagtcttcagaaagtgctggatgaaatagaaaagcagtcggagtttcacttcttctataacaacaagcaagtggatatctcccggaatgtgacaatcaaaagtaaccagaaagagatcagtcaggttctgaaccaattgtttgccggaacgaatatcgggtataagatattggagaacagcataatcctgtgtccaaaacatatttag

SEQ ID NO: 1781 - DNA, 1221 bp, B.fragilis
gaaacaatgcttcgaatgcgccttcgtttccctgctgaacctggaagaacagagtttcatcgcttactgtgcgcgaggtgtcgttatacatgtagaccttcgttttgggcaaaaataatattattttcaaaaaaaatacgttttttggttaggagatttctattttggttcgtcttatctataaaagcacgaattatggatgaatcctgttacattaatgagtcggttcttttaaattattttgcgggggagctcccagccgatcgccggaaagaggtggaggaatggatagcggcttcggaagataacgagaagatggcacgagatattttccggctctaccgcgcggcagacacactggactatatgaatcgggtggatgcttccgcagccttacagcaggtgaagggcagaatacacaaacatcgacatagaatctcctggatggtttgggggcagcgtattgctgcttgtatggcgttaccgctgcttgccaccaccctttatttaattctgaaaaatccgccgcaagaatatgtggagatacggaccaatcccggtatggtggctgaggcaaatttaccggacggtaccaaagtctggcttaactccggatcttcactgaaacatcctgttaagtttacaggggatacgcgtacggtggaacttgacggggaggcttacttctctgtccgtaaagacaggagtaaacggtttgtggtcaatactcctttcaatatacagaccgaagtattgggtacggagttcaatatggaagcataccggacggatagtgtagtcaggacaacgttggtatcgggatcggtcaggttgtcatttttggggaaaggcgatacaaaagaaacattcgtcatgaagcccgatgaagaatttgtatataatacggcgacacacgaggcacgggccgaaaaatcgtatgtggagatctatacagcctggaagaacggtcaggtagtgcttaaaaacacatcattggccgaaacgctgaagatactcagcaagaggtttaatgtagagtttatcgtgaaagattccacactatatgccaattctttcaccggtgtgttcagcaggcagtatttgccgttgatccttgaacacttcagatatgcatccggaatacagtataaataccttgatctggagtatgatgccacacacaaggcaatacaggaaaaaacaaagatagaattatattaa

SEQ ID NO: 1782 - DNA, 282 bp, B.fragilis
aagttgacaatgcaagaagaagaagtgatgatctacatttgggaactggaaagttgctatgtgaaagacatcgttgccaagtttgagcaacctactcctccttacaccacggtggcttccatcgtgaagaatctcgaacggaaaaaatatgtcccatgtcagactatccgacacccgggtgtcagatatcgtatgctactgccaaatgtacgtaaagataaggagatctgcaacgaaactaagaactgtttcgtcctttcaatgcaggaggaaaggaagtaa

SEQ ID NO: 1783 - DNA, 639 bp, B.fragilis
ccaaaaaacgtattttttttgaaaataatattatttttgcccaaaacgaaggtctacatgtataacgacacctcgcgcacagtaagcgatgaaactctgttcttccaggttcagcagggaaacgaaggcgcattcgaagcattgtttctcaggcattacccggctctttgtgcctatgcccggctctttgtcgaaccggatgacggccaggagatcgtatcggacgtcatggtctggctttgggaaaataaagaaatgcaggcattcgagagttccttaaaaagttatttgttcaaggctgttaaaaaccgctgcctgactctcatcaaccggaacgaagtgaaacaacggatcgaaaaaatgatattcgataatctccaatcgcagtatgatgatcccgacttctacgctatacaggagttaaccgaaaaaatagaagaagctctggcacgacttcccgagaatgtacgcgaagcattcgaactcaaccgctttcagaatctgacatacaatgaaatagccgaacgactgggagtgtctcccaaaacaatcgattaccggattcaacaggccttaaaacagttgcgcatcgacctgaaggagtatctccccttattacttcctttcctcctgcattga

SEQ ID NO: 1784 - DNA, 200 bp, B.fragilis
tccttccagccccgtggtgaagaccattactggatatccagtaatgccgggttgataacgatcaatccgatcacaaagcagcatttccgccaatttacggtgaatgacggactgcaaggcaatcagtttacagcccaatcttcattgaaaacagcaagtggtaaactctatttcggcggaatcagtggcttcaattctgt

SEQ ID NO: 1785 - DNA, 390 bp, B.fragilis
ctcttcagattatgttgtactttcatgcaaatgaaaaaaagcaatatttacataggtgaaattatcaaaaatgtgatgtctgagagacaggttacaaaggccgaactcgcaagacggttggatgttaagcctcaaagtgtagattacttactgacaaggaaaagcatcgacacggatacattatacaatatttcaatagcgctagactatgatttttcccttttatatagtatcaaacgagaacagagaaattctgataacgaaggtatcagatataaactaggaaatgccaaaattatggtagagatagaattacagcaagatgaaattataaagcttaatttgaaaaagaaaatagcagaactgttggatggaggggctaataaatag

SEQ ID NO: 1786 - DNA, 234 bp, B.fragilis
cacaggaaaacatctcctatacttccgaccaaggcaagaccctatgatttcaatactgcagacaaactcaacacattgcttataaacgctttggtttctacaggcgagttgaaggaaattgaggaatacgatgttgactttgaccatcagttccttgaaacggagaagtatgatggcaaaaccgacctacaaaaagttcctcggctacaggcctggcgtatatgttatcggtga

SEQ ID NO: 1787 - DNA, 348 bp, B.fragilis
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagaccctatga

SEQ ID NO: 1788 - DNA, 252 bp, B.fragilis; identical to SEQ ID NO: 860

SEQ ID NO: 1789 - DNA, 2178 bp, B.fragilis
tttttattgaaccatatcatgaagaacatgaaaaaactgacttttaagttagcttgcttttttctctctcttttagtgagtagtgtggcaatggccgaaagtattacttctcccaacggactcttgaaactgaatgtatctgtgaatgagaagggggaacctgtgtatgaactttcttataaaggtaaagaagtgattaaaccttctaaactgggtcttgaactgaaagacgatccggggttgatggacggttttacgttgtctgatgccaaaacttcttcttttgacgagacttgggagcctgtttggggcgaggttaagcaaattcgcaataattataatgaacttgcgattactttagaccagaaagctcaggatcgcaaaatggtgattcgttttcgtctgtataatgacggactcggatttcgctacgaatttccacaacaaaagaatctgaattattttgtaattaaagaggaacattctcaatttgctatggccggtgatcatacggctttctggataccgggagattatgatacgcaggaatatgattatactcggtcgaaactttctgaaatacgcggcttaatgaagacggctgtcactcccaatgcttctcaaactcctttttctcctaccggtgtacagactgctttgcagatgaaaacagacgacgggttgtatatcaatctgcacgaagctgctttggtggattattcttgcatgcatctcaatctggacgataagaattttgttttcgaatcgtggttgactcctgatgcccaagggaccaaaggatatatgcaaactccttgccactctccatggcgtacggttatggttagtgatgatgcgcgtgatattcttgcttctaaattaacattaaatctgaacgagccttgcaaactggaggatacttcctggattaagcctgtaaaatacgtaggtgtatggtgggaaatgattaccggaaagagtacttgggcttatacggatgatgtttattcagtgaagttgggcgaaaccgattatactaaaactaagcctaatggtcgtcatggtgccaataatgagaacgtgaaacgttatattgattttgctgccgaacacggttttgatcaggtgctggtcgagggctggaatgaaggctgggaagattggttcggcaagtcaaaagactatgtgttcgacttcgttactccgtatcctgattttgatgtgaaaatgttgaatgagtatgctagaagtaaaggagtgaagctgatgatgcatcatgagacttctgcatctgtgcgtaactatgaacgtcatatggatgaagcttatcaatttatggaagataacggttacaatgcggtgaagagtggatatgttggcaatatcatcccgcgtggtgaacaccactacggtcaatggctgaataatcattatctgtatgcagtgaagaaagctgcggatcataaaattatggtgaatgcacacgaggctgttcgccctaccggattgtgccgtacatatccgaatctgattggtaatgaatctgcccgtggtacagaatatgaagccttcggaggcaataagcctttccatactacgttgcttccatttacgcgtctgataggtggtccgatggattatactccgggtattttcgatactcaactctctttcctgagtggtgagcatagttttgtacataccactttggccaaacagttggctttgtatgtcactctttatagcccattacagatggctgccgatcttccggagagttatgaacgctatatggatgcctttcagtttattaaagatgtagcagtagactgggatgaaagtaagtatattgaagcggaaccgggagagtacatcactgtggcccgtaaagctaaaaacaccaataattggttcgttggaggaattactggtgaaaatgcacgcacatctacgtttgtacttgatttcctggaaccgggaaagcaatatgtagctactttatatgccgatggtaaagatgcggattatgaaaaaaatccgacttcttatcagattaaaaaaggtctggtgacttataagacgaagatttccactgacttggcccgtagtggaggttttgctattagtttgatagaggctacccctgccgataagaaagcacttaaaaagtggaaataa

SEQ ID NO: 1790 - DNA, 342 bp, B.fragilis
aggaaattgaggaatacgatgttgactttgaccatcagttccttgaaacggagaagtatgatggcaaaaccgacctacaaaaagttcctcggctacaggcctggcgtatatgttatcggtgacaagaatgtctatatcgagaacagcgaaggtaacccgattgtgcgttttcattcggccgacacccataagaaaatcttcgctcttctggaatcccagaacaatccggtaaaacgcttcagggggaaacgggggttcccgcttcaaaggaaaatctcagtgaaaaaaagaaaactttgcaaacttttttacatcccggccaacccgaggcatttggtctaa

SEQ ID NO: 1791 - DNA, 1887 bp, B.fragilis
atcaccccatctttttattttatggctataacgattatcattctcgtactgtcggctgtcttttttatgagtggaaaggtacgttccgacttagtggcgttgtgtgcgctggtattattaatccttttcaatatcctcactccggaggaggcgctttcaggattttctaattctgttgttattatgatggtcggcctgtttgttgtaggtggtgccatctttcagacggggctggcaaagatgatcagcagccgtatcctgaaatttgccggaacaagcgaactaaaactttttatcctgattatattggtgacggctgccatcggcgcttttgtcagcaatacgggaacggtggcgttgatgctgcctattgtggtcagtatggccatgagtgccaatatcaatgtaagccgtttgctgatgcctcttgcttttgccagtagtatgggtgggatgatgacattgattggtacaccgcccaaccttgtgatacaaaatgccttgattgaagccggctatgaacgtctctctttcttcacttttactcctgtaggcttggtgtgtgtcactgtcgggctgattgtgctgattccgctgagtaagatcttcctgacgaagaaaagtgataaagaggcacggggaaagcgcaagaataagtcgcttcaggagttggcgggtgaataccagttatcacagaacctttatcgggtggaggttgaagagtcttccggttttgtaggtaagaccatacaggagctagggattccgcagaggtatcatgtgacgattttggaggttcgccgccgttcggtttcgtcccggcacttcttcaagacaaaaaagcaggagatggcagaagccggaaccttgattgaggcggaagatattctttatgtattaggagaatttgaaaatgtgaaacgctttgcaggtgagaaccgtctgtctttattggatacacataagaccgaggggagtctgcatgatacggacgagggattcgattttcaggagataggcattgctgaaattctgttactgcctaccgccaatctgataaacaaaccggtgaaagcttccggattcagggagaattatagcatcaatatattgggtattcagcgtaaacgtgactatctgctgaagaatctgaaggatgaaaagatgcattcgggagatatcttgctggtgcagggaagttgggcaaacatagccaggcttggtgaggatcagtcacagtgggtcgttctggggcaaccgttggctgaagcggccaaagtaaccctgaatcataaagcaccggtagcggcactgatcatgttgggtatgattgtaaccatgatgtttgactttattccggtggctcctgtgacggccgtaattatagcggcactgctgatggtactgaccggatgtttccgcaatgtggaagaagcttataaaacaatcaactgggagagtattgtgctgatagcgggtatgctgcccatgtcattggcattggagaaaaccggagcttcggaggtggtgtcgcaatcgttggtgaatgggctgggggcctatgggccttttgctttgttggcaggtatttacttcacaacttcgctgatgacaatgtttatcagcaatacggccactgctgtgctgcttgctcctatcgctcttcactcggccgtacagttggggctgagcccttatccgttcctgtttgccgtgacagtggcggcaagtatgtgttttgcttcacctttctccacgccgcctaatgcgttggtgatgccggcaggacgctatacgtttatggattacgtaaaagtaggtctgccgcttcagatcattatgggcgtggtaatggtgttcgtattgccgctactgtttccgttttag

SEQ ID NO: 1792 - DNA, 1068 bp, B.fragilis
caaaaaggattaaagaatatagaaaccatgaagaaagaaaatgatgaaataaccgatctgttccgttcccgtctgggaaatgccgaaatgaccgtgcgggacggtttctgggaagaactgaattctgagatgatggtgcgcagccatcaccggaaagtagttttctttcgtgtagcggcagcagcttccgtactgctggtattggctgcttcgtcggctgctttctggttcttctctccgaaagcggagatagaagaagcttttacccaagtggcggttgtcagcggaaatacaacacatctggatggagacgtggtgaaacaggattttacccctatgcgctccgaaccggttttgggtaaaccggctcccaagcgttccggtgttttggcacaatcatcgggagaggaagatgattcggtatcggttacagtctccatgtcattcagtttctcttctacgactacacgcaggagacaaaataatcatccggacaaaagttattggcaagctggtggagaaggtggggctttggcaagttctgctgatggaccccggccggacgatcacacagttgtggcggacaaatcgaggacatgggctgtgaaagctgctgtgggtaccgctttgcctgccgctaacggtaagtacaagatgcccgtaactgccggactgacggtagagaaaaaaataaataaacatttagctgtcgaaaccggtttattgtattcaaacctgcgtgccgaacagaatctgcattatctgggaattcccgtaaaactgaatatgacgctggcggaaactcccaaatttgatctatatgcttcggtaggcggagttgcagataagtgcatagcgggagcgccggataacagctttaagaatgaacctgtgcagctggctctgactgcgggcgtaggaatgaattataagaataatgataaacttgctttatttgccgaaccgggagtaacgcaccatttcaagacaaactccaaactggaaacagtacggtcggcgaagcctacgaattttaaccttgattgcggtctgcgtatgacctattaa

SEQ ID NO: 1793 - DNA, 1038 bp, B.fragilis
tgccgacaatcccgacatagagctatgatgaagagacataatatactgacggtactggcagtcctgctgctcacctttgccgcatgcgataaaaatagtgcccccggattcagtttcacgactgactccatccttacattgactttcgataaagagctggatgccgcctttgtcggagtggggacccaaaattacaatccggtgggaatgcggcgttcgggcgatactcttttcattgccaaccgtgccgaaggttctgacggtgtgtgggtggtacgcgcttcgaccggggagttgctttattcgctgaccggctggacctacaacgggaaaaacgagaagttcgacaatcaggtgatggatgtggcggtcagcagcgattacatctttgtggtgaaccgttcgtcccggatcgacctgttccgacggaacgattattcgtatgtgaccaccatcgggcgtaccggatggcagtcgagttctctgttgcaatgcgaagcggccgaagtggctggtgataaattgttcatccgtgacaaacagaagattaaagtggtgcagatttcagattgtacgcctgaaaatcgttttaaggttcctgtctttgctcagaatacggacagtacgtcttctaataacggttttaatcttgagtccgttgcgcggcatgaaggcttgatctatgtgtccgactacgaaacctcacgcatcctggtgatcgatcccgccaccgtggcggtcaagggagagccggtacgctttttgcgctcttaccgcatgccgaacaaaccgctcagtatgggattctttcagaacgaaatgtatgttgtctgcgcaaataaccgcatcgtgagagtagacctccgtaccgggaaagagctcggctcttattcatcctttgccggaggagtggggctgggaactcccggacgcctctttttccataatgatacattctatcttgcagggcgcaatgccaatgctccccggctgatacaggggaaagttatgtttgttgaaatatccgagctggactaa

SEQ ID NO: 1794 - DNA, 714 bp, B.fragilis
tcgcttatgtcaaccgatcatatatccacacatcccgactcccctcttcacggaaacgggatcgggagtgaggctatcaacctcgctgccatccggcaggagtacaccaaaggcgggctgaaggaaggagatctttccgacaacccgctttctcttttcaaccgatggctccacgaagctatcgatgcacaggtagacgaacctactgccatgctggtaggcaccgtatctcccgaagggcaaccatcgacccgtaccgtactgctaaaggatttgcatgatggaaagtttatcttttataccaattacgaaagccggaaaggtacccatctggcaaagaatccgtatatttccctctctttcgtttggcacgcgctggaaaggcaggtacacattgaaggcattgcctcaaaagttcctgccggagagtctgatacctatttccgccaacgtccctacaaaagccgtataggagcacgcatctctcctcaaagccgtccgttgaaaagccggatgcaactgattcgcaatttcgttgcagaagcagcccgatgggtaggcagagaagtagagcgccccgcacactggggaggatatgccgtcactccccatcggatcgagttctggcaaggtagggcaaaccggcttcacgatcgctttctatattcccttcaaccggacggaagctggcagaaagagaggcttgctccctga

SEQ ID NO: 1795 - DNA, 1221 bp, B.fragilis
attatccggtccctttttttgatatactgcttaattaaatttatctttgtttttctaatcccgcaagatatgaaaaacacatttattcttttcctcgttgctctgagctttgtttgcaactcttgtaatcggactccctctgtggaagagcccgatgttctgaaagtagagttgaaggaaactcctgtttctgtttccgatttcttttctaaagttgaagtgattccgttggaaacttcggacagttgtctgctggccagaatcttgagagtacgggtttctggggatactacttatatattgactcaggattatcccaccttcaggcatatcacgttgatggcttttgacaagaaggggaactaccttcgttctatcgggcgagtaggacagggtcccggtgaatattcacaggtttatgatgccgttatcagtgagcagcggaaccgggtatatatgttatctcctttcggatcgatgtatacctatcgtttggatggttcgtttatagacagaaagatattgccgcagaaaatgaactttcaggagattggactgactccggatggcgatctgctgacgtggtcggcgcagaacaaggatgacggggcttgtatcatgcggttggatgccgattcggcgaagttgatcaatgagttctggtccgatgatttctggttgaactgggcttgtagggatatgttctattcctatcaaggcaaagcttactttgctcccgctttttatgaagaggtctacgaacttacgagcgatagcttccgtgtagcctatcgctgggatatgggagaacagaatataaatatagcacaatatcatttcaattcgaatccggacacacgcagggaggaggacaggcggctgaacgaatatcgtgaaaccggtaaaatagcctttaatttcaccaatcagtaccaaaacggaaagtactattatgctcaattgctcagcttggcatccaaacccaaatggaaatacacaaatcttttttatcgtaaaaaggatggagctgtcttctattttgagaagacacgagagggtatccgaatcgatccggaagtgttaaccgaggattttatgctttgcatcgttccgacagaagagctggagaattataaaagtatccttcccgaggaagaatatcgggtgctgagtaaaagggtggaagatgataatccctgtgtggtgaaattttatttttag

SEQ ID NO: 1796 - DNA, 648 bp, B.fragilis
ttgaagatgtttaagtatttgaaaggattttggcgatatttgttaaggaagcgagtctcatcattatcactgattgatgatctttcaactattcatccgaccgctagggtatattcgggatgtaggataattcaatcagatataggagcatattcttatgttggttatggctctattctcgtaaatgtagctgttgggaaattttgttctatcgcaggagatgttgaaataggtttagcaactcatcgcatggatgctatttctacttctcctttgttttattcttctaataatgctttggggatatcttggacctcatattcttattttgatgattctcacaagccagttagtatagggcatgatgtgtggattggtacgagagtggtaattatgggaggggtgaagattggtgatggagctgtcattggtgcttgtgctgttgttactagagatataccaccatatgctatttgtgtagggattcctgctaaagtgatacgctatcgattccctagagagacgatagatgtgttggaacatgcggaatggtggaattggtctgaagttctattaaaagaaaatatagaaaatttcaatggatctgatactcttttttttaatcgtataccattaaaacagaaatga

SEQ ID NO: 1797 - DNA, 738 bp, B.fragilis
atacatccgcctatgattctggattatatataccacagcgggttcgccatcgaagcagaaggtgtaacccttatcattgattattacaaagactcttcagaaacggaactgaataaaggaatcgtgcacgaccgtctgctccaacgtcccggaaaactgtatgtgcttgcctcacatttccatcccgaccacttcaaccgggaagtactaacatggaaagagcaacgtccggatatcatctatatcttctcaaaagacattctgaaacaccatcgggcacagaaagaagatgcgatctatattaataaaggtgaagaatacgaagatgatatgctacgtattcaggcattcggttctacggatgtgggcatctcctttctgatccatctgcaaggcaagagcatttttcatgccggtgacctgaacaactggcattggagcgaagaatctaccgaacaggagatacgcaaagcagaaggagacttcctggcagagataaaatatcttcaggcagcagttccgaccatcgacctggtaatgtttcccgtagaccgccgaatgggaaaagattacatgaaaggagcccaacaattcatcgaacgaataaaaactactatatttgtacccatgcactttagcgaagactacgaaggaggcaatgccttccgatctatagccgaagccggcggatgccgtttcataaccatcacccaccggggcgaaagctttgatatataa

SEQ ID NO: 1798 - DNA, 1092 bp, B.fragilis
ataaaacatacaattatgaacaaactgacacaaattttcctcgtgttatttatgatttgcctgcccgtgacactttgggcagacaatgacaaagatgatgatgacagcagataccttgcaggcgccgtgcccgaagttgacggacgggtagttttcagccgcgaattcagtatccccggtatgtcgcaagacgaaatctatgaacggatgctcaagtggcttgacggacgcatggcccagaacaaaaacaatagccgggtggtatataaagaaaaaggagtcatcgccgcagccggtgaagagtggttggtattcagttctaccgccctttctctggaccgcacctggctgacataccaagtcaccgtaaactgccagccccaaaagtgtacaatggaggtagagaaaatccggtacacctatcgtgaaaaagaaaaatatgcggctgaagaatggatcaccgataaatacgctctaaacaaagcgaaaacgaaaatggtacgtggtctagccaaatggcgcagaaagacagtcaactttgccgacaacctctttgaagaagctgcaaaggcactgagtcagaaacctatggaagcaaaagcagaagccactccgaaaaagcctgccgtggtaaccgcaccgaaagtcgtggttatcggtgataatcaagagactggaaaagtagaaaaagcagcagaacttacccctgcaattcccgttatctctccaagcacgatgccgggttataaagaagtagcccccgaccaggttcctgccaatgccattcagatgggtgcaggccgactggtgattgctatcggttccgatcctttcaatatgaccatgatgacagccaacgccggaggatccataggaaaaatttcgggaagtcctgttgtattcagtatcctttctcccgaccagccttacgaacagttggagaaagcagaaacatacagcatacgcttctatcctaccggacaaaaagaaccgtccgtcatactggaatgtcagaaactaccggccccgacacctatggaaggacagcccagaacttatgcaggtaaaataaccaaagcatttatgaaataa

SEQ ID NO: 1799 - DNA, 549 bp, B.fragilis
ccatttagtacggatgttatgaaaaaaacatttttaatgctgctcacacttgttctgtcattgcttacttgcgtaagttgcagcgaagagacattagattacaacaaccccgatgtagaccttttcgtaaggcaactcaaagcgggaaattataataccaagagtccgaagggctttgtagaagtacctaaatttacggagaaggatattccgacattgctcaattatgccgaagatctgactttgatcacttcttttccgctgccgccggtgtctgcttattatagtggcaaggtccgcttgggtgaatgtatgttgtgggttgtggaaaccatccggttaggtcattatgcttcgtttggttgcaaaatggtgagagccaatgccgagaactatgaaggtatctatttcctgactgatgaagagttgctcgatgctgctgcccgataccgtcgctggtgggaaaacaggcagtatcctcgtacggcatggaccatcgacgcatgctttgacgagcccctttgcggaagcggataccgttggtggtaa

SEQ ID NO: 1800 - DNA, 183 bp, B.fragilis
aatgcgttaacaatgttaattgaagaaagatataaggatgaagataccggttcagacggcgtaaattcacttcctaaacttgagttatcttattcagccggtgtctgttttttcttatcaaagcaagcaaaaaggacaattatcaacttggagataaagaatttaccaccaaatttgatttaa

SEQ ID NO: 1801 - DNA, 474 bp, B.fragilis
atgaaaacaacccttatcgtcgtaggacggactgtagagcagcattatatcactgcaatcaacgattacatagagcgtaccaaacacttcatttctttcgatatggaggtgattccagaattgaaaaatacgaaaagcctgacacccgagcaacagaaagagaaggaaggcgaactgatagccaaagcccttcagccgggagacgtggttgtgttgctggacgaacacggaaaagagatgcggtcggtggagtttgcccgctggatggagaaaaagttggtaaacgtcaacaaacgcctggtatttattataggaggaccttatggcttttcacaaaaggtatatgacgcggcacacgaaaagatatccatgtcaaaaatgactttttcgcaccagatgatccgcctgatctttgtagaacagatatacagggccatgaccatactgaacggcggaccctatcaccatgaatag

SEQ ID NO: 1802 - DNA, 2886 bp, B.fragilis
acactccccgcctccgtagcggaagcttatatcccctggcgcagacgtgacgccaatcccgaacaaaaagggattattgtgatcaatgcatctaccggcaaagcggtagacaatgtacttccggtggaaatcaaccgtgaatacggacgcatccgatttgacgcaagcggaaatgccggagattattatgtgtactacctcccctaccacacctcgggagggccctatccgaaagtaaactatcctcagcaaccggataaggcggatccgcaatggaaagcaacctgtaaagccactccggccggaaaggcggtacaagccaagctggtacgtttcgaatcgctgggcagtttcaacagcttctatccgatggaaatcatcgccacagcacaggagaagcaggcattgatcgatgctaacagcaacaagcctttcctgctgttgcccgaagaccgtaaatatcccatccgcatgttcgatgatctgtcataccgccaggtgacgcaaggagccacaggcgagtttttcggtgaagcggatctgaacgaatactatgtgctgcaactgggactgtgggcattcaagaatccggtgaacggagtcaaagtaacctttaccgacctgaaaggaaagaacgaaagtatacctgcatcggctcttacgtgtttcaacacggaaggaaccgactggctgggacgcccgatacatccggaggtaaacgtcggtaaaggccgtgtacaacctttatggatcggcatccagatgccggaacatgccggcagagggatctaccggggcacggtcaccgtgagcgacctgagcggtgcttcacaggaagtgaacatagccattaacctgtcggacaacgtactggtagacaaaggagacggagacttgtggcgtttgtcacgtttgcgctggctgaattcacagtatgcagtcaataaccggccggtgaagccattcattccgataaaggtggcagaccgtacaatcagcgtgctgggacgcagcgtcactgccggcgaactgggactgccggcttccatccggagttacttcaccgaagagatgacttccataggcaaagaacccaaagacattctgtcacaaccgatggaatttgtcattcgccagaatggaaagccactgcccgtcaccatcacttcaccgctaaagttcggcaagaaggaagacggaacggtaagctggaccgctaccggaaaagcaggggcactggacttaacagtacttgcaagtatggaattcgatggtttcatgaattatcagatcaaagtaaaggctgccgaaaatacatcggtagacgatatagccctgttaacttccatgccggcaacaacggccaaatatcgtttgggaatgggttatgaaggctcactgcgcccgaaaagcgaccaatggaaatggaatgtggaacagaatcaggaaggtttctggtttggcgatgtaaacgccggcatgcaatgcctgttccgtgcagagaactatcgccgtccgctaaacacaaacttctacaaaatgcaaccgttgaacatgcctccatcctggtttaacgacggtaaaggcggcatcagctataaagagaaaggaaaccaggtagacatcaagacatacagtggcagccgtaccctccaaaagggcgaagagctgaacttcgacttcttggtactggtaactcccttcaagcccatcgacacgatgaagcaatggaccgaccgctactaccacggataccagcctgccgagaaactgaaagagggcgacgcacacgcctaccaggctgtagacgttgtgggagaaacaggagcaaacgttatcaacctgcatcacggcaatgcggtgaatccgcatatcaactatcctttcttccgccctgccttcatgaagcagtacgtagacgaatcgcatgccaaaggatataaagtgaagatatactatacggtacgcgaactgacgaaccatgcaccggagctgtttgccctgaagagccttggacacgaaatcttctcaccgggcaagggaggaggctatgcctggctacaggaacatctggacggcgactacatcggagcctggtttgtagatgcttacaaggatgcggcaatcgtgaacaccggcatttcacgctggcacaacttctatgtggaaggactgaactggctgacaaaaaatgtcggcatcgacggagtctatatcgatgacttggctttcgatcgtaacacgatgaaacgcatccgccgggtactggaaagtaaccgtcccgatccgcgcatcgatgtccattcagccaatcagttcaatccggccgacggttacatcaacagcatattcctttacatggagcacatgccttacctggaccgcctttggtttggagaatactttaaatacgaaaagtcaccggaatactggctgacagatgtatcgggtatccccttcggcatgatgagcgaaatgttgcaggatggcggcaatccttatcggggcatgctgtacgggatgaccgcacgcgaaccaatggaatccatcccctcacaactctggaaggtgtgggatgcattcggcataaaagacagccgcatgatgggctattgggtatcctacaatccagtgaagacaggacgcaatgacattctggcaacctcgtttgtgaaagatggcaaagtaatgattgccattgccagttgggcaaaaaaagacagtgatataaaactgcagatagattgggagaaactgggcattgacgctgataaagccaggctgacggctcctgacatcaaaggtttccaggaaggattcagcctgtcgccaaaagataaaataaaagttcccaaagacaaaggattcatctttattctggaataa

SEQ ID NO: 1803 - DNA, 597 bp, B.fragilis
acaaacgacgcagacatacgttcgattttaaaaaggcaattgacattggaaaacgagatagaactgataaagggctgtcgggcaggaaaggattcggctcggaaggaactttataccctatactcgaggcaaatgctggcggtatgtttccgctatacgggcgatatggaagcggcgcacgatgtactgcatgacggtttcatcaaaatattcaccaacttttcgtttcgtggcgaggcttcgctcggaacgtgggtgacccgggtgatggtgactcaggcactggattacctgcgaaggcaaaagcgggttagtcagttggaggtacacgaggaacagctacctgacatccccgaccttccggaaggaggggaggcagggcgaatttccgaagaacagttgatgaagtttgtcgcagatctgcccgatgggtgccggacggttttcaacctttatgtgtttgaagagaagtcgcacaaagagatagccgatatgctgggtatcaaagagcattcatccacttcgcagttgcaccgggccaagtttttattagcaaaaaggattaaagaatatagaaaccatgaagaaagaaaatga

SEQ ID NO: 1804 - DNA, 588 bp, B.fragilis
aaaacctttcttaatgaattaatctttcaaaaaacacgtattgttatgattgaaaaagtattcaaagtgggtgatacaatcaccatcaaacgtacctcacaagcaggtactggttatcgttacgctttagtacgcctgaccggcggagttgcccttgtagaggaattgtcagaagatgccgatactccgggaggaacgtctgtacagtcttttatcttccggtttttacagccggggcaggtagagattcagtttgcctattaccgtgactctgaggaagtgctttacgaagatgtattctcttatgaggtggttacttcggagaaagcgaacccgataatagggggctggggagaattcaaaccgttgacggatcaggagaaagagatattccgtacttgcatgacattgaagggtgtggactatactccgcttctggttgccaagcaattggcaagcggatataactaccgcttcatctgtatgactgaattactaatccgcgaacccaagtatggttttgccaaagtcactatttatgctccgctgagaggagaacccatattagagagtattatagagtgttga

SEQ ID NO: 1805 - DNA, 486 bp, B.fragilis
tttcaaaattatatgaatcaagtccaaaatctgcaacacattgcccgtgagttgctttatttgggtatggatggttctcccatctataccgatcatttccgtcaactgaacaccgaagtttttcgcttgtccgaagcccttttctctatgaaaggtgccacatccgaggaagaagcagcgatttgtctgtccctgttaatgggctataatgctaccatttacaatgatggcgacaaagaatctaagatacaaagcattttagatcgctcttttgccgtattggaccatcttcctgcttctctattgaaatgccaattgctgacttattgctatggcgaggtattcgaggaggatttagcacaagaagcacatcaaataatggatagctggaaaaatagggcactttcagaagaagaattggaagtgatggagacattgcagacaatggaagataatcggtatccgtgtagtgaggtagaagattga

SEQ ID NO: 1806 - DNA, 183 bp, B.fragilis
acttgcaaatactttgaaaaaaaatgcttcataaaaatagtgtttgataagtcggattctttgtttacttttgcaaatcaattaattataggaaagtatgaagaaaaactttttttatgcaggtggtctgtcattgcttctttggggtatggcagcatgttccggacaaggaaaagcggataa

SEQ ID NO: 1807 - DNA, 339 bp, B.fragilis
ttattttgtctcctgcgtgtagtcgtagaagagaaactgaatgacatggagactgtaaccgataccgaatcatcttcctctcccgatgattgtgccaaaacaccggaacgcttgggagccggtttacccaaaaccggttcggagcgcataggggtaaaatcctgtttcaccacgtctccatccagatgtgttgtatttccgctgacaaccgccacttgggtaaaagcttcttctatctccgctttcggagagaagaaccagaaagcagccgacgaagcagccaataccagcagtacggaagctgctgccgctacacgaaagaaaactactttccggtga

SEQ ID NO: 1808 - DNA, 519 bp, B.fragilis
atgtctgaacaacaggagtattggtttgccgctcggacaaagaaggatcaggagttttctgttcgcaatgctttagaaaagcttggaatagaatactttcttccaacacaatttgtcatccgtcaactgaaatatcgtcgtcgtagggtagaagttcctgttatcaagaatcttatttttgtccggaccacgaaagaccgtgcctggtctatcacgaaggatgatcatgttcctctttattatatgaaggatctctatacccatactttgttgatcgttcccaacaaacagatggaagatttcaagtttgtgatggatttagctccggaaaatgtaacttttgatgatcttccccttaccgttggtacaaaagtgcaggtcgtcaaaggagagttttgtggcattgagggcgaattgtccagccttgccaaccgtacttacgtagtgattcgtattcacggagttctttctgccagcgtcaaagtacctaaaagttaccttcgtattctttcagcgtaa

SEQ ID NO: 1809 - DNA, 1305 bp, B.fragilis
ataattaataaaaataaaatgaatatggaagaaattcgaattgctgttattggattaggatatgttggattgccattagcgcgtttgttctcaacaaaatttaaaactgtcggttttgatatgaataaatcgcgagtggattctataatgaaaggacatgatgcgaccctagaagtgtctgattcattattacaagatgcaataactaataatcattttatgtgctctaatgagttgagtataattaaaaattgtaatttttatatagtggcggttcctacacctgtcgacttggataatcgtccagatttaagacctcttttaagtgcaagtgaaactgttggcaaggttatatcaaaaggagatattgttgtttatgagtcaactgtataccctggagtaacagaagaagagtgtattccacttatagaaaaggtttctgggctcaagtttaatgaggatttttttgcaggttattctccggagcgtataaatcctggggataaagaacatactgtcgaaaaaattataaaagttacatcaggatcgacacctgaaatcgcagagattattgatagagtttacaataaagtattggtgaatggtactcataaagcaccttctataaaggttgctgaagcttctaagattattgagaattctcagagagatgtaaatatagcttttatgaatgaattggcaaaaatatttaatgcaatggggattgacacaaatgatgtaattgccgctgcttcttcgaaatggaattttataaaattaagaccaggattagttgggggacattgtattagtgtagacccttattatttgattcaaaaagctcaagtttatggtatatttcctcgtataatgtctgctgctcgacgtttaaatgacggcatgggagattatattgccaatcaggtaatacaattaatgaataaaaaggggattttggtgaaggatgcccatatacttattttaggtgttacatttaaagagaattgtcctgatattcgtaatactaaaattgttgatatttattctgtattatctgagtatacatctaatattaaagtttatgatccttgggtaaatcaaagtaaaattaaagaagagtatggaataaatgtaattaatgaagatctaaagaacttagaaggaaaatttgatgtaattattttaggagttgcccacgattgttttaaaaatatacaagttaatgatcttttaaaaaaggaatatggggtcgtatacgatgtaaaaggtgtacttgatagaaatattgtagatggtagattgtaa

SEQ ID NO: 1810 - DNA, 1029 bp, B.fragilis
aatgtaaataagaaaattatggcatatacaatcgcattttttggtaccaaaccttatgatgaagcttccttcaacgagaaaaacaaggaattcggattcgaactccgatttttcaaaggtcatctgaaccgacacaacgtattgctgacacagggagtggatgccgtctgcatctttgtcaacgataccgcagatgccgaagtaatcagaacaatggctaccaacggagtaaaactactcgcccttcgttgtgctggttataataatgtagacttgaaagctgcagccgaaaacggtgtaaccgtcgttcgtgttcctgcctattctccatacgcagtagccgaatatacagtggcactgatgctctcgctcaaccggaaaattccacgggcatcatggcgcacccgggatggaaacttttcactgcacggactgttaggcttcgatatgcatggaaagacagccggtatcatcggtacgggaaagatagccaaaatactgatacatatattaaaagggttcggcatgaacatactggcgtatgacctttatccggattacaactttgccagagagaatcaaatagtatacaccacactcgacgagctgtatcacagctcggacatcatctcactacactgccccctcacggagcagaccaagtatctgatcaacgactactccatcagtaagatgaaagacggcgtgatgatcatcaacaccggccgtggacaactgatccacaccaatgcactgatcgagggactgaaaaataaaaagatcggttcggccggactggatgtatatgaagaggagagcgagtacttctatgaagacaaatcggaccgtatcattgacgacgatgtactggcacgcttgctgtcgttcaataatgtaatcgtaacctcccatcaggctttctttacccgtgaagcgctggccaacatcgcagcaacgactctggagaatatacgggatttcaaaaatcagaagcctttggtgaacgaagtcaagttgagcaatgcctaa

SEQ ID NO: 1811 - DNA, 315 bp, B.fragilis
tatccaaccaaaaggaatagtaataacatccaagataaactcaccaatcctcttttaagaaaagaatacatcacaactaaaaatgggaaaaacagtataaaagatgatgtcctcactccacataatatagaaaataaaaaagaagcagctacaatcgaatacttcccatatttaaacattataagcgctacaaatgctataaaagcacctccttccttgggattagaaaataaaccattcctatatattaaattattaatgccaatagcatcttctgacaactttacaacatattttaaattaatgatttcataa

SEQ ID NO: 1812 - DNA, 993 bp, B.fragilis
aagataaacaaaggcatccttgttcctttttcaaaaaacgatataactatgaacagaatttcttctcttttcggtattcagtatcccattattcagggaggtatggtgtggtgtagcggctggaagcttgcttcggctgtcagtaatgccggtggtctgggactgataggctccggttcgatgtatcccgacgttttgcgtgaacatattcgtaaatgccgggcggctaccgacaaacctttcggggtaaatattccgttgatgtacccacagatagaggaaatcatgaacatcgtggtggaggaaggagtcaaaatcgtatttacctccgccggaaatccgaaaacgtggaccggatggttgaaagagcgcggcatcacagtggcacatgtcgtttcttcctccaaatttgccatgaaatgtgaagaggcgggagtcgatgccatagtggctgaaggatttgaagccggcggacataacgggcgggaagagactacaactctttgcctgattccggcagtgcgtgaagccaccactttacctttgattgcagccggaggcattggtacgggagaggcgatttttgccctgatggcgttgggagccgaaggagttcagatgggcacccgttttgctttgacggatgaaagttcggcaagcgacatttttaaagagtattgcttgcggctgaacgaaggcgataccaaattattgctcaaaaaactcgcaccgacccggcttgtgaccaattcgtttcgtgatagggtagaggccgctgaaggacggggggcttctgccgaggaacttcgtgaactgttgggtagaggtcgtgccaagaaaggaatctttgaaggagacctggaggaaggagaactcgagataggacaggttgctgccctgttccgccgtagacaaagtgtggacgaagtgatgaaagaacttttagaaggataccggagggcttcggacaagatacgttctgccgggttataa

SEQ ID NO: 1813 - DNA, 663 bp, B.fragilis
atgatgaaaaatgattcagcagtagtcctgttcagtggtggacaggattcgacaacatgtctcttctgggcgaagaaacactttaagaaagtatatgcgctcagtttcctgtacgggcagaagcatgcacacgaagtggagttggcccggggaatagccgaaagggcaggagtggaatttcatgtaatggatacctcttttatcggaagccttggcagcaattcattgacagataccagtatctcgatggacgaagacaagcccaaagattcatttccgaatacttttgtgccgggacgcaacctgtttttcctgagcattgccgctgtctttgcccgtgagcagggagctttccatctggttacgggagtttcacagaccgattatagcggttatcccgattgccgggattcgttcatcaagtcgctgaatgtcaccttgaacctggcgatggatgaacagttcgtcattcacactccgttgatgtggatcgataaagccgaaacctgggcgctggcggacgaactcggtgtgttcgatcttgtgcggaacgagacactgacctgttacaacgggattcccgccgacggatgcggacattgtccggcatgtaagttacgcaagcagggactggaagagtatttaagtaaaagaaaccgttaa

SEQ ID NO: 1814 - DNA, 1161 bp, B.fragilis
aaagtgaaaaaggttaaaatgtgctgtttgaagagaaggaacatctttattttatttcaatttctgttgatattatgctttatcttttcatctataggtgaaactttttattcttctgtaaatacaaatacgcaatatattattgttttattttctttttattatttattttctattttgtgttgtaggggagtatatccagaccaattaataatattgctatatgcaatattattatctttctttatgacctatctttctagtcgaggaaatatcaatatgctgaaaataaattatatatatatatatcctattttcttaggctatttactttcatatagattcgagaatggttttgtactaagagtgttacaggtgtgtttgatagctaatttcttggctatttgttatgaaatcattaatttaaaatatgttgtaaagttgtcagaagatgctattggcattaataatttaatatataggaatggtttattttctaatcccaaggaaggaggtgcttttatagcatttgtagcgcttataatgtttaaatatgggaagtattcgattgtagctgcttcttttttattttctatattatgtggagtgaggacatcatcttttatactgtttttcccatttttagttgtgatgtattcttttcttaaaagaggattggtgagtttatcttggatgttattactattccttttggttggatattatatgttctattatatgtctgatgtaagttcgcttatggaacgttttataaatctactaagtactacggatgagggtaactcaatgcggttggtttttatgaaaaagcatgtcgatatatgtgttgatgattacaatttatttgattatttatttgggcgatttggatattcaagaaaccagattggcaatggggcagaatcttcttggcttgatttattgacaaatgttggaatatcaacttttttgttatatgtgattccactgtgtcaaataattgtctgttctcaaaaatggataatgaaaataacttatttggtactttttgtgtcaatggggatctctagatttggaattggaataacaagtggggtcttattttggctgttaatttttcaagaattaaaagaaagtaaattgtctaaggatatatcttga

SEQ ID NO: 1815 - DNA, 1056 bp, B.fragilis
aatattatgaatagatatccttatattatcgctgaaataggaggtaatcataatggcgatatggagctcgcacgagaaatgataaaatctgctaaagaacatggagctgatgccgtgaaatttcagctttaccgtaaagaagatttatggactaatgatcatttagaagagttaaataatggagttgttaatttggaaaatgtatctaattggtctactcaggagttagggctcaagaatatatttgagcaagttgaaaaattttccgtccaagaaaaagatcatattgttttttttgattatgctagagagttcggtatagattatgcaacttctgcttttactaagcaagatatagatttctgcattgatcaaaaagttgcttttttaaaaatagcatcttgtgatataacaaatttggatttaattgaatatgctatttcaaaggattatccattgttaatatcattggggttagctgatttgggagagattgaacaagtcgtaaatttgattcctgagaaatgtagaccgaatattactttattacattgtgtgtctttatatccacctaaagatgaaattgtgaatctaaaatttatgcatacattaacttctacctttggcttgaatgttggctattctgatcatactttaggggtgtctatatctttagcagcggtagctttaggagcaaaggtcatagagaaacattttactttagataaagaaatgcccggttgggatcataaagtttctgctaatcctgaagagatggctgttattagtcgagaaactaaaagaatagttgattcactcggaaatggtattaaaactatttctgaagatgagtttgaaaaaagaaaaaaatttagaagaagcataactactaaatatgttttacaggaaggacatgttataagttatgatgatatacttttcaaacgacctggaacagggatttctgcaaatcgattgaaagatgtaattggtagaagagtaaatcatactatagaagcagataaaactttattttgggaggatttgataagatga

SEQ ID NO: 1816 - DNA, 1167 bp, B.fragilis
ttatatatgaaaattgttcatttgtgtttagcgagtttttttgtagataattatacttatcaggaaaatttgctacctaagtaccataaaatggcaggacacgatgtcactattattgcttcattggtctcattcagtgaaaaaagaaaacctataattttgcctggtgaatctatttatgaaactcaagagggatgtagagtgtatagagtggattataaacgttcattttatttttttaatcgattgctgagaagatataataaattgcaatctttgttagacaaagaaaggcctgacatgatttttattcatggggttcagtttgcaaatgtctcaattatattgaaatataagaaaaaatatccaagtgtacggatactatgtgataatcatgctgattggattaacagtgcaagaaatttattgtcaaaaaagattttgcatggaattatttggagatattatgccaataagatagagccatatgttacaaggttttatggagttactcctttacggtgtgagtttttgaaaaagatgtataatattccttcttcaaaggttagtttgttggttatgggagttgatgattgggggataccatgggaaaatagaaatgcgatccatatgaaaataaggaatcaattgaatattgcacctagtgatttcttgattattacaggaggaaaaattgatgaaagaaaaaatattcatttattaatggaagctgtattaaatagctttgagagtaatattcatttggtggtatttggtaatatagctcctgaaatgaaaaaaaagattgattctttggaggataatgaaaaaattcattatgtaggatggttgtcctctgagaaaacgatagagtacttttttgcatcagatttagctgtatttcctggcacacattctgttttgtgggaacaagctgtaggaattggtattccatcaattttcaaatattgggatgggatgacacatgttgatttaggaggtaattgcttgtttttgttcgaaaatagctctgaagaaatttcaaaaaaaataagttctctttcttcaagagagacaaagtatttagaaatgaagaaaatagcttcttgtttcgctcataaattttactattctgatattgctaaaaaagtaattgaagatgtttaa

SEQ ID NO: 1817 - DNA, 1329 bp, B.fragilis
tttaatatgaaaaataaagtagatatactatctttcacttattctagtaagggaagggatattgatattgtggaaccagtattaagcaaattggaactagagttaggtgttataataaagcgatgttggttatatgacaattttgtttttgatatattaaggtataagcctaagatgcttattttagctaatgctatcggatgtcattatcatttttgggctgcaaaattcgcctctatgttaggaattaaagtggttacttttgtttctgagggtgactatcgttatataaatggttcaattacaacaatgttatacggttggaataaggaagagcatttgtatgaagatttacatcttgagtggtcacaaagaaatattaattacttttctactagtcctagctttgatgaaaatatagttaaattatctggtgctacaggttttgataaatataagcttcttaaatttcttaataagaatgattttttaatgaaatatgatttaggacattatgaaaaaatagttggattaggaggttggacttttgactttgcttttaacgagaatcatagtactggaccaattttttttggaaaagagttggatggtataaaggcatctttatttgcattgcgcgaaggctatagggcattggttacaaataatcctgatatattgtttatttgtaaaaagcatcctttgacaataaatgaatattatgatgagttttctttggtaagagaatatcctaatgttataacactacaaaccgaagagaatatttatgatttaattaatgtttcagatctatggataacattcgactccacaactgcacttgaggcttggttattgggaaaaacgacattactttataatcctgttattcaggattttaatagatcttcaataatgaagggcagtccaatactgactactcctgaaatgctgattgactctgtaaaagaattttatgagaataataggattattgatgccttttcacaaaaagaaaatgaacgtaataacataataaaggaagtgattgcgttttgtgatggaaaaaattatcttagagctgctgatctgataacatctttgtatttaggtgagaaaaagaaaaaggaaaaagttcatgttgcttttattttgaagatgggggggtgtggaattagaaatttcttgagaaatttggttgcttattctaatttttttgatgttatacctcgtgtaagacgatttaaaaatacccgattggcattatataacgagaaagaaagagagtactatagattgatttataaagaagcgataactaatgattga

SEQ ID NO: 1818 - DNA, 603 bp, B.fragilis
gaaagtatgaagaaaaactttttttatgcaggtggtctgtcattgcttctttggggtatggcagcatgttccggacaaggaaaagcggataaagcagctgttgttgcggatagtgtagtggtgaaaacggatagtgttgcggcagacagcacaggatatattgtgaaagtgggagagtcagctcccgattttaccattactctgaccgacggaaagcagatgaaactctccgaacttcgcggtaaagtggtgatgttgcagttcacagccagctggtgcggagtatgccgtaaagagatgccttttatagagaaagatatctggctgaagcataaaaacaatcctgagtttgctttgataggcattgaccgtgacgaacctctcgataaggtgatcgcatttggaaagtcggtaggggtgacgtatccgttgggattggatccgggagcggatatctttgcgaagtatgcattgcgtgaatcgggcatcacccggaatgtcctgatagaccgggagggtaagattgtgaagctgactcgtttatataacgaagaggagtttgcctcactggtggatcaaatagatgaaatgctgaaaaaataa

SEQ ID NO: 1819 - DNA, 1296 bp, B.fragilis
cttataatgaaaacattttttagatctgtagctatgctactcggactgggactcttgcctttagcggcacatgcccagaaaaaagtaatcatcgaagatgaagaaccgaactccgtgatgtttgtatcgacaaacaaagccggagacgagattatccggataatgaacgaaacacgcctcccgcgtttccacgaaccgaaggctccacgctttgtactgaccgaccgacaaggaaaattcgcactgggtattggtggatatgtccgggcaactgccgaatatgacttcggaggtattgtgaaggatgtggatttctatccggcactgatccccaacaaaggttctgccgaccgtgcccgcaaccagttccagatggatatcagcacttccaccctcttcctgaagctggtgggacataccaaacgtttaggggatttcgttgtttacaccgctgcaaacttccgtggagacggaaaaaccttcgaactgcaaaatgcttatgccaccttcctcggctttaccctgggatacagttatggtaactttatggacctggccgccctaccgcccaccatcgacttcgccggccctaacggctcagctttctatcgtaccacccaattgagctacatgtgtgacaaactgaaaaattggaaattcggcgtcggtgtcgaaatgccttcggtagacggtaccacgaaccagtatcttaccatcaacacccagcgtatgccggactttaccgcttcagcacagtataactggaatgccaacagccacctgaaactggccgccatcgtacgcagcatgacttactcgagttctgtggacaacaaggcacattcaaaagccggatacggccttcaggcttcgacttccttcaacgtaactccgaaatggcaggtatacggacaggtgaattacggaaaaggaatcggacaatatctgaatgatttgagtaacctgaatgtggatatcgttcccaatccggagaaagaagggcgtatgcagacgctccccatgttgggatggttcgccgggctgcaatataacatcagtaaaaacgtctttgtatcgggcacttacagtctgtcacgtctttattcggaacatacctatccgagcgacgagcccgatatgtaccggaaaggccaatacctggtagccaacctgttctggaatgtaaccagcaacttgcaggtaggtgccgaatatctaaggggctggcgcacagacttcagcagcaatacccgccatgccaaccgtatgaatgcattggtacaatattcgttctaa

SEQ ID NO: 1820 - DNA, 1032 bp, B.fragilis
tatgaaatgaaagatcgtattattttgtcaaatgttaaaaacataaaagatatcattcacgctattgatgaatatcagaaaggggttattgcggttgttgatgatgataataaattaatagggattgtaacggatggtgatataaggaaggctatattatatggagaattaagtatagagaaaattattaacaagagacctgtcacctttcaatatggttcaaatcaacgctcaattatcaataaattactggaaataaagtcatctcttattccattaatagaaaaagatggaacatttgtagatttttatttcttggggaataattataaacattataattctacaaaagtcgtaattatggcaggagggctgggaagtaggcttggtgagttgacagaaaatacgcctaaacccatgctgaaaattggaggatatccaatattagaacatatccttaaatcttttagagaatgtggatttgttgactttattttttgcgtaaactataagtcagaagttatacaagaatatttccaagcaggggaaaaatggaatgttaatattgagtacgtaaaagaaaataaaagattgggtactgggggggctttaagtctcttaaatgcaatggttgatggcgatttttttgtaattaatggtgatgtgttgtcaactctaaattatgacgaattcttatataagcataaaaatgaccagtcagtagcctcgatgtgcttgcataaaatggactatcaaataccatatggtgttattaaaacagatgaaaaaagcacaattgttgatattgtagaaaaaccgacgttttattattatataaatactggtatctatgtattaaattcatgtgttctttcatatattcctcgtgatactttttatgacttacctatgctatttaaagaccttaaagaaaagagtatgttgataaaggggtatatgacatctgatttttggatggatattggacgtaaagaagattattggggaataaagaaaaattttgaattataa

SEQ ID NO: 1821 - DNA, 846 bp, B.fragilis
ttgatgaagaatttggtcgcattgtttactgtcttttattctggggcagaatgctttttgaaagactttctatcttctttgaaagaacaaagttacaaagagtttgatctaataattgtgaatgatggatttgaggttggagagtttgaaaatttattatgtaatttaaatgttgtagagataaaattcagttctactgtctcgaagaatagagaatatggtttaaattatataaaaagagcgggttataaatatttaattctatgtgatgtagatgactttttttcaagaaaaagggtggaaatttccttaaatatgctgcgtgaatttgatgttgttgttaatgatgttgatatcgtttcaaatagaaatgaaatattaataaataattatttttcgaggagtttgaattcttcaacaaacattgatttacattttataaaagaaaagaatctattaggattttccaatacagctataaaaacagacttgtttgatagtattaattttcctaccaatttagagatcgttgattggtattttttcacaattattttaaaaaaagagcctaaagtgggatttatacatcaagcacttacttactacaggcaacattctaataatttgattggtataggtgattatcctatagaatttttcaagaaaatgttagatctgaaaatttctcattatagttatttatctgacattgatttagattataaatcactttatattcaatatctagatatgaaacgaaagtctgatatggatattattatgggaattgataaaaataaaaagataaataaatatcccctatggtgggaaaacataaaactataa

SEQ ID NO: 1822 - DNA, 717 bp, B.fragilis
ctaatgattgatttttttatatcaatattactttatttttatattttattgttccgaagaggaattcgaacagcatttccttgtttggtgagtccactttttgtttttaataaaacaaaaaaagtaacagatgtttcattgggtaagtcattcattggtagagatgtgatgatatctgatggatgtcatttttatgacactcctattgtttttgggaaagtaaaaattgggcgttacacttctataaatggacctggaacaagaatttgcgctttcattcatgagataaatataggggcattttgttctattgcatcaaatgttgtaatacaagaatataatcattgtgttaatcatgtgactacatataatatttatcatcatattttgaatttgaaagattcaatttcgatatctaatacttcaaagggacctattacaatagaagatgatgtatggattggttctaatgtagttattttgtcaggtgttaagattggaagagggagtgttattggagctggggcagttgtagtaaatgatgtacctccttattcggtcgcagtagggaaccccgctagaattgttaagaaaagatttgatgatgaaactatttcttatattgaaaagactcgatggtggacgtggtctatagaggagattaaaagaaaagaggatttctttaggaaagaatttataaaaagtgaaaaaggttaa

SEQ ID NO: 1823 - DNA, 1944 bp, B.fragilis
cagatcatcgaacatgcggatgggatatttacggtcttcgggcaacagcaggaaaggcttgttgctgttagcatcgatcaatgcctgcttctcctgtgctgtggcgatgatttccatcggatagaagctgttgaaactgcccagcgattcgaaacgtaccagcttggcttgtaccgcctttccggccggagtggctttacaggttgctttccattgcggatccgccttatccggttgctgaggatagtttactttcggatagggccctcccgaggtgtggtaggggaggtagtacacataataatctccggcatttccgcttgcgtcaaatcggatgcgtccgtattcacggttgatttccaccggaagtacattgtctaccgctttgccggtagatgcattgatcacaataatccctttttgttcgggattggcgtcacgtctgcgccaggggatataagcttccgctacggaggcggggagtgttcacgaaacaatggcgcgatggtaccccagtgtgtcgggtgtccagtagttttcgccgtaaaacgaggcttcgggggacgaagtcttgagtcgctgccggaagggttaacaagcctgacagtgcccataaaagagtttcttcataatgtttatctaataactatgtgcaaatttacaaagaatcatttatggatttggcagatcggccgtttttttattataaaccgtttctgcccaaaagcctgtgtggtaatcgggtatgcgattagcgatgtttcgctccgattatcaggaagaatctttttgtgggaaaaatattttttatattatctttgcgccctcaaaatgaataaaccctacactatgaacagaaagcaaattctgtgtatctcgcttctggcattctcgctgtgtgcctgtcaggatgatgatacagccgatattctcgatgcttttggcactccgcctgctttgacgaagatgacggcacaagagtttctcgatcagggagaacagatgtttgaagatggcgaaagcgtggacgagattgtttccgccgatcgtgccttctatgtgaataacccctttaatgtttcgatggcggatggaaagctccggctgttcaacggcatggcgcacgatttcaaggaagtctccctttggctgacgatgccccatttgcgtgacaccatccaattgatgcaatttgaggaagtccccggtttttataacatcaaacttgattctccattgaaaatgggagaggtcgtctatgcttcgaagagtggaaagcctgtccgtgtgaataatctggcactactgtcgcccgaccagtatgaattgctgctttcgtgcaacgactccgtattcgatatgctgaagaccatcaagatgaaaacccgtatccagatgggaaagtacggcagtggaaactggggagtcatgacagcaaatgcagcccgctactatgccacatcggcggtgaatatggctgtcatgttcagttccgaaatttttcgtgattcattgatgaactacaaaggtagcattcacaatgatgcaggaaaggagatcgaccgtgaagggctactgaattcgattctcaataaacaaagtcttgtgttcggagtggttaccggttccggtatcgccgggctcggtggaggaaatgctttgggattgcgtgaagaatatctggccggattcttctaccagaaccgggtggcaatcgattgcaactgggtgcttcatgtctggattcacgagctagggcactgtctgggctatggtcattccagcagcctgtgttacgggtcggtgcccgatgaaatagtaccgaaagtgtatcgctacatgatgaagcaccgcatgctgccttatatcatcaatccctttaagagttacaatgattataatcccggcatcaatgatgccgacaatcccgacatagagctatga

SEQ ID NO: 1824 - DNA, 459 bp, B.fragilis
attatgaccgaattgaaagagcagctttctttgttgggaagaaagaccgaatataagcaggattatgctcccgaggtattggaagccttcgataacaaacatcctgagaatgattactgggtacgtttcaactgtccggagtttaccagcctatgccccataaccggacagccggattttgcggaaatacgtatcagctacctgcccgatgtgaagatggtggagagtaagagcctcaaactttatctgttcagtttccgcaatcacggtgcctttcacgaagactgcgtaaacataatcatgaaagatctgatccgcctgatggatcctaaatacattgaagtgaccggcatcttcacccctcgtggcggcatttcgatttatccgtatgccaattacggtcgtccggggacgaaatacgaagagatggcaacccaccggttgatgaatcatgaatag

SEQ ID NO: 1825 - DNA, 504 bp, B.fragilis
ttcctcggggaattgaccggcaattcttcaagcaataaacaggaataccaattattaaaagataacttagtcagatcgtacaataaagctttgaagaaaaatgcgccttattcaatctttgctataaaaaatggcccaaaatctcacattggaagacatttgatgacctcatttctttcaatgaagggcctaacggagttgactaatgttgtgggaaattggagcgataagcgtgcttctgccgtggccaggacaacgtatactcatcagataacagcaatacctgatcactacttcgcactagtttctcggtactatgcatatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataa

SEQ ID NO: 1826 - DNA, 504 bp, B.fragilis; identical to SEQ ID NO: 1825

SEQ ID NO: 1827 - DNA, 1302 bp, B.fragilis
atgtttaattggacttacttagatggcttgtctaattataacattatatctcgatattcgtttaatattataaattttatgaaaatacctttttcaccaccttatattgacgaggcggtcatcaacgaagtcgttgattcgttacgttccggttggatcacatccggtccgaaagtgaaggctttggaggaagaaattaaatctttctcaggagcaaaagaagtgctttgtgtcaattcctggacatcaggagctattatgatgttgcgttggctgggagtgaaggagggcgatgaagtgattgttcctgcctatacttacagtgcaacggcattggctgtgctccatgctggagccaaaccggtaatggtggattccggaactgattttaatatttcggtggaggctgttcgtaaagctattactcctaaaacaaaggcgattatacccgtagatattgctggttttccctgcgattatgaaagaatcatggcactggtgcaggaaccagaaatggtaaaactgttccgttcggaatctcctgtgcaagaaaaattgggacgcatcttggtgatgaatgatgctgcccactctttgggagcacgttacagtaaccgtcagcgtaccggttgtgaaactgatgtggctatcttttcacttcatgccgtgaaaaatgtgactactgccgaaggtggggccatttgcctgaatctgcctaagccgttcgataatacggagttgtataaagagctacggatgacaagcttgaactgccagaccaaggatgctttttcgaaatctaaagccggaggatggcgttatgatattgtcggtttcgggatgaaaatcaatatggccgatgtaaatgccgccataggactggcacagatacgagaatatccggaattgctgaaagaacgaaagcgggtgtttaatgcttatagcgatgctttttcggcttgtgactgggccatcgttccgccttctgtggatggggaaaaggaaagctcttatcacatttatgctttgcgtattaaggactttaccgaagaacaacgcgaccggatgattgatgaaatcgctaaaagtgaagtggctgtcaatgtgcactttataccgatgccgatgttgtcgttcttcaaatcgatgggatatgatataaaggattatccacaagcttatcagaactttaagagcgagatatcattgccgatatatccccaattggatagtgaaaaattgaatttcattattgaaactgtaaaggcggcctatgcgaccgtaattgcagaaaaccgatag

SEQ ID NO: 1828 - DNA, 1446 bp, B.fragilis
tttatagattgtatgtataagaaacaatcattttggtctaatataattaaacaaagtagttggtattatctatgtagtgcattaaataatggattggcaatattgttattaccttttctttctaggaggttgtctacagaagaatatggtataatacaattatctactggaattggcctgtttttgcctatggtcttttcttgcggaattgatagggctatatatcgctttttcaatgagtgtagaacccacaaagcaaagaaagagttaatatctactgtatattggtttgttgttattgttggtatggtctttttgacaatctttgttttatcttcttcattatggtttaaatctgttgtccatatttcaccatatccttatgtcttattatttgcatatccttatttatttgcagagctgtctacgataggtcaatcttattttcagcaagtctttgatttaaaaagaatgactataatagaagttataggaactgctattaatctgttattatctatatattttgttgtaacttgggatgatggagcattagctcgtttggttgctataactatctcttttttttttaaatcatctatatattcttactatttattaaagagaaatcttttagtgtttagatgtaattatataaaggtatgggaatatgtaaaattttccttaccactattaccaaatagtattagtttatggctttctagaacttttgatagaatattaatatcttattattgtggaacagctatagcaggtgtttactctactgcggtacaagtatcatttgtcttatattttattcaagattcagtgacacaggcgtttggacctatgcagattcgtttatttattcaaaataaagttgaagcagtaaggtgtttgaaaataatgtctaagatattttatattataatgcttgtctctgtagtctttttaagttctttctgtaaggaaattatgaatttcgttttggatgaaaaatttgtgccacctgtgattgtagttgccttgttatcttctgtatacatatatcaggctcagtatcgattattttcagatatattgatatatcataaaaaaaataaatattttatgtatgcgggtataatacaagctgttattagtttattgattaatatagtatttatacctaaatatgggtatgttgtagcaggatggtctagtttaattgcagttatgttatacacattgattatagcatattatagtgtgaaaattgagaatttatctttggattatagtttttatataaaatatacattgattctaatgttggctttattcttattgttgaatcctttgtttaatatggatatgcatatattgttgaagttgttgcttgtaagtgggattttagtgtttggagtaagagacgtttttaaattgaaaaaaaatatagtttaa

SEQ ID NO: 1829 - DNA, 741 bp, B.fragilis
tttttgatgtgcgaattggggtactttataagttcttaccgtttaagtccatataaatttaggtttttccctataagtaattatagaattcacagatcaggtatgattttcctgctttacttttgttgcaaacctaaaaaaaacatcatgaaaaagattttatttattctatttacagttcagtttattctgatccctcggataacaggaagttatggtgcaaattctatcggaaataatcatggacattcggtaactaatcaaggaaagaaaaccatcaagaaagacatctttggagatactgtcattgaggacaatcacggtaataggaaaaccattaagaaagatatctttggagatactgtcattgaggacaatcgcggtaataggaaaactatcaagaaagacatttttggagatactgtcattgaggacaatcgcggtaataggaaaactatcaagaaagacatctttggagatactgtcattgagaacaattgcggtaataggaaaaccattaagaaagacatctttggagatactgtcattgaggacaatcgcggtaataggaaaagcatcaaaaaagatatctttggaaatactgtcattgaaaataataaaggttataaaaagaccattaagacagatatattcggtaataaaataatcgaagataatcatgggaaaaagcaaattattaaaaaagatatattcgggaatgttattattgagaattactaa

SEQ ID NO: 1830 - DNA, 711 bp, B.fragilis
aactttattttgggaggatttgataagatgatagctataatacctgctcgtggaggatccaaaggacttcctggtaagaatataaggaaaatgtgtggtaaaccattgattgcttatactattgaatgtgcattaaagtcaaaatatatagatcgggtaattgtatcgactgatgatgatgaaattgcacgtatttcgttaaagtttggtgcagaagttcctttcatgcgaccaagtcatttagcttcagataccgttcttgctgtagaaaattatctttatacaatagatagaattgaaaaagaagaaaatgtaattattgatagatttattgttttacaaccaacttctcctttgagaagtgtggaagatattgattgtgctgtagaattatttaaaaaaaagaatgcggactctgtggtgagttacacaaaagaagaacatccaatttattggcataaaaatatagacaatgataatagactaattaatattttcgatgataaaattgtaaatcgtcaggaattaagaactacttattatcctaatggagccatttatatctttaaaagtagtttaattagaaataagaaatattatacagacaattcttttgcttatgtcatgcctagagatagatccgtagatattgattttttggaagattttctttatgcagagtatttgttgaaaaaatgtagtatgaaatga

SEQ ID NO: 1831 - DNA, 189 bp, B.fragilis
gggattattttattatgcatgagtcatagctacaattcactttacaattacctctgcttactctattcacaacctacttatgaagataagaaggataaacaaaagatatttcgactgtataacgatttgttttctgagcaaaaagaatatccgaatgcttatccgtgtgctataatgggtgacggataa

SEQ ID NO: 1832 - DNA, 819 bp, B.fragilis
aaagccataaggtcctcctataataaataccaggcgtttgttgacgtttaccaactttttctccatccagcgggcaaactccaccgaccgcatctcttttccgtgttcgtccagcaacacaaccacgtctcccggctgaagggctttggctatcagttcgccttccttctctttctgttgctcgggtgtcaggcttttcgtatttttcaattctggaatcacctccatatcgaaagaaatgaagtgtttggtacgctctatgtaatcgttgattgcagtgatataatgctgctctacagtccgtcctacgacgataagggttgttttcattcaagtgcaaactcttgtttattgcacaaaaataagaaaaaaatattgtttttagcattaaatacttacctttgcgtatcgataatacttgtgattatgaaaaaacgggtacttttatggatggccggactcgtattcgctgtaacttcgctcttcgcacaggacataccggtgggcgtggtcgttgcgtttaagaaaggaaactcccaagagctgaacaggtatttgggagagaaggtgaatctggtgattcagaatcgctcggagagtgtagacaggcaggcagctgaaggaacacttgccgcctttttcagtagcaataaggtcagtggttttaatgtaaaccatgaaggtaagcgggatgaatcgagttttattatcggtaccctgaccactgccaacggcaatttccggataaactgcttcttccgcagagtacagaacaaatatttaataaatcaaataagaatagataaaaccaatgaatga

SEQ ID NO: 1833 - DNA, 519 bp, B.fragilis
aaaggaaaaagagcaatggaaaagatgaatattacccataagatagtggctatgcagcccgaactggagcattttgcgtataaattgactgccgacagggagtcggccaatgatctggtacaggattgtctgttgaaggcattggacaacaaagagaaatttgtgcatacccagaatttcaagggatggatgtacaccatcatgcgcaatatctttatcaataattaccgtaagtcattgcgcgaagtagacatgaccgactctacttataatctctatgcgcaaaccatgacggaaggcgaggaggggaaccggtttgagacgatctacgacctgaaggagctctacaaagtgatcaatgccgttcccgaagacctgaagaagccttttatgatgttcgtggccgggttcaagtatcgtgagatagccgagaagatggatttaccggtagggactatcaagagccgtctgttcctgatccgtaaaagattgcagcaggatttgaaagatttctcgtaa

SEQ ID NO: 1834 - DNA, 1059 bp, B.fragilis
cggtttaagagaagaaaactttctgtgtcgtctgtggtgagaaaacaatcaagcatgaatttgaaatttttatatctgttattattgatatctgccctgtgtatatcctgttccaaggacgaagaaccttcggataagggcagtacttctccccaagagccggtttacaccacctttacagatgccggcgaagtggttgttcccggagtgcttccggccaatttcactccccggtccgtacgggtcaagggggacactttgtttgttgccaataccaatgccgccgaccgttccgtgctattgctgaacctgacgacaggcgaactgatcggacgtatcgattcatgggtacggaaaggtgtcaaagagacctttaatgccgagataggcgacatggctgtttctgaccgttatatctttgtgggtatgtacaactcccgtattaatatttttgaccgtcgcacccttcagtttgtcaatgccatcgggcgttcagacggaaagtggggagacgatatttatagcatgacccattgctacggacttcgtgagtgtggcgagagactgatggtgcgtgataaaaataccattcgcggctattggatttatgaagccgttaccgaacctgcgttccgggttccctggatcggaaaggtgaaagtgcccgaaggagtcggatatgactatcaggcccgtatccatggtatggcagagtatgacgggcgtatgtatctgaccgactggtacaacaagagtgtgcaagtgttcactccgtcgaaaatggagatcgtgttcggtgaagagacacatatcacttccgatgccgtgtttaagtacgatgatattcaaccgctcggactgcttgcctacggaggcgaattactgatgtcggtacagaagagtgggaaaatacagcgttatgatccggagacaggagacctgctcggagtgctggccgagtttccgggtaaggagatcgggcgcatggagatagcccggggaatgctttactacattgacctcaaagccgggaaactgatgaaggcaaaaggagaataa

SEQ ID NO: 1835 - DNA, 852 bp, B.fragilis
ctgatgaagagttgctcgatgctgctgcccgataccgtcgctggtgggaaaacaggcagtatcctcgtacggcatggaccatcgacgcatgctttgacgagcccctttgcggaagcggataccgttggtggtaaaaaattaaatcagatgaaacgtattgtctttctgatgctgtctttagggatggcagtgacccttcatgcccaatggaccgcgaaagattcggtgaatctgcagcgcatcctgaatggcaaagaggatattaagctgaatatggatgctgtgaaacagattgatttcaacagttcgccgactgttcctaaaatgtcgaaggaacggcccggtctgagattggatgaaacgcttccgcaggtacttgaaaagaagaaggtggtgctgaccctccgtccctatacggccaataccaaatataattgggatcctatttatcaaaagaagattcgggtagatgccgatacatggaggggagatccgtttgtcgagttgtatcagacggttccttccaactgggctaagaatgtatatgataaaggtatacgcagttcatacgaagagatacgttccagtggattgaggcataatctgtttggcgaacgtgccaatggaatgatggtgcctacgcagagcatggtacatacctctgccatgaaacttggaaaaagcggcgtgaccgtgaatggaggtacgattggcggacttgatttaatgaccatttttacaaaggacttctgggacaagaagggacgcaaccggagatcgcgcacgttggaggtgctgaaggcttatggcgattcaacaacagtgctgcttcctgaaccgattgtgcactga

SEQ ID NO: 1836 - DNA, 645 bp, B.fragilis
tgttcgtttgggagtatgaaacctttaattttagtcggtggcggcggacattgtaaatcggtgattgatgtcgctgagagtatgaggcattccatcctgggtatattggatcttccgaaaaatgtagggcattccatcttaggctatcctgttctcggtactgatgacgatattcccttatttgtgaatcaggctgactttattgttactgtcggatttataaaggaatcttctctaaggttgaagattcatgataaaatacgaacttccggtgggcatttgggtaccctgattgcttccaccgcttatgtttccagacatgctcagatcggtgcgggtactgtggtcatgcatcatgcctttgtgaatgccggtgcacggattggcagtggttgtatcatcaatacttttgtaaatgtggagcatgatgccctgatcggtgataattgtcatatatcaaccggtgctatggttaatggagattgcaaagtgggtgattgttcttttttaggtagccagtcggtaatggtgaatggtacatccatcatttccggttgtatcatcggcgcgggttcggtagtacgtaaggatattttggaaaagggaatttattcgggtaatcccgcaatcttgaaaatgaaataa

SEQ ID NO: 1837 - DNA, 207 bp, B.fragilis
aataagaaaggaaagattatgagcttagaagatgcgattatgggtggaattgtctttaaaggaaagaaagaaggcccgaagaaagatgaaaataaagtgaaaacaaaagcgaagaaaacaacctatataaagggaactcacggttccggagctgccaagatgaaagctgagatccggagaaagagggcgaacagacataaacggtaa

SEQ ID NO: 1838 - DNA, 1332 bp, B.fragilis
agaaaaattttgaattataacattatggaaaaaatagtatatatagtacatgccgttgatactgaaggaccattgtatgaatctaccgaagctacatttgaaagattaaagtcctctttcaatattgagttggaaccgacttttgctaacttacaaaaattacgtcatagagaaatttttttgaatggattagaggataaaattgtagaatttctagatccttcactacaaaattacaatgatagttgggataaaatagatttgatgttatcgaaaattttatcaaatgattttagattcaaattttgtgattcttttagtggtggatgggtttataactggttttgtttggatcatgttggctatgattataaccctagaagacgcgatatgggatatcataatatacatgatcgttacattgaattattggataaatatggcaaatataaagatgatattcagtggcatttccatccaatgtctcattataaggaggcacatcgagcaggtaaatcatatgaacactcagaaacattgtatcaaattttaagtcgtagaatcattgatcgtaatttttttccttctgtttttagggcaggatgtgtaacagaacgaccagatgctaattggtttctagagcaatggatacctttcgattgctctaattttgctgtagagaatgaaaataaggaacaatatagggatcaaagaaatggacaagctggtgattggagacgtgctcctagtgattggcgtatatatcatcccgatttttatgattatcagaaagaagggtgttgtcatagaagtattggacgttttctaaatatcgtgtcacgctatgggaacatcacatcctatgaaattgaaaaggcatttcaaagagcgaatgagggacttcccactctgttgggaatctttaatcatgattttagaaatatgggtaatgaaattgaatatttttgcgatttactatatgatatttctagaaagtataataatgtttcttttaaattcgctacagctaaggaggcttttaatgcggtattgcagaataaactatctgagtttgatctgaatgtgaggttaaaggggaatgagctctatgtcgatactataaagggatgcgtatttggtccacaaccttatttggcaataaagactaaatctggtaaatatattcatgataattttgattttggtttggatggtaaatcttggtcatatgtttttgatgaaaatatgattaagtttgaagatgttgatacgattggtgtagcagctaatgatatgtgtggacaagttagcctcaaatgtataaaggcttga

SEQ ID NO: 1839 - DNA, 936 bp, B.fragilis
gttgttttcttcgcttttgttttcactttattttcatctttcttcgggccttctttctttcctttaaagacaattccacccataatcgcatcttctaagctcataatctttcctttcttattctatattttccgtggacaaagatactctttttctgtgaattccctatctttgcccgctgtaacaactaaaaaccaatcaatgaatacatccctgctcccggcagaaaaagacccgatgggtgctgccatagccgatttttatcatcgccaaaaagcagacagattacgcgtattttcttctcagttcgatgaagacgaaatacccgtcaagcaacttttccgcaaagccggacaaatgcctctactcgaacgcacagccctcgcaatggctaccggaacaatactcgacgtaggtgccggaagcggttgccacgctcttgcccttcaagagagcggtaaagaagtttccgccatcgacatctcccctttatccgtcgaagtgatgaaactgcggggagtgaaagatgcccgccaagtcaatctgttcgacgaacgctttgccgcgactttcgataccatccttatgttgatgaacggttccggcattatcggacgtttggagaatatgcctctcttcttccgcaagatgaaacaattactccgcccggatggttgcatcctgatggattcgagtgacctccgctatctgttcgaagatgaagacggcagcttcctgatcgacttggcaggagattattatggagaaatcgacttccgcatgcaatataaagatattcaaggcgatcccttcgactggctgtatatcgacttccagaccctcagcgcctatgctgccgacaatggcttcaaggccgaaatgataaaagagggtaagcactatgactatctggcccggctgactgttgccttataa

SEQ ID NO: 1840 - DNA, 735 bp, B.fragilis
aatctatttataaaagaaaggatatacatcatgaaaaaagtagttcaccgctcagatacccgcggacgatccgtatatgactggctcgacagccatcacagtttcagctttgacgaatattacaatcccgaacgggttcatttcggtgctctgagggtactgaacgatgaccgggtagccccgggtgaaggttttcagacccatccccataaaaatatggaaatcgtctccatacctttaaagggtcttctggcacatggcgacagtaaaaagaacagtcgtaccattactgtaggcgatattcaggtgatgagtgccggtacaggcatttatcatagcgagatgaacggcagcaaatcggaaccggtggaatttctgcaaatatggatcataccgaaagaacggaacactcatcccctctatcaggattatgacatccggggattactgaaaaaagacgaactggccttcatactatcacctgacggaagtacacctgccaaactattgcaggacacttggttctcgatgggtgagataggagccggaaagacagttgaatatacactgcatgggacggatatgggagtctacgttttcctgatcgaaggagaagtaaagatagatgatgtgatcctgactcgccgcgacggattgggaatatccgaaatcaagaattttgagatagaaactctgaaagactctaaaatactactgatagaagtaccgatgtaa

SEQ ID NO: 1841 - DNA, 597 bp, B.fragilis
ataagtttcttgatccgtttttttgatatcgttttttcccttttgggaattcttctgctttctcccgtttttcttcttctttatatagccatttgtctcgaaagtaaaggaggtggtttctataaacagctccgtgtgggaaggtacggaggggatttttatgtttataaatttcgttcgatgcgtgtaggggctgataaaaaggggttgataacggtaggagggagagatccgagaataactcgtaccggatacctgatccggaagtataaattggatgaattgcctcagttgtttaacgtactgaaaggagatatgagtctggtagggcctcgtcctgaggttcgtaagtatgtggatttatataccgatgaacaaaagaaagtattgagtgtacgtccggggattacggattatgcttctattgagtatgtagatgaaaatatgattcttggagaggcttcggatcctgacagagcatatatagaacagattatgcccgataagatacggtataatatgaaatatatctgtaatcgttcggtgaaggaatattttaaaattatatttctgacattttggagcatcattcgttag

SEQ ID NO: 1842 - DNA, 1119 bp, B.fragilis
agtaacgttatgattatcggagtacctaaggagattaagaacaacgagaaccgtgtgggcatgacgccctcgggagtcgccgagttagtgaaacgcgggcatactgtatacatacagcacaccgcaggagagaacagtggttttcaggacgaggcatatacagccgtaggagcacaaatactgcccactatggaagagacatacgctatggcccagatgatagtaaaagtaaaagaacctatcgcaccggagtacagactgatccgcaaaggacaggttgtgttcacttatttccatttcgcttccgatagagagttgactcttgccatgatagagaacggctcggtctgcctggcctacgaaacagtggaaaaagccgaccattctctcccgctgctgatacctatgagtgaagtagcaggacgcatggccatacaggaaggtgcccgttttctggaaaagccacaaggtggaaaaggcattttgccgggtggtgtaccgggggtaaagccggcaaaagtgttaatcctgggtggagggatcgtaggtagtaatgcggcccagatggcagccggattgggagccgatgtcacaattgcagacatcaacctgagccgtcttcgctacctgagcgagaccttaccgaaaaatgtaaaaacactatacgcctcggaagtgaggctgaaaaaagagttgccggacgtggatcttgtagtaggttcggtactgattccgggagacaaggctccgcacctgatcacccgtgatatgctgaaaatgatgcaaccgggtacggtattggtagatgtagccatcgaccagggaggatgtttcgagacttcgcatcccacaactcatagtgaaccgacgtatgtagtcgatggaatcgtacattatgctgtagccaatattccgggggcagtgccttacacctctacattggcattgaccaacgccactctgccctatgtcatagcattggcaaacaaaggatggagaaaggcatgcaagaaagatccggcgctggctttaggtctgaatgtggtagaagggaaagtggtatatcgagcgatagccgatgtattcggcctgaaatacgagcaattgaacttagaataa

SEQ ID NO: 1843 - DNA, 753 bp, B.fragilis
ataggatatatgaaacatatcttcaataaggaacaatgccaaaaagcaacattcattcttgaaagccctttggctaaactgtcggaactttactcaagcgagataaaagacttggctgttgtatggtgctattattcggggagaatagagggtaatacctatacctatgttgaaacagaagcattgcttaaggacggcatcacttccgaaaaaaaatatgaagatgctaaaatgctgaaaaatctatataatacattcatttccgaactggaatatattcatcaagagaaaaataaggagattatagatgaacgtactcttttcagacttcatcaatctatttccacaggtttggtttctaatgaggaatcaggctttttaaggacacgtgcagttaggatcagcggtactgattatgctcctccaaaagatttgcaagaaataaaaagtaaattgggagagatattatatgagcaagacgtttatactaatccattggaaaaggcagttttcttacattgtaatattgcacggctgcaaccttttatagatgggaataaaagaacttctcgcatgatagaaagtgttgtcatgatgaatgctgatattattcctgtatattcagcaaaagatgctgatattttgaattacaggaaagggttgattcgattttatgaaacgggggattacactaagtattctgactactttctaaataggcagttggaacgcattaaagaaatagatatataa

SEQ ID NO: 1844 - DNA, 1827 bp, B.fragilis
ataagagatatgagaaagttattgtatgttattctgttactacttttccgtttattgatgtttccgggggctgtttgtgccgaaatactctctttgccggacagcttgataacggatgataacgtatataaatatactttctccgattttgataaggcacagcaggttatggaacaattgagaaagcggaaatctctttccatgttccggatggatgtggtggaaggtgatttatatttcaatgtcggccaatattataaggcgttgaagttctataagcgtgctttggacagtgactcggtgcgcaataatgataagaactatatggaacaggtgcatcgcatgatctcttgttacgactgtttgcataatgaaaataaaaaatcgctgtatgtctatttacttttaaaaagggcagagcagtgcggggataaagccatgcagtccgttgctttgttcaatatgggtaaaatgctgtattatcagggtaataaggagaagggatatgaatatctggaacaggcgattgaaatgatgtcaaagacggactatcggtataaatacgataatctgcgttatgattacaacactttactgatattccagaagtcggacaggcgtaatgaggaggctctcaggacactggctgcgttggaaaaggtggtgaccgaagagaccggcagtgaaactccgatggaggggttgagtgcaaaggagaaaaaagcaatgtatgcccattatgctgtcgttctttttcggttggggcaggcggaagaggccgaacgttactaccggaaattcctggcggcaagtgaggaatatgaccgtgacgattacctgattatgccttatttgttcgacaggaagatgtatgaccaagtgatccggatgaatgccgcccgtgagaagatgtatatcatgcggggggatacggtgaactattacatgactacgatcaagagatctcttggatgggcttatcgtgataagggcgattaccgtactgctgcaagatattttgagcagttggctgtgttgcgcgacagcattaagaatcgtgaacaaaaaagtgcggcattggaattggcagctgtttatgaaacgaacgaaaaggatttgttcatccaacagcaggcggctgatatgcaaaagaggaatctcttattggtatttaccctctgtatcgtttttctgttaggtgtgcttttgtggcggacgatacggcataaccggattatacgtcgcaaaaataaggcgatggtaggcactatcgaagatttgctgatacataaagaagaattgtatcggaaaaaggaggagaatcttattctgaaagagcaattggagagggagcagaatttaaggatgtccgcaggtgggggatcgctatcaaccgataaggacgggaaagcggaaacaactgttgttccggaacctcaagccggagatggaaatgacatacacgataggatattgttcgacaagttggaacacgagatcattagccgtcagctctatcttcagccggacttttcgagggaggaactgatcaagacaatctatattcccaaaaataaatttgctcctcttttcaagcagtatgcgggaatgagcttttcgaagtatattaataatcttcgtttggagtatgcggctaagatgttaaagaaccaccccgattatacagtagatacgatagcccaggagtgtggcatgtcgactcaatctctttatcgcctcttttcgggaaagtatggagtgactccgacagattttcaggtgggggtacaacatattaataataagaatattactgaggataagtga

SEQ ID NO: 1845 - DNA, 786 bp, B.fragilis
tcgtataccattaaaacagaaatgaagatttcgattataactgtcacttttaatagtgaaaaaactattaatgataccattcaatctgtgttgatgcaatcttattctaatattgaatatataataattgatgggaaatctaatgattcaacactaggaattgtgaaagaatatatacctctatttagtgggcgtttgaagtatataagcgagaaagattctggtatctatgatgccatgaataaggggataaaattggctagtggggatataattggtattataaattcagatgatttttataaaagcaataatgttatagcaagtgttgctaatgcttttaatgacaatagtattgaggttgtttttggtaatattcaatttgtcaatcctaataacaagacacggattgttcgaaaatattctggtaaaggattcagaccttggatgtttcgatggggaattatgcctcctcatccttccttttttacacggaagtcatgttatgagaagtatggaatgtataattcgacttttaatatttcaggtgattatgatttgatggttcgttttcttttagtgaagaaacttaagtataaatatatggatttggacatggtgataatgagactaggaggtgcaagtaccaaatctataagatcattgctgattaataataattataatgttataagggcatgtagggaaaatggagtatatactaatatttttatggtttctttgcgttacataaagaaaatatcagaactgatttttaaagtttag

SEQ ID NO: 1846 - DNA, 1470 bp, B.fragilis
gcaaactacatgaaacagtatatagttgccttgatgcttgcctgcagcattcagggacattcacaagatgtgaagcaggctacttttgttcctccatttgactttacactgactctgagcggcaacttcggagaaatccgggctaaccattttcatggagggcttgatttcaagactcagggtgtcattggcaaaccggtacgtgcgctcgccgacggatatatttcccgtattcgcgtcaccaatgggtcgggacatgtactcgatgtggtgtataacaacggttatacgacaatcaaccggcacttgagcggtttcatgcccgatattgcccggagagtggagaaactgcaatatgaaaaagaagattgggaagtcgagattgttcccgagccgggtgaatatccggtgaaggccgggcagcaaatagcctggagtggtaataccggttattcattcggtccgcatctgcatctggatgtgatggagaccgctaccggtgaatcgattgatccgatgccctttttcaagtcgaaaataaaagataacaccgctccccgggcagaaggaatcatgctgtttccacagccgggaagtggggtagtgggagggagcccggaacggcagagcttcccgataaacacagcgcgtcccatcgaggcatggggagtgatcgggtcgggcatcaaggcctacgattatatggatggtgtgcacaaccgttatggagtgcataccgttgtgcttagagtggacggtacggaagtgttccgcagtgtggtcgaccgtttttcacaggatgaaaaccggatgataaactcttggacctgcggacaatatatgaagtcgtttattgatccgggcaatacgctccgcatgcttcgggcttcgaacgacaaccggggactggtcaccattgatgaagagcgggactataagtttgaatacgaattgaaggatgctttcggcaatacttcccgctaccgttttacggtgcgtggaaagagacagccgattcagccgctcgggcatcgggagaaatatttctttgcctgggataagacgaactttctgcaagaacccggattgacccttaccgttccccggggaatgttatacgataatgtgcctctcaactacgaagtgcattccgatagtggggcgatagcctatacttatcagctgaatgacgagaaagtgccgttgcacgggggatgtgagttgcgtattggtctccgacgtcagccggttgccgacagcaccaagtattatgtggcacgtgtcactcccaaaggaagtatgtacagtgccggaggtacttacgaggatggatttatgaagacccgaatccgtgaattgggaacttatacggttgctgtagacacagtgccccccgaaattaccccggtaggtaagaatacctggggccgtaatgggaagtcttcaccacggggctggaaggatcagcgg

SEQ ID NO: 1847 - DNA, 849 bp, B.fragilis
ataaaaccaatgaatgagttaatagacagactgatcgatctggcctttgccgaagacataggtgatggcgaccacacaacactttcctgtattcccgccactgcaatgggaaaatcgaaacttttaatcaaagaagcaggcgtgttggccggcatcgaaattgccaaagaaatattccaccgtttcgacccgacgatgaaagtcgaggtatttattaacgatggtgctgaagtgaaaccgggtgatgtggcaatgattgtggaaggtaagattcagtctctgctccagacagaacgtctgatgctgaacgtgatgcagcgcatgagcggtattgctactatgacacgcaaatacgtgaagcagttggaaggcacgaaaacacgtgtgctggatacccgcaagactactcccggactccgtatgcttgaaaaagcggcggtaaagattggcggcggcgtgaatcaccgtatcggacttttcgatatgattctcctgaaagacaatcatgtggactttgccggtggcattgacaaagctatcaaccgtgccaaggagtattgcaaggagaaaggaaaagatctcaagatcgaaatcgaggtgcgcaacttcgatgaactccggcaagtattgagcatcggcggagtagaccgcatcatgctcgataactttactcccgaaaatacaaagaaggctgttgagatgatcggcggaaagtatgaaaccgaatcgtcgggcggcatcacgttcgatacgcttcgcgactatgccgagtgtggtgtagactttatttcagttggtgcccttacccattcggtgaaaggactcgatatgagtttcaaggcatgctga

SEQ ID NO: 1848 - DNA, 693 bp, B.fragilis
aaaacaggaattatgaaagaaaaagtatccgtacccttcatgttgctcggcattctgttcaatgtttgcctgattgcagccaatcttcttgaaaccaaagttattcaggtaggcagtatcactgttactgccggattattggtatttcccatctcttacattatcaacgactgtatagccgaagtatgggggttcaaaaaagcccgtttgattatctggagtggctttgccatgaacttctttgtagtagccctcggactgatcgccgtggcattgccggcggcccctttctgggaaggcgaacagcattttgattttgtattcggcatggccccccgtatcgtagtagccagtctgctggcttttctggtcggttcgttcctcaatgcctacgtcatgagtaaaatgaaagtggccagtggcggacgtaacttttccgcccgtgccatttggtcgacggtggtgggagaaactgccgactcactgattttcttccccatagcattcggagggctgattgcctggccggaactgctggtgatgatgggtactcaaatcgtactgaagtctctctacgaagtgattattcttccgattaccatccgtgtcgtgaaagccgttaagcgaattgacggaagcgatgtctacgatacggacatctcctacaatgtactgaaggtaaaggatatctga

SEQ ID NO: 1849 - DNA, 399 bp, B.fragilis
aaaacaaacttagaaacaatggaaataaaaagtagatttgaccacttcaatatcaatgtgactgatctggaacgtagcattgctttctacgaaaaagcattgggattgaaagaacatcaccggaaagaggcagccgacggctcttttatcctggtatatctcacagataacaccaccggttttttattggaactcacctggctgcgagaccataccgaagcctatgaattgggagagaacgaaagtcatctttgcttccgtgtagcgggagattatgatgccgtacgccaatatcacaaagaaatggactgcgtatgctttgagaatacttccatggggctctatttcatcaatgatccggatgactactggattgaaatattaccggaacgactttaa

SEQ ID NO: 1850 - DNA, 186 bp, B.fragilis
ttctacgacttaaaatttgatacaatgtttctgagtgttcatatgatttacctgctcgatgtgcctccttataatgagacattggatggaaatgccactgaatatcatctttatatttgccatatttatccaataattcaatgtaacgatcatgtatattatgatatcccatatcgcgtcttctag

SEQ ID NO: 1851 - DNA, 279 bp, B.fragilis
gcaacttgcttcatcctcttccttgaggatactcttaggcaattgttggctagaagccggtatctactgttcaaggcaccgggcaagtggacggacagccaaaaacggagggctggaattctgttcaagcaattcccggatataaaggccgtgtgttattatgcgttaagatggggaaagatttttactgattatatagacaaggatgtggcgtgtgccaaaaacttagaggtgggtgttaagaatagaacttttataatggaagtgtgctgtatctaa

SEQ ID NO: 1852 - DNA, 444 bp, B.fragilis
aaagaaatagttatgagtcaattatatttttcgtctaagaaaaggaataatggttctattcttcaaataagaggccattattatgcaaacaatagaaatgattgttttcaacccatcggacagcttagtcccatttcgtttagtgccgtaaaaggaaatcagttattgattacattgaatgttccagatacgtggtgtgacaaggcgggtgacggagcttggtttgccatctctgtgaatgatgaaataaaaagcagaggtgtatattatagtggcaaggatgggcaacgtgtccctatcacattgcaaacggttgtcgatgtagaagaggaccatagttatattataaaaggattgtggtgtaacgaaagcgggactgaaaatcggaattgtaatatcggtgaattttcggaaaccgtactgaccgttttggtacttgattga

SEQ ID NO: 1853 - DNA, 258 bp, B.fragilis
ggcgcatttttcttcaaagctttattgtacgatctgactaagttatcttttaataattggtattcctgtttattgcttgaagaattgccggtcaattccccgaggaattattcgataaagataagcttacattatgaagagcagcatattacagccgtatgggtctacttgacagtaaaatttgaagagcattggaagcctgttgatgtagaggtcgagtttagatgcaagttcaaggagcgaaaggtggatgggtag

SEQ ID NO: 1854 - DNA, 1239 bp, B.fragilis
ttgtatgcatttttgaagaataatataaatatgcttaatgtagataattttatcggcgatcatatcacttttcgtcgttccagcatgtttgctcccgatattgcagcaaacagtgatcgtcttcgtcaggaggttgaaggtaagagtttattggtgattggtggtgcgggttccatcggttcttcctatataaaagccattcttccttttaagccttccaaacttgttgtgattgatttaaacgaaaatggattggccgaactcacccgcgatttgcgttccacttacggtctgtatattccggacgagtatcgtacttatacattgaattttgcagatcccatcttcgagcgaatgttccgcaaggagcagggttttgatattgtagccaacttttcggcgcacaagcatgtacgaagtgagaaagatgaatattcggtacaggctctgattgaaaataatgtaataaaagctaagaaactgcttgatctattatcggaatttcctccccgtcactttttttgtgtttctacggataaggctgccaatcctgtgaatataatgggtgccagcaaacgtatcatggaagatatgataatggcgtactcttctaaatttaaagtcactactgcccgttttgccaatgtcgccttttccaatggctccctattggccggttttattgaccgtatcatgaagaaacagcctctggccgcccccaatgacgtgaaacgctatttcgtttcacctgaagaaagcggtcagatctgtatgcttgcctgtgttcttggaaataatggagagattttctttccaaagctgggtgaggaaaagatgatcactttttcttctatctgtgaccgtttcctccgtactctgggctatgaaaagaaagagtgtgctacagatgaagaagccagaagatatgctgccgaaatggcggatgacagcaagatatatcctgttgtttattttaaaagtgataccacgggtgagaaaggctacgaagagttctatgtgcccggtgagcggttgaacttggaacgtttttcttctttgggtgtgattgaggatgtcagtaaacgtcctttgtctgaattggattccttctttgatgacctggaatctctctttgcccttccggactgtcataagtctgatatcgtgactgcgcttaaaagattccttcccaatttcgaacacgtggagaaaggaaagaatctggatcagaaaatgtaa

SEQ ID NO: 1855 - DNA, 1506 bp, B.fragilis
atgagaaaattattcttgattagcatcgggttgctaatcgtttcaacttcaacttttgcgggaggtctcctgacgaataccaatcagcacgtattgtttttgagaatgttggctcgtgatgcttctacacaaattgacgcggtatattccaatccggcgggtgtggctttcatggaaaacggcttccacttgtcactcaacggacagagtgcgttccagacaagaactatcacttctactttcgctccgtttgcagggtttggaggaaacgctaccaaagtatataaaggagaagcttcggctccgttcattcccagtgtatttgcagtatataagaaggataagtgggcattttcggggaattttgcggtaaccggtggtggcggtaaggctacttttaatgaagggctgggttcatttgagtcattggtatctgtagtacccggcatgttggtagctgcgggcaatgaaatggtggataaaggtgttctgccgattaacatttttaatggaaccaataaatactctgttgacagctacatgcgtggtaagcaaatgatttttggccttcagctgggtgccacatatagaatcacagattacttgtctgcatttgccggtgtgcgtatgaactacgtaagcaatggttacgaaggacacattcgtaacattgaggctaacatcggtggtggagaaatggtaaacgtgaataagtatttcagtgattatgccaagcaggccagaacagccgcagatgcttatctggctgcaaatgatctggctaattatgcaaaatatgatgccattgcaaaagaagcaaccaaggttgccggactgacggccgataaagaactggattgtgaccaaaccggttggggagtaactcctattctgggtctggactttaagatgaataaatggaacatcggtgtgaaatacgagtttaacaccaaattgaatgtagagaacaagacccgtatagataatacaggactgtttgcaaatggggtaaatactccgcatgacattccggctctgctgacagtaggtgtttcttatgaaattcttcctgtacttcgtgcttcagttggctatcatcatttcttcgataccaatgcacgtatggccgatgctaaagatcctgtgaccggtcagactatgggcaaacagcatttcatcaaacagggtaccaacgagtatctgggaggtatcgaatgggatgtgtgtaaatgggctcaggtaagtgccggtatgcaacgtaccaaatatggtgtgggtgataattatcagagtgatatgagttttgcagtcagctcttattcatacggtttcggtgccggattcgatattgcgaagaacctgaaattgaatgtcgcttatttctggaccgattacgataaatatacaaaagagactcctaactatgggggtaccggaatcgccggaaaagatgtcttcacccgtaccaacaaagtgttcggtatcggtctcgactataagttctga

SEQ ID NO: 1856 - DNA, 1221 bp, B.fragilis
aagattccttcccaatttcgaacacgtggagaaaggaaagaatctggatcagaaaatgtaatgtttacaagtatgtataataatataactactttcattcataacttgtttggtacggatgaatttgttccgttgcacgctcctttatttatcggtaacgaaaaaaaataccttgcagaatgcattgatactacttttgtctcgagtgtgggcaaatttgtcgatcgctttgaggagcaggttgcttcctataccggctcaaaaagagctgttgtctgtgtgagtggtactaatgcattgcacatgggtatgcttcttgtcggtgttgagcgtgatgatgaagttttaactcaggctcttacttttatcgctacctgtaacgccatcagttatattggtgcacatcctgtatttcttgatgtggatagagatactttggggctttctcctcttgctgtaaaaagatggttgtctgggcatgcggaagtaaggaatgggcagtgttataataagaagacgggacgccgtatcaaggcttgtgttcctatgcatacgttcgggcatcctatgaagattgacgaattgtcggcagtgtgcaacgaatatcatatagaacttgtcgaggatgcggccgaaagtattggtagtttctataaaggccgtcatacgggtactttcggaagagtgggagccatcagttttaatggtaataaaacgatcaccaccggtggtggggggatgttgcttttccaggacgaagagttgggcaagtttgccaaacatttgacaacccaagccaaagttccgcaccgttgggcctttgttcatgatcatatcggctacaattaccgtatgcctaatatcaacgccgcattgggttgtgcccaaatggagaatcttgacaggtacgtttccaataaacgtgagacggcggaacggtaccgtgagttcttttctcgtattcctgatgttgagtttgttgttgagcctgcgaacagccgttctaactattggttgaacgctgtacttttgaaagaccgccgggcccaacagtctttccttgaatatacgaacgatcatggtgtaatgacccgccccgtttgggaattgatgaacagacttgagatgtttcgtggatgtgagacggatggtttggaaaatactgtgtggttggaagaaagaattgtgaatataccaagtagtgttcgtttgggagtatga

SEQ ID NO: 1857 - DNA, 234 bp, B.fragilis
ttgctcagaacagaggaattagtgttgaaaaagtatttagaggataaggagggagatatgtcaactataaagatcaaacaagttaaaagtagaattggtgctccggctgatcagaaaagaactcttgatgcactgggacttcgcaaattgaaccgtgtggttgaacacgaaagcactccttcaattcttggaatggtagataaggttaaacacttggttgccattgttaagtaa

SEQ ID NO: 1858 - DNA, 342 bp, B.fragilis
agattgctgaccgtccgggtggttatactcgtatcatcaagactggaaaccgtttgggtgacaatgctgaaatgtgcttcatcgaactcgttgactacaacgaaaacatggctaaagagaaagttgctaagaaagcaactcgtactcgtcgttcaaagaaaactactgaagctgctcctgctgccgaagtacctgcaactgaagaaccgaaagctgaatcagcagaataattcaactattattcttatagatataaaaaaggctgctctgaaaagagtggccttttttgttgattttactaaagatacattaaaaacatttgaaggtgaacagtcggactga

SEQ ID NO: 1859 - DNA, 1851 bp, B.fragilis
atatattatttttgcgggtcaaacaatcaaggaaatatggaacaactaaatctcatcatagacacttatcaacggattattctcgaatcggaatcgaagctggcaaaggtaaaacaacacatttaccgtatcggtacactccgactgatacttttcgctgcaggaattgcaggtatcatttatttctgggacgagggcaggctggtgatcggcggtatcgcggctatcaccttcatcccctttatattattggtgaaactgcacaaccggttgtttcatcagaaagattaccttgaaaagaagatagaaatcaaccgacaggaattacaagcccttacatacgatacgtcagctttcgataatggggaggagtttatcaatccatcacatctttatacttatgatctggacgtatttggagaacattcactctttcagtacataaaccggactgccacgcaacccggtaaaaaaagactggcagaatggatgaatatgcacctgaagagcaaagcggagatagagaaacgacaggaagcagtacgggaactggctccggagttagaaatgcgccagcatttccgtgtactcggattgctgcataaaggtaaaactgctgacgaagaagaaatcaggaactgggcttcgagtccggaatattatcggaagaaatggtatttccgaactttggctatccttatccccaccgccaatgctgtctgcatcgggctggccatagccggaatcatctcattcaccacatggggaatcgtcttcgcaagtataggattgttcagttcttcattctcaaaaggtattagccggatgcagtctgtttacggtaaaaagatgctgatactgacaacctatgcacgactcattcacattattgaggagaaaaaaatgcgatgcagcgcattaaaggaaatcaaggaattggtgggaggtgaaaaacaaacggcttcacaagccgtaaaacgcctcaccgaactcatgaatgcactggaccaacggaacaatatgttaatgcaatttgtcctgaacggactatttttctgggaattgcggcaagtcatgaagatagaagcctggaaggaaaactatgcagcccacctgccggattggcttgaagccattggcgaaatggatgcttactgttcgctggcctgttttgcgtataatcatcccggatatgtgttccccgaaattgcatccaaaccattttgcgtggaggccgaagcattgggtcatccattgatgaatcgaaataaatgtgtacgcaatgatatccggatcgcaaagcgtcctttcttcatcatcataacaggtgcgaatatggcagggaaaagcacctatctacgtaccataggagtaagctatctgctggcatgtatcggagcccctgtctgggcagagaagatgaagctatatccggcacaactcgtcaccagcctgcgcacgaccgactcattggcagacaatgaatcgtatttctttgcagaactgaaacgactgaaacttattattgataaactgaactccggcgaggaactgttcatcatactcgacgaaattctgaaaggaacgaattcgatggataaacaaaagggctccttcgcactgatcaaacaattcatggctttacaggcgaacggcattattgccactcacgatctcctgctaggctctcttatcgatctattccccaaagatatccacaactattgtttcgaagcggacatcactaacaacgaactgactttctcctacaagctcagagatggaattgcgcagaacatgaatgcctgcttcctgatgaaaaaaatgggaatagccgtcatcgacgactaa

SEQ ID NO: 1860 - DNA, 582 bp, B.fragilis
gaggataaagcaatgtcaagaataggaaaattacccattagtattcccgctggagtaacagttactctgaaagatgatgtggttaccgtaaaaggacccaaaggtgaacttagccagtatgtgaacccggctatcaatgttgctattgaagatggacacatcactttaactgaaaacgaaaatgcaatgctggataatcccaagcagaaacatgcatttcacggtttgtatcgttcgttagtacacaacatggttgttggtgtttctgaaggatataagaaagaattggagcttgttggtgttggttaccgtgcttctaatcaaggaaatatcattgaattagcattaggatatacacacaatatctttatacagttgcctcctgaagtcaaagtagagacaaaatcagaaagaaataagaatcctcttattcttttagagtcttgtgacaaacaattgcttggtcaagtttgctctaagatacgttctttccgtaagcccgaaccgtataaaggtaaaggtattaagtttgttggcgaggaaattcgcagaaagtctggtaaatcagccggtgctaagtaa

SEQ ID NO: 1861 - DNA, 612 bp, B.fragilis
aaagaaatggctagatatcctggaccaaaatcaagaatagcccgtaaattcggtgaaggtatctttggagctgataaagttttgtcgaagaaaaactatcctcccggacagcacggaaattcaagaaaaagaaaaacttctgaatatggtattcagcttcgtgagaaacagaaagctaaatatacttatggagtattagaaaaacaattccgcaacttgttcgaaaaggcagctacagctaaaggtattaccggtgaggtacttctccagatgcttgaaggtcgtcttgacaacatcgtgttccgtttggggattgctcctacgcgtgcagcagctcgtcagttggtaggccacaaacacattacagttgatggacaggtagtaaacattccttcatacgcagttaaaccgggtcagttgattggcgttcgtgaaagatctaaatctttggaagtaattgctaattctctcgctggtttcaatcacagcaaatatgcttggttggaatgggatgaagcttcaaaggtgggcaaattgctgcatattcctgaaagagcagacattcctgaaaacattaaagagcatttgattgttgaattgtattctaaataa

SEQ ID NO: 1862 - DNA, 489 bp, B.fragilis
aaaatgagacataataagaaattcaatcatttaggtcgtactgcttctcacagaagtgctatgttatctaacatggcttgttctttgatcaagcacaaaagaatcactacgactgtagcaaaggcgaaagctctgaagaaattcgttgagcctttgatcacaaagtctaaagaagacactacaaactctcgtcgtgttgtatttagcaacttgcaggataaactcgctgtaacagaattgttcaaggaaatctctgtgaagattgctgaccgtccgggtggttatactcgtatcatcaagactggaaaccgtttgggtgacaatgctgaaatgtgcttcatcgaactcgttgactacaacgaaaacatggctaaagagaaagttgctaagaaagcaactcgtactcgtcgttcaaagaaaactactgaagctgctcctgctgccgaagtacctgcaactgaagaaccgaaagctgaatcagcagaataa

SEQ ID NO: 1863 - DNA, 1008 bp, B.fragilis
ataataattaatttcatggcgatattagcatttcaaaaacctgataaagtattaatgttggaagcggatgccaaattcggtaaattcgaatttcgtcccttggaacccggttttggtattaccgttggtaatgctttgcgccgtatcctcctttcttcattagaaggttttgctatcaccactatccgtatagaaggtgttgagcacgaattttctagtgttcctggagtaaaagaggatgttaccaacattatcttgaatctgaaacaagtgagattcaagcaagtagttgaagaattcgagagcgaaaaggtgagcatcactatcgagaattctagtgaatttaaagcaggtgacataggtaagtatttgactggatttgaagtgttaaatccggaattagttatttgtcatttagattctaaagcaactatgcagattgacattacaattaacaaaggtcgtggatatgtccccgctgacgaaaaccgcgaatattgtaccgatgttaatgtaattccaatcgattcaatctatacgccgatacgtaatgttaagtatgctgtagaaaacttccgtgtagagcagaagactgactacgagaaactggtacttgaaattactaccgacggttccattcacccgaaagaagcgctgaaagaagctgctaaaattctgatttatcactttatgttattctctgacgaaaaaattactcttgaaagtaatgacgttgacggtaatgaagagtttgatgaagaagtattgcatatgcgtcagctgttgaaaactaaacttgtcgatatggatctgtcagtacgtgccctcaattgcttgaaggctgctgatgttgaaacattgggcgatttggtacagttcaacaaaactgacctgctgaaattcagaaacttcggaaagaaatcgcttaccgagcttgatgatttgctggaaagtctgaatctgtcgtttggaaccgatatttctaaatataaattagataaagaataa

SEQ ID NO: 1864 - DNA, 450 bp, B.fragilis
atatattgtttaaatattgtcagggtagtcctgattaatttaattattttttatatgactgatccaatagcagattatttgacgaggttaaggaacgcaattaatgcaaagcacagagttgtagaagttcctgcttcaaatttgaaaaaagaaatcactaagattctttttgaaaaaggctacatccttaattataagtttgtagaagatggtcctcaaggaactattaaagttgccttgaagtatgattctgttaacaaagttaacgcaatcaaaaaacttgaaagaatatcttctccgggtatgcgtcagtacactggttacaaagatatgccgcgtgttattaatggtttgggtattgctataatatctacttccaaaggtgtaatgacaaacaaagaagctgctgaactgaaaatcggtggtgaagtattgtgttatgtatattaa

SEQ ID NO: 1865 - DNA, 561 bp, B.fragilis
gtaatgagtaatactgcaagccttaagaaagaatatgcagagcgcattgctcctgcattgaagtcacaattccagtattcttctacaatgcagatacccgtacttaagaagattgttatcaatcagggtttaggtatggctgttgctgataagaagattatcgaagtggcaatcaacgaaatgacagctatcactggtcagaaggccgtagctactatttcgcgtaaagatatcgctaactttaagttgcgtaagaaaatgccgatcggagttatggtaactctgcgtcgtgaaagaatgtacgaattcctggaaaaattggttcgtgtggctttgccgcgtatccgtgacttcaaaggtattgaaactaagttcgatggtaagggtaactatacccttggtattcaggaacaaatcattttccctgaaattaatatcgatagtattaccagaattctcggaatgaatattacctttgtaacctctgcgcaaacagatgaagaaggttatgccttattgaaagaattcggtttaccgtttaaaaacgctaaaaaagactga

SEQ ID NO: 1866 - DNA, 303 bp, B.fragilis
attatggcaaaggaatcaatgaaagcacgcgaaataaagcgtgctaaattagtagccaaatatgccgaaaagagagctgccttgaagcagattgtgagaaccggagatcctgctgaagcttttgaagctgcacagaaattacaggagcttcctaagaattctaatccgattcgtatgcacaatcgctgtaaattgactggtcgtcctaaaggatacatccgtcagttcggtgtttcaagaatccagttccgtgagatggcatctaatgggctgatcccaggtgttaagaaagcaagctggtaa

SEQ ID NO: 1867 - DNA, 222 bp, B.fragilis
tatatggcaaagcaatctgcaatagaacaagatggagttatagttgaagcattgtctaatgcaatgtttcgtgttgaattagaaaacggacatgagattactgctcatatttctggtaagatgagaatgcattacattaagatcctaccgggtgataaagtcagagtcgaaatgtctccttacgacttatcgaaaggaagaattgtatttagatataaataa

SEQ ID NO: 1868 - DNA, 477 bp, B.fragilis
ttatttgttgaatataaaacgaattacaatatgaacttaagtaatttaaaacctgcagaaggctctactaaaacaagaaaaagaatcggacgtggtccgggttctggcttaggaggtacttctacaagaggtcataaaggtgctaaatcaagatctggatactctaagaaaatcggttttgaaggtggtcagatgcctcttcaacgtcgagtacctaaatttggttttaagaacatcaatagaattgaatataaagctattaacttagaaacaatccagaaattagctgaagctaagaagttggaaaaagtaggtgttaatgactttattgaagctggattcatttcttcaagccagttggttaaagtattaggtaacggaactttgactgctaagctgagtgtagaagctcatgcattctctaagagtgcagttgctgctatcgaggctgctggtggaaatgtagtaaaactctga

SEQ ID NO: 1869 - DNA, 447 bp, B.fragilis
acagtcggactgaataatctgttatatttgcaggcagatatggcaaagttcattaaaattatattgttcatgttgtttgctgtggcacttcatagtgtagctaacgactatttcgctgaaaaacaggcggaacaagatatctatatggctatgtcaacaatgaaaggggatacgcacgaaacagtcagcagtccccagacaccctatttccctgatgccgaattggccgggaccggaattcagacgcatcagatcgcaatgtcgcgcatacagcgtatacaagcggccgaatctattttttctttaaaagcccttgctcaaaggctggcagaccgtgatgctgttttatctcagcattgggggaagctttatgaaaccactacttcttattggtggcatcctgtaagcgaatactatgttttcgctctaaggcgtattattgtatag

SEQ ID NO: 1870 - DNA, 357 bp, B.fragilis
atttgtattattatgacaacaaaaatagaaagacgaattaagatcaaatatagagtacgcaataaagtgtcaggtactgctgcacgtccgcgtatgagtgtatttagaagtaacaagcaaatctatgtccagattatcgacgatttgtctggtaagacattggctgctgcctcttcactgggtatgactgagaagttgcctaagaaagaagttgctgctaaagtgggtgagattattgcgaaaaaagctcaggaagcaggtattacgactgttgttttcgaccgtaatggttacttgtatcatgggagagtaaaagaagtagctgatgctgctcgtaacggtggacttaaattttaa

SEQ ID NO: 1871 - DNA, 384 bp, B.fragilis
tatatggctataagaatagttggtgtagatttacctcaaaataagagaggtgagattgcgttgacctatgtatatggaataggtcgtagtagttcagcaaaaattttagataaagctggtgtagacaaagatctgaaggtgaaagactggacagatgatcaggctgcaaagattcgtgagatcatcggtgcagagtataaggttgaaggtgatcttcgttctgaagtacaattgaacattaagcgattaatggatattggttgctaccgtggtgtacgtcaccgtattggtctgcctgtaagaggtcagagcactaagaacaatgcgcgtactcgtaagggtagaaagaaaaccgttgcaaataagaaaaaagctactaaataa

SEQ ID NO: 1872 - DNA, 531 bp, B.fragilis
attttaatcattatggcaggagttaataatagagttaagattactaacgatatagaactgaaagacagattagttgctattaatcgtgttactaaagtaaccaaaggtggtagaacttttagtttctctgcaattgtagttgtaggtaacgaagaaggtattatcggttggggacttggtaaagctggtgaagtaacagcagctatcgctaaaggtgttgaatcggctaagaaaaatctgacaagagtgcctgtactgaaaggtactgttcctcacgaacagtcagctaagtttggtggtgctgaagtattcatcaaacctgcttctcacggtactggtgttgtagccggtggtgctatgcgtgccgtattggaaagtgttggtgtaactgacgttttggctaaatcaaaaggatcttcaaatccgcataaccttgtaaaagccactatcatggctttaggcgagatgcgtgatgcaagaatgattgctcagaacagaggaattagtgttgaaaaagtatttagaggataa

SEQ ID NO: 1873 - DNA, 804 bp, B.fragilis
gtagaaatgatatttcttaaaactgaagatgaaatagagctgctccgtcagagtaacttacttgttggtagaacgttggctgaagttgccaaacttgtgaaaccgggagttaccactaaagagctggataaggtagcggaagagtttatcagagatcatggtgctgttcctacctttaaaggttttcccaatcaatatggagatccgtttcctgcctctttatgcacatcggttaatgaacaggtagtgcatggcattccgggagatatcgtgttgaaagacggtgatattgtatcggtcgactgtggtacctacatgaatggtttctgtggtgattcagcttataccttttgcgttggtgaagtggacgaagaagttcgtcagttgttgaaggtaactaaagaggcgttgtatattggcattcaaaatgctgtgcagggaaaaagaatcggtgatatcggatatgctattcagcaatattgtgagtcccattcttatggtgttgtgcgtgaatttgtcggtcatggtattggtaaagacatgcacgaagaccctcaggtaccgaattatggtaaaagaggatacggaacacttttaaagaaaggtctttgcattgcgattgaaccgatgattacgcaaggtgaccgacaagttattatggaacgtgacggatggacagtgagaaccagagatcggaaatgtgccgcacactttgaacataccattgcggtaggtgcaggcgaggctgatattctgtcatcatttaaattcatagaagaagttttaggagataaagcgatataa

SEQ ID NO: 1874 - DNA, 648 bp, B.fragilis
gagtttaacttattagttctattattattttatgttgccgtgcctggtagttataggtgtggtagtatttatcagctattatttactaataatttaaacttcaatattatgacaacccaagctatcgatgcaacaatttttgcatcttcacacccagatattgcaaaacgcaccagtgtttccggacttatcttctcttgcattatgttattggcaggagtgattgcatttgtttctacttttgagatgaaagaccgttcatcgactatcagtatgggacttatggtactaggcaccgccttgttcttgattggcgttttccggttgttctggaaatccaaggagattgtttacttgccgacgggcagtgttgctaaagagcaaagtatcttttttgatttgaaacatctggatgaattgacagacatggtgaagtcgggtgatttctctatgcaatcgactgccaaaggtggtacaagtggaaatctgcgtttagatgtaatgctgtccgaagacagaaagtttgccgccgtacaattgttccaatttgtaccctatacttataacccggttacatccgtacgttatttcacgaatggtgaagcagcttctattgccgctttcctgactaagacaaaaggacactga

SEQ ID NO: 1875 - DNA, 405 bp, B.fragilis
ataataattgttgatatggcaaaaaaaacagtcgcagctaagaagagaaatgttaaggtagatgctaatggacaattgcatgttcattcatctttcaacaatattattgtttctcttgcaaatagtgaagggcagattatctcttggtcgtctgcaggaaagatgggatttagaggttctaaaaagaatactccttatgcagctcagatggctgcccaggattgtgctaaaattgcattcgatcttggcctgagaaaggtaaaagcatatgttaaaggtccgggtaacggtcgtgaatctgctatcagaacgattcatggtgccggtattgaagttacagaaatcattgacgtaactccgcttccgcataacggttgtcgtcctccgaaaagacgtagagtttaa

SEQ ID NO: 1876 - DNA, 1359 bp, B.fragilis
  unsure (199): Identity of nucleotide sequences at the above locations are unknown.
aactctgattcaatgagaaaagctattgagtcatcaaagaatatatggaaaattgaggatttgagacaacggatcctcattaccatattgtttgtggcgatttaccgtttcggttcgtacgtcgtgtttcctggaatcaacccgggtatgctgacacaattgcatcgacaaacaagtgagggccttttagccttgttanacgtgttctcaggagcagcattttctaatgcatctattttcgcattaggaattatgccttatatctgtgcatcgatcgttatccagttgctgggaatcgttgtgccatattttcagatacttcagcgagagggagaaagtggcagaagaaagatgaatcaatatactcgttatttgacgattgctattttgttggttcaggccccttcttatttgctcaatcttaaaatgcaggctggaccttccttaaatgcttcattagattggactctgttcatggttacttctaccattattttggcagctggaagtatgtttatcctgtggcttggtgaaagaatcacagataaaggtattggtaatggtatttcatttattattttgattggtattatcgctcgtcttccgcagtcattattccaggagttgatttcccgtatgaccgacaagactggtggtttgatcatgttcttatttgaaatagtattcctgctgatcgtaattgccggagctattcttttggtacaaggtacaagaaaaattcctgtacagtatgcaaagagaatcgttggtaataaacagtatggcggtgcaagacagtacattcctttgaaagtgaatgctgccggtgtaatgcctatcatttttgctcaggcaattatgtttattccgatcactttcattggtttttctaacactaacaatgtgagtggtttcgttcatgcatttactgaccatacgagtttctggtataattttgtttttgcagtaatgattatcttatttacgtacttctatactgcgattaccattaacccgactcaaatggccgaggatatgaagagaaataatggtttcattccgggaattaagccaggtaagaaaactgctgagtatatcgatgatatcatgtcacgtattactttgccgggttctttctttttggctttcattgctatcatgcccgcatttgccggtatctttggtgtgaaggctgagtttgctcaattcttcggtggtacgtctctgttaattcttgtaggtgttgttttggatacactgcaacaagtcgaaagtcatttgttgatgagacattatgatggcttgttgaagtctggtcgtatcaaaggacgcaccggtagtagtgtagctgcatattaa

SEQ ID NO: 1877 - DNA, 186 bp, B.fragilis
atccaaaaatcacatcccaaggacaagaataccatcaatagtgcagatactgacagcatgccccggcttcctatatataaagcccgttccatggtaggtaattttatcgatatggctgaaaagataaccattgctatcgcattgattccgaaacagaggctgaaggatagaggagagagtccgtag

SEQ ID NO: 1878 - DNA, 534 bp, B.fragilis
gccagtatacctcctccgataggggcgatgactgtagctattccatttattccgccgataacggcaagcatgccggccagttgctgtcccgaatactcgtcggtagctatggagcgggaaatcactacaccacctgctccggcaatgccttgtaagaatcgggatgtcacaaattgtgaaatggtatgtgaaaagatgcaccccaccgtagcgagcaggaacagaatcatggccagaagtaatggaggacgtcgcccgtacttgtcactcaagggaccgaaaattaattgtccggcagccaagccaatcatgctggtggtgagtcccaattgtaccatagaagatgaagtgtggaaaaaatctgccatagccggtaaggtaggcaaatacatgtccattataaaagggccgaaagcacttaatacacctaaaaataataataagaaccgtctggaattctgtctgtcagtcattgctattctctttgatcaatacggttgcaaaattactccatctgttaggaatcgaatatag

SEQ ID NO: 1879 - DNA, 2280 bp, B.fragilis
acatacagtaccatgaaatttaaaacattcctggcgggatgtttaggaggcttattgtctctgaactcctgcacaaactcgccggacatgactgattacgtagcctatgtcaacccatttatcggtacaggcggacacggtcatacttttccgggcgccattgtcccccatggcatgatttctcccagcccagacacccgcatagatgggtgggatgcctgctcgggatattattacgcagatttcaccatcaacggattctcacacacccatttgagcggaactggttgttgcgactatggagatgtactactgatgcctacggtgggcgaacaaaagtacctccccacaggttcacagagccagcagatggcttatgcttctgccttttcacatcagaatgagactgccgaaccgggctattactcagtcttcctggatacttatcaagtaaaagccgaactgactgcaagcaaacgggcagctatccacagatatacttttcctgaaagtaaagaagcaggattcatcctcgacttggactacagtctgcaacggcagaccaacaaagagatggaaatagaggtcatcagccccactgaaatctgcggccgtaaaaagaccatgtactgggctttcgaccaatatatcaacttttatgcaaaattctcgaaacctttcacctacacgttggtgactgattcgatggcactcgacgatggaggcagactgctgcctacctgtaaagcattacttcactttgacacgaccaaagacgaacaagtgtttgtcaaagtcggaatctctgctgtggacatagagggtgcacgcaaaaatgtagaaactgaaataccagactgggattttgacggagtacgtaaagacgcacgcaaagcgtggaatgaaacgttatcgaagattgatattactaccaatgataaaaatgacaaaaccatcttctataccgcactctaccacactgccattagcccgaatctgtttacggacgtagacggacgttatctgggtatggatctgcaagtacatcaaggagatacactgaatccgatgtataccattttttctttatgggataccttccgtgcactgcatccgctaatgaccattatagatccggatctgaacaatgctttcatccgttcactgatcaaaaagcatcaggaggggggcattttcccaatgtgggacatggcttccaactataccggtacaatgattggttaccatgccgttcccgtcattgtagatgcatatatgaaaggcgatcgtaatttcgacatccaagaagcttaccgagcctgcgtgcgtgcggcagaatatgatacaacaggaatcaaatgccccgatctggtgttaccccatctgatgccgaaagccaaatattataaaaactcaatcggctacgtaccgtgtgaccgcgaaaacgaatcggtcgccaaggccttggagtacgcttatgacgactggtgtatttcagtatttgccgatgcattgaacgactacgacacccgggacaaatacgcacgtttcgcaaaagcctacgagttttacttcgatccgggaacccgctttatgcgcggattggacagtaagggcgaatggcgcactcccttcaatccacgttcttcaactcaccgcaacgatgattattgtgaagggactgcctggcaatggacctggttcgttccacacgacatcgaaggattggtaaaactaatgggcggcgaagatgccttcatcggtaaactggattctctgtttaccgccgactcttcactggaaggcgaaacaacctcctcggacatcagcggactgatcggacaatatgcccacggcaacgaacccagccaccacgtgattcatatgtacaactatgtgaaccgtccgtggaggacgcaagaattggtagacagcgtataccgtagccaatatgccgatgccgtagacggactgtcgggaaatgaagattgcggacaaatgtcggcttggtatgtactcaattctatgggattctatcaggtatgtccggggaaaccggtttattctatcggacgcaccgcattcgataaagccgtagtaaacttgcccgatggcaaaaagtttacagtgatagttaagaataactcgaaaaagaataagtatatcaaaagcatgacactgaacggaaaaccattggataaaccattctttacgcatgacgatatcatagcaggcagtacgttggaaatagaaatgacagaccggcggccccaaccctaa

SEQ ID NO: 1880 - DNA, 2409 bp, B.fragilis
gaagggatcactgaaacggaaagcatattatctcccccggctgtttataatgccccctccgccctcatgataacgagtcgaaatacaaaaagacgaatcaatcagcacacaagctctttcgttttacatttatattctctacctttgcacactaaatcaatcaattacttaaaaaactctaacccaagccgcatgaaagtactttttcattcactatttattcttttatttgttttcactgcctgtacgtctacccctaaacaggcaactattgactatacccaatatgtaaacccatttatcggaaccgatttcaccggtaatacctatcccggagcacaagtccctttcggcatggtacaacttagtccggacaacggacttcccggctgggaccgtatctccggatatttttatcccgatagcactattgccggattcagccatacccacctttctggtacgggggcaggcgacttatatgacatctcttttatgcccgtcaccctgccttataaagaagcagaaactccgttaggtatttactccaaattttcccatcaggacgaaagtgccacggcaggatattaccaggtactgctgaaagattacggcatcaacgtcgaattgacggcaaccgaacgatgcggcattcagcgttacacttttcctgaagccaaagccgctatctttctcaacctgaaaaaagctatgaattgggactttaccaatgattcgcacatcgaagttatcgactcggtaaccattcagggataccgcttctccgacggatgggcacgcgaccagcatgtctatttccgtacacgcttctctaaaccttttacagccgttcaaatggatacaactgccatcctgaaagacggaaaacgaatgggtacggctaccatagcccgattcgatttcgacacacaaaaaggagagcaaatacttgtcaacacagccctttccggtgtcagcatggaaggagcagctcaaaatctggcagccgaagttccggaggataatttcgataaatatcgtgaggctgcacgggacaactggaaccggcaactctctaaaatcgcagtcaaaggcgaccataaggacgattgggtaaacttctacaccgcactctatcacaccatgcttgctcctaccatttatagcgatgtcgacggttcgtattacggtccggacaaaaagattcatcacacagacggatgggtaaactacagtactttctctttatgggatacataccgcgccgcacatcctctatttacctataccgaacccgaacgtaccaacgatatggttcaatcatttctggctttctacgaacagaacggacgcctgccggtttggaatttctacggtagtgaaacagatatgatgattggctatcatgccgttccggtcatcgtggatgcttatctgaaaggtattggaaactttgatccgaaaaaagcattggaagcttgtgtagccactgccaacctggacaattaccgcggaattggtgcttataaagaactgggatatgttcctttcaatgaaaaagatagttataatgccgaaaactggtcgttatccaaaacacttgaatacgcttatgatgattactgcattgcccgcatggcagaaaaactgggaaagaaagagattgcggacgaattctataagcggtcgcaaaactatcgtaacgtatacaatccggcaacctcgttcatgcaacctcgtgatgacaagggagaatttcagaaagactttaaagcagatgcttatacaccgcatatctgcgaaagcaacggttggcaatatttctggtcggtacagcatgacatagacggactgatcggtctgacaggcggaaaagaacgttttgcacaaaagctggacagcatgttcaccttccatccttcggccgacgatgaacttccactcttcagtaccggaatgataggccaatatgctcacggaaacgaaccgagccatcacgtcatctacctttataatgcggtagaccaaccctggaaaacccaggagtatgtggcaaaagtaatgaacgaactctacctgaacagccctgccggactctgcggaaacgaagactgcggccagatgtcggcttggtatgtattcagcgccatgggattctatccggtaaatccgataagcggtcaatatgaaataggtactccccttttcccggaagtgcaactgcaccttgacaacgggaaaacattcactgtcaaagctccgactgtcagcaaagagaatatctatatccgatcaaccaaactgaatggaaaaccctatgataaaagttacattactcatgaacagattatgagtggtgcaacccttgagtttgaaatgggaaaggagaaagttacgagtgatcaataa

SEQ ID NO: 1881 - DNA, 3663 bp, B.fragilis
  unsure (231): Identity of nucleotide sequences at the above locations are unknown.
gtagttgggttgaatataggtttgggctgtatcacacaggcagacatacgttttgttggcggatacagcccttggttttcttccctgccttttcttaatatcaatagtatgctaaattttaaacatctgtttctggtaagtgttgctctgtggtcggcagtaggaatggttcgtgcccaggagttcgatccgaagcaaagctacgagatccatacccagaacggacttgtnctggacaatcaggagagtctggatttaggtagtaagatatttatttctaaaaaggaaccccataaagagtcgcaggtctggaatctgataccttgcggtgacggctgctactccattgtcagtccgctcaccgaactgggaatcgacaatagcggcaatggaagcaaggagtgtccggtcatccaatgggaccccaataaagaaaatcccaatcagcaatggcgtatcacggctttacccaatgggaattatttgttcaccagtgtagcgagtggttataacctggggttcccggatgccggtcttgtggccgagccggtttaccagctcaaaccggatgcgcagaaaataagccagcaatggaaaatcgtgaaatcgaatctgaaagtggtggctgaggcttttaaaacccggagtgataatgactgggagaatgaacggatatttgccgttaacaaagaagaggggcgttctacgtttgtcccctttgccgatacggaagagatgaagggcgatccttcgtacacccgtccttggatacgcaatcagtcttcccgttatctgttgctgaatggtgactggaagtttcattgggtgaagcaaccttccgaacgtccggtggatttctataaaccgggctatgacgtgtctgcctggaaagagattccggttccttccaattgggagatgctgggatacggaacccccatctataccaatatcacctatccgatacgcaacaatccgccctttatacagggacagagaggatatacggtagagaaagagcctaatgcggtaggttcctatcggagggaattctctctgccggccgactggaaaaataaagaagtgtttatccacttcgacggagtgtacagcgctatgtatctgtggatcaatggtaagaaagtcgggtatagccagggtgccaacaacgatgccgagttcaacattacacagtatgtgaagccgggtaaaaacatattggcagtcgaagtgtatcgctggagtgacggcagctatctggaagaccaggatatgttccgcctgagcggtatccaccgggatgtctatctggtggcgactccgaaacttcgcctgcgcgacgtgcatcttacttctgtcatcagtgaccgtttcgacaaggccgacttatgtgtcaaagcagacgtgaagaactatggcaagtctgctgtgaatgcctccgtgcgcatagctctgctggatgccggtggcagaactttgcgtacgtttacaactgcggccggtaatctggctgccggaaaagagatctgtctgcctgcaaaagcaagtattcgtgatccccaactctggagcgccgaaacaccttatctgtatactgtgaatctggaattgctggatgcttccggcaaggtgctcgaggcaactacccagcaatatggtttccgcaaaattgaaatacgtgacaataaagtgtatatcaatgatgcattggtgttgttcaagggtgccaatcgtcacgatattcatccccgtttcggtaaagcggtacctgtagaaagcatgatagaggatattcttctctttaagcgtttcaacctgaacaccattcgtaccagtcattatccgaatgatccgaagatgtatgctctgtttgactactatggactttacgtaatggacgaagcggatctggaatgtcatggcaacatgatgctgactaagcgggaaagttggaaagaagcctttgtcgaccgggtggtacgtatggtgaaacgggacaagaaccatccttccgtaatcttctggtcgatggggaatgaatcgggcggaggacccaatttcgaggccgcttatcaggctgccagagagattgacgcacggttcatccattatgaaggaatgaatgatgttgccgatatggactcacggatgtatccatccatcgaaagtatgatagctcaggacaacgagccgcgcaataaacctttctttctatgtgagtatgcacatgccatgggaaatgctgtcggtaacctggaagaatattgggactatattgccaatcagtctaaacgcatgatcggaggttgtatctgggactgggtggatcaaggcatcaataaacccggagaagcgccggaccgttattatttcgggggcagcttcggtgatcgtcccaacgacaatgatttttgttgtaacggactggtgacacccgaccgtagagttactcctaagttatgggaagtgaaaaaggtataccaatatatgacttttgaagaagtgggagagaacaatgtggggttacgcaatcattattcattcctgaatatgcgtcatttcaacctgcgttatgtcatcctcaaagacggggtgcctgttgcggaagaggagttcgggctgcctgacggcaagccgggtgaacaccgtacgatccatatcccttatctccgtcacttgacggaagatgccgattaccacatcaacttggaagtgaagttgaagcatgactgcgtctgggctaaagccggacatgtagtggcaacggagcagttcttactaagagagagaaaacagaaaacggaggttccggaactctctgcttccctgcaggtggtagaagaacgtcagtacatccgtttccgtgctccgggtaccgagatctcatttgattcaaagacaggcatgatgatcggtctccgatatgacggacaaaacatgatacatggtcagcaaggaccggcgttgaactggtatcgttccatcagtaatgatcctcgcgaatggattcagcctgtggttgtattgcgtggttttgactggaaactggcggaagacggaaagtcggcgtctgttcagtctcagatagaggtcaaagttgggcaagtcaatataccgtatacggtcagataccgggtttacagtaacggcagggtcgatgtggcagccgactttacgacagaaagtaatttcgatctacctcgtctgggcttgcaaatgttcctcaatccttcactggaacaagtcgaatggtatggccgcggtccgatggagaactatcgtgaccggaagaacgcagcctacatgggacgctacaaaacgactgttacggatatggccgagcattatgcgcgggcgcaaacaatgggcgaacgcacagatacacactggctggcgttgacagacggacaagggaaaggactcaggatcaccgcaacggatacgttggatttcagtgcccaacattacacggataaagatttatggcaggtaaaatatggacatgatttgtctgatatccgccgtgcggaggttgttctcaatttagattgcattcagcgtggattgggcaatgccagttgcggaccgggaccgcgtccccattatgaaatccggaaggatacggtttatagttattctttccgaatggaaccattgagataa

SEQ ID NO: 1882 - DNA, 1137 bp, B.fragilis
aaaagacaacacaaagaacatcttattaataaaaaactcaaacagaaaatgaaacgcattgtttttttagattatgtacgcgtatttgcgtgctttctcgttatgattgtacactccagtgaaaacttttacggtgccgccggatccacggacatggccggaccgcaatcttatttagccagtgaagcagaccgcttatgggtagctgtatacgatggcttttcacgcatggcagtaccattattcatgattgtctccgcctttctccttgctccgatgaaagaagaacaaactacatggcaattttatcgccagcgattccttcgtatcataccaccattttttatattcatgatactatacagcaccttaccaatgttgtggggacagataaacggagagacatcattaacggatctatcacgaattttcttgaacttcccgacacttgcaggacatctgtggtttatgtatcctctaatcagtctttatctattcatacctataatatctccatggctgagaaaagcctcggcaaaagaagaacgcttcttcatagggttgtttctgttatcaacatgtatcccatatctcaaccgttggtgtggtgaagtatggggacaatgtttctggaacgaatatcacatgctatggtacttctcaggctatctgggttacctcgtgctggcacattatatacatactcaccttacgtggagtcgttcaaaacgtttcatcataggaaccattttaatggttatcggagccgtattaaccatctattcattctatagccaggctatacccggtgagactctttccactcccgtaatagaaataggatgggccttctgtacaatcaactgtgtactgctcacagcgggtacattcctcatgtttacgtgtatcaatagctcaaaagctccacgaatcataacagaaatgtcaaagctcagctacggtatgtatctaatgcatatcttctggttaggattatgggcaacagtatttaagtataccctggcactgcctactgttgccgctataccatgcattgcagtcagtacatttatctgttgcttcataacttcaaaactcatttcattcataccgggcagcaaatggatcataggatga

SEQ ID NO: 1883 - DNA, 195 bp, B.fragilis
ccatactcaaatgttcatcctatgatccatttgctgcccggtatgaatgaaatgagttttgaagttatgaagcaacagataaatgtactgactgcaatgcatggtatagcggcaacagtaggcagtgccagggtatacttaaatactgttgcccataatcctaaccagaagatatgcattagatacataccgtag

SEQ ID NO: 1884 - DNA, 705 bp, B.fragilis
actaaaaaaaacatatttatcatgaaaacagtatttaatatcgtactaggtgtatgcgccattgctttggtttacatttgctatgctagtatcatgggtcctatcaacttcgaaaaagctaaaaagcacagagacaaagcagttgttgcccgcttgattgatattcgtaaagctcaggcagaatatcgtaacatttacaagcagtatactgcaagctttgacacactgatcgatttcgttaagacacaaaagattcctttcgtatctaaagaaggcgtattgagcgacaagcagctggaagacggtatgactgaaaagaaagccatggctctgatcaacaaggctaaaaagactaacaactggaaagaagttgaagctgccggcctgatgggcttcaaacgtgatacaatatgggttgccgtaacagatacgatctacgataagtcattcaatgcagactctttgagatatgttccgttcggtaatggtgcacagttcgaaatgtacactaaaaacgatacaactaaatcaggagctcctatcttcttgttccaggccaacactccatatgatgtatacttgaacggacttgacaagcaagaaattgcaaacttgaaagaccttcaggttaaattgggtaaatatgccggtttgatggtaggttctatcgatactcctaacaacggcgcaggtaactgggaataa

SEQ ID NO: 1885 - DNA, 2211 bp, B.fragilis
tcaatgaaaaacaaaatcctatttcaaagacccaggctgctcaaagcatcgctggttcttcttttagctgccgctcctatccagtggtcatttgcacaattcacattttcaacttcccgcactacattggggcaagtcatcaaaacggtgcaatctcagtctaagtatcaattcttttatgatgaccaatcgtcaaacatgccgattgagaatctgaacgtaaagaatgtaagcctggaacaactgttgaatactgcgctcaaaggtaaaaacctgacatacaaaatcgaggataacattgtttatctgtctcaggcttccaaacaacaggatccggttcaggcatcggccaaacgtcagatcagcggtacggttgtagatgctaacggtgaggcgctgatcggcgtcaatgtatctgttaagggtaccagcacaggagccattaccgacctggagggtaaatacaccctgactgtcaatgatccgaaagctgaaatcgtattctcctatatcggatacaaacaacaagtgttgcccgctaaagaaagcattctgaatgtaacgatgagtgaagatacccagatgatcagtgaagtggttgtaaccgctttgggcatcaaacgtgagaagaaaatgttaggatatgccgtacaggaaatcaaaggcgaccaactgaaccagacaggggatccttcagtgaccagtgcattgcaaggtaaagtagccggtctgcaaatgaatacagccggaactggcctgggtggttctaccaagattacaatccgcggtaactcttctctcgcagataacaaccagccgctctggattgtagacggtgtaccgttcagtgacaataataactcggatgctacctattacggtggtgtcgaccgtggtggttcatccgtcgatatcaatccggaagatattgaatcgatctctgtactgaaaggtccgaatgccgccgctctctacggttcgcgtgccggtaacggtgtgatcttggtcacaaccaaaaaaggtagcaagaaagatggattcggagtacgctatagcggcaacttcacttggagccaggtagccgaaactcttgaaatgcaagatcgttacggacagggccacattgtgactcaggatgaaaacaagaatcctctgtctcaatattatgccaaatatgatccgacagactcttccagttggggaccggtattggacggaagcatgcagaaagcctggaacggcgatacctatgcattctctaaatacggcaacaaactgaaagattacttcgataccggtttcgcacaaaaccacaatgtatcggtgagcaacgtaacagataaatcgcactttcgtgcttctttcggcagctcgaacaataagggcgtattcccgaacgagaagctcaaccgaatcaacctcgacctgaatgccggaatggaaatgaacaaatatctctctatggacggaaagatttcactttcacgtaccaaagcagaagatcgtccttacttcggtacttacggagcaatcgctcaattgatgggtattcctaacaatattcgcctggacgacctgaaacaatattcgacagatggcaatgcacacgtaaactggacaggtcctactgccggtatccgtaacccttattacgtcctgaaccagcgccacaactctgacgaacgttggagagcattcggatattatggaatgaaaatcaactttactgactggttgcacttgtctgccaaatatgcattcgattattatcgtacccgaatcgaagaaacgaacgcaggtgacggtatcaacggtgagagcagtatcaaagatatcaccgatgacgaaatgaaccgcgaggagcagaatttcttcgaatcgaacgcagaaatcgtattgatgggtgacaaacagctgactgacaatttccgtctgggattcacggtaggtggtaacttcatgtaccagaattatgaatcactgaatgccggcgtacgcaatatgctggataagggacaatggattttcaatgcagccaatatgctgaacgctgccggagaaaccggacatgaacgcgcaacaaattcagtattcggatctttgcaactctcttgcaaacaatatctgtcactagacttgactgcccgtaacgactggtcgtctacactgccaaaaaagaacactctttcttctacctgtctgccaacttaa

SEQ ID NO: 1886 - DNA, 1044 bp, B.fragilis
tattctgaaaaaagcagtgcaaagatagcttgtttttattatttttgccgtattaacaagcgaaatatttataagatgcgcaaagtttactacatctataatccgcaaacgcagacttatgaccggatttatccgactgtccgacaacgggcgctgagcattctccgccgtctttttataggaatgggactgggagccggcagtttcatcattctgttactgattttcggttctccctcagagaaggagttgcggaaagaaaatagccaactcttggcgcaatataacgtactctctcgtcgtcttgacgaggcgatgggggtgcttcaggatatccagcagcgtgatgataacctctatagagtgatttttatggccgatcctgtttcaccggctattcgtcaggccggttatggtggtacgaaccgttacgaacaattgatggatatggctaactcaaagttggtgatcaacactacccaaaagatggatgtactgagcaaacagctttatatccagtccaagtcatttgacgatgtagtggcaatgtgtaaaaatcatgatcagatgctgaaatgtattcccgccatccagcctatatccaataaggaccttcggaagacagcatccggttatgggacacgggttgaccctatctacggaacaacgaaatttcatgccggcatggacttctcggcgcatccgggtacggacgtgtatgccacgggtgatggtacggttgtgaaaatgggatgggagaccggttatggcaatactgtcgagattgaccatggcttcggatatcgtacccgctacgcccatttacaggagtttcgtactaaactgggtaaaaaggtcgtgcgtggtgaagttatagccggggtaggaagtacgggaaagagtaccggtccgcatttgcattacgaagtgcacgtcaaaggacaggtggtcaatccggtgaactattactttatggatttgagtgcggaagattatgaacggatgattcagattgccgccaaccacggtaaagtatttgactaa

SEQ ID NO: 1887 - DNA, 408 bp, B.fragilis
aaaataagaaaaatgaaacaaagagttacctccaatcacatcgaacgattgcaacccaatgaaatattcgttttcggcagtaatctgtccgggcatcatggcggtggtgccgcccttttggcaatgaacaaatggggtgccatctggggacaaggtgtaggtttgcaaggacaaacttacggaataccgaccatgcagggtggagtagaaacaatccgcccttatgtagacgaatttattcaatttgcaaataaacatccggaaatgacttttctggttacggaaataggatgtggcatagccggatttactcctcaagaaatagctccactatttgctaaagccacaactacagagaatatccacctcccacaacggttctgggatttattagaaagaatcccataa

SEQ ID NO: 1888 - DNA, 378 bp, B.fragilis
ctaaaagagaagaaaatcatgcaaaatacggagagagacctgaaattatattactctatcagtgaagttgcccaaatgtttgatgtcaacgaatcgttgcttcgtttctgggaaaaggagttcccgcagatatccccaaagaaagggagtcgtggcgtgcgccagtataggaaagaggatgtggaaaccattcgcctgatctatcatttggtgaaagaaagaggaatgactctgcccggagctcgccagaaactgaaagataacagggaagcgacgatccggaattttgaaattatcgaccgtttgaagcagattcgtcaagagttgatcggaatgagggatgctttggatgggttttcaacaaaaacgggaggggct

SEQ ID NO: 1889 - DNA, 201 bp, B.fragilis
aaagaggagaaccgttgctttaaaagccaaaggattgttggttttaaaggcaggatcctttggttttcaattaacatcttgaatcttaagtatctgtttgttagtgaatcatggcttatggtatgctttgactttatctttagtcggttgcattggattttaaatctccttttagcgttttgtcaggaaagaacgccatag

SEQ ID NO: 1890 - DNA, 552 bp, B.fragilis
catgcaagccttattaacatgcgagtaatcagcggaatatataaaagaagaagatttgatgtgcccagaaccttcaaggcacgtccgacaacagattttgccaaagagaatctgtttaatgtattatccaattacatgaattttgaagagggcattgttgctctcgatctgtttgccggtacaggcagtatcagtatagagctggtttcacgtgggtgtgaccgcgtcatcagtgtggagaaagagggagcccatcatgctttcatcagcaaaattatgaaagaggtgcaaacagacaaatgcctgcctatccgtggagatgtatttaaattcataaatggcagtcatgaacggtttgatttcatttttgccgatcctccctatgaactaaaagagttggaaacaattccggatttaattttcaagaacaacctgctgaaagaggatggcctgtttgttctggaacatggcaaaaagaataactttgaagatcatccccactttatagaaagaagggtatacgggagtgtcaatttttccttcttcagatag

SEQ ID NO: 1891 - DNA, 1170 bp, B.fragilis
atgaaacaagaaaaacaaaccgaactgttgcggactcagcagatgctgaatgaagtgaaccgcaagttgttaatgacgcttggggtcgcggaagtttttccatggaagtgggaattggcagagcatatggtatggtttgatgcccgtccgtcggacgatcctgcaggatgggagatttttcataatgattcgtttccggtttctatagcgcgtgtttatcaaggcatctataaggaagaccgccttcgggtgattgaagcttgtcgggggatactgaaaggcaaaatgaagaaagtggtggtcgaacttcgtttctgggctaaaaagagagagggattcgtattggagtggttggaaatgcatgccattcccgggaaagttgatgaaaatggcagactgttgactgtagagggatcgctgatgtccattaccaggcgaaaggttatggaagaagaactgaccgcagctaaagagaaagcagaagaagccaatcggttgaaatcggcattgattgctaatatgaaccatgagatacgtacaccgttgaatgcgattgtaggttttgcatctttgctctctatcatagatgacgaaaaagagcagcaggagtatatcggattgatacagagtaatacggagcatcttttgcgattgatgaacgatgttatcgatctctccaatattgagtcgggcgttatggacatagtcggttcggatgtagtcctcgattcattgatgaaagagatggaattgacgtatgttcccaaagcagaaacgaacaacctggttttggcttgggatcgggagcagtcgaatgctcacatctatacagatcgggacaggctgatacagatattggagcacttattggataatgctattaaatttacaacaaaggggaccgttcgttgggggtatcaagagaaagagaatggtcaaattaggttttatgtgacggataccggatgtggtattcctaacgataaaaaggaagtgatatttgaacgatttgtgaaacttgatagctttacccaagggcttggattgggattgtccctttgtaaaattattattgagcgtatgcacggaacgattggagtggaatcggaagttggagaaggatcgactttctggtttactatccccaatttatccgacaatcatatttaa

SEQ ID NO: 1892 - DNA, 1128 bp, B.fragilis
gtgctaagtttcactatttatctccgaactcctatctttgcagtacataaaaaacatagaaccattatgagtaaacaagaagtcatcctttgtgaagatctggaaagtagtcttaaacgtgccatcgacaactgcccacacgaccgcctgttcattctcactgacgatcatactcaccgtctctgcctttctcaactggcaggcttatcaatcctgaaagatgctgtcgaaatcaccatcggagccgaagacgtacataaaacactcgaaaccctggcctctgtctggcaggtattaagtgaaaaaggcgctacccgtcactcgctcctcatcaatctcgggggcggaatggtcactgatttaggtggatttgcagccgcaaccttcaaacgcggcattgcctatatcaatattcccaccaccctgctggcaatggtagatgcttctgttggcgggaaaaccggcattaatttcaacggattgaaaaacgagataggtgcctttgcacctgcagccagtgtattaatcgaaacagagtttctccgtacactcgatgcacataatttcttttcgggatacgccgagatgctaaaacacggactgatcagcaacacctctcactgggctgaactgcttgcattcgatacggagaagatggattacggatatctgaaaaaattggtaggccactccgtacaagtgaaagaagatatagtggaacaagatccattcgaacacggcatccgcaaagcattaaacctgggacataccgtaggacacgctttcgaaagtctggcgcttgctgagaatcgtccggttcttcacggatatgccgtagcttggggcattgtttgtgaactctatctatcacatctcaaagccggcttcccaaaggagaaaatgcgtcagaccatccaatttataaaagataattatggagctttccacttcgactgtaagcaatacgaccgtttatacgaattcatgcaacatgataagaaaaacagtgcaggtgtcataaatttcacactcctaaaggaaatcggcgatatcagtatcaaccggacagcagataaagataccattttcgaaatgttcgacttctatcgggaatgtatgggaatgtag

SEQ ID NO: 1893 - DNA, 885 bp, B.fragilis
acctacatttgttgcctaaaacagacttttatgaaaacagaccgattgcttgccgatacaaaaacgatccgatatgaagagaccgacctggcctctttgatatcggccccataccatttccggtgtggtatctatctgatttgtacgcagggagaagccgttgtctctaccggtgtgcagaaatatatattcaatgaacagacagaattgatcttcctgaccggcggtttgctgcaagtgctcgaaacttccggagatttgcaggtgaaaatgttgatgttccctaaagaagcatttttaaatgccatgttacctatcgatacaccttactttaattatactcacgaacatccctgttaccatcatactgctgacgaacggagtcagaagacctggcggcagatcaatttgtggatggatatggcacaaatgttgtttaccgaaccgatgcctcagttcaggggacaacaagagcacaactttttgcaaagtctgcttatgtggctgtttaatacgattccggaaaaattggctgtcagtaagcaatatagtcgtacgcaattactttgccatcggtttatgcaattgatccgtgaatatagtatgcatgaacatcaggtagctttttatgccgaaaaactttgtatatcgtctcgttacctgcataaaattacagttcggcatttagatggaaagaagcctaaacagcttattgatgaacagttggtggctgaaataaaagtgctgttgaatgaacctcgtttatctgtaacagaaatagctgagcaactgcattttccggaccaatcctatttgacgcatttctttaaaaagaatacgggtatctctccaaaagagtttcgggcgatcaagaatctcggatga

SEQ ID NO: 1894 - DNA, 600 bp, B.fragilis
tcaataacttgtagcccgcacccccaaaaccagcagctaaaaaagatggacgacacatttgatataacctacaaagccctgttccggaggtactatccgaacctgatgttctacgccacccgcctggtgggcgatgaagaagcagaagatgtggtacaggatgtattcgtggaactgtggaaacgaagagattccatggtaataggcgaccagatccaagccttcctctatcgggcggtatatacccgggccttgaatgtgctgaaacatcgcagcatagaggacggatattgcgctgctgtgaaagaaatcaaccaaaaacgagcggaattctatcagccggacaacaacgaagtaatccggcggatagaagaccgcgaattgcgaaacgaaatctaccaagccattaacgagctaccggacaaatgcaaggaagtgtttaagttgagctatctgcacgaaatgaagaataaagaaatagctgacgtgatgggagtctctttacgtacggtagaagcccacatgtacaaggcactgaagttcctacgaaaccgtctcggccatttatggtttttatttctactattttttatcaaatag

SEQ ID NO: 1895 - DNA, 1437 bp, B.fragilis
cttttttctcgtacaaaaatgataaataactatttagagcggcaaattaaggaaaatttttcttatcagccaacttttgagcaagaaatagctgtaaaatctctttcggagtttctactttctacggctaatgatacggtttttgtgcttcgtggatatgcgggaacaggaaagacttctcttgtcggggccttagtgaaagcgatggataagttacaacagaaatcggttttactggctcctacgggaagagcggctaaagtattttctgcttacgcaggacacccggcttttaccattcataaaaagatatacaggcagcagtctttttcgaatgaagtaagtaatttttcaattaatgataatctgactactcatacattatatattgtagatgaggcttccatgatttcgaatgaaggtttgtccggttcgatgttcggtaccggacgtctgttggatgatttggtggagtttgtctattccggtgtagggtgtcgtttattgttgatgggagatacggctcagttgcctccggtaggagaagagcaaagtccggcacttgctaccgaggcattgaaaggatatggactgaatgtcatagaggttgatctcacacaggtggtacgtcaggttcagtcgtccggtattttatggaatgccactcagattcggcagttgattgctgaagacgagtgtttttcgctgcctaagataaaagtaagcggatttccggatatacaggtggtacgtggcgacgagttgatcgataccctgaccggctgctacgaaaaagacggaatggacgagacgattgtggtatgccgttccaataaacgggctaatatatataataaaggtatacgtgctcagattctttacagggaagatgaactgaatacgggtgacttactcatggtagcgaagaataattacttctggacagagaagtataaagaaatggattttatagcgaacggagagattgctgtggttcgtcgggtgaggcgtactcgtgaactgtatggtttcaggtttgctgaagtacttcttgcgtttcccgatcaaaatgactttgagttggaagctaatttgttgcttgatacgcttcattcggatgcacctgctttacccaaaacagaaaacgaccggcttttttattctgtacttgaagactatgtggacatcaccgtcaagcgggagcgaatgaaaaaaatgaaagctgacccacactacaatgctctacaggtgaaatacgcttatgcggtgacctgtcataaggcgcagggcgggcaatggcaaaatgtttttcttgaccaggggtatatgtcggatgagtatctgacacctgattatttccgttggctgtatacagcttttacgcgtgcatcgaaaactctctatctggtgaattatccggaagagcaaatagagtga

SEQ ID NO: 1896 - DNA, 198 bp, B.fragilis
ttcggttatcgaaaccaactgccccggcagaataaccgccagttcattcttagcaagaatatgaatattatcaaagatacagatcttggcagtacctctcaaacacaaaatgatcatcccaacttcggtgtaggacggaacagacgtcacacgaatgtgcttcatgttctcacaaaccataagttcatcccccaataa

SEQ ID NO: 1897 - DNA, 2301 bp, B.fragilis
tatccatatagcaatacacttatccacaccatgagaaaaattcttttgaccgcttgccttatagcttgctcactaatggctgaggccaaagactggacccaatacgtaaacccactgatgggaacgcagtcttctttcgaattatcaaccgggaacacctatcccgctattgcacgtccgtggggaatgaacttctggacaccgcaaacgggcaagatgggggacggatggcaatacacgtatacagccaacaaaatcaggggattcaagcaaacccaccaacccagcccatggatcaatgattacggacaattctccatcatgcccgtcacaggcaaacttgagtttgatgaagaaaaacgtgccagttggttcagtcataaaggtgaaatagcaactccttcctactataaagtatatttggccgagcacgatgtagtgaccgaaatgactccgacagaacgtgcggttctgttccgtttcacctttcccgaaaacgaacactcgtacattgtagtagacgcattcgacaagggttcctacgtaaaagtaattccggaagagaacaagataatcggctacaccacccgtaacagtggtggagtgcccgagaatttcaagaactacttcgttatcgagttcgacaaacctttcacttacaaaggcacttttgcagacaaaaagctggaagaaggcaacttggagcagaaagccgaccatacgggagccatcattggtttcagtacccgtaaaggtgaaatcgtgcatgcccgtatagcttcttcgttcattaattttgaacaagcggctcagaaccttaaagaattgggtaacgactcttttgagcaacttgcacaaaaagggaatgatgcctggaacaatgtattaggtaaaatacaaggggaaggcggcaatctggaccagtaccgtacattctactcctgcctctaccgttctctgctatttccccgcaaattctatgagtttacggcagacgggcaaccgattcattatagtccttacaacggtcaggtactccccggatatatgtacaccgatacaggattttgggatacattccgttgtttgtttccattcctgaacctgatgtacccatcggtaaacaaagaaatacaagaaggacttatcaatacttataaggaaagtggtttctttccggaatgggcgagtcccggacacagaggttgtatgataggcaataactctgcttcagtattggtagacgcctatatgaaaggagtaaaggtagacgatgtgaaaactctgtatgaagggctgattcacggtacagagaatgtacatccggaagtctcttctaccggacgcttggggtatcagtattacaataagctgggctacgtaccctatgacgtgaaaatcaatgaaaatacagcccgcacattagaatacgcttacgatgactggtgcatctaccaactggctaaagccctgaaccgaccgaaaaaagaaattgaactatttgccaaacgtgccatgaactaccggaatgtattcgacaaagaaagcaaactgatgcgtggccgtaatgaaaacggccagttccagtcaccattctctccgttgaagtggggagatgcattcacagaaggtaacagctggcattactcctggtcggtatttcacgacccgcaaggattaatcgatctgatgggaggcaaaaagatgtttatcacgatgctggactccgtatttgcagttcctcctgtattcgacgacagttattatggacaggtgatccatgaaatccgcgaaatgaccgtgatgaacatgggtaactatgcacacggcaaccaaccgatacagcacatgatttacttgtacaattatgccggacagccctggaaagcgcaatactggcttcgtcaagtaatggaccgcatgtatactccgggtcctgacggttactgtggcgacgaggacaacggacagacctctgcctggtatgtattctcagccctcggattctatccggtatgtccgggaacagatgagtatgtcattggagcccctctattcaaaaaggcaacgctacactttgaaaatggcaataatcttgtgatcgatgcacagaataacagtaaggagaatctttatatcgaatccctccgggtcaacgggcaagaatcaacccgaaactatctgaaacatgccgatctgctgcaaggcggaaccattgaattcaaaatgggttcacaccccaacctcaacagaggcatcaacgatgatgatgccccctattcattctccaagatgaaatag

SEQ ID NO: 1898 - DNA, 1293 bp, B.fragilis
  unsure (210): Identity of nucleotide sequences at the above locations are unknown.
aggcaaaaaagaatagatttcctatttttgcaaccgaatataactatagaaataaagaccatgcgttatctactctcagcgccttcgcagataaaggccactatccagcttccggcgtccaaaagtatcagcaatcgtgcccttatcatccatgctctgtcaaaaggagacgatgtgccttcgaacttgtccgactgcgatgatacgcangtgatgataaaagctctgaccgaaggcaatgaagtgattgatattcttgcggccggaacggccatgcgctttctgacggcttatctgagcagtactccgggtatccataccatcaccggaacggaacggatgcagcaacgacccatacagatattagtaaacgccttgcgcgaactgggagcccatatagaatatgttcggaatgagggttttccacccttacggattgagggtagagagctcacgggcagcgaaatcaccctaaagggcaatgtgagttcacaatacatatcagccctgttgatgatcggtccggtactgaaaaacggtttgcaactccggttgaccggagaaatcgtttcacgaccttacatcaacctgactttgcaattgatgaaagatttcggcgcctcggcttcgtggacatccgaccagaatatccaggttgatccacaaccttaccactgccttccgtttaccgtcgaaagcgactggagtgcagcttcttactggtatcagatagctgccctgtctccccaagcagatatagaactgaccggactgttccgccacagttatcagggcgacagccgcggagcagaagtatttgcccgcctgggagtggcaaccgaatatacggaaacaggtatacgactgaagaagaatggcacatgtgtcgaacggctggatgaagattttgttgatattcccgacctggcacagacctttgttgtgacttgtgcactgctcaatgtgcctttccgcttcaccgggctgcaaagcctcaaaataaaagagacagaccggatcgaagcccttaaaacagagatgaaaaagctcgggtatatattgcatgacaaaaacgacagtatcctttcttgggacggtgaacgcgtggaacaacagacatgtcccgttatcaagacttacgaggatcatcgcatggctatggcttttgctccggcagcaattcattatccgacaatacaaatagacgaacctcaagtagtctccaaatcataccccggatattgggacgatttgcgcaaagccggtttcggcatcaaggtcggagaggaataa

SEQ ID NO: 1899 - DNA, 2631 bp, B.fragilis
atatatagaagtatgttgactgcaaaagaaaccagagattcgtttaagaatttcttcgagtcaaaaggacatcagatcgttccttcggctccaatggtgattaaagatgaccccaccctgatgtttaccaatgcagggatgaaccagtttaaagatattattttgggtaaccacccggcgaaataccacagagtcgcggactcacaaaagtgccttcgtgtaagcggcaagcacaatgaccttgaagaagtaggacacgatacctaccatcacaccatgttcgaaatgctgggtaactggtcgttcggtgattacttcaagaaagaagccatcagttgggcatgggaatatctggtagacgtcctgaaactgaatccggaacacctgtatgcaacagtattcgaaggtagcccggaagagggcctggagcgtgataacgaggccgcctcttactgggagcaatacttgcctaaagaccatatcatcaacggaaacaaacatgataacttttgggaaatgggtgatacaggcccttgcggtccgtgttcggagatccacatcgacctccgtcctgcagaagagcgtgccaagatttcaggacgcgacttggtgaaccacgatcatccccaggttatcgaaatctggaatcttgtattcatgcaatacaaccgcaaagccgacagcactcttgagccgcttccggcgaaagtgatcgataccggtatgggattcgaacgcctgtgcatggctttgcagggtaaaacatccaattacgacacggacgtattccagccgttgattaaagcaatcgcccaaatggccggaacggaatatggcaaaaatgaacagaacgacattgccatgcgtgttattgccgaccacatccgtaccattgcgttctcaattactgacggacaattgccttcgaatgccaaggccggttacgtgattcgtcgtatcctgcgtcgtgccgttcgttacggatatacattccttggacagaaacaggcatttatgtacaaattgcttccggttctgattgacagcatgggagatgcctatccggaactgattgctcaaaaagagttgatcgaaaaggttatcaaagaagaagaagaatcattcctccgtactttggaaaccggtatccgcctgcttgataaaacaatggctgacaccaaagctaacggaaagactgaaatcagcggtaaagacgctttcacattatatgatacattcggtttcccactcgacctgacagagttgattctgcgtgaaaatggtatgacagtcaatgtcgaagagttcgatgccgaaatgcaacagcagaaacaacgtgcccgcaatgcagctgccatagagacaggtgactggatcatactgaaagaaggaactactgagtttgtaggttacgattacacggaatacgaaacttccatcctgcgttatcgccaggtgaaacagaaaaaccagactctgtatcagatcgtactggactacactccgttctatgcagagagcggtggccaggtaggcgacaccggtgtattggtaaacgaattcgagactatcgaagtaatcgacaccaagaaagaaaataatcttccgatacatattacgaagaacctgcccgaacatccggaagctccgatgatggcatgtgtagacacagacaaacgtgccgcttgtgcagccaatcactcggctacccacttgctggacgaagcgctccgtgaagttttaggcgaacatgtagagcagaaaggatcattggttacaccggactctctgcgttttgacttctctcacttccagaaagtgacagacgaagaactccgcaaagtagagcatctggtaaacgccaagatacgtgccaatgttccattacaggaacaccgcaacatccctatcgaagaagcgaaagaactgggcgcaatcgccctgttcggcgagaaatatggtgaccacgtacgtgttatccagtttggctcatccattgaattctgtggaggtacccacgttgccgctaccggaaatatcggtatggtaaaaattatctctgagagttcggtagctgccggtgtacgccgtatcgaagcatataccggagctcgcgtagaagaaatgctggatacgatccaggatactttgagcgacttgaaagctcttttcaacaatgctcccgaccttggtgtggccattcgcaagtatatcgacgaaaacgcaggactgaaaaaacaggtggaagacttcatgaaagaaaaagaagctgccgtcaaagaacgcctgctgaagaatgtacaagagattaacggcattaaagtcattaagttctgcttgccgatgcccgccgaagtagtgaagaacatcgctttccaacttcgtggtgaaattacagaaaatctcttctttgtagccggaacagtagatgccaataaaccaatgctgactgttatgatcagtgacaacctggttgccggcggactgaaagcaggtaatctggtgaaagaagctgccaaactgattcagggtggcggtggcggtcaacctcacttcgcaacagccggtggcaagaatccggacggactgaacgctgctgttgagaaggtactggaactggcaggaatctaa

SEQ ID NO: 1900 - DNA, 441 bp, B.fragilis
gaaaaagctatctttgtgacattaaatttagataaaatgaaagcattattacctgtattctgccgtcctttaggatatgtgattcttgttatttctatgtttattccattcctgttattgatgcagggaatggtaacggacagtaacttattattttataaagagtgtattaaactgctgatgatattgggagcaatgatgattatttttgctttatcacgtaatgaaggtcgtgaaacagagattatacggaacaaagctactcgtaatgctatttttctgactgtgctttttttgtttggcgggatgctttatcgggtagcaacaggagatatcatgaccgtagatacctcttcttttcttatttttcttattatcaatgtactctgccttgaatttggtatgcaaaaagcgcgaatcgataaaatctttaaaagataa

SEQ ID NO: 1901 - DNA, 1971 bp, B.fragilis
cgacacgatatgaaatttgttaaccgattctttatgattcttgtggcactatgcctggtttgccccggcgttagtgcagttgttaatcccaaaccttttgtgattcccgaactgaaagagtggaaaggtgccgaaggggcatttgtaccgactgaaacaacaaaaatagtctgtcctgccaatcagccggaactattgcgcattgcccgtatgctggccgatgactgtgaaacgatgttcggtcacaaaccggaggtagtacaaggtaaaggcggagccggtgatgttattcttgccattcgtgcagataagaagttgggcaaagaaggctatacggtgaaagttaccgatcgtatcttgctgactgctcccgaaagcataggggtatattggggaacccgtactctgcttcagattgcggaacagagtgaaaatcatcagttcccgaaaggtactttacgtgactttccggactacgctatgcgtggctttatgatagattgcggtcgaaagtttattcctctttctttccttcaggattatgtgaagattatggcttattacaagatgaatactttgcagattcacttgaatgataatggctttaaacagttcttcgggcacgattggtcgaaaacttatgcagccttccgtttggagtcggatacttatccgggtttggctgccgaagacggctattacaccaagcgtgaatttatcgatttacaaaagttggctgagaacctttacgtagaaatcattcccgagattgatgctccggcgcatactcttgcctttacacattataaaccggagatcggcagtaaagagtacggcatggaccatctcgatctgtttaatcctgaaacgtataagtttatggatggactatttaaggagtatctggaaggggacgaacctgtattccgtggaaagaaagtgcatatcggtactgacgaatactcaaataagaaaaaagatgtagtagagaagttccgtgctttcaccgaccattatatccgctatgtagagagctttggcaaacaggcttgtgtatggggagcactgacgcatgccaaaggtgatacaccggtgaaatcggagaatgtgatcatgagtgcatggtacaatggctatgccaacccgaaagacatgatagagcaaggctataaattgattagtattcctgacgggctggtatacattgttccggctgccggatactattatgattatctgaacacgaagtatttgtacgaaaattggactcctgtacagattggaaaggctgttttcccggagaaagatccgtctatcctcggtggtatgtttgccgtatggaacgatcatgtaggcaatggcatctcgacaaaagatattcatcaccgcgtttatccggctttgcagactttggctgtgaagatgtggaccggaaaagatgtatccgttccgtatgctgactttgataaacaacgcaatgccatcagtgaggctccgggtgttaatcaactcggccgtatcggtactacaccgggattggtgtatgaacaggcttccgttgctcccaatagcgagactcctcaccgtgaaatcggttacgattatctggtaacatttgatattgacggagccaatgaagcaaagggtacggaactgttccgttcgccggatgccgtattttatctttccgatccgatccgtggcatgttgggttttgcccgtgacggttatttgaatacatttagtcaccgtatccacaaaggcgagaaagcaaccatcggtattagtggtgacaataagtcgacccgtctacttatcaatggacaggtagtagaggaaatgaatactcaaaaactttactataatgccgggaaagattctatgaattatgttcgcactttagtcttcccgctagagaaagccggaaagtttgatagtaagattacaaatctgaaggtttataagaaataa

SEQ ID NO: 1902 - DNA, 591 bp, B.fragilis
agatatagtatgaaaatcaaaatatacaaatcgcttgccatgtgcactctcctgttaggactggctgcatgtaatgatttcgaagaaatgaataccgatccctacgcaccggtatacgatccggaaataatcggtgccacacctgacggaatcgatatcgactacgaactgacacccagtgcactgaaaagccttcaaggcacggaaagcgccatcggttcggtgttcgccaacctgacttacgaaggactctataatgattatcaggttacgaccaacctgactcatgacatctacgctgcttactttgccaacaacgttagcggattcgtgaccaactcgcctacctacggttataacgacggatggtccaaaagacgctgggagcacttctacgataaccgcactgtagaagaatacagtcagttgatcaaaacattctggttctgcggaaaagagcgctatcacaatgcgttctatatgacccgtatctactacgcattcctgatctctatgcaaacagacacttatggagcccattccattggaatactacgtaaaaatgtgcaatgcccacagacgagaaagtga

SEQ ID NO: 1903 - DNA, 1500 bp, B.fragilis
gcgaacttaatttattctgatatacaaaactgtaaaatagacgaacacatgaatctaagaaatttctttttagcggcgggaatcgctgctgtagcggtacctgtatgggggcaaaaggcccccgaaccctacgggctgactcccagtgcgagacaggtagagtggtataaccgggagatgatcgctttctttcacttcgggatcaatacctttgaggagtatgtaaacgaaggggacggacgtgctccggcagctatattcaatcctacggccctcgattgcggacagtggatgcgtacccttcagtcggccggtatccccagtgccatcattacagccaaacatgccgatgggttttgcctttggcccagtaaatatacggattatggagtgaagaactctgcctggaagaatggaaagggagacgttgtgcgcgagtttgtggatgcttgcgaggagtatggcattaaggcgggcatctatctgggtccgcacgaccggcacgagcatctttctcccctttatactacggagaagtacaagcagtattatggtcaccagttggaagaattgatgggtgactatggaaaagtctgggaaacttggtgggacggtgccggagcagacgaactgactactcccgtctatactcattggtataagattgtgcgagagaagcaaccggactgtgtcattttcgggaccaagaactcgtatccttttgccgatgtgcgttggatgggaaatgagtccggcaaagccggtgatccttgttggtcgactaccgactctgtatgcgtcagagatgaatggaagaactatgaagggctgaacgaaggagtaaaaggcggtgatgcatatatccctgccgaaaccgatgtatcgatccgtcccagttggttttatcatgctgaggaagacagccgcgtgaaaagcgtaaaggaactttgggatatttattgcacttctgtcggtcacaacagcgtgttgctgctcaacttcccacctgatcgtcgcggactgattcatcctaccgattcacttcatgctgccttgctgaagcagggattggatgaaaccttcggaaacaatctgttggctaaggccaaggtgaaagcaacgaacggacgcggaggtaaattccgtccggagttcctgacggacaacaataaggaaacttattttgccggccgagacggagccaaaacctcggacatcgttttcactctttcccggcagacagagttcgactgcctgatgattcaggaagtgatcgaattgggacaccgcacgacgaagtggagtgtggaatactctaatgatggccgtaactggaccccgataccggaagcaaccgataagcagacggtggggtataaatggatcgtacgtttcgcaccggtaaaagccaaacaggtacgtcttcgtatcctcgacggatttgcctgtcctgctatccatacattcggagtgtacaaacaatcggctttatttcagtaa

SEQ ID NO: 1904 - DNA, 1209 bp, B.fragilis
tcaaagagaatagcaatgactgacagacagaattccagacggttcttattattatttttaggtgtattaagtgctttcggcccttttataatggacatgtatttgcctaccttaccggctatggcagattttttccacacttcatcttctatggtacaattgggactcaccaccagcatgattggcttggctgccggacaattaattttcggtcccttgagtgacaagtacgggcgacgtcctccattacttctggccatgattctgttcctgctcgctacggtggggtgcatcttttcacataccatttcacaatttgtgacatcccgattcttacaaggcattgccggagcaggtggtgtagtgatttcccgctccatagctaccgacgagtattcgggacagcaactggccggcatgcttgccgttatcggcggaataaatggaatagctacagtcatcgcccctatcggaggaggtatactggctcagataacaagctggcaaggcatctttatctgcttattctttatgggagtggttctcctatccggaagcttacatttgaacgaatcacttccggcaaaacacagacagactgtgagttggcaagacttataccatagtttcggagaagtcctccacaaccgccgctatgtaggctacgtcctgcaatatggtttcactatgggaatactgtttgtcaatatctcttctgcaccattcatcatgcaacaacactacggactctctcctctatccttcagcctctgtttcggaatcaatgcgatagcaatggttatcttttcagccatatcgataaaattacctaccatggaacgggctttatatataggaagccggggcatgctgtcagtatctgcactattgatggtattcttgtccttgggatgtgatttttggatctacgagttattgatcttcgctctactctcgatgattggcatgacttttacagcatccaacaccttggccatggagtgtgagcgacggaatgcaggcattgcttcggcacttttgggagccaccgggtttgcattcggaggtattgtatcgccattggtaagtttaggagatatgatgacctctaccggaatattgtttttagcaggttctgcctgtgcctatgcatgcacccgatatgtactgtcaccatccgttcaaccctccggagtgctatatcattga

SEQ ID NO: 1905 - DNA, 846 bp, B.fragilis
gttctatcgatactcctaacaacggcgcaggtaactgggaataatccgaatatgcccgatagagcaattgcagaaacgattgactttggtaaatcggaacaatatacattgtccatccgtcttagtacggatggattttctttttctatctacaatccgattcacgatagttcgctctctttctttgagaaggaggtcgaggcttcattatctcttacagccaatctcaaacaggctttccgtgaattggactttctgaatcatacttacaaacgggtaaacattctgatggcagacaagcgtttcaccctaatcccccttgaactgtttgaggatgatcagtccgaaatgatattctaccataaccacactcccaaagaaaatgaaacggtaaaatataatattttaaaaaagaataatgccgtagtcatcttcggcatggataaaagtacttgccaattcttatcagatcagtatcccgaagcaagattttattcacaagcagctccattagcagaatatttttcggcgaaaagcagattaggcaacagtaaaaagatatatgcttctattcgccgtgatgccatcgactttttctgttatgagcgtgggcatctgcttcttgccaattcatttgaatgtcgcaaaacaggtgaccgaatctactatctgctctatctatggaaacagttgaattttgatcaggaacgggacgaacttcacctgacaggtgcatttaatgataaagagaaactaatgcaggagttacgtaaatacatacagcaggtattcataatgaaccctgcaagcaatattgacatgcaagccttattaacatgcgagtaa

SEQ ID NO: 1906 - DNA, 1158 bp, B.fragilis
aatacatggatcagaaagatgtatacgacgttatcttttaaaatgcttcgatcaggcccatcactgcactggcacaacactccttctactgcgcaatacagcctgggtgaaaacgacaagtgctttggaggcgacaaagacaaatggcttcgttttgccaatacccttcgtttacgattggcactacgtgtatcgaatgtagatccccaacttgctaaagaacagggtgagaaagccatggccgaccctgccggattgatgcaaagcgatgatgataatatgaagcagactcccaaatactcgtacatcacgggtggtaacgaaaacatctacacacttctgtacaactggagtgctaacgtagtgttatccaaagaaatggaacgagcttataaagaacaatcgaccattctcgacccacgttgcgaaatattgtggtggagaccgaccgctcttgaggacctgaaccaaaccgaacccaaagaagacatgacaaaagacttcaatggttgcgaaaacggtgagacttcattgggaggaagctacacaacgacttattctccgagccgtgtattcatcaagcaagatcagaaaaaactcgaccgcaaacattggtggtgttatgcacgcgaaatagtatggctgggttactccgaaagcctgttcctccgagcagaagccgctctccgaggatgggccggtgctaaaggtaccgctgaagatctctataaggaaggcattgaagcttccttcaactactatcagattggtgctgacgaggaaggacaagaaaagatcagcaaatacatggaaggattgaaaggcttacaagccttcaagagtggtgacagagaagcacagttggaacaaatcatcacccagaaatggattgccgtatatcccaacggtaacgaaggatgggcagagttccgccgtacagactatccccgctatatgaaaacacctaaaggaggcaataactcaggaggtgaagttgcaaacgggaagttcatcaaacgcctgagatacccggacagtgaagtatctaacccgaaccgtccgaaagatgtagatacacagggaactcgtttatggtgggacgtagccgacaccaatgatgatggaggcaattacgttaccccaaacaacttccgctaa

SEQ ID NO: 1907 - DNA, 912 bp, B.fragilis
ttattttacttttgtatcaacaaagaaaggattctgatgccaaacagggatagtgagaaattgataacggatggttatactacgactttattgggggatgaacttatggtttgtgagaacatgaagcacattcgtgtgacgtctgttccgtcctacaccgaagttgggatgatcattttgtgtttgagaggtactgccaagatctgtatctttgataatattcatattcttgctaagaatgaactggcggttattctgccggggcagttggtttcgataaccgaactaagtcctgattttctttgtaatatagttgtgctgtcgcgtgcgctttttgatgatacgttgagtgggttcagtcgtttttctcctcttttctttgtttacatgagaagccattattggtatgaattgacaggagaagagattgagcggttcaaacttttttatggatcactctcacagcgggcaaaagaccctacccattttttcaggagggagtctgtattgttgttactgagaatcttttatctggatatctataacgaatattacagcaagtctcatttgatgaaagggggatcggatatgggtaagagtaagctggcgcatgattttttctgtttaattatgcagcattaccgggaacacaaggatgtcgctttctatgccgataagttatgcatcacttccaagtatctgtcaatggtgataaaagaggcgagcggaaagacagcaaaagattggattgtagagtatgccatattggagatcaaagccatgttgaagaactctaccatgaatatacaggagatatctattaaaacgaactttgcgaaccagtcgtcgctggggcgtttttttagaaagcacacaggaatgacgcttacagaatatcgtatgcatcgataa

SEQ ID NO: 1908 - DNA, 2970 bp, B.fragilis
accttttgctttgaaggttgtcaaacaaacgattgttattattcaacctacaggcaaatgaagaaactattgatctggacggtgttgctgctgacagctaccctatccacttatgcgcaaaacaaaattgtaaccgtatcgggccgtgtaatagaggccggtacgaaggaaccggtcgaactcgctgctgtgcagttattatctctccctgacagtgctcaggtagcgggtatgaccacttcgacacaaggctacttttctttatccaagcagaaaccgggaaaatatctgcttaaagtatctttcatcgggtatgtcaccaaaattattcctgtgcagctaacagctaatgttcctgcaaaaaagatggggaatattgaactggcaactgatgctgtcatgctgcaagaagcggttgtggtagcagaagctccgcaagtgacggttgtagaagatacgttaatgtacaattccagtgcttaccgtacacctgagggggctatgctggaagaattggtcaagaaacttccgggcgctgaaattgatgatgacggtaatgtgaaaatcaatggtaaggatctgaagaaaattatggttgatggtaaggagtttttcggtggagacgtgaaaaccggtttgaagaatcttccggtagatatggtcgataaactgaaaacttatgataaaaagtcggatctggcacgtgtgacggggattgatgacggtgaagaagaaacggtactcgacttgactgtgaaaaaagggatgaatcagggatggtttggtaatgcagatttgggagccggtactaaagatcgctataccggacgaatgatgctgaaccgctttgtcgataaaacccagttctctattataggctcggcgaataatgtaaatgatcagggattctccggaggaggtggcggtccgcgctggcgtagtaacaatggcttgaatgctactaaaatgttgggtgccaactttgcgacccagaccaacaagctagaactgggaggtagtgtacgatataacttccaggatgctgatatctcaagtatcaattcttccgaacgtttccttcagaatggcaattcatattctaattcgaataataagaaccggaataaaggaacaaacctgaatgctgacttccgtatggaatggaaaccggatactttgacaaatattatctttcgccctaatttctcctatgggaggacaaataatgcttctcgctctgaatcgggcactttcaatgaagatcctttcaatctgatcgtaaatccaaatgattatctgaattttgataatttgtctgacgatccgttgaaagacattcgtgtgaatgccaccaatagtgcttcgttgtctaaaggcaaaagtctttcgggaaacgccactttacaggttaaccgaaaattgaataatagaggacgtaacctgactttccgtggagtctttggatatggtgataatgatagcgatcagtatacacagtctgaaacacgttattaccaattgctgaatcatttgggaggtgactctatcctatatcgtaatcaatatattacaactcctacacgcaactataactatacggcccaagtgacttatagcgaacccattgccaaggccactttcttgcagttcagttatcagtttcagtataaatatagcaagagtgacaagaccacgttcgatttgctcgattatccggactgggctatcggcggagctctcccttccgggtatgagtctcatgcagtggacagcttgagcaagaatgctgaatatcgttattataaccatgacgcttcagtggggttgcgtttcattcgtccgaagtatcagttgaatgtgggtatgtctttccaaccacagaattctaccttgtcttataaaaaaggagactatatgattgatacaacacgtactgtattcaatttcgcaccgaatatggacttgcgtttccgtttctcaaaagttagtcagttgcgtttcacctatcggggacgtagcaatcagcctactatggagaacttattgcctataaccgataactccaatccgttgaatatacgtatgggtaatcccggattgaagccttcttttgcacatacgatgcgtttgttctataacacatataatgcagagaaacagcgtggaatcatgactcactttagctttacagctacacagaacagcatcagtaacagtactcgctataatgaagaaaccggtggattgattacacgaccggagaatatcaatggtaattggaatgcgtttggtatgttcggtttcaatacagctttaaagaataagaagtatacgattaatactttcactaatgtgaactaccagaataatgtggcgttcctttataatcaggatacgaaaaacaatgatagaaatacaagtacaggcctgacattaggtgagagagtaacaggttcctatcgcaatgattggtttgaattttctttgaacggttcgatcaattacacagccgaacgcaataaacttcgtccggagaacaatcaggaaccttatacatattcttatggagcaagtaccaatattacgatgccttggaaaatgactttggctacaaacatcgccaatcaaagtcgtcgcggctatcgtgactcaagcatgaaccgtgacgaacttatctggaatgcacaacttgcccagtcattgctgaaaggtgctgctactgttagttttgaggtttatgatattttgagacaacagagtaacatcagccgttcattgtcagccgatatgcgttcggtatccgaatataacggtattaatagttactgtatggtacactttatctaccgtctgaatatcttcggcagtaaagctgctcgagaaaagatgatgaatagtggtagaagaggttttggtggacccggtagaggtcccggcggtggctttggtggcggacatccccgcttttaa

SEQ ID NO: 1909 - DNA, 1269 bp, B.fragilis
cgactggtcgtctacactgccaaaaaagaacactctttcttctacctgtctgccaacttaagttttgtcgtttctgattttgtccgttcactggacaaaacactgcccaactggctgactttcgccaaggtacgtttgtctgccgcacaagtaggtaaagatacggacccgtatcagttatacaatacgtacggatttaaatttgaaaaaggtgagctgattccaagcaaatcgaacgtgaaaatgaacgaccagctgaaaccggaaatctcttcttcttacgaagcaggtttggatatgaagttcctcaacaaccgtttgggatttgactttacctattattatagccgcacgaagaaccagatcatgaaagtgcccgccgctgctccctggagtggaggtaaatgggtcaatgccggtctgatcaccaacaaaggtttcgaaatgatgatctactctacaccggtacaattgaaagacttctctttcgatctgaatgtcaatctggccaagaacgtatcgaacgtagaaaaactggctgacggtgtagactacatctacttcaatggcgactctaacttcccgatcaacgtaggtgcacgcccgggtcacaaattgggtgaaatctatgccaagactctctacaaacgtgacgaacagggcaacatcattataaataaagagaacggcttgcctatgacgaccacagatgctgacgaacgcctggctaaacctatcggcaacatccagcctaacttgctgatgtctgtatctccgtcgttcacctacaaaggctttacactgtcggccatgttcgatatgaaattcggtggcgatatcatctctatctccgaaatgaacgcaacaggctcgggtatggctaaacgtactatgaatcgtggagaaagcgataactttatgatgatcttcccgggtgtatacgaagacggaacacccaatactcagaagatctcagcatccaactattacggagcacagaacgcagaagactttatatacgatgcttctttcatcaagctgaaggaactggccatcggctatacattccccaaaagcatgctgaagaaaacgccgatcaactcgctgaatgtttcgttcgtagcacgtaacctggcttatctgttgaaacatactccgggaacaagtccggaaggtggttacgacacaaccatgttctctcaagccatcgactttatggctgtaccttatacccgtacattcggattctcagttaaccttggtttctaa

SEQ ID NO: 1910 - DNA, 240 bp, B.fragilis
gctgtgtgcttagctctcctttcttttatatttaaagttgagcccctggccggtatattccgatcaggggctcaattgctatttatctatttaaagagaattctgtcaggttcagatttgtacatgtctgaatataaatcgtctacatgggactattacatatggggcgtatccgattttatggaagtagccatactcaaatgttcatcctatgatccatttgctgcccggtatgaatga

SEQ ID NO: 1911 - DNA, 1512 bp, B.fragilis
atcgggacagttgttgttcgtatccgatattttccatacatttgttctttgtataatccgcggagggcgaatatgatagattggaactacatagcaagtgtaatagctaccgttgcctttgatattatttatttcggggctattatcggtacgattgtcatcgtgattctcgacaatcgtaatccggtgaagacaatggcatggattctgatcctgatgtttcttccggttgtagggttggttttctatttcttttttgggcgtagccaaaggcgtgagaagattatcggtaagaaaagttatgaccgtttgctcaaaaaaccgatggcagagtatttggcgcagaactgctgtgaaacgccgaaggaatatgaacggctgatacagctgttccagaatacgaaccaggcttttccgtttgagggaaatcgggtcgatatttacactggcggatattctaaactacaagctctgttgagagagttgcaaaaggcgaggcttcatattcatatggaatattacatctttgaggatgatcctgtgggacgattggtacgtgatgtactgatcgagaaagcgcgggagggagtcgaggtgcgtgtgatctatgacgatgtaggatgttggcatgttcctcatcgctttttcgaagagatgagagatgcaggaattgaggtacgcagttttttgaaggtccgttttcccttgtttacgagtaaagtgaattatcgcaatcaccggaagattgtggtgattgacggacgtattggatttatcggtggaatgaatcttgccgaacgttatatgcgtggcttttcgtggggaatctggagagatacgcatatattgcttgaaggaaaagcggtacatggtcttcagactgcttttttgctcgattggtatttcgtggatcgcactctgatcactgcttcgcgctactttcctaagatagaagcttatggcaattctttggtacagattgtgacaagtgaaccgatcggtccctggaaagagattatgcaagggttgacagtagccatatccggtgctaagaaatatttctatatgcagacgccttacttcttacctaccgaacaaattttgggtgcaatgcagactgctgcattggcgggagtagatatccggttaatgttgcctgagcatgcggataatcgtgttacacatttgggctcctgttcttatctggcagatgtattgcgtgcaggagtcaaggtctatttttataaaaagggtttcctgcattctaaattaatggtttcggatgatatgctttcgacagtggggtctaccaatctcgatttccgtagttttgaacataattttgaagtaaatgcctttatgtacgatatggagacagcattgcagatgcgggagattttcttgcaggatcagcgggaaagtactcagattttcctgaagagctgggaaaaacgttcttcgcgtcagaaggcaatggagtctgtagttcgattattggctccgttgctataa

SEQ ID NO: 1912 - DNA, 1029 bp, B.fragilis
ttgtttctattatataatgaaaaagaaaagatgaataatctgagcgaagacatattgatgagatatctgacaggcgaatgttctgacgaagattttgccagagtgaacgcttggatcaaagaatcagacgataatgcccgccgacttttccgaatggaagaggtatatcatttgggcagacacgacagctttccggatcagaaaaaagttgcccgggcagaagcacgactatacaagaaactggctcaggaagatgcacatagccgcaaagtgatcagaatgcaccaatggatgcgatatgccgctatcatcgtgctcgcactgatgataggcaccggaggcggatacctgtactatcaggccgatccgacccggaatatgataacggcctcgtccacggatggcaaagtgaaagaagtgatgttgcccgatggcacaaaagtatggctcaatcaatcggccaccctgagatatcccaaggaattctcagaatccgaaagagatgtatatctcgatggagaagcttatttcgaagtcactaaaaaccgtcggtgtcctttcgttgtagaaagtgaggctatgcgtatcaaagtgttgggaaccactttcaatttcaagtgcgacaagagtcacaaactggcagaagcaaccttgatcgaaggagaaatagaagtgagaggaaaccacgatgaaggaatgattattctttcgcccggacaaaaggccgaactgaataaaacaacccgcagactggtggtgaagcaagtagatgccaaattggatgccgtatggcacaatgacctgatcccgtttgaacaggcggacatttttgtcatcacccggacattggaacgcttttatgatgtgaaaatcattctttcacccgacattaagtccgacaaaacttactcgggtgtattgaagaaaaaagataatatagagtctgtactccaatcgttggacaactctatacctatcaattataagattgtgggagacaatatctttatttcttcacgtaacaagtga

SEQ ID NO: 1913 - DNA, 231 bp, B.fragilis
gtaagaagatttaagcaacggcagtacccacttttagaggccggcattggccggaaagctacccaagtgcgggggtgcttcaccgccaaacttgcaaattcctttcaatcgtttcacagaagcattcagagcttgtatttagctttgattaaattattatgtatcgatttgaacttctatatttgtattgcacaaacagacaaattatggaaaaccgtatctgcatactga

SEQ ID NO: 1914 - DNA, 1155 bp, B.fragilis
gttattcgatcagatcttcgcaccctatctgcaatgagtacggacgaagagcggatatacagcattgctctgacacaaataccgggtgtggggcatataggtgccaagcgcctggtagacggtatgggaagtgctaccgatgtatttcgctaccgtaccgagctgcccgaccgtttgcccggagtgaaccgggcggtagtcgcggcattagactccccgcaggccttgaaacgtgccgagcaagaatatgagtttgcccggaataaccgcatctcttgttttacactggcagatgaagattatccttcccgcttacgggagtgtgacgatgctcctgtcgtgctgttctttaaagggaaggccaatctcaatgccttacacattattaatatggtggggacccgtaatgcgacagactacgggaagcacatttgtgtcagcttcctgcaagagttgcagatgctgtgtccggatgtgcttgtagtcagtggattggcttatggaatcgatatcaatgcccaccgctcagcactgtctgtcgaacttcctactgtgggggtattggctcacgggctggatcgcatctatccgtcccttcaccgtaagacagctatcgacatgcttcggcaaggcggattgctgacagaatttctttccggaacgaatccggataaacacaacttcataagtcggaatcgcattgttgccggtataagtgatgctactattgtggtggagtctgccgctaaaggcggttcgctgattacagcggatattgccggaagctatcatcgcgattgttttgcttttcccgggcgggtcacggacgaatattcaaagggatgcaaccagttgatacaagataacaaagctgttttgctggagtctgcatcggactttgtgaaaacaatgggctgggacagcgatttgaaaagtgtcaagccggaaaccgtacagcgaaacctctttccggatctgtctgccgaggaactgagaattgtcgatattctcggaaagctgggcgatctgcaaataaacgcattgatggttcaggccgatattcccattaataagatcagtgctattctgtttgaacttgaaatgaaaggcgttattcgggttctggcaggaggagtttaccagttactcagataa

SEQ ID NO: 1915 - DNA, 933 bp, B.fragilis
ggctatttttttattccttcttttattgtctttctaaataattctcttacatttgtcgtaaacatacaaacaaacacacccgtatatatgcccagctccgtttgtggagatcccatgatgtgtcagaactgcaaaaagtcagttcctaatgccattttccatgtttaccatagacgtggtttccattatcctgcacaaaaatgtgaggagaatttcattttgttccttatcaagggagaaatgctggtgaatagccgggagtatgccggaacgatgcttaaggccggagaatttatgcttcagcccatcagttcgaaaatagaaatgctggccatgaccgatgtggaatgtatctattatcagtttaatcaacctgaattgttttgtgatatccggtataatcgtatcatgaaggagactgatcctccgttaattccctcacccttacctattattcccgaacttcaacattttcttgagtctgcacgtacttatctgagcgaaaagaagatttgtcgggatctcttatcattaaagcggaaagagcttgctttcatactcggttatttttattcggattatgacctggcttccctggtacatcctctctcaaaatatacctcttcgtttgagtgctttgtatatcagaactataagaaggtgaagactgttgaagagtttgctaaacttggaggatatagccagactacattcaggaggattttcgataatgtttttcatgagccggtgtatgagtggatgcttagccgccgcaaagaggagatcatttacgaacttcagaatacagaggctaccatctctgaaatctgttataaattcgggttcgaatctttaccgcatttctcaaacttctgtaaaaagtcatttggtacctcgccacgcagcattcgattgaagcgttcatccgaatga

SEQ ID NO: 1916 - DNA, 258 bp, B.fragilis
cttcataggccccaccaaggcaaaagtatctttggtgtggcttataacagcaaggagatgataatgaatgaaagatataacaaggttgctttgcatggttctcctctcgtttctggtggtgacgggatgcagccggcgggatattctggacgattatccggtgagtggtgtggaagtgcggctggattggagcggagtgacggagaagttgccggaaggagttcggattattttctatccgaaagacgaaaaaggtag

SEQ ID NO: 1917 - DNA, 969 bp, B.fragilis
aggatggctttagatttatttaaacgtgtagaaagccgtaagggcttgtttgctgttgagaagataacattgatatacaatctgttaacttctatcttgattttattcatgtttcaacgaatggatcatccgctccacatgttatgggacagggcggtgattgcggcaatgacttttttgctgatgtatctctatcggctggctccgtgtaagttttctgcttttgtacgtatcgccatccagatgagccttttatcctactggtatccggatactttcgagttcaaccgcgtcttccccaatctggatcatttgtttgctacggccgagcagtggatgttcggcggacagcctgccgtatggttctgtcatgcgtttccgcagatgtgggtgagcgagccgttcaacatgggctatttcgcttattatcctatgattctggttgtgacgttgttctatttcatctataggttcgacctgtttgagaagatgtcttttgtactggtcacctgctttttcatctactaccttatttatatattcgttccggttgccggccctcagttctatttccctgccatcggtatggattcggtttcgcagggcgtctttccttccattggcgattatttcaatcacaatcaggagttgcttcccggacccggttatcagcatggattcttttacagcctggtggagggctcacagcaagtaggagaacgtccgactgccgcttttcccagttcgcatgtgggcgtgtcgaccattctgatgattatggcatggcgtgccagcaagaaactgtttgcctgcctgatgccgttctatctgttgctttgtggagctactgtttacattcaggcacactatctgattgatgcgatcgcaggatttgtttctgctttcgtgttgtatgtattggtgacgaagatgttcaagaagtggttcgcagtgccgatgttcaagtga

SEQ ID NO: 1918 - DNA, 219 bp, B.fragilis
aatccatttacgtgggagaagtatccgactgatccgaagaatgagaaggggattcggatgaagctttgtccgttatcgggtaaaaagagcggtttctattctgtttttaaagcagtaattttttcacctctggctgcacgtgtacgaagggcacgtggagagtctccaaaggaagctttgcagaaatgtgcaaaatgtgataaagagtcgaatccgtaa

SEQ ID NO: 1919 - DNA, 1026 bp, B.fragilis
attattatgtatcgatttgaacttctatatttgtattgcacaaacagacaaattatggaaaaccgtatctgcatactgaccctttttgtttttctctttctgctttcgggagaaagccgggccatggtagcaatgccggatgcctggaccagaatgatgattggtgtaaaccagaaggattggtcgctgttacgtgaaagagtgcaggctgacctccacgttccggatcgtgaggatgtgctgatgttgatcgattatcaccgcgatgaccggatgaaatgtgagaatttattacgcaggttgaacggtggagaagcataccgctatattatgaataaaatcttaccgcttttatatgtatacagagaacattcacctgtacccataccggatgataaagctgccggtgtgtttttgagtacggtgaatgtattgccccgagtgaaattcgtacatcctcagccggtggtcccggaagagggaaaaatagaaacaccagtaataatagaacagagaacagtgcttgcactgaaaaacaacctgctatacgacctggcattggcaccgaatatagaggtggaaataccattgaacagacgctggtcggtcaatgccgagtataaatgtccgtggtggctcaatagtagccgggagttttgctatcaattgctttcgggaggcgttgaaggtcgttgctggttgggcaaccggaagcggaggaatcgcttggcaggacatttcattggagcttatgccgaagggggaatttatgatttccagtttaaaggagacggctatcaaggaagatattatgcagcttcagggctgacttatggatatgcaaagcagattgcacggcatctctcgtttgaattcagcctgggcataggttatctgactacggagtacaagaagtacactccttatgagggagacttggtttggaaaagtagtgcacgctataacttcataggccccaccaaggcaaaagtatctttggtgtggcttataacagcaaggagatga

SEQ ID NO: 1920 - DNA, 498 bp, B.fragilis
agattaaaccaaatgaagtcgaacaagaatgaatttctaaaactactgacggcctaccagggaattatccacaaagtaaaccggatatatttcaggtcggaagccgacagggaggacaattttcaggaaacagtctaccagctctggcggtctttcccggcgttgcagaataaagagaaacctgcttcgtggatttatacggtggcaatcaacacctccatctcgaaagtaagaaaggacagccgcatcgaatttcgtgactcgccgccggatggagagcctgttgacccctgggaacaacaggaacaggacgaaaactggcaaagacttgtcaatgccctgcaaaagctgaatgaaatagacaaatccatcatgctgctttatatggaagactatagttacgaagagatagccggaatagtggggataagcagttccgccgtcggcgtaaagattcacagactgaaaggtcagctacaaaaacaatttaaaaagtaa

SEQ ID NO: 1921 - DNA, 2502 bp, B.fragilis
ttaatgaaccacaaagtgttgtacagagtagctttattctgtcttttttctatgctgtcagccgttcttatgcatgccggcgaacagcaacaacaaagtaaaggtatagtgacaggtcgaatcgttgaccaacagaagcaaccttactatccggttgcagttgccattgaaggtgtttatattggcggatataccaacgagaatggagtttatcatatcaatgatgtgccgacgggcagtcagacgatagttgtatcgggcataggagtgaaaactaaaaaggtgccgatacatgtgactgccggaaaagtgaaccggattccggacatagagatcgatacccaggcggaagagctggaagaagtacaggtgattggaaaatctgaagctcgccggcagcaggagcaggcgtatgccatatcggtactcgacatcaagaaagcgtataatagcgctgcacctctcaacaaattattgaacaatgtgtcgagtgtccgtatccgtgaggaaggtggtatggggtctaactataatttcagcctgaacggattttcgggcaatcaggtgaaattctttttggacggaataccgatggataatttcggatcgtcttttaacctcgctaatatctcggctaacatggctgagcgtgtagaggtatataaaggggtattacctgtaaatctgggtgccgatgccttgggaggagcggtgaatatcgtcagccgtagagatgccaattatctggatgcgacctattcttttggctctttcaatactcataaagtctcggtgaatggagcctatacccatctgaaaacaggtttcacggtgcgtgccaatgctttctataactattccgacaatgattataaagtgtttgtgcccatcatcgatctggctaccaataagaagatagacgagcggtgggtaaggcgctttaatgatgcctaccggtcaggaggtatccgcctggagacgggaataaccaataagccttatgccgactatctgcttgcaggcattattctttcgaagaatgataaagatgtacagactggtgctacgatggatgccgtttacggtggcgtaaaaatgaagagtgaatctgtgatcccttctattcgttataagaaagacgatctgtttcttgacggactttcgctgtcactttacggaacgtataattctgtaaatactttcaatgtggataccatcgcccgccgttacaactggttgggagaatccgttccgtctacttctgcaggagaagggtattatacggattccaagataaagaaccgcgaatggttaggaaacggaaacatcagttacgtgatcgacggtcaccaatcattgatactgaaccatgtggtttctgctatgcggagaaccatgaatgataaagtacggccggatgatgaaaacaacaatgtacctcagcaactgactaagaatatcacaggcttgggatggcagatccgctatgatcgttggaatgccaatgtattcggaaagatgtataagttgtacagttctacctataagcggttggatgaatatacagagaatgcccgttgggaaaaagtgcgggatcataaaaccaatttcggatacggtgcggcggctacttattatatcttaccctctttgcaggctaagttctcttacgagcatgcctatcgtttgccggaaagtatcgaaatgtttggagacgggttgattcagcagcggaatccggatttaaaaccggaaagcagccggaatttgaatctggggttgagcttcattcaaactttcggagcccatcaactttcggctgatggaaacttcatttatcgttatacgacagactttatcctgaaaggggtcagcctgaccagtaatccgactaccggttacgagaatctgggtaaggtgttgacaaagggtgttgaggctgctgtcagatataactataaagatctgttccatacgggagccggttttacttaccaggacattaccgaccggcagcgatatgagaagacgaaggacagctttgtcggcgaaggtatcacagagaatattacctataaagagcgtttgccgaacatcccttatttgtttgctaatgccgatgcaggggttcgttttcacgatttgatttggagaaactctgtgctgacgtttgactataatcttaattatattcattcgtattatctttcgttcccgggcttgggtgcaaaaagctctaaaaaagtaatccccgaacagttctcacacgatctggcattggggtattcaatggacaacggaaagtatagtgtggttgtggagtgtaccaatctgaccaatcaaaagctgtatgataactaccgcttgcagaaacccgggcgtgcctttaatgtgaaactgagatatttctttagtaaagtaaaaaagtctgatgattacaatgtatcgaatttatatgtatctccttgctgcctgccttttattgggtgtcacggcatgtga

SEQ ID NO: 1922 - DNA, 1029 bp, B.fragilis
cttaaaaaacatactattatgaagaagattttattcgcagcagtcgctgcaatggcaattacgggttgctcacagaatgaagagattgaaaaggctgtacagccggtggaaattagtttcaatacggcagtgagtaagacaacaagagctacgactttagtgaactcagcttttacaaagtttacggcatatgcctattctactactgaggcatttgctaatgctacaaaagttaatgcgctgatatctggcgctgagtttactaaaggagaaaactccgcatggggcagtggtaactctgtattctattggccggcaacagatcaagtaagtttctttgctttttcacctaacactaaggaacagctttcttggggagcagctgttgctgaaacagcgcctacactgacctatactgtgaaagatgctgtgaaagatcaggaagatttggtggtagcagaagtgatgaataagcaaaaagctacgagcggttccacaggagcggttgctttaaattttaaacacgcgttgacgaaggttggttttaaaataaaaggagaaggaagtggtgttacttacactttaaataaaatagttattaatgccaagaaaaaaggtgtgtatacttatgctacttctactactgatgagacaacattaggtacatggactattcctagcgatgttacagctaatacagcatatactgtcgaacctactaatgcactttctattacaggagcagatagcgatgctactgtagatgcgactttggttggagcagattacacagccatgcttattcctcaagatttaactggcgttacattcgaaatttactacaaagctgaggctggtggtgcgatattgtgtgataaaacaactactccggaagaaattacatttgccgatggaacttggactgccggacaaagcgttgcttacgtattgacgttaaaaggcgttgagaagatgtctattaccggttcagttgctgatagctgggatttcactgagactcctaagtag

SEQ ID NO: 1923 - DNA, 1134 bp, B.fragilis
gagatgaataagacttttcggaaggcttgtgcgaaacttcatttatggcttggattgctttcgggtattgtggtattcatagtctgcatcaccggctgcatgtatgcatttaaagacgaaattaccgatgccacacaaccttggcgctttgtagctccattggagaaagagtttttgccgccttcccgcttacttgcgatagcggattctgtcatgggaggagcttcggccacagccatcacttacggtgaaagatcggatgcggcctgggtggactactatcagccggaagcagggatgagtactgtttttatcaatccgtatagcggacaggtattgaagtcggtagtgaatcataacggtgatttcgatttcttccggttggtgcttagcgggcatcgcactttatggctccccagggagatcgggagtccgattgttggttacagtgtattgattttcctcatcaccctgataacgggagtgatactttggtggcccagaagctggacacgcaaggcacttgtgcaacggttgactctgaaacgcccctttaccttttcaaggcttaacttcgacctgcataatgttgcgggtttttatgctgcattggtgctggccgtattatgttttaccggattgatatttagcctgaattggtttagcagaggcgtgtacagcatcacttcgggtggtgaagagttgaagccctacgttttaccggtatccgatacattgcaggttgtcaatcgtgtgacaaaccctttggacagactttatactcagctacggcttgaagaacctgctgccaagaccttttattttgctttacccggacaagccgatggtgtttaccgggtcagtgttgtacataaaagagggtcttactaccgtaccgataatttgttttttgaccggtatacactggtttctttgaaaggagccggtccttatgccggtaaatataccgaggcctctcccgccgataagttccgtcgtatgaatctggagattcatgacgggcgcatctgggggcttcctggtaaaattataatgttccttgcgagcctgacgggtgcttcacttcctgtgaccggctttatcatctggtatcgtaagcgctgtaagagataa

SEQ ID NO: 1924 - DNA, 291 bp, B.fragilis
cattctgtcaaaatgataatcgtatttgctcagatcggcttatttacggccaagagtatgggcacaaagaaaaatcgctttccctacgggttagcgattttctttttattatcccaatcgaaaaagaagcaacctaaccgaaagcagaaacaggaaaaacaagaacaaaatggaaggaagaaagagtatatgaaggtattttatctttccggaagccttcttcattcaagagcaacgggaggagcatatagccttatcctacttcagaaccgggataaagaaagaacatga

SEQ ID NO: 1925 - DNA, 429 bp, B.fragilis
aaaaatttaaagggcttgaataaaatggaaaagtatatctatgaacttactttaaaggtacgcgactatgagtgcgacctgcaaggcattgtgaataatgcgaattaccaacattatctggagcatacccgtcacgagtttctttcatcggtaggcgtaagctttgcaaaactgcatgaagagggagtcgatccggtggtagcccgcatcaatatggctttcaaaaccccgttgaagagtggcgatgaattcgtttccaaattgtatatgaagaaagaaggcatcaaatatgtattctatcaggatatctttcggaaaagcgatgataaagtagtcgttaagtcgaccgtagagaccgtatgtgtcgttaatggacgcttgagcaacagtgagttattcgatcagatcttcgcaccctatctgcaatga

SEQ ID NO: 1926 - DNA, 768 bp, B.fragilis
aggaaaacaaaaatggataaaaatatatcattcacactgaaggtatggcgccagaaaggcccgaaagcaaaaggtgcttttgaaacatatcaaatgaaagatatcccgggcgatacgtcgttcctcgaaatgctggatatcctgaacgaacagattattaatgacggtggcgaacctatcgtattcgaccatgactgccgcgaaggtatctgcggcatgtgttctctttacatcaacggacacccgcacggacctgcgacaggtgctactacctgccagatgtatatgcgtcgcttcaaagatggagacaccatcacagttgaaccttggcgttctgccggtttcccggtaatccgtgacttgatggttgaccgttcggcttatgacaagatcatgcaggccggtggttacgtaagcgtaaacacaggtgctcctcaagatgccaacgctatccttatctctaaggatatcgccgacgaggctatggatgccgctgcatgtatcggttgcggtgcttgtgtagctgcttgtaagaatggttctgccatgttgttcgtatcagctaaggtcagccagctgaacctccttccacaaggaaaagtagaagcagcacgccgtgcaaaagctatgctttctaagatggacgaactgggattcggtaactgtacaaacacacgtgcttgtgaagcagagtgtccgaagaacatttcaatcagcaacatcgctcgtttgaaccgcgatttcatcatcgcaaaactgaaagactaa

SEQ ID NO: 1927 - DNA, 636 bp, B.fragilis
actagtagaaaaatgaagaaatttgtgcttatttgtttttgtgtgctttcttcggtagggggatatgctcagaactgggatatcaatacgttacataaaataaacagtcttgatagtaagtttgcgaggaattatagcaaagccttttctaaatcggcaccttatattgcggtaggtgtaccggtggcgatggctgtatatgcaggtatcgataaagataaagagttgctgaaagatgccatttacatcggtacgagtgtggccgaggcagtcgtgattacgtatggtatgaaatatgcttttgaccgtgagcgtccctacgaccgttatccggatcgggtagatgcacgtagtcatgaatcgagtccttcgtttccttccggtcatacggcagcagccttttcactggctacttctttgagtatccgctatcctaaatggtatgtgatagctccatctgctttctgggcatgttctgtgggattctcaagaatgaatgaaggagtacattacccgtcggatgtagcagcaggagctgtgataggggccggttgtgcggtagccaatatttatgtgaatcgctggcttaacaagtggttgttcggtgagaagaagaaggttacaataagttattga

SEQ ID NO: 1928 - DNA, 1029 bp, B.fragilis
ttatcatttgaccagaattttatggagagtattctaattaccggagcgagtggatttatcggcagtttcattgttcaggaagcattgaagcgcagattcggcgtctgggcggggattcgtgcatccagcagtaagaaatacctgaaagaacgtaagatccactttcttgaattggactttgcacatcccaatgaactgcgggcacaactgtccgggcataaggggacatataataagttcgattatatcgtccattgtgccggcgtgaccaaatgtgcggacaaaagcgactttgaccgtgtcaactatttgcagaccaaatactttgtcgacacgttgcgtgagctcaatatgattcccaagcagttcatctacatcagtaccctgagcgtattcggtccgatacgcgaaaaggactattcacccattagtgaagaagatactccggctccgaatacggcttacggattaagcaagctgaaagcagagctctacattcagagcatacccggttttccgtatgtcatctatcgtccgacgggggtatacggtccccgggaagcagactatttcctgatggcaaaatccatccggcagcatacggacttctccgtagggtataagcggcaagatctgacatttgtatatgtgaaagatattgtacaggccattttcctgggaatcgagaaggaggtttcccgccgcgcttactttctgtctgacgggaaggtatataaaagccgggctttctccgacctgattcaaaaagaattgggtgatccgtttgttattcacatcaaatgtccgttaattgtgctaaaagtcgtatctttgctcgccgaatttatagcgacccgttcgggaaagagcagcacgttgaattcggacaaatataaaataatgaaacaaaggaattggcaatgcgacataactccggctgtgaaagaactgggatatgctcctgagtacgacttggaaaaaggagtgaaagaaacaattgcctggtataagaatgaaggatggctttag

SEQ ID NO: 1929 - DNA, 495 bp, B.fragilis
ttctatcaagagaatatagttatgaagacagtaatcattgaaaacaaagagcaagtagaagaaattatctcccgctgtgacatttgctttgtaggtatcactgacctggaaggaaatccgtacgtaattcccatgaacttcggttatcaggacggggtgatctatctgcattccggtcccacgggcagcagcatcgatatgctggcaagaaacaaccgtgtttgcattaccttcagtgtagaccacgaattggtatttcagcatcccaaagtggcatgcagttaccggatgcgggccaagagtgtgatttgcagaggacgtgtgaacttcattgaagatccggaagagaagcgcgaggcactcaatatactgatgcgccattacagtagccgggaatttgtgtattccgatccggcagtcaagaacgtaaaaatctgggagattccgattgacagcgttacggcaaaggagtacgcagtgccgcatacaaaatga

SEQ ID NO: 1930 - DNA, 993 bp, B.fragilis
atagaaaatcgtaaaaagatgaaaataggccacatagacctgggcgaacgccctgtatttctggctccgatggaggatgtcactgaccccgcttttcgcctgatgtgcaaaaagtttggagccgatatggtatacaccgagttcgtctcgagtgatgctttgatacgttccgtcaataaaaccactcaaaaactgaccatctgcgatgaagaacgccccgtcgccattcaaatatacggtaaagacacggaagccatggtgggtgccgcccggattgtagaagaagcacaaccggatatattggatatcaactttggttgcccggtaaagaaagtagcaggaaaaggggccggagccggcatgttgcagaatatccccaagatgctggaaataacccgtgccgtggtagatgcagtcaaaatacctgtcaccgtgaaaacccgactgggatgggatgccgatcataaaataatagtggacctggcagagcaactgcaggattgcggcattgcggcactggccattcacggacgtacccgtgcgcagatgtatacaggcgaggcagactggaccctgataggagaagtcaagaataacccacgtatgcacatacctattataggaaacggtgatgtgactacggccgctggtgccaaagagtgctttgagcgatatggtgtagatgcgattatgataggacgcggcagtatcggccgtccctggatattccgcgaagtgaagcattatctggaaaccggagaagaacttccgcgggaatcattcgagtggtacctcgatgtgttgcgcgaagaggtgctgaacagtgtagcccgactggacgaacgcagggggatcatccatatccgccgtcatctggcagcaactcccctatttaaaggaatccccaatttccgtgagacacgcattgccatgctacgcaccgaatcggtagaagaactcttccggatattcgacggactcaccacagagtag

SEQ ID NO: 1931 - DNA, 1959 bp, B.fragilis
attgtaaatagcattatgactaagatagattcaaaaattcctgaaggccagctcgccgaaaaatggagtaactataaggctcatcaaaaacttgttaaccctgccaacaaacgtcgccttgacattatcgttgtaggtaccggacttgccggagcatctgctgccgcttctctgggcgaaatgggtttcagagtattcaatttctgtattcaggattcaccccgccgtgctcactctattgcagcacagggtggtatcaacgcagctaaaaactatcaaaatgatggtgactcggtttaccgtcttttctacgatacaatcaaaggcggtgactaccgtgcacgcgaagccaacgtttaccgtctggctgaggtatcaaacgctatcatcgaccaatgcgtagcacagggtgtacctttcgcacgcgattacggtggcacacttgacaaccgttcattcggtggtgcacaggtatcccgtacgttctatgcccgcggccagaccggacagcagctgttgctgggcgcttattcagcattgagccgtcaggtacaaaaaggtactgttaaactttacactcgttacgaaatgctcgacctcgttgtaattgaaggacgtgcgcgcggtatcattgcccgtaacctcgtaactggtgaaatcgaacgtttcgctgctcacgctgtagttatcggtacaggtggttacggaaacgcattcttcctttctaccaacgctatgggttccaacggttcagttgccatccagtgctataagaaaggtgcttattttgccaatccttgtttcgctcagattcacccgacttgtatccccgtacacggtgacaagcagtctaagctgacattgatgtctgaatcacttcgtaacgacggtcgcatctgggttccgaagaagattgaagatgccaaagcattgcaggcaggcactaaaaagccgaccgaaattcctgatgaagaccgtgacttctatctggaacgccgttacccggcattcggtaaccttgttccgcgtgacgttgcttcacgtgcagccaaagaacgttgtgatgccggtttcggtgtgaacaataccggtttggccgtcttcctcgatttcaaatatgctatcgatcgtctgggtgaggacgtggttcgtgcccgttatggtaacctcttcgacatgtacgaagaaatcactgacgagaacccgtacaagactccgatgatgatattccccgctatccactacaccatgggtggtatctgggttgattatgaattgatgacttctatcccgggtctgttcgctatcggtgaagccaacttctccgaccacggtgctaaccgcttgggtgcatctgcattgatgcagggtctggctgacggatacttcgtattgccttacactatccagaactacctggccgatcagattcaggttccgcgcttctctaccgacctgccggaatttgctgcagccgaaaaggaagtgaaagataagatccagaagatcaaagccgtaaacggaaaacactctgttgactctatccacaagaaactgggtcacatcatgtgggacttcgtaggtatggcccgtacaaaagaatctctgcagaaagccctgacaggcattgaagaggtgaagaaagatttctggaccaacgttcgcatcccgggtgatgtaaacgaactgaacgtagaactggaaaaagcacttcgtctgatcgacttcattgaagtaggtatgctgatggctcgcgacggtttgaaccgtgaagaatcttgcggtggacacttccgtaccgaataccagaccccggaaggtgaagcgttacgtgacgataagaacttctcatacgtagcttgctggaaatacaccggtgaaaattcagaaccggagttgatcaaagaagatttgaactaccagttcgtaaaagttcagactcgtaactacaagtcataa

SEQ ID NO: 1932 - DNA, 879 bp, B.fragilis
ttcatggccagagaaactcaatgtaatagacagacagattgtgcgcaatgtcccaaagctacagaaggcatacttgttcaccggaagtttcccaaaggacaacattttccgcccgacaaatgcacacaaaattgtatcctgtttatactacaaggagaattactggtcaacagtgaagagtatcccggcaccacattacgtgaaggacaatttattctccagtccatcggctccaaattagaattactggcactaacagacgtaaattatgtagtgtactggttcaacgaaccacccctgatctgtgaacagcgctatcatgagatcctgcaacaatcagaagctccgctaacttatacaccattggttatgacacaacgcataaccaacttcatgaaagatatttgtgattacctcgatgaacagatgccttgcggcgcattcatcgatctgaaatgtcaggaactgatgtatctgatcatctgttattacccgacaccccagttgagcaagtttttctatcccatcagcagctatacggaaagtttccaatatttcgtcatgcagaattacgaaaaggtgaaaaacgtagaggaatttgcacacctgggaggctataccactaccacttttcgccgtttattcaagaacatgtatggcgtacctgtatacgaatggattctgagcaagaaaagagaaggcatcctggaagacctccagcataccaaacaacggatcaccgagatcagtaatcgttacggattcgactctttatcacattttgcacatttctgcaaagcttcctttggagactctccacgtgcccttcgtacacgtgcagccagaggtgaaaaaattactgctttaaaaacagaatag

SEQ ID NO: 1933 - DNA, 903 bp, B.fragilis
caaatggaaagtgaaaagtcttccagggagaagggaatttataaagtaacgatcgtgggaagtatcgtgaacttccttttgctcgtttttaaattctttgccggaattgccgggcatagtgcggctatgctggccgatgctgtccactcactatccgatttcatcaccgatattgttgtcattgtctttgtccgcattgccgggaaaccggaggataaaggtcacgattacggccatggcaaatacgaaaccttggctacggccatcatcgggttgttacttctgtgtgtcggtttcggtatcttttggaatggggcttcgtccatttatacttttttgcggggcggacagttggagtctcccggtgtagtggcattggtggcggcactggtgtcgatcgtttcaaaggagatactttatcagtatacagtgattcagggcaagaagttgaactcccaggctgtgatagccaatgcctggcatcaccggagtgatgcattgtcgtctatcgggacggccatcggtatcggcggtgccatcctgttgggagatcattggcgggtgctcgatccggttgctgcggtggtagtcagtttctttatcatgaaggtgtctgtacggttgctgattccgtgtgtggacgaactgcttgaaaagtcgttgccggaagatgtggagaaagagattgagcagactgtactctctttcccgggagtgagccagccccaccatttgcgtacccgcagaatcggcaattattatgccatcgaattgcatgtccgtatggatgggaagataactctggaagaggcacatagtacggcaactgccattgaaaacaagctgaaagagatgtttgggaaaggaacccatgtaggcattcatgtggaaccgacgaaataa

SEQ ID NO: 1934 - DNA, 225 bp, B.fragilis
ccctacttgagcagggctatcaaatgcatcatttattataatattatggatagtcccatatttgaaaacaggattcaagttttatacttgaatcctgaagttttctatttacacaaaatgatggacagtatcgaatactacttaggagtctcagtgaaatcccagctatcagcaactgaaccggtaatagacatcttctcaacgccttttaacgtcaatacgtaa

SEQ ID NO: 1935 - DNA, 954 bp, B.fragilis
acagatatgggaaagatagcaaagaaactgacagatttagtgggtaacaccccgttactggaactgagtaattacaatgcaagtaatgggctgaaggctcgtgtagtggcaaaactggaatatttcaacccggcagggagcgtgaaagaccgtatctctctggctatggttgaagatgccgaagccaaagggacgttgaagtccggcgctactattattgagccgaccagtggaaatacaggtgtcggcctggcatttgtggcagctgccaaaggttacaaactgatattgaccatgcccgatacgatgagcatggaacgcaggaatctgctgaaagcactgggagcggagcttgtgcttactccgggagcgaacggaatgaaaggagccatcgccaaggccgaggaactgagggctgccactcccggatctgttatcctgcaacagttcgaaaatccggctaaccctgcagtccatgtccgtactacgggtcaggagatctggagagataccgatggaaaggtggatatctttgtagccggagtgggaacgggaggtactgtaagtggggtaggagctgctttaaaggagcataatcctgccgtacgaatcgttgccgtagagcctgtcgattcgccggtgctgtccggtggagttcccggtccgcacaagatacaggggattggtgccgggtttattcctaaaacttatcatgcagccgtagtagacgagatcaggcaggtgggaaatgacgatgccatccgcaccagtcgtgagttggctgctaaagaaggacttttggtcggcatttcttcgggagcggcagtatatgcggctacagagctggcaaaactgccggaaaatgaaggaaagctgatcgttgtattgctgccggatacgggagaacgctatctgtcgactatcttgtatgcgtttgaagagtatccgctttga

SEQ ID NO: 1936 - DNA, 1278 bp, B.fragilis
tttgtgactatgtataagataaacgattttgaaataatggctccggttggctcacgcgaatcgctcgcggcagctatccaggcaggagccgattctatttattttggtattgagaacctgaacatgcgtgcacgttcggccaatacatttaccatcgaagatttacgcgagatagcccggacctgtgatgaacatggaatgaagagttatctgacagtgaataccatcatttacgataaggatatcgaattgatgcgtaccattgtcgatgcggccaaggaagcgggcatttcggccgtgattgcggctgacgtggcagtgatgagctatgccaacaagattgggcaggaagtacatctgtctactcaattgaatatttcgaatgcggaagccctgaagttctatgcgcaatttgccgatgtagtggtgttggctcgtgaactgaatctggagcaggtggcggagatctaccggcagattcaggaagagcatatctgcggtccgagtggtgagctcattcgtatcgagatgttctgccacggtgcgctttgcatggctgtttcgggtaaatgctatctgtcattgcacgagatgaatcattcggccaaccggggagcttgcatgcaaatctgtcgccgtgcttacaccgtccgtgacaaagataccgatgtagagcttgaggttgacaatcagtatatcatgtcgccgaaagacttgaagaccattcacttcatgaacaaaatgatagatgccggggtacgtgtgttcaagattgagggtcgagcccgcggtcccgaatacgtacgtactgtcgtcgaatgttataagcaggccatccgggcatatctggatgattcgtttaccgacgagaagattgcggcatgggatgaacgcctgaagactgtattcaaccggggattctgggatggctattacttgggacagcgtttgggcgaatggaccaagaactacgggtcggcagccactgagcgtaagatatatgtgggtaaaggcatcaaatacttctctaacattggtgtggccgaattcttggttgaagcggcagaagtaagtgtgggtgataaactgttgattaccggacctactaccggagctgtgtttgctacgcttgacgaagctcgtgtagagctgaacccggtggagactgtgaaaaagggagaacacttctcaatgaaactggataagatacgtccgagtgataagttatataaattggtttcgaccgaagaactgaaaaaatttaaagggcttgaataa

SEQ ID NO: 1937 - DNA, 966 bp, B.fragilis
atgaaagatataacaaggttgctttgcatggttctcctctcgtttctggtggtgacgggatgcagccggcgggatattctggacgattatccggtgagtggtgtggaagtgcggctggattggagcggagtgacggagaagttgccggaaggagttcggattattttctatccgaaagacgaaaaaggtagaaagatagatacgtatttgtcggtaacaggtggggaagtaaaagttccttcgggacactacgctgttgttatttacaattacgatactgaaacggtcttaattcgtggagaggaatcttatgaaaccattcaggcttataccaatttttgtaaattgggtattgcaggtacagaaaagatggtttggggaccggatccgctttatgtggtaaatatagatgatttggatatacagaatagtgaagagacattgattctgaagctgaaaccaaaattggtgataagaacttactcctttagtatcaaagtgcagggattaagtaatgtttcaaacgtgatagggagtattggtgggatggcagatcattattttttaggaaaagcttatgctatgtgcgatgactatccgattaatattgacctgaatgtgaaagccgggaagatagaaggggtatttaccacttttggattaccggaagctattattacccgtttagaaataaaacttccggtgatgatgaacctgatgattattaaggtggacaattcggtacaggaggttaagattaatataacggaagctgtacaagaacctaccggtggtggtgaaggaggagaaggagaggaaacaaaaccgccggcattggttgaagttgaaatagaagatgaaataaaagtagatgatgtggaaactcctccaagtggaggtggtggcattggtggtgatgtaggagattgggacgacgaaacgaatgtagagttgcctgttggataa

SEQ ID NO: 1938 - DNA, 2157 bp, B.fragilis
aacgaaccaattatggctaaaaagaaagaaaaaaaagccggcaaaagaatgaagaagaaagagctgtcgaaggcggttctcgatttcttccatgccaaacaagatgaggtgatcagcctgaaatatattttctcggaactgaagttaaccactcatccgctaaaaatgctttgcatggatatcctgtccgatctcctggctgatgactacataaccgaagtagataaaaacaaatataagcttaacaatcacggcatagagatgaccggaaccttccagcgcaaaagcaatggaaagaactccttcatccccgaaggaggcggagatccgatattcgtcgcagagcgtaactccgcccatgcgatgaataatgataaagtgcgcatcgccttctatgccaaacgccgcgggtgcgaagccgaaggggaagtgattgaaatattgcagcgtgccaacgatacctttgtcggcacactggaagtagagaaatcgtatgccttcctcgtaacggagaaccgcacgcttgccaacgacatcttcatccccaaagataagctgaagggcggaaagaccggtgacaaagcagtggtaaaagtaacagaatggccggataaagccaaaaacccgatcgggcaggtgctcgatattctcggcaaagccggagataacactaccgagatgcacgccatcctggccgaattcggattgccatacgtctatccgcaatcggtagagaaagccgcggataagattccggcggaaatttccgccgaagaaatagcccgccgcgaagatttccggaaagtaaccactttcaccatcgacccgaaagatgccaaagactttgacgatgccctttccatccgcccgctgaaagatgggctttgggaagtcggcgtacacattgccgatgtgactcactatgtgaaagagggaagcatcatcgacaaggaagccgaaaagcgtgcaacttccgtctatctggtagaccgcaccataccgatgctgcccgaacgcctgtgcaacttcatctgttcgctccgccccaatgaagagaaacttgctttctctgccatattcgatattacggaaaaaggggaagtgagagactcacgcattgtacacacggtcatcgaatcggaccgccgcttcacttacgaagaggcgcaacaaatcatcgaaaccaaagaaggcgacttcaaagacgaaatactgatgctcgacaccatagccaaggctctgcgtgaaaagcgctttacggcaggagccatcaacttcgaccgctacgaagtgaaattcgagatcgacgaaaaagggaaacccatcagcgtctactttaaggaatccaaagacgccaataagctagtagaagagtttatgttgcttgccaaccgtaccgtagcggaaaagataggaaaagctcccaaaggtaaaaagcccaaagtgctgccttaccgtatccacgatcttccggatccggagaaactggacaatctggctcagttcatcgcacgctttggttacagactccgcacaagcggaaccaagacggatgtatctaaatcgatcaatcatctgctggacgacatacaaggaaagaaggaagagaacctgattgaaaccgtatctatccgtgccatgcagaaagcgcgctactctacacacaacatcggacactacggactggctttcgactattatacccacttcacctctcctatccggcgttttccggacatgatggtgcaccggttggtgaccagatatatggatggcggacgcagcgtgtcagaaacgaaatacgaagacctgtgcgaccacagctcgaacatggagcagattgcagccaatgccgaacgcgcttccatcaaatacaaacaggtggagttcatgagcgaacggctgggacagacctacgacggagtaatctccggcgtaacagaatggggactgtacgtggaactgaacgaaaacaagtgtgagggaatgatacctatccgtgacctggacgatgattactacgaattcgacgaaaagaactactgcctgcgcggtcgtcgtaaaaaccgtatctacagcctgggagacgcaatcaccgtcaaagtggcacgcgccaacctggaaaagaaacaactggacttcgcactggtagagtaa

SEQ ID NO: 1939 - DNA, 1230 bp, B.fragilis
aaaagtctgatgattacaatgtatcgaatttatatgtatctccttgctgcctgccttttattgggtgtcacggcatgtgaagaagaaggattgggaaatgaggaaactccttttgctccctatgtactcagcctgggtatcaattccaatgggactaccacttattatgtggttactgcacccgaattgatgtccggaacaatcaatgcggtggccaaaggtatcgagcaaaacggatatcgtgattatgaacaggccggacaaacggtgttcagtattggcggactgggactgaccagtgcaaccggaattgtacgtgatgcaaacggctatctgacggagcgtggagactttgtctttaacagttcgctgaatgcgtttacacaaatggacgggcagaacatgatcggccttgaacttccggctaataaggagagtggggaccaaatgaccttatataccgtaaatatcagtgatgtttctatcacttctcaggtcaaagctccggtatttccgctgaatcaactcgaatggccgagtatcacgggtatgtgttatagtgaaggtaatgtgtacgttacttattttccgatgaacccttccacttttgagactttatataccgatactacttttgttgcggtatactcttatccggatatgcagtttaagacattgatgaaagatacgcgtaccggtcctgccggttcgtggaatgcatttaacggtatttttaaggtagagtccggcgatatgtacatcatgtctaattctgccattgccaacgggttctcacaaagtaccaagaatgctgctttccttcgtatccctaaaggtgagacgcattttgatgactactattttgactttgagacggtttcgggaggattgaaacctgcccatatcaaatatatcggtaatggtctggtatttgccgaggtcagctcaatcgtacgtcatcaatccgccgaccgttggggagataagagtttgaaatgctgcattatcgatcttaataataaaacggtacgtgacattaaagagattccggtgcataacggagatggcggacggcgttttgccgctctggtagacggaggttatgtttatcgtccggtcactacttcagagggtacttacatttatcaggtagatcctcaggcggctactgcggtcaggggagctaaagtttcaaccacgtttgtcggcggtttcttccgtctggattga

SEQ ID NO: 1940 - DNA, 861 bp, B.fragilis
tgcgcggctgttcagccccgtggtgaagacttacgaacacttaatagcatgagaaagtatttatcattcattctcctgttgattggcttgaccttacaggcacaggagacgtacaaaacagtaaaagacatttcgtatattcctgcgggggaaacggacggttaccgtaaagagcgttgcaaactcgatgtttactatccggtcgggaagaaagactttccgacgatcgtctggtttcatggcggtggattggagggaggaggaaagcatgttcccgagatgtttatgaatcagggatttgcaatcgtcgctgtcaattaccgtctgagtcctaaagctcagaatccggcttatacagaggatgctgccgctgccgtggcctgggcttataaacatatagaagagtatggaggctcaccgagacgtgttttcgttaccggtcattcggcaggaggctatttgactttaatggtgggactggataagtcttatcttcaggaatacggggtagatgccgatagcatagctgcttatcttcctatcagcggacagactgtgacacacttcacgatacgtaaggaacgctcgttgcccgagggtattccggtgatcgaccaatatgctccttgcaacaaggcccgtaaagatacaccgccttttgtactgattaccggcgaccggaatcttgagatggccgaccgctatgaagagaatgccttattggcttcggtactgaagaatattggtaataagaaggtatcgctatacgaattgcaggggttcgatcatgggcaggtatacgtccccggctgttgcctggtagcgaattatattcgtaattttattgcggacggaaggtaa

SEQ ID NO: 1941 - DNA, 195 bp, B.fragilis
tatccaaatgtatataactatatctctatctatttatatcacttagagtattttatttttcttgctatctttagtgaaaatggtcttttctttatctcctcctgcatatctgtgcccatgagcccagatagcaaggctcacataaacatatcagaaggtacggtaatactcttatttacaaagtattataaatga

SEQ ID NO: 1942 - DNA, 621 bp, B.fragilis
aaagtaaacgtaatggaaacaaatgacattaaagaaacctggaaagcgggaatagaaagaaccatcaaaccgtatccggaagagagattgaatgaaatggttgtcaactctgccagaaaatcaatcaagacagtgtatcccggaactgttttccggctcgttatcattgccgtggccgttttcctcatcgtatcacagttcgtaaaagagcaaaacgcaacaagaatgtatttggatatgggcgctttggccgtgttgtccgtctcttatttcctctgggaacgctccgcatacaagatgcggaagtatacccatggaatgcccgtaaaggaatggttggaataccgtatcaaagagattgagaaaagcatcaggttcaataccaaatatgactggattgtatacacatgttccttcctttcggcaatcggcttctacgtgttttacctgatggcaacgaacgtcgtccccggcatactgaacgtcattgttattccgctcggcatgtgcatttaccttctgatcatcaaacgctctctgaaacggaattaccggagaaccctgcaagagctgaaagaactgtacagacaatttgagattgaagatcaggaagggagatga

SEQ ID NO: 1943 - DNA, 720 bp, B.fragilis
gtggttttattgacggaacgtatcaaagcatcactcgagacgaactcggtgtataccatatcggctccaaactttttgcacatcaggcgaaaagcggggtcagtgacatcctccatcggagccagaaatacagggcgttcgcccaggtctatgtggcctattttcatctttttacgattttctattcattatttggctgcaaaagtacggaaaaaacccctacctttgcacctcattcatttatttaactggatagaaattatgaaaaaaagactattttccattgctctgtgcctgacttttatcttgtctgccacttccgtctcggcccaggatgctgcctacagagaggcattaagcaagatgcttgaggcttcgggtgccatgactacagtgaagtcgatggttccgcaaatgatcgggatgatgaaacatacttattcgaatgttccggatgaattctggaagaacttcgaggagcaattatcggagaaagcaaacacccagtttctggatatatacgtgtctatctatcacagatacctgacgataagcgacctgaagaagatcactgcattttatgaatcgccggtaggcaagaagctggccgagtccactcctgtgatgactgcggaagccatggaagcgggccaacagatcggtatgggaattgccaaggagataatggcaaacctcaaagaaaaaggatatgttcagtaa

SEQ ID NO: 1944 - DNA, 705 bp, B.fragilis
aatcaatcatttatgtggttaagtaattcatctgtaggaaggaaagtggtgatgagcgttaccggtatcgcccttgtcctgtttctaacgtttcacatggcgatgaaccttgttgcgatcatctcggctgagggttacaacttggtttgtgagttcctgggagcaaactggtatgcgttggtagctacgctgggcctggctgccctcttcgtgattcacattatctacgctttctggctgacaatacagaatcgcgcagcacgtggtagcgaacgttacgccgtagttgacaaacctaaaaccgtggaatgggcatcacaaaacatgttggtgctgggtatcatcgttatcttaggtttgggccttcacctctttaacttctgggctaaaatgcagttacctgaattggtgcacaacatgggaggagtagcagacacaacttatgctgctgatggtgtttatcacatcatgaacactttctctaaccctgtatatgtagtgctgtacctcgtttggctgggcgccctttggttccacctgactcatggtttctggagctctatgcaatctttgggctggaacaacaagatttggatcaaccgctggaaatgcatctccaacatctattcaaccatcgttgttgtatgctttgctctggtagtagtcgtattcttcgttaaatcgttggcatgcggtgcttgctaa

SEQ ID NO: 1945 - DNA, 399 bp, B.fragilis
aagtataatctaaaattacttggtatgaatgaacagaaagaattgacaaaagcagaactccagatcatgcaggtgctttggcagaaagaaaatgcttttgtgaatgaaatcttgcaggagctggaagaaccacgtccggcgtataatacagtttctaccgtgttgcgtgtgttgcaaaacaaaggttttgtagcttatcgtagtttcggaaagaattatcaatattatccgttggtttcaaaagagagttataccaatcgttttatgaatcgggttgtggataacttttttagcggttcggtgaaagcaatggtttcgttctttaccaaaaaagagaaaatgtcggtgcaggaaatcgacgaactgattgaaatgctgaaggaaaacaaaaaagaataa

SEQ ID NO: 1946 - DNA, 876 bp, B.fragilis
aatatgaataaaaagaatctgctgatcattgccgtatctgttctggtgcttgcactcatcggtcttacctatctgttattctctgaaaaacagactaaccgtgaactggttcaggaattccaactggataaagaagaccttgaaaatgaatacactcgcttcgcacagcaatatgacgaattaaaactgaccgtatcgaacgactctctggcagacttgctggcccaggaacaggtcaaaacgcaacgccttcttgaagagctccgtacggtaaagagcagcaatgccacagagataagacgcctgaaaaaagaattggcaacactaagaaaagtaatgatcggttacatcaatcagattgactcactaaacaaactgactgcccagcaaaagcaagtaatagccgaagtaacgcaaaaatacaatgccgcttcacgacagatcaacaatttgtctgaagaaaagaaaaacctcaatcaaaaagttacgttagccgcccaactggacgcaactaatatctggattgaacctcgtaacaaacgtggcaaaaaggctaaaaaagtaaaggatatcgtgaaactggccatcggcttcaccatcgtaaagaatatcacagccgaaaccggagagcgtacactttatatccgaatcaccaagcctgataatgatgcgcttaccaagagcccgtcaaacacattcccttacgaaaaccgtacgctgacctactccatcaaaaaatatatcgaatacaacggagaagaacagaccatcaacgtattctgggatgtagaagagttcttgtatgccggtgcctaccgggtagatatttttgctgacggaacgatgattgggtcgcagaaattcacattggactaa

SEQ ID NO: 1947 - DNA, 3294 bp, B.fragilis
tacaaaatgaaaaaactcttcatgagtgctgtggcccttctgtttgccggagcactttgggcacaagagaatccgttgtggatgcgtcattgtgctatctctcccgatggaactaccattgcattcacctacaaaggtgacatttttacagtccccgtatccggtggcaaggctacgcaaatcactaccaatccagcttttgatacgacaccgatttggagtcctgatagtaagcagattgcttttgcttccgaccgcatgggaagtatggacgtatttattgtgtcgaaagacggtggagagcctcgccgtttgacaacattttcggggggcgaaactccggttgcttttactgatgccggacatattttatttactgccgatatcatgccttctaccgaagatgccggattcccttcaaacggacaatttcagcagatatatcagattccggtttcgggcggacgtcctgtaatgttctcgtccatgccgatggaatgtatttctataaataaagaaggaacaattctttatcaggacaagaaaggatacgaagattactggcgcaagcatcagaagtcaccgattgcccgtgatatctggatgctccggccgggacagactccgcgctacgaaaaacagactactttcattggtgaagaccgtgaaccggtgtgggcaccggacggaaaatcattctactatctgagtgaagagaatggaacgtttaatgtttaccagcgtactcccggttcggatacatccaagcaagtgactcaccacaagcaacatccggtgcgctttctcagtatggcttccaacggtaacctttgttatggtttcgatggtgagatctatacgttggctcccggcggtaaaccgcagaaagtttctgtaaagattctatccgatagaaatgataaagacctgattcgccagattaagaccagtggggctactgagatggctgtttctccggatggtaaggaagttgcttttattctgagaggagatgtgtatgtcacttcggtggaatataagactactaaacaggttacgaacacaccttgccaggaacggggtattgattttgcacccgatgggcgcactctggtgtatgcttcggaacgtggcggactctggcaactctatacttcgactatcgtacggaaagacgaaaaacagttcacttatgctacggaattgaaagaagaacgtctgactaattcggatgtcgcttcattcaatccgaagtatagtccggacggaaaagaaatcgcatttcttgaaaatcgtacggcaatccgcgtcatcaatcttaagactaagaaggtacgtactgtgatggatgcacaatatcagtattcttatagtgatggtgatcagtggtttgagtggagtcccgatagtaaatggattctttctgaatttataggtatcggtggttggaataataaagacattgtgcttctgaatgccgatggtaaaggagaaatgcacaatctgaccgagagtggatattcggatggaaatgcaaaatgggtgttgggtggtaaagcaatggtgtggttcagtgaccgtgcaggctatcgcagtcatggtagttggggcgctcagtacgatgcttacattatgttcttcgatgtagatgcttacgaccgtttccgcatgaataaggaagatcttgctttgcttgaagaggcagagaaagctgaaaaggccgagaaagaaaaagcagaaaagaaaaagaaagagaataaaaaagacgataagaaaaaagacgccaaagagaaaaacaagaaagatggggatgaagaaaagaaagaagaggtgaaacctttgaagttcgatctcgacaatcggtttgaccgtattgtacgcctgaccgtcaattcttctttcatgggtgatgctgtattgacaccgaaaggtgataaactctattatctggcagcttttgaaagcggttatgatttgtgggaacatgatctgaaagagaattctaccaagattctgttgaaaggtgttggaggcggttcgttattgcccgataaaaaaggtgagaacatctttatgtgtaccggtgggggtatgaagaaaattgagatagccggtagtaaaacaacaccgattgcatttgaatctttctttgattatcagccgggtggcgaacgtgcttatattttcgatcatgtgtggcagcaggtcgatgataagttttatgtgaaagatctgcaaggggtagattggcctttgtataagaagagctatgaaaagttcttgccatatatcaataataactacgattttgccgaactgctgagtgagatgcttggtgagttgaacgcttcacataccggagcccgttattccggtgcaggaggtgcattagcaacagcagcactgggtgtattctatgacgatacatataacggtgatgggttaaaaataaaagaaattatcgagcaaggtccctttacattgaaaaagacggatgtgaagccgggttgcattatcgagaaagtggacggtactcttattaagaaaggtgaagactatttcccgttatttgaggggaaagtaggacgcaaggtgctgctctctgtctatgatcctgctacaaaaaagcgttttgaagagactgtgaaagcaatcagttatggcgcgcagcgtgaattattgtataaacgttgggtagaacgtaatcgcaagaaagtagaagaattgtcgggtggccgtttgggatatgtgcatattaaaggtatggacagccaaagtttccgtaagatgtattctgaattattgggacgctaccgtaataaagaagctgtagtcgtagatgtccgtcataatggaggtggttggttgcacgatgatgtggtgacgcttctgagtggaaaagaatatcagcgttttgttccccgcggacagtatattggtagcgatccgttcaataaatggctgaagccctcgtgtatgctggtttgtgaagataactatagtaatgcacatggtactccatatgtttacaaaacattaggtatcggtaaacttgtaggtactccggtggccggaactatgacagctgtgtggtgggaacgtcagatcgatccgagtcttgtatttggcattccgcaggtaggttgtatggatatgcagggtaattatctggaaaaccatacacttgaaccggatgtgttgatctataacgagcctgccgcttcgttgaagggtgaagatgcacaattgaaagctgcagtagattgtttattgaaagaactgccaaagaaataa

SEQ ID NO: 1948 - DNA, 2196 bp, B.fragilis
ggtatgatcgattttgattatagcgaatgggctattcttcgtttcataggagcttcatttgtgttatggctgtgttattacttgttgttcgatcgtaaagcacccttcaaccaatgccggaattatttgctgttttcggtgttgttggccggggcagtatcggtgttacgtattccggtttacccggtagaggtggtgaaaccggtaaaaatggaacaaatagtggtggcgcaggaagcgcaaacggataaagtttctttgatgcaaatagataataatgggatacaaccggatacgcttgcaacagcaatgctgacggatgtgaatgaagctgtcacgcatcagacggaagaagaaatagtcgaagaacctttttatgtttcgtggaattattggcaaatagcctggattgtatacggttcgggagtatttatccttttggtgcatttattggtcgaaatggtgcggatctggcgtttaaagcgttggggaacttgtactacggatgccgatgggatttgcatcgtacgtaacaatgaggtcgtttcgccgttctcgttctaccggatgatttttatcaaccggaaattagaaggcgaagtgttgcgtgtagttctgcttcatgaaaaggcgcatattcgtaatcatcactatcgggacactttatttattgaaggtttgtctattttatgttggtttaatccgtttgtctggctggtaaaacgtgaactgcgagccctccatgaatttcaggtggatcgttgtttgctttccggcgagattgaattatttgaatatcaaagcatcttattcgaagagttgatgggatacagcccgaaggttgcaaatggttttcataattcattaattaaaaaacgatttatcatgatgaaacatcaatataaagaacgtttggcaggggtacgcaagatagcgttgcttcctttatgtataggtgtattggctttattctcttttacggaaaatccggtgctggtcgaacctgtattgccaatggtatctgtgacgataaaggcagaaactccgaaagtcgtattacccgaagtaacagtagacagtgccggtaatgagaaagactttttattgctggatactccaaagatagttcactatgtacaatcaagggatgctcacatcgttcaatccggggccggacagccgcttgcgcaagtctcaatttttgtaccgaaggctctggatacactttcggcagagagctcggatggaactttttcacaggagcaaaatataaatcataccgtggatatcgatttacgggctgatcaggttgtattgtctcgtgctccacgtaaaaataatgcatatgtgcggttcattgaacggtctaaagaagatacccgtgttactttggctattccaatacattatgacaggcattggttgcaatttgaaaaggggttgtccatcgttgacgaagattcgaaggatgtttaccgtattcgttcggttacccgtgggattgagttaaaccgggtttattgggttgtggggcaagaagggcaaatgttggaatttactcttgtatttcctccccttgaccggaaagtaaagacagtaagtatccgggattgttttccggaagagaaaggattgacgccgcccaatggaggcgcatggacgttggataatctgaaagttgataattttcagccgacagctgtccgtcaagccgaatatgacagagagggacgacctctacgttctgataaattggaagaagtgactcttaatgcgaatcagctgtctgtttcttctcgtcacaatggtggaagaacgcagattcagaagattgaaactttgcctgataagacgttggttgttttgagtgtacctattcattatgatcgtaattggttagtcatcaataaaggattgtgtatagtagattgcaagactggtgatgaatatccggttctggaagaagcacatggcattgaaatgaataaattgctgtgggtggaaggttgtcaggggagctctgttttactgacacttgtgtttccaaaacttcccaagagggtaaaaacgattgatttctataacaagtatccggatgcgggaattatttcgccgactaacggaagcagttggaactggtggaaaatcaagataaaagattatcagaaagaaccctataaacgcgtgattttgtag

SEQ ID NO: 1949 - DNA, 231 bp, B.fragilis
actatctttggagtatccagcaataaaaagtctttctcattaccggcactgtctactgttacttcgggtaatacgactttcggagtttctgcctttatcgtcacagataccattggcaatacaggttcgaccagcaccggattttccgtaaaagagaataaagccaatacacctatacataaaggaagcaacgctatcttgcgtacccctgccaaacgttctttatattga

SEQ ID NO: 1950 - DNA, 954 bp, B.fragilis
aatataagtattatgtcaaaagtaaccgtagtaggcgcaggtaacgtaggtgctacatgtgcaaatgtactggccttcaatgaagtggcagacgaagtagtaatgctggacgtaaaagaaggcgtttcagaaggtaaagcaatggatatgatgcagactgctcagttgttgggtttcgacacaacaatcgttggttgcacaaatgattatgctcaaactgctaactctgacgtggttgtgatcacttctggtattcctcgtaaaccgggcatgactcgtgaagaactgatcggtgtaaatgctggtatcgtaaaatcagtagcagaaaatcttttgaaatactctccgaacgcaatcatcgtagttatctctaacccgatggatacaatgacttacttggcattgaaatcactcggattgccgaaaaaccgtgtaatcggtatgggcggtgctttggatagctcacgtttcaaatatttcttgtctcaggctttaggttgcaacgcaaacgaagtagaaggtatggtgatcggtggtcacggtgatactactatgattccgttggctcgtctggctacttacaaaggacagccggttagcacattgctgagcgaagaaaaactgaacgaagtagttgcttctactatggtaggtggtgctactctgactaagttgctgggtacttctgcatggtatgcaccgggtgcagcaggagcttatgtagtagaatctatcatccacaaccagaaaaagatggttccttgctcagtaatgcttgaaggcgaatatggcgaatctgatctttgcatcggtgttcctgtaattctgggtaaaaacggtatcgaaaagatcgttgaactggaactgaatgctgacgaaaaagctaaatttgctgccagtgccgctgctgttcacaaaacaaatgctgctttgaaagaagttggcgctctctaa

SEQ ID NO: 1951 - DNA, 2031 bp, B.fragilis
agactaataatactcatcctctgcatctgctcctctctgcagatgcagggtgcactttccgccttaaaaggcggaaagtctaacctcgccctccacctcgacgggaaagataataacgtacggacaggtatgggaatattggaaccttcgtggacactggaatcctggattaaaggggatgattgccaatgggatagtctcgaagtgatcatcggaggaggagaatatagtgaactgaactgggtggattatctgcctttggttgtgaaagaaggcaagattcactctagccgtgccaatctctcatcaccccaaacactggatgaccaatggcatcacgtggcactgacctgtgacggaaagcaaaccatcctctatcttgacggtaaacaagtagacaaagctgacacggcgacagctattcttcccggagccatcggagtgcatgacgtatattatactttcgggggattaatcgacgaagtacgtgtctggcgcagcgcacttccggagcaaaccatccgtcgttggatgaaccgtccggtagaagccactcacccggcatttaaatctttgtggggatattataacttcgatgacctgaaagatgaaacatctgtcaattgggtaggtaaaggacatcaggcttatcacatccgtaacggacgtaacaaatacaacgaaaaagctccactggcacatgcagtccccaacgacaaccctgcttttaaagagtttgacggaaaccaacagttgttcaatgccgtgattatccaaagtgaatgggatgctgatcagggaagtaaaaacgaccaggcgctaaaactgaggattgccgtacaaggttccaaaaacccactgaaactaacggaactgaaacttgacttcaccggaactaccgaccttgcagacattgagcaaatccatatctattctaccggtagtgaagcacgttccacacagcgcaaagagctgttcggcaacggacatactcccgaacagtcattgacactccgtcccactcacggagaagagattctgctgcaaccgggcatcaactattttcttctcacatttgatgtccgctccaaagcaactcctggacataccttatatgcctcagtacctttcttcaagttgaacggaaaaaaaattattcccggaacatctgccgaagaagtacgtaaacaagtgacttgcaacaaccaaacacaatccaatatagtaaaagtactccaatggaacatctggcacggaggtatccatctgggtaacgaaggccaacaacgagtactcgatctgattcgaagcagtcgtgcagacgttatcatgatgcaagaagcttatggcatccaacaaatgctggcagattcgctaggataccacctcaagacacattctctcaaagataacctggccatgtatagccgtttcccattggaagcaatcgcctggagagaacctttcaaatcgaatcctgccaaaatcaccttaccgaatggtaagcggataatgtttgttgactgctggttgcgctatgcttaccgcccggaatatactagcggctatgctgaaaaaggtctcgatccctctgtatgggttgcagaagattccatattggcattacccgatatccgaaacatctataccaaggatatagccccgaaccttgaaacggacatgccagtcattgtcaccggagattttaactcgtgcagccatcttgactggaccgaacgggctaaaccattacaccacggatatggtccggtagctttcccggcctctcgttatatgctggagaatggcttcaaggacagcttccgcgagaagaatcccgacgaagttgcttatcagggaggtacagttgcagccatttacgggcaaatgcaaatgtcccgcattgacttcatttattataaaggaggactcaaagtattatcttccaagatcgtacgtactgctcctgaaatagactatgtatgggcatcagaccatgcagcagtactgaccgtattcgaagtggaataa

SEQ ID NO: 1952 - DNA, 2286 bp, B.fragilis
tgtatgacaaaaagaacttgccaatttccgaagcacacatgccttcgagaaatcaactttttgaagatagcaggtatcagtctcctgctattctgcacgacatcacaaattgccgtagcagacagttatgaaaaaaatgctgtcacagccacacagcagagtaaaacagagaaaataacaggtaaaatagtcgatgagagcggagaggccatcatcggtgcctcggtaaaagtacaaggaagcactatcggtaccatcaccaatatggaaggagagtttatgataccgaatgtccccaacaaggccgtactcgaaatcagctacatcggatacaagcccttagaagtcgctgtcggaaaatccaaagatttacgcatcacgatggaagaagacactaaaacgctggatgaagtcatcgtagtaggttacggtacgacttctaaacgcaaaacaaccgccgccattgccagtgtcaatacagaagacattatcaaagcaccgacggcaaacatcacccaaagcctggcaggacgtgctcccggtctgttggtcacaaccagcggaggcggtctgaataacttttccagtgtctctatccgtggagggggcactccgctttatgtaatagacgatgtgatttccgaagagcgggatttccgcaatctgaatgctgaagacatcgatcagatcacaatcctgaaggacgccgcttctaccgccgtttacggagcacgtgccgccaacggtatcgtaatgatagtaaccaagcaaggcaaagcagggaaaatgagcgtcaattataactttaactataactggagccaacctgccaatatgcccaataagttggatgcccacgatgcagccttctacaagaacatgagtatgaccaatgacggattggcaccggcctatacggacgatgaactggaactgttccgcaacggatcagatccacgcagatatcctaatacggactggcaaaaactctgtttgaagaactccgcaccggaaatgcaacataccctgactgtcaccggtggtagcgaaaagataaaagcatatacctctttggggttctacgatcagaagtcactctataagttcgatgtaaacagtttcaaacgctacaacttccgcacaaatatcgtagcagatttcaaagaaataggtttgaaagtaacttccagcatcgaagcttacaaaacggacttaagatcgcctaatgccaaatcgggagacagctattatcacacctggggacacatccagaataaagccccctgggaaatagcatacaatccgaacggacaaatattcaacacaccggataacccattgatggagatctcccccgacgccggatacactaaaaacgaaaacctcagtgccatagcaaacctcgcactggagtggagcgtaccttatgtaccgggcctacgattgaaagcactgggtaactaccgtatcaacaacgacaagtcaaaaagttggaaaaaatcacctttagcatacgattgggatggcaaccccaacgatcccggcaaaccttcactgagcaagtcttattcaaactggtcatcgtacaccgtgcaaggctttgccaattatgaccgtactttcaatcaggtacacacaatcagcgccacagccggtatcgaagcctataaactctttaaagacgatgcctcgttatcccgcgaagaatatttgctggacgtagaccagatcggtgcaggtcctgtatctacagccaaaaacagttcttcggaaggtgaagaagcgcgtgccggtgtagtagcccgactgaaatatgactatgccagcaaatatgtggccgaggccagcctccgttacgacggtagcgacaatttcccgcgaggtaaacgctggggaacattctatgccggctctcttgcatgggtcatttcggaagaaagcttctggcagacattaaaagaccgtcatatcttcgaccagttcaaggtaagagcttcttatggcgagatcggttcagacgccatcggacgctatgcttacctgcaatcatacggactgaacgaccgtggctacctgcttaacggaagttggtatccgggattttccgaaggtgccttggtcagcaaagacattacctggtatactacccgcgactttaacatcggattcgatttcggatcgctcaataaccgtctttcaggttctgtagactatttccgcaagagcaccaaaggttatctgacctctccgtcggcagtagcttataccgacccgttgggtagtctt

SEQ ID NO: 1953 - DNA, 183 bp, B.fragilis
aaaagagccctattcctgaaagatatcatccatttgctcttcaaagacataattatcattctgataagtacctctcgcttcgagatcaaaagaaaaaatcaaccgaacgatacaattccccagtacggagacgaaataaatcatacaaagaatgaaatttgcgtaaagaatggaattatttaa

SEQ ID NO: 1954 - DNA, 189 bp, B.fragilis
ttgtattctgggaaattaaataattccattctttacgcaaatttcattctttgtatgatttatttcgtctccgtactggggaattgtatcgttcggttgattttttcttttgatctcgaagcgagaggtacttatcagaatgataattatgtctttgaagagcaaatggatgatatctttcaggaatag

SEQ ID NO: 1955 - DNA, 684 bp, B.fragilis
caagtagctgttaaggccaaatcaattttcgctgacaaaacagtaccaaaaaccactgttgtttcttatcctatctaccacatcgaaaacatcgttaaaccggtgtctaaaggtcctcacgctaaacaagttatcttcttgtcagctgatgccttcggtgtattgcctccggtatctatcttgaacccggaacaagctcagtactacttcctgtctggatttacagctaaattggctggtacagaacgtggtatcactgaaccgactccgacattctctgcttgcttcggtgctgcattcttatcattgcacccaactaaatatgcagaagaattggttaagaagatggaaatgaccggtgctaaagcatacttggttaacacaggatggaacggaagcggcaaacgtatttctatcaaagatactcgtggtatcatcgacgctatccttgacggttctatcgacaaagctcctactaaggttattcctttcttcgactttgttgttcctacagaacttccgggtgttgatccgaagatccttgatcctcgtgatacttacgctgatcctgcacagtggaatgaaaaagcaaaagaccttgccggtcgcttcatcaagaacttcgctaagttcactggaaacgaagctggtaagaagttggttgctgctggtccgaaactctaa

SEQ ID NO: 1956 - DNA, 216 bp, B.fragilis
ggtttgtgttcgttctttttggtaatatacgtcagtttccatacttttccggtaaagataccgttcacatcatccgaatcgttgcatccgcttacaaaagggagcatcaaaagtaataataataagtatttatatttcatttttttctatttttttattccgtttctgattagtaatgcgtcaatcgtaggttcttgtcctctgaaacgtttgtaa

SEQ ID NO: 1957 - DNA, 1128 bp, B.fragilis
gaagtggagccggtcgaaaagaatcatattgcctgtagtaacaggcgacgagttagaacttcgcgtttacacaggcccccaagatctcgccataggttcgtatggcattgccgaaccaaccggagcgccattcaccgattacggaacaatagatctggctgtgattccgggtgttgctttcgatcggtacggacatcgtttaggccgcggcaaaggatattacgaccgtttattacctcaaattccggctcccaaagtcggcatttgtttcccgtttcaattgatagaagaagtacccgcagaagcattcgacttccgtatggatactattatagcacaatgaaaacaaattatcacacacataccactcgctgcatgcacgccgtgggagatgatgaagactatgtacgcagtgccatcaaaggtggctttcaggaattgggcttttctgatcatggcccatggaagtatcacacagattttgtatcggacatacgtatgctcccggaggacttaccggaatatatagaaagcatccgtgccttgaaagaaaaataccggaatcaaatcagcatcaaaatcggattggagtatgaatactttcccgaatacatccactggctgaaagaaatcatcaaagagtaccggttggattatatcctctttggaaaccaccattaccatactgacgaaaagtttccctacttcgggcatcataccactaatcgggatatgctcgacctttatgaagaaagcactatcgaaggaatggaaagcggactgttcgcctacctggcacatccggatctttttatgcgttcctacccagaatttgacaaacattgtatcagtgtcagccgccatatctgtcgggcagcagcccgattgcacatccctttggaatataatatcggctatgtagccatcaatgaagcacggggaataacgacttatccttgcccgcaattctggcatatcgcagccaatgaaggatgcacggctattatcggactggacgcacacaataaccttgatttagaaaatccgacttactacgatcgtgcctgtcaggaactgaatgcgctgaagatgcccgtcatagatacaatcccattcttgaaatactga

SEQ ID NO: 1958 - DNA, 498 bp, B.fragilis
attatggcaacagcatatcataacttatcagattacgattttaattcagttccgaatgcagaagaaatgaaattcggtatcgttgtttccgaatggaacgctaacatcaccggtgccctgctggacggagctgtgaaaactttgaagaaacatggagccaaagaagaaaatatcctggtaaagacagtacccggaagtttcgaacttaccttcggcgctaatcagatgatggaaaatagcgatatagatgcaattattatcattggttgcgtaattaaaggagatactccacattttgattatgtttgcatgggagtgacacaaggcgtagcgcaactgaacgcaactggcgatataccagttatttacggattaattaccaccaacactatggagcaggcagaagacagagccggcggcaaactgggtaataaaggagacgaatgtgcaattactgcaataaaaatgatcgattttgtttggagtttaaataaatag

SEQ ID NO: 1959 - DNA, 1188 bp, B.fragilis
aggcatctttttttgttttgcgacctaaaaccccgaaaatctttctacttttgtaaccaaactcaatgtgcacacatgatactgaagcgtatatctatactgaactataagaacctggagcaggtagaactgaatttttcggctaaactgaattgctttttcgggcagaacgggatgggaaaaaccaatctgctcgatgcggtctactttctgtctttttgtaaaagtgcaggaaatccgatcgattcgcagaatattcgtcatgaacaggacttttttgttattcaagggttctatgaggcgatggacggaacacccgaagagatttattgcggaatgaagcgtaggtcgaaaaaacaattcaaacgtaataagaaagaatattcgcgcctgtcggatcacatcggatttattcctttggtgatggtgtcgcctgccgactcggaattgatagcggggggcagtgacgaacgtcgccgctttatggatgtagtcatttcgcagtatgataaggagtatttggatgctttgattcgctacaataaggcattggtacaacgaaatacattgttgaagagtgaacaaccgatagaagaagagctttttctcgtttgggaagagatgatggcacaggccggtgaggtggttttccggaaacgggaagcatttatcagtgagtttattcctatatttcaatcgttctactcgtacatttcgcaggataaggagcaagtgggactgacttatgagtcacacgcaagaaatgcatctctgcttgaagttctgaaagaaagccgggtacgggataagattatgggttattcgctccgggggatacataaagatgaactcaacatgttgttgggtgactttcctattaagagagaaggttcacaaggacagaacaagacgtacctggttgcactgaagcttgcgcagtttgattttttgaagcgtacgggaagtacggtacctctgttgctgttggatgatatctttgacaaattggatgcttcgcgcgtagaacagattgtaaagttggtggcgggtgacaatttcgggcagattttcataacggatacgaatcgtgaacatttggaccgtatattatataaggtggggagtgactataaaatgtttcgtgtggagagcggagctatcaatgaaatggaggaaaaagagagatga

SEQ ID NO: 1960 - DNA, 1101 bp, B.fragilis
aaacattttcttacttttgcaccgcattctaatgaaacaaatgcgaatttagaaaagtatttgaacaaatattataaaacccttaaaagtttaaacaaaatgattaaagtaggtattaacggttttggccgtatcggacgtatggtattccgtgcagcagttaagaactttggtaacgacattcagatcgtaggtattaacgacttgttggatgctgaatacttggcatacatgctgaaatatgattcagtacacggtcgtttcgaaggcgaagttgctgtagaagacggtgctctgattgtaaacggaaataaaatccgtctgactgcagagatggatcctgctaacttgaaatggaacgaagttgatgctgacgttgtagttgaatcaacaggtttcttcttgactgacgaaacagctcgcaaacatatccaggctggtgctaagaaagttatcatgtctgctccttctaaagactctactcctatgttcgtatatggtgttaaccacacttcatacgcaggacaggacatcatttctaacgcttcttgtactactaactgcttggctcctatcgctaaagtattgaacgacaagttcggtatcgttaaaggtttgatgactacagttcacgctgctactgctactcagaaaacagtagacggtccttctaagaaagactggagaggtggtcgtggtatcttggaaaacatcatcccgtcttctacaggtgctgctaaagctgtaggtaaagtattgccggtattgaacggtaaactgactggtatggcattccgcgttccgacttctgacgtttctgtagttgacctgacagttgttctggaaaaagctgctacaatggctgaaatcaacgctgctatgaaggaagcttcagaaggcgaattgaaaggtatcctgggctacactgaagatgcagttgtttcaactgacttccgtggttgcgctaacacttcaatctacgactctaaagcaggtatttctttggattctaacttcgctaaagttgtttcttggtatgacaacgaatggggttactcaaacaaagtttgtgaaatggctcgcgttatcgctgctaaataa

SEQ ID NO: 1961 - DNA, 1554 bp, B.fragilis
ttttgcgccaaattcataacatatctatatatgcaagagaaaattataatacttgatttcggttcacagaccacgcagcttatcggtcgccgggtgcgcgagttggatacgtattgcgagattgtcccctataacaagtttcccaaaggcgatgaaaccgtcaagggagtgattctgtcgggaagccccttctccgtatatgacgaaagtgcgttcaaggtcgatttgagcgaaatcagaggtaaataccccatcttgggcatctgctatggtgcacagtttatggcgtataccaatggtggcaaagtagaaccggcaggtacccgtgagtatggacgtgctcacctgacttctttctgcaaggacaatgttttgttcaaaggtgtgagagagggtacgcaggtatggatgagccacggtgataccattactgctatccctgagaattttaaaaccattgcatcgacagacaaagtggctattgccgcctatcaggtagagggcgaacaggtatggggagtacagttccatccggaagttttccacagtgaagacggtacgcagatgcttcgcaatttcgttgtcgatgtatgtggctgtaaacaggactggagtccggcgtcattcatcgagagcacggttgccgaattgaaagctcagctgggtgatgacaaggttgtactgggattaagcggaggagttgactcttctgtagccgccgttttgctgaacagggctattggcaagaatttgacttgtattttcgttgaccacggtatgcttcgcaagaacgagtttaagaacgtgatgcacgattacgaatgccttggcttgaacgtgattggtgtggatgccagtgagaagttcttctctgaactggaaggcgtcaccgaacctgaacgtaaacgtaaaattataggtaaaggatttattgacgtattcgatgaagaagcacataaactgaaagatgtgaaatggctggctcagggtacgatttatccggactgtatcgagtcactttctatcaccggtactgttatcaagagtcaccacaatgtgggaggacttcctgaaaagatgaatctaaaactttgtgaaccgcttcgcctgttgtttaaggacgaggttcgtcgtgtaggtagagagttaggtatgcccgagcacttgattacccgtcatcctttccccgggccgggacttgctgttcgtatcttaggtgatattactcctgagaaggttcgtatcttgcaagatgccgatgatatctttattcagggtttgcgcgattggggattgtacgatcaggtgtggcaggcaggtgttatcttgcttcctgttcaatcggtaggcgtaatgggagacgaacgtacttacgaacgtgccgttgctttgcgtgccgtgacttcaacggatgctatgacagctgactgggcgcatttgccttatgaattccttggtaaagtgtcgaatgatattataaataaggtaaaaggtgtgaaccgtgtgacctatgatatcagttcgaagccacctgcaactatcgaatgggaataa

SEQ ID NO: 1962 - DNA, 711 bp, B.fragilis
aaaaataacaaaaagaatcatataaaaatggcagaacaaaagaaccacaacaacgaactgaatgtggaagatgcactgacacagtcggaagcatttcttgttaaaaacaaaaaagcaatcattggcgccgttgtagccgtaatcgtaatcgtagcaggtgcaatcctctacaagaatttctacgcagaacctcgtgaagaaaaagcacaggctgctcttttcaaaagcgaacagtactttgagcaaagtgcatacgaacaagcactgaacggtgatagcattggttctatcggtttcctgaaagtagccgatcagtttagcggtactaaagcagccaatctggcaaaggcatacgccggtatctgctaccagaatttaggtaaatatgaagaagccatcaaagcacttgacggtttcagtggagacgaccagatggtagctcctgccattcaaggtgccattggtaactgctacgctcagttaggccagctcgataaagcaacttctgctcttctgaaagcggcagatcatgcagacaacagtaccttgagccctatcttcctgctccaagccggagaaatcctgatgaagcaaggcaagaacgaagaagcagtaaaagccttcaccaagattaaggataaatacttccagtcttatcaggcaatggatatcgataaatacatcgagcaagctaaactattgaaaaaataa

SEQ ID NO: 1963 - DNA, 189 bp, B.fragilis
aatctatgtttaatagcatacatctgtttatttgtagaatattttgggattaatgtcgtttttaaagtttatatttactcattgtttaatactaaaatcttttattatgagagctttaatttacgtagtttgccttattggggctatgtgcggttggtcatgttcagaccatattgccgattcgtctga

SEQ ID NO: 1964 - DNA, 2151 bp, B.fragilis
gacacgttaaataagaagaaaactgtacggaagtctgtgatactctgtggtgaaatttgtaattttgtaaatgtaacattgatattactgaatatgacaaatatagcaaatgcacaaaatccattttttgagaaatatacaactccgtatggcactgttccttttgacaaaataaaaaatgaacattacgaacccgccattcgtgaaggtatcagtcgccaggcagcagaaatagatgccatcgtcaacaacccggaggctcccacattcgctaacacaattcttgcttatgaaaaatcaggagagttactcgatcgggttaccaccgtattcggcaatttgcgcagtgctgaaaccaatgatgacctgcagaagattgcccaggagatgattcctttgttaagcgaacacagcaataacatcagcttgaatcaggaactcttcgaacgtatcaaagttgtatacggtcaaaaggattccatagagctgactccggaacaaaccaagcttctggaaaacgcttataacggatttattcgtcgcggagccaacctgcagggagaagccaaggagaaatatcgcgagctgacaaagaatcttagtaaactgacattggatttcagtgaaaataacctgaaagaaaccaataactatcagttgactctgaccgatgaagcccagttggccggtctgccggaaagcgccatcgaagccgctgcagaaacagcccgggaaaaaggagtgaatggctgggtgttcacattgcatgcccccagttatattccttttatgacgtatgctgataaccgggatttacgtcgtgaactttacatggcttacaatacaaaatgtacccacgacaacgaatataacaacctggaaattgtgaaaaagatagccaatatccacatggaaatcgcacaattactgggttatgacaattatgcggaatatacactgaaagaacgcatggccgaaaccggtgatgccgtatataaactgctcaaccaattgctggatgcatatacccccaccgcccataaagagtacgaagctgtacaagaattagcccgtacagaacaaggagatgcttttgaagtgatgccttgggattggagctactactccaacaaactgaaagacaggcagttcaatattaacgaagagatgctccgcccctacttcgaactgagcaaagtgaaagcgggagtcttcggactggctaccaaattgtatggcatcacgtttcataagaacccggatatcccggtatatcacaaagatgtggatgcttacgaagtgctggataaagacggaagtttcctcgccgtactgtatacggatttccatccgcgcgaaggtaaacgttccggtgcctggatgacagaattcaaaggacaatggatagaagataccggtgaaaacagccgtccacatgtatcggtagtcatgaatttcaccaaaccgacagaaagcaagccggcactgctgacttatgacgaggtggaaaccttcctccacgaattcgggcatgccttgcatgggatgtttgccaactcaacttatcagagcttgagcggaacgaatgtatactgggactttgtagagctcccgtcccaaatcatggagaacttcgggattgaaaaagaattcctgcatacctttgccaatcattatcagaccggagaaccgttgcctgacgaattgatcagccggctggtagatgcatcaaacttcaatgttgcgtacgcctgtcttcgccaagtcagtttcgggctgttagatatggcctggtatacccgcaatacccccttcgaaggtgacgtaaaggcatacgaacgtcaggcatgggctcaagcacagatattgcccacagtttcggaaacctgtatgagtacccagttctcacacatctttgccggaggatattcggcaggttactatagctacaagtgggcggaagttctggatgcggatgcattctcactgttcaagcaaaaaggaatcttcaatgaagaggtagccaattccttccgtaacaacatcttgtcgaaaggcggaacagagcacccgatgatactttacaaacgtttcagaggacaagaacctacgattgacgcattactaatcagaaacggaataaaaaaatag

SEQ ID NO: 1965 - DNA, 249 bp, B.fragilis
ttactggaaaagagcatttacggaaatatcatctataatatgctggaaaaagaagcctatattcaatatttcaaccaaagcgatcagactgtgaagaagaccgtcgagttgctcgaaagtgaaaaagcattccttaaggctcccgtcagcgtagaacctcaaaaggaggaaaagaaagatggaaagaaaaaaacaactgcgcaagtggatagcacaggagaagaagaaatactccgactctacgcttaa

SEQ ID NO: 1966 - DNA, 309 bp, B.fragilis
aatggaggaaaaagagagatgaaacgaaacgatgcggaaccgattggaaaactgattcagaaatatctgcgtcaggagagcttggagtctccactgaatgagcaacgcttacttgattcgtgggagacggtgctgggacctactattatgtcgtacacaagggatttgtatattcgtaatcaggtgttgtatgtacacttgacctctgctgccctccgtcaggagttgatgatggggcgggaacttttggtccgtaatttgaatcagaaggttggggctacggtgattaccaatattattttccgctaa

SEQ ID NO: 1967 - DNA, 1284 bp, B.fragilis
ctacacatgaaaactccttcgcaaacacatgtgctcggactggcacatcccccacttccgatggtacgccttgctttcatagggcttggcaatagaggtgtattgactctgcaacgttatctgcaaatcgaaggtgtcgaaatcaaagcactttgtgaaatcagggaaggcaatctggttaaagcccaaaagatacttcgggaagccggttatccgcaaccggacggctataccggaccggatggatggaaacgaatgtgcgaacgggatgacattgacctcgtgttcatctgtaccgactggctgacccacactcccatggcagtatactccatggagcatggcaagcatgtagccattgaagttcctgcagccatgactgtagaagagtgttggaagttggtagatacggctgaaaagacaagacagcactgcatgatgctcgaaaattgttgctatgacccgtttgcactgactacgcttaacatggcacaacaaggtgtattcggcgaaataacccatgtagagggagcatacatacatgacctgcgttctatctacttcgccgacgaaagtaaaggaggatttcacaatcactggggaaagaaatatagtatagaacataccggtaatccttatccgacccacggtcttggtccggtttgccagatactgaatatccatcggggagaccgcatgaactacttggtctctctgtccagtcttcaggcaggtatgaccgaatatgcccgtaaaaacttcggagcagactctccggaagcccgccagaaatacttattgggtgacatgaatactaccttgatacaaacagtgaagggcaaaagtatcatgattcagtataacgtagtaactccacgtccttacagccgcctgcatacagtttgtggaacaaaaggattcgcgcagaaatatcccgttcccagcattgctctcgaacccgacgccggctctcctcttgaggggaaagcactcgaggaaataatggagcgttacaaacatcctttcacagccactttcggtacagaggctcatcgcagaaatctgcccaatgaaatgaactatgtaatggactgccggctaatttattgtttgcgcaacggattaccattggatatggatgtatatgatgctgccgaatggtcgtgcatcacagaactgagcgaacaatcggtattaaacggcagtataccggtagagattccggactttacgagaggagcatggaagaaatgccatataagcagaacatcagatctctactaa

SEQ ID NO: 1968 - DNA, 516 bp, B.fragilis
aaaaaaatgaaatataaatacttattattattacttttgatgctcccttttgtaagcggatgcaacgattcggatgatgtgaacggtatctttaccggaaaagtatggaaactgacgtatattaccaaaaagaacgaacacaaaccctatgatttctggggtgataaagacaaatatgaacaatccatcaagaattacatcaataaagaaggtgcatacacaatcaaattcgaaggggagactacagacaatgtcatcagcggaaagtttagcggaacgcttttgtcacattcttataccggaacctggagtgccaatggcgaaagcaatgctttctcagcttccgtaaaagggtctgaaaatgatccgttaggatttagtaacaaatttgtcgaaggactcaacagggctacttcgtacaaagggaattacgacaacctctttatctattacaaggatgagggaggaagagagttatgcctggtatttcatgttgataaggacaacaataaataa

SEQ ID NO: 1969 - DNA, 444 bp, B.fragilis
cagcgtatggacacagcaaacagcaaacaatcagatttggacaagcgttatatccgcatggcttccatctggtcggaaaactcttattgccaacgccgtaaagtaggagcactgattgtcaaagacaaaatgattatctcagacggatataacggaacaccatccggctttgaaaacgtttgtgaagatgataacaacgtcaccaagccctatgttctgcatgctgaagccaatgccatcaccaagatagcacgttccaacaacagtagtgacggtgctacgatgtatgtcactgcttcaccttgcatcgaatgtgccaaactgatcatacaggcaggcatcaagcgagtggtgtactctgaacactatcgcctggaagacggaatagagttactgcaacgtgcaggtatcgaggtcgtttttgtcgatacgagtgaaaaatga

SEQ ID NO: 1970 - DNA, 2028 bp, B.fragilis
actatgagactaaaattaaaacatatatacttctgctcattgatagcaatgggcggattggcgataacttcgtgcgaggattttctcgaccggtcacctatcagccaggtaactcctgagaagtacttcagtacagtagaccaggtagcaaactacctcaataactactacaacgactatctggacgactccagaaattataagctatatcaccaacaggcttggaactcaggcatgcaacgcaacgatgccaacacagacaacctgttggcagacgacagtagcctggattattttgccggtaactggcaggtaggaagcgggaaatcgattcaagctccattaaaccggatccgtacatggaattacctgcttgagcaagtacttcccaaagaaaaagaaggatcgattcaaggatcggttgaggacctgaaacactacatcggcgaagcttacttcttccgtgccatggcctactataaagcattggtgaaatatggcgactatcctatcgtagataaagttctccccgatcaggaagagattttactggagtacagtacacgtgctccgcgcaatgaagtagcccgccagattctgaaagatttggatgaagctatcaaccgtatgcacgaccagggtttccaaaacaaccagcgtatcaacaagcaggtggctcaactctataaatcaagagtagccctgttcgaagctactttcgagaaatatcatcggggaaccggacgtgtaccgggagatgaaagttggccgggtgctaaaatgtcttacaacagcggcaaaacgttcaacattgacggtgagatagacttcttcctgaccgaagccatgaatgcagcagcagccgtagccgaccactgcacgctgaccgaaaactcacacgtgctaaatccggagtatggacaaatctataattggaacccgtattacgaaatgttcagcacaccggatgcttccggttatagcgaggtgttgttgtggaaacagtatgacaaatcattaaatgtttcacattgtgcgcctgcacgtctgcagaacggtgaccgtaccggattgactcgcggattcattactactttcttgatgaaaagcggtttgcctatttatgctgcaggcaacgaatatcacggtgatgtatctatctcggatgaaaaagaaaatcgcgacgaacgtctgcaactgtttgtatggggtgaaaaagatgtattgcacagtgataccaaaaacccagctgtagcagcagccggcacaacactgcttttcggagttccgaatatcatctccgaacagaaacagactcaagaccttacaggataccgcccacgtaaagctcacacttacgattacgcacagactaagggtgacgaactgctggggaccaatgcttgtgttgtcttccgttctgcagaagctaacctcaattacatggaagcctgctacgagaaaaccggttcactggatgccaaggcacaaaagtattggaaagcactccgcacacgcgccggtgttgacgacgattatgccaagactattgcagcaaccgacttgagcaaagaaaatgacttagccgtttactcgggcagcaaaatggtggatgttaccctctataatatccgtcgcgaacgccgttgtgaattcatcggtgaaggtatgcgctgggacgacctgaagagatggcgttcctgggatcaattactgaccaaaccctatatcattgaaggtatcaacttctgggatgccgcttataaagatcacaaggacattaaggacgatggtacccttgatgcaaacgtttcgcccaaaagcgacagcaaatacttacgcccacttcgcagaacctcaatcaataatgaattgtatgacggtctgacttggcgtaaagcattttatctggatccgatcggcatagaagatatgtctttgaccgctaccaatccggaagatatcaacacaactcagttgtatcagaatccttactggccgatgactgccggtaaagcattggaatag

SEQ ID NO: 1971 - DNA, 555 bp, B.fragilis
aacctcaaaaggaggaaaagaaagatggaaagaaaaaaacaactgcgcaagtggatagcacaggagaagaagaaatactccgactctacgcttaaatcgttgtcggaaaaggtattgataactcttgaggcatgccccgaatttcaaaaagggcatactatattgctctatcactcaatgaaggatgaagtgcagacgcacgccttcattgagaagtggagccggtcgaaaagaatcatattgcctgtagtaacaggcgacgagttagaacttcgcgtttacacaggcccccaagatctcgccataggttcgtatggcattgccgaaccaaccggagcgccattcaccgattacggaacaatagatctggctgtgattccgggtgttgctttcgatcggtacggacatcgtttaggccgcggcaaaggatattacgaccgtttattacctcaaattccggctcccaaagtcggcatttgtttcccgtttcaattgatagaagaagtacccgcagaagcattcgacttccgtatggatactattatagcacaatga

SEQ ID NO: 1972 - DNA, 1485 bp, B.fragilis
aaagatatgagtacaaagaactcttcacggtttacccctgtcatcatcgctatcagtgtggtaatcggaattctgataggtacattttatgccaaacactttgccggcaaccgactcggcattatcaacggctcttcgaacaagttgaatgctttgctgcgcattgtcgatgaccagtatgtggacaccgtcaacatggccgaccttgtggaaaaggcaatgccacagattctggcagagctggatccccactctacttacattccggcacaaaacctggaagaagtgacatcggaactggaaggcagcttcagcggtatcggtatccagtttaccatccaggacgacactatccatgtgaacagtgtcattcagggaggaccttccgaaaaggtaggattaatggccggtgaccgtatcgtgatggtagacgacagtttgtttgtagggaaaaaagtgaccaacgaacgtgccatgcgcactctgaaagggccgaagggtactcaagtgaaactgggcgtgaagcgcgctacggagaaagatcttttgaacttcactatcacacgcggtgacattccgcaaaacaccatcgacgcagcttatatgttgacagatgactttggctatatacaggttagtaaattcggacgtactacacatgtggagttgctgaatgccattgctttactgaatcataagaactgcaaagggctgatcatcgacttacgtggcaacacaggaggatatatggaagctgcagtgcgcatggtcaacgaattcttgcccgaaggtaaactgatagtctatacggaaggacgcaaatatccccgtgccgacgaatttgccaatggaacaggcagttgccagaaaatgcccgttatcgtgctgattgacgaaggttcggcttcggccagtgaaattttcaccggtgctattcaggataatgaccgaggtatggtagtgggtcgccgttcgttcggtaaaggcctggtacaacagcctatcgacttcagtgacggatcagccatccggctgaccattgcccgctattatactccatccggacgctgcattcaacgcccttatcagaatggtaaagaccgcaactacgaaatggattggctgacacgatatgaacatggagagtacttctcaaaagatagtatcaagctcgatgaaaacctgcgttattctaccgccctcggacgtccggtgtacggaggaggaggtatcatgccggatgtattcgtcccacaagacaccacgggagtgacttcatatctgaccgaggtgctgagcaaaggacttaccatccaattcaccttccattacacggataataaccgcgataagttgaagaagtacgaagacgaagaatcactcttaaactatatgcgtcgtcagggactggtcgaacagttcatacgctacgctgacagcaaaggggtgaaacgaagaatcatcctgattcagaaatcatattaa

SEQ ID NO: 1973 - DNA, 1830 bp, B.fragilis
aatattttgggattaatgtcgtttttaaagtttatatttactcattgtttaatactaaaatcttttattatgagagctttaatttacgtagtttgccttattggggctatgtgcggttggtcatgttcagaccatattgccgattcgtctgatttatctgtacagacacgtacaattgtatctccggaaggagtttctacttcaaatccggatctgattagtgattgggaacatcaatctttgcttaccctttctactggtgaacggattaatactccatggacgcccggtgcatctcactctatgtcagaagaaactgtatcggatatcaaaaaagaagatggatggactatgctttttcatacttttaaggcattaaatgagtctcccaacagcaattatctctgcttctataatgaattgacaggagttattaaggtgttttattatataaaaaatgctcagggaaataacggatttcagtggagaatcagcactgccaatggggtagggagtagtttattggctttgaacagttatatttctcctttggataacagttctgacaaacccaattgtatgaatctgtctacttttgcacaaacaccaattaatggattgacaccgggatggaatggatttgagtttgaagttccttatactacggattaccgcaatatcagtttatcaataaacagttataatcaggtgataactgatttcaatttttcaggtacaaccgagctgaaaacggaaggtactattacaaaaaatgtagctaacggaggaggtacgacaaaaacggctgctactttggccagttcgggagcaaagaagtatatggatgagttgaagaaaaaagcgaatggacaaccctctaatatagcaggtgatgtgaagttgggtaagaagatcgttgatgcattaacttctggaaactatttttcagcaatagcgaaagggctgaagtttatttttggatctactactacccgacctgaagtatctaaagtgagtttgactacgacaggggttgtaacgatggggggaacttcgcaatctggttcgcatgataatgtggaaccactattttcaattaatttgtatgatttgatgaatggtaatttagctgcattaaaaaagtctccttcttttaattctcttgtattgcctgtagatgttactacacggtcgggaggagaacgctatgcaggagtttggactttgaaagagtctcctgtcatccgaatgacccgttatggacgtgtattgaattataatatatctggtggagtatttactgttgcctctgtattgttaccttacttagattcgaatgtaaataaaaaggcttctgttattttgaatccttatttgagtcaatacgttacttctatgcaaactatggtagatgtggtgtcttgcgcgaagttaaatggcgagaaatatttcaatggttatgccatttcagattttatgtcggaagaccccatatatgaagataaagatttggcaattcgtaagtctgctttttctggatcgggaggtgagatttgtaatcaatcgatatctatttcagattataatataggggatggaggaaatcaaaatatgtatttttttgattggggaactaatataaagggtgatgaagtagctgtggttacagttaatatagcttataactataagggcaaagtacacaatgtctctatatcccggaattataaggtccaatatgtgcatgatcctgctacagatgtaaaaatacttggtactgccggaactaaaaaagtggtaattgtgaataactatccccaatttgaataa

SEQ ID NO: 1974 - DNA, 447 bp, B.fragilis
aaaaagatgggaaaaagtacttttttacaagactttaaagctttcgccatgaaaggaaacgtggtagatatggctgtcggtgtgattattggtggtgcctttggcaaaatcgtttcgtcggttgtagccgatatcattatgccacctttggggttactcattgggggagtgaactttacggacttgaaatgggtaatgaaagctgcggaatatggggctgatggaaaagagacggccgctgctgtgacattgaattacggcaactttctgcaggcgactttcgattttcttatcattgctttttctatattcttatttattaaactgattacaaagttgactcagaagaaagctgaggcacctgctgcgccgcccgcacctcctgcacctacaaaagaagagatattgttgactgaaatacgtgatttattgaaagaaaagcagtaa

SEQ ID NO: 1975 - DNA, 417 bp, B.fragilis
aagcaaggcgtaccatcggaagtgggggatgtgccagtccgagcacatgtgtttgcgaaggagttttcatgtgtagttaggatgttagggttgtatataaaaaaagagaatctaatttctcagattctctttagagcggaagacggggctcaaacccgcgaccctcagcttggaaggctaatgctctatcaactgagctacttccgcaatttttgtgggcaaagatggattcgaaccaccgaagtcgaaagacagcagatttacagtctgccccatttggccactctggtatttgcccttttgtttgcttttgagtccctttgctttctcttaagtaggtttgtttctcaattgcgatgcaaagatacaactatttatttaaactccaaacaaaatcgatcatttttattgcagtaa

SEQ ID NO: 1976 - DNA, 201 bp, B.fragilis
agtcatttattccgatttacgatagaaaatttagttgttgaaatagcaaatatctctttcattaccgtatatgtattatggggggagaaactggaactttcctttgatatctcgttagaaaccaagatattgtggcctttccttcttccttcgggaaatgcttgttttaattctatgttaaagcaagtgttctgtatttaa

SEQ ID NO: 1977 - DNA, 252 bp, B.fragilis
  unsure (58): Identity of nucleotide sequences at the above locations are unknown.
cacttccgagcaggacagatactcaggatatttcctaaaaaagtaacgggtaaagttnatcctacccttcgtccatgcagctctgataccatcctcagagccatcaaggaactgacacaggaaaacatctcctatacttccgaccaaggcaagacctatgatttcaatactgcagacaaactcaacacattggttataaacgctttgggttttaccggccaattgaaggaaatttgggaaatacgatgttga

SEQ ID NO: 1978 - DNA, 2091 bp, B.fragilis
aaagcattacttttgctctacttaaaaagtaatcaaaagccgatgattaaaaagatattagcagcattattgttgtttcctacatttgcatatgctcagataaacacagacagggtgatgatgattgcccgaaacgcgttatactttgaggactatgtcctttccattcagtattttaatcaggtgattaatgcgaaaccctatttgtatgaaccctattttttcaggggacttgccaaaatcaatctggatgattaccagggggctgaagccgactgcgatgcggctatcgacagaaatccttttgtagtgggggcttatcagattcgtgggttggcaagaattaagcagaataaatacgatggtgcaattgaggattataaaaaagcgctccactttgatccggagaatattactctttggcacaatctgaccttatgccatatacaaaaagaggattacaaagctgctgaagatgatttaggcaaattgcttgcagtcgctccgaagtatacaagggcttatttgatgcgtggagaagtcgctttgaaacagcaggatacgttgcgtgccctgaatgactttaatacggccattgagatggataaatatgatcctgatgcctgggcttcccgggccatcgtcaggttgcagcaagggaagtatgccgaggctgaatcggatttaaatcacgcgacacatttgaatgctaaaaatgccggaaactatattaaccgtgctttggcacgcttccaccagaacaatctgcgcggtgctatgagtgactatgacctggctctcgatattgatccgaacaactttatcggacactataaccggggcttgctccgggcgcaggtaggggacgacaaccgtgctatcgaggactttgattttgtacttcagattgaaccggacaatatgatggctacatttaatcgcggattgcttcgtgctcagacaggtgactaccggggcgccattaaggattatacaaaagtgattgatgtatatccaaacttcctggcagggtattatcagcgtgccgaggcacggagaaagattggtgaccgcaaaggtgctgaaatggatgaatttaaagttatgaaagcgcaactcgataaacagaatggcgtaagcaatgctgataaatcggtggcagacaataaaaacggtaataacaaagacgagaataaaactcgtaaaaagtctgataaggatatgaataattatcggaaaatcgttattgcagataattctgaggtggaacaaaaatataagagcgacattcggggccgggtacaggatcgtaatgtgaatattaaaatggaaccgatgtacgctctcacttactacgaaaagatgagtgatgtgaagcgggccgtgcattattataaatacattgatgatttaaatcgtgccggtgttttacccaaacgtctgtatatcactaatatggaatcgccacttaccgaagaacaggtaaagttccattttgcactgatcgatacacatacatcggctattgttgaaaatcccaaagatgcgcgcacacggttttctcgtgctctcgacttttatctggtgcaggactttgccagctctattgaggacttgactcaagccattttattggatgacagtttcttccctgcttattttatgcgttctttggtgcgttgcaagcaattggaatatcaaaaagcggaagaagctaatgccgcttcggcaacaccggccacattgccgggtatttccgctccgcaaaaatcggaagtcagtgcattggattacgacattgtgaaaagtgacttggatcatgtgatcactttggctcctgattttgtttatgcttattataatcgggcaaatgtgttggctatgctgaaagattatcgtgcggcgattgccgactatgataaagctattgaattaaacaaggagtttgcggaagcttattttaatcgtggattgacacatattttcttgggtaacaataaaaacggaatagctgacttaagtaaggccggagagttaggtattgtttcagcatataatattctgaaacgatttacagaggtgccggaataa

SEQ ID NO: 1979 - DNA, 1950 bp, B.fragilis
cataacattatgataaaaataacatttcctgatggctctgttcgtgagtataacgaaggagtaaacggactgcaaattgcagaaagtatcagttcgcgtttggcgcaagacgtactggcgtgcggagtgaacggtgagatttatgatttaggacgtcccatcaatgaagatgcttcggtagtactctataagtgggaagatgaacagggaaagcatgctttctggcacacgagtgcccacttgctggctgaagctttacaggaactgtatccgggcattcagtttggtatcggtccggctattgaaaacggtttctactatgatgttgatccgggagaggctgtcatcaaagaggctgatctgcctgccattgaagcgaagatggctgagttggttgcaaagaaagaggctgtcgtgcgtcgggatattgcaaaaggcgatgctttaaagatgtttggcgaccgtggagaaacatataaatgtgagctgatttccgaattggaagacggacatataactacatatacacaaggtgattttacggatctttgccgtggtcctcacttgatgacaactgctcctattaaggcgataaagctgacttctgtggcaggagcttactggcgtggccatgaagatcgtaagatgctgacccgtatatatggtatcactttcccgaaaaagaagatgctggatgagtatctggctttaatggaagaagctaaaaaacgcgaccatcgtaaaattggtaaggagatgcagttgttcatgttctctgatacggtgggtaaaggattgcctatgtggttgccgaaaggtactgctttgcgtttgcgcttacaggacttcttgcgccgtatacagactcgttatgactatcaggaggtgattactccgcctatcggtaacaagctgctgtatgtgacttcgggacattatgcgaaatatggtaaagatgcattccagcccattcatacaccggaagagggtgaagagtacttcctgaagccgatgaactgtcctcatcattgtgaaatttataagaatttcccgcgttcgtataaggatttgcctttacgtattgccgaattcggaactgtttgtcggtacgagcagagtggtgagcttcacgggttgactcgtgtgcgtagttttactcaggatgatgcacatattttctgtcgtccggatcaggtgaagggagaattcctccgtgtaatggacattatttcgattgtcttccgttctatggatttcgataacttcgaagcacagatttctttacgcgataaagtgaatcgtgaaaaatatatcggtagtgatgaaaactgggaaaaagcagagcaggccattattgaagcatgtgaggaaaaaggattgaaggcaaagatagaatatggtgaagctgctttctatggccctaaattggattttatggtgaaagatgccatcggtcgccgctggcagttaggtactatccaggttgactataatttgccggagcgcttcgaactggaatatatgggatcggataatcagaaacaccgtccggtaatgattcaccgtgctccgtttggatctatggaacgctttgtcgctgtattgattgagcatactgccggtaaattcccgttgtggttgactccggaacaggtagttattctcccgattagtgaaaaattcaacgaatatgcagagaaagtgaaaacttatctgaagatgaaggaaattcgtgctattgtagatgatcgtaatgaaaaaatcgggcgtaagatacgcgacaatgagatgaaacgtattccgtatatgctgattgtcggtgagaaagaagccgaaaatggggaagtttctgttcgtcgacagggcgaaggggacaaaggaaccatgaaatttgaagaatttggtgaaattttgaacgaagaagttcagaatatgataaataaatggtaa

SEQ ID NO: 1980 - DNA, 1266 bp, B.fragilis
aaaagactaattgcgaattatacttttatacacctaattataatcaacatgagacaaaaatcacttcttttactgctaccctttctgctactatcttgcggaggaaaaaagaacagcggacagttgtctgacaccgcagtccaaatcgttaaacccgaatttccacaaattgtaccttttgaaacaggcatcgaaacagaacaagagatactattgagtgagattgccgattcgattcggtacatcccgttggaaacgaacaataaatgcctgataagagggttaaagggaagcaatatcatccggacaaaagaatatttcttcctaccatggatcgataaattatttcagtacacaaaagatggtaaattcatacggacactggggcgcaaaggcggcggaccgggtgagtttaactggatcatgcagatcgatgtggatgaaaaaaaaggattggtctacatgttaacaactacggggaaaatcaatatctattctatggaaacaggtaaattcatccgtgcaatgaaagttcctaatatagaagtaagtgagtttgcgatgttacgtgttcaggatacaattgctgcaacattcatgcgcaataataacggaaaacgtaaagaacgtatttacctttctaatctgaaaggtgacacattgaaaattttcaatcgttgggacctatttgacttaaacagtaaatatcgctggatgatcagcagtgacatagatcgttatatgttccattacaaaagccatacctgttataaagaatattataacgatactctatttactattacccaagaaactttggagcctcgatatatattccaaatgggtaagtactctttaccgatagagtgcagatttgaatatctgaacggcgatgggaagcgctttcaggaagtagctgctccttacatccaatacaataccatagagactgactcttacatattcatgccttactctaattgggcaggagagaaagcgcaagaaaaacaaatggctatttacgataaaaaggccaaaaactgttttaaagtatccacaggccatataaagaatgacttgactccaggtctgccattacgcccgataacagcacttgacagccatacgctgttatatgtatgggaagctcctgaacttcttgaaaaggctgaaaaaactccttccatcctccaaatcgaaccattaaaaggattgaaggaagacgataacccggtaatgatgatagtatatttaaaacaaccataa

SEQ ID NO: 1981 - DNA, 348 bp, B.fragilis
ttaaatttggtagacaataaaaaacaaactggaagtaaacgttatttaatgaagaatgacagcatgaaatcgcaataccggatcaatgaacagatccgtgcgaaagaagtccgcattgtaggtgatgatgtagaacctaaagtatatcccatttttcaggctttaaaattggctgaagaaaaagaactggatctcgtggagatttctcccaatgcccaaccacctgtttgtcgtattattgactactctaagtttctgtatcagttaaagaagcgtcaaaaagaacaaaaggctaagcaggtaaaagtaaatgtaaaagagatacgttttggtccgcaaacagatgac

SEQ ID NO: 1982 - DNA, 225 bp, B.fragilis
tattcaaaatcaaaatgcgtaaggtttatgaaaattgcagaaattaaagaaatgtctactaatgatttggtagaaagagtagaagcagaagtggttaattacaaccaaatggttatcaatcattctatttctcctttggaaaatcctgcgcagatcaaacaattacgcaggacgattgcgcgtatgagaacagagttacgccaaagagaacttaacaataaatga

SEQ ID NO: 1983 - DNA, 441 bp, B.fragilis
gaaactatgttacaaccgaaaaagacaaaattcagaagacaacaaaagggccgcgctaaaggtaatgcacagagaggcaaccagctcgcttttggatcttttggtattaaggctttagaaactaaatggatcacaggccgacagattgaagctgctcgtattgcagtgacaagatatatgcaacgtcagggacagatttggattcgtattttcccggataaaccgattactagaaaacctgctgatgtacgtatgggtaaaggtaagggtagccccgaaggattcgtggctccggttacaccaggtagaattattattgaagctgaaggagtatcttacgagatcgcgaaagaagctttgcgtttggcagctcagaaacttccgattactacgaagtttgtcgtgagacgtgattatgatattcaaaatcaaaatgcgtaa

SEQ ID NO: 1984 - DNA, 735 bp, B.fragilis
atgggacaaaaagttaatccaataagcaaccgtttaggaattatcagaggatgggattctaactggtatggtggaaatgattacggtgactctttgctggaagatagcaagatccgtaaatatcttaatgcaagacttgcgaaagcaagtgtatcaagaatcgtaattgaacgtacgctgaagctcgttactattactgtttgcactgctcgtccgggtattattatcggtaaaggtggccaggaagttgataagttgaaggaagagttgaaaaaggttaccgacaaagatattcagatcaatatctttgaagtgaaaagaccggaactggatgctgtgattgttgctaacaacatcgctcgtcaggtagaaggtaaaattgcctatcgccgtgccattaaaatggctatcgcaaatacaatgcgtatgggtgcggaaggtatcaaaattcagatttcaggacgtttgaatggagctgaaatggcccgttctgaaatgtataaggaaggaagaactccgttgcacactttcagagcagacatcgactattgccatgcagaagcattgacaaaagtgggtcttctcggtattaaagtttggatctgtagaggtgaagtttttggtaagagagaattagctcccaactttacacaaagcaaagagagtggtcgtggaaacaatggtggaaacaacggcggcggaaagaacttcaaaagaaagaaaaataatcgctaa

SEQ ID NO: 1985 - DNA, 633 bp, B.fragilis
aaaataatggaagttaacgtatataacattaaaggtgaagacactggaagaaaggttacgttaaacgaatctatcttcggaattgagcccaatgaccacgctatctatctggacgtaaagcaatttatggctaaccagcgtcagggtactcacaagtcaaaagagagaagcgaaatcagcggatctactcgtaaaatcggtcgtcagaaaggtggcggcggtgctcgtcgtggtgacatgaattcaccggtactcgtaggtggtggacgtgtatttggtcctaaaccaagagactactacttcaagctgaataaaaaagttaagacattggctcgtaagtcagctttgtcgtataaagctcaggacaacgcaatcgtagtggtagaagacttcaactttgaggctccgaagactaaggttttcgttgaaatgacaaaaaatcttaaagtttctgacaaaaaactgcttgtagttttaccagaagcaaataaaaatgtatatttgtcagctcgtaacatcgaaggtgctaacgttcagactatctcaggattaaatacttacagagtattgaatgctggggttgttgtgcttactgaaagctctttgaaggctattgacaatatcttaatctaa

SEQ ID NO: 1986 - DNA, 273 bp, B.fragilis
actatgagtcgttcattaaaaaaaggtccatatattaacgtaaaactcgaaaagaaagtgcttgctatgaatgaatcaggcaagaaagttgtcgttaagacttggtccagagcttcaatgatttcgcctgattttgtaggccatacagttgcagttcacaacggaaataaatttattcctgtatatgttaccgaaaatatggtaggtcacaagttgggtgaattcgctccaactcgtacattcagaggacacgctggtaacaagaaaaaataa

SEQ ID NO: 1987 - DNA, 840 bp, B.fragilis
caatatttaataaaaatggcagtacgtaaatttaagcccacaacaccggggcaaagacataagattattggtactttcgaggaaattactgcatcagtaccagaaaagtcgcttgtatatggtaaaaaatcatctggcggtcgtaacaacgaaggtaagatgacaatgcgctacttaggtggcggtcatagaaaagtgatcagaattgtcgatttcaagagaaataaagacggtgttccggcagttgtaaaaacgatcgaatacgatccgaaccgttcggctcgtatcgcattgttattttatgctgatggtgaaaaaagatatattattgctcccaatggattgcaagttggtgcgactttgatgtcgggagagaacgctgcgcctgagattggtaatgcgcttccgcttcagaatatcccggtcggtacagtaattcacaacattgaattgcgtccgggtcagggtgctgctctggttagatcagcaggtaacttcgctcagctgacttcaagagaaggtaagtattgtgtaatcaaattgccttcaggtgaagtaagacaaatacttagcacttgtaaagctactatcggtagtgttggtaactcagatcatggattggaaagctcaggtaaggcaggtcgctctcgttggcagggccgtcgtcctcgcaaccgtggtgttgttatgaacccggttgatcacccgatgggtggtggtgaaggacgtgcttccggaggtcacccaagatctcgtaagggattgtacgctaagggacttaagactagagctccgaagaaacaatcgtctaagtacattattgagagaagaaaaaagtaa

SEQ ID NO: 1988 - DNA, 294 bp, B.fragilis
ataatgggaattattattaaaccgttggtgacagagaaaatgactgcaataactgataagctgaatcgtttcggctttattgtacgtcctgaagctaataaactggaaattaagagtgaagttgaagccctttataatgttacggtagttgatgtgaatactgtgaagtatgctggcaaaaataagagccgttatacaaaagcaggtatcatcaatggtcgtacgaacgcttttaagaaagccatcgtgacattgaaagaaggagatactattgatttttatagcaatatttaa

SEQ ID NO: 1989 - DNA, 195 bp, B.fragilis
actgcaactgtatggcctacaaaatcaggcgaaatcattgaagctctggaccaagtcttaacgacaactttcttgcctgattcattcatagcaagcactttcttttcgagttttacgttaatatatggacctttttttaatgaacgactcatagtttactcaattaatcagattacttttttcttctctcaataa

SEQ ID NO: 1990 - DNA, 270 bp, B.fragilis
atgatcagcttgatggaagcaagaaatttaagaaaagaaagaacaggggttgtgctgagcaataagatggaaaaaaccattaccgttgctgctaagttcaaggaaaaacaccctatatatggtaagttcgttagcaaaacgaagaagtaccatgctcacgatgaaaagaatgaatgcaatgtaggtgatactgtacgcatcatggaaactcgtcctttgagcaagactaaaagatggagattagtagaaataattgaaagagctaagtaa

SEQ ID NO: 1991 - DNA, 432 bp, B.fragilis
aataataaagtaataaatataatgggagcaagaaaaaaaatatcggctgaaaagagaaaagaagcccttaaaaccatgtattttgctaaattgcaaaatgttcctacttctcctcgtaagatgcgtctcgtggctgacatgattcgtgggatggaagtgaacagagcacttggcgttttgaagttttcttcaaaagaagcagctgcaagagtggaaaaattgttgcgctctgcaattgctaactgggagcagaaaaacgaacgtaaagctgaaagtggcgaattattcgtaacgaagatttttgttgatggtggtgctacactcaaaagaatgagaccggctccgcagggaagaggatacagaattcgcaaacgttcaaatcacgtaacattgttcgttggttctaaaagtaataacgaagatcaaaattaa

SEQ ID NO: 1992 - DNA, 734 bp, B.fragilis
cctggtgatccagtaaaagtaactcaaaaacagaatcatggtatggctatgagaaagacaggctatataactatccttctgacgggatttctggcaacgctcttgttgggtagctgctcaacagatgatgttgccgaactccccttggaagaaggggttccggttcgttttgaaataaagcgggatgggatcatgagtcgtgcgccgggagatgcagctctttctgtcaacaggatattgattctgccttttcggaaaacggatgaggcatcgtccaacgatgcagctaatttcattccggaatatagtgcagcccgacaattggacgtcaactcgtttccggcagtagtcacgatgcttactctttcggcagcctctacctatcagttgttggtgatcggatataatcggagtgattatgattttaccggtggcgggggtgcgacgaaacggtttaatatcggttcgacagatactccggctacattggctaatttgtatttgcaaccggtcaatccgacggtagttccggagttcttctcgtgtttcggaaacggttaccggggtgcaacgttggttggtcccatttttaaaccttcacagatcaactatgtgacgggtacgctgaaaaggctggttagcggttttacacttgaagtgaccaatgttcctgcgtatgtcaactctatgacatgtcttcaccacggggctggaaggatccgcggtggttctat

SEQ ID NO: 1993 - DNA, 1203 bp, B.fragilis
tccttccacccccgtggtgaagacgtttcgtggttaagtttgtttgatattggaatcggaaatggattgaaaaataaattgacagaatctttggctgtaaataatattgagtattcaagaaaattggtaagtacatcatatgtatactctgcactaatcttttctgttatattagtgatatctttgattatcaattgttttattaaatggaatctacttttgaatgttgagcaaatatttaataatgatctaactataacagcttttctggtaattatagcattttgtgtgaggtttatacttcaaataataactccagtattggctgccacgcaaaatataagatttaattcattaatagaatttattgggcaaattggggcttttattggggttatacttcttaattatttaggagtaaaatctattattatttttacaatagtagtattatatgttccattgataattttgtttgttttttcaatttatttatattctaataaattgaaggaattaagaccttgtattagattttctgataaacagcatttttctgaaatcttttctcttggtattaatttttttattatacagatatctgctattgtaatattccagactaatagttttcttatagctaatagttttggtcctgctgatgttactaaatacaatattgtttttaaatattataacattctaatccttttgtggggtattcttatgacacctttatggccatcttatacaaatgcatatatactaggaaactataaatggattaagaaatctgtaaaatactgtttgtttatgtttttattaacaataatagtggctgttattatggcttttgtaggtccagcagtcattgaatattggctagggcaggacttgaatataagcagatctttattattggcaatgctcctatttgcattggtaagcatatggaataatatttttggatgtgttgttggggctattggaaaggttagattaggtgtttattcaactagtttatctgctttgatattttttccattattttatcttcttaaatctttacgattagctattgaaggagctatttggagtatgataatttgtatctcattaagcgcttttctatcccctattcaaatatattattttatttatacgaagaaaaagtctttattcttaacgaaattattgagctaa

SEQ ID NO: 1994 - DNA, 186 bp, B.fragilis
aacaattcgttcaatcactcagaaatcagtatcctaaaaccgagatactttccctatggtagttttgtaagcgaggcaccgttgctccgcataagtcaaatatcaacagaaagattatgcatttgttttgccatgaatcattattatctgttaaagttatatcccgtcatccaattgtttaaatga

SEQ ID NO: 1995 - DNA, 1152 bp, B.fragilis
tttacaaagttttaccctatgaaattaataattaatgcttctactttaagtggaacgggagttactcaagttgcggtttcatttattgaagaatgtaaacgatttgaggaaaattattatttcgtttttctaagtaatcatgtttatagtcaagttgaaatagagaaattcccttctaattttaaattttatgttatagataaacatcctagatattttatagaaggttattctacaaggcgatatttaagaaccatggaagctataataaagccagactgtgtttttagtatttttggcccttcttattggactcccaaagcaccccatttaatggggtacgcctatccacattatgtatatccagagtctcctgtttttgatataatgactgttaaagataagatacgtttttgcttgtataaaaaaatacataaatactttttgaaaaaaaatggattttattatgtttgtgaaacagaagatgtgtctaatcgattaaagaaatatttgggaatatcctctgatagagtatatactgtttctaatacatataatcattattttgaccaatttaagctccctttgaattcatttgtggagaaagatgttacagagtttaagtttctaagcttatgctcttttgctgttcataaaaacttgcaaatattgaatcaggtaatcccactattaaatgatactttaaaaaacataaaaattattttcgttttaactgtagatagtaaaagttttaagtattatttgtctgaagaggccaaaaagtcaattgttaatttgggaattattgatgtttctaaatgtcctcaactttataatgaatgtgacgcattatttttaccaacattgctcgaatgttttagtgctaattatgtagaagcaatgaagatgaggaagcctattgttacttctaatcttccttttgctactaatgtatgtaaaaatgcagcattatattttgacccaatgaatgcgcatgatattgttgaaaaaatttctcttttggtacgaaataagcaattatatcgaaatttgtgtcttgagggagacttggtgttgaaaggttttaaaacatctcaagaaagagcaaaatcttatttggaaatttgtaaatcaataattcggaaagtatga

SEQ ID NO: 1996 - DNA, 1224 bp, B.fragilis
atcaaaattactttaataattatgattcatgtcgatttgagtaaacgtaattctattttttcattgatattagtctggatatttttgacaagtacagctccttttgtcttttttagatggcctgggcatccctataaaacattgtcttttttatgcttattcactatggtttttcatttaaatgttggacgaggtgttaagcgggtagatagttccattttcgctattgtcttgttgcaaatatgttattatatattgatctctttctatcattctgattttaaaaatattaatctttgtatacaacttatttcgttgtgcattattatatcctatattaagatctatgtcggatttgatgtttttgtgaagtcatttatctggataatgttaattatgggtgtcggtggaaccttgaccttttttttgcatttattgggtttgataactcctatattcagagttgaatatggatctgatatatcttattttttaggtttgacaacaacaaatgttttttttgatagtgaaggtattagggtaattcgttatgctggtttctttgacgaaccaggtactttctctttgttctcaatttttgccttaatattgaataaggtatattttaatgataaaaataaggaactcttacttatattggtaactatattcactttctcaatagcattttatgtaacaatatttttttattttttattcttttatgtgactaaaaaagatatgaaatatgtaccattaataatatccgtagtttttatttgttatctttctttgcagaatagtaatggtggctctcttggtacaatatacaaactgacatttgaaaggttggatttttctgaagatgctagaggtaataataatagagctggcccaatggaaaatgatagacgaatattttttaataatttcttgcttggagtaggacttgggagtgaagaagtggagggttctaatgtttttgctgtcttcgcacgatatggtgttattggttcgtttttcttttatgcgtttctgatttatttattgttattaattgtcaatgttccattggaaaatcgaaaattattttttaaaatatatattgtgatacttttgacttttttttatagaccagaactttcttctgttatggtacttttagtcttttatatgcttattgattatataaaaagtaagaaatatttaaattgtaagaactga

SEQ ID NO: 1997 - DNA, 282 bp, B.fragilis
ggaaaaatgactaaagcagatattgtaaacgaaattgcaaagaacaccggtgttgacaaagtaacagtacttacaacagttgaggcatttatggatgcagtgaaagattctttgtctaaggacgagaatgtttacctccgtggatttggtagcttcgtcgtaaagaaaagagctcaaaaaaccgctcgtaatatttctaagaatacgactatcatcattccggaacacaacattccggcgttcaaaccagctaagacattcaccctttcggtaaagaaataa

SEQ ID NO: 1998 - DNA, 930 bp, B.fragilis
tatatgaatgcacttgttactaatcctttggtatctatagtaattccggtatataacagagaactatacatagaagatgctataaaatctgctattagtcaaacgtatcaaaatattgagattattatagttgataactgtagtacagatttaacttggagtattttgaatacatgggcaagcaaagatcatagaattaaaatatatcagaataaaactaatataggacctgttttaaattggaatgaatgctttaagcatgcttcaggtgagtatataaagattctttggtctgatgattggatggcattagattttattgaaagagcagtgaatctaattgatgagaagtcagcgtttgttatatcaaatcataagatcgtatcagaaaatggtattgtagataatgtaaagtataagaaacaaaaatatacaagaaaagagtatctgtataatatattatttcaaaatattgagaaattcccattatctcctggatgtgctctttttagaacgaaagatttgaatgataactttgttatagatattcctaatactgatggactggattcaaaaaaaaatggtgcaggtaatgatctattgatttttttaaatatcgtgctaaattatgctcatatttcaattttacaatatgatggtagctttttcagagcacataaagagtccttctctattcaaaatcagttagaattgtattatgagtgggctaaagtctattttattcaaaaaaaactgaataaaacttattattctaatataaaaaaaataatgttttggcaacaaataaataaaggtaataagatttatcataatttatatgtgtgtctgaaatataattattggatgccactctcattttgcatcattatcttgggtggagttttaaattctttgagaaatagaaagtaa

SEQ ID NO: 1999 - DNA, 966 bp, B.fragilis
aggagctatttggagtatgataatttgtatctcattaagcgcttttctatcccctattcaaatatattattttatttatacgaagaaaaagtctttattcttaacgaaattattgagctaatgaataatttgttgtccatttttatacctacttataataggtgtaatgttttagatactgttttagatcgtgtcattagttctgtaaaagaatatgatgtttgtgtacaagtgtatgataattgttctcttgataaaacagaaaatattgtatgtgcaaagcaaaagttgtatccttatatattctattgtaaaaatgaaactaatatagggctagatcgaaatatgcttaatgtccttaataaacaagtctctaaatatacattaatgttgggagatgatgattttttggtagatgatttttataagaaaatagaatcttacttaaaacaatgttttgattttattgtcctttctgttgattcgacatttaaaacaactgtttatgtagagaaattgagtgctttctcttttttatgggataaaatgccatatggtactgtaataattagaaatggattaataaatcgttgtgatgttgagaaatatattggtactagtcatgcatattctgctattccttgggaatcaatgttgagtagcaatgcaattggaaaatgtttgttttattcagattatatactagtagagctgggagaaattgagaaaacttggaaatctaatgctatagatatttttatgtatcaaatacctttgtggttttcaatactacctgaacaatatatcatgaaaaataagatatataggggctatatgagaaatcttttttctttaagaaatatttggtctttatataggcgatataattttaagagtttaagtagtatgcggtttttgtcaaatattaataagtttaaatttgtgttaattagtagattgcaataa

SEQ ID NO: 2000 - DNA, 951 bp, B.fragilis
cttatgtattatctgataatcttagttctgctatttctggcagaacttttttattttcatattgccgataaatataatattatcgacaaaccgaatgaacggagttcgcatacccggattacactgcggggtggaggaattatcttctacttgggtgcattggcttattttctgacaaatcagtttgagtacccttggtttatgttggctctcactctggtgacggtgatcagctttgtagatgatatccgctccatatcacaaggacttcgtcttgtttttcattttacggcgatgggcttgatgttctatcagtgggagttgtttactcttccctggtggactgtagttgtggctttgatcgcatgtacagggattatcaatgcctataattttatggatggaattaatggcatcacggggggatattcgctggttgtacttggatctttggcgtttatcaatcattgggttgtttcgttcgttgaaccgggtttgatttataccatgctgtgtgcggtgctggtttttaatttctttaatttccgtaagagggcaaaatgctttgccggtgatgtggggtcggtcagtattgcttttattattctgtttttaatcggtaagctgataatcgatacggaagattttagttggattgtgcttctggcagtatatggagcagacagtgtgctgactattgtccatcgattgatgttgcatgaaaatattggtctgccccaccggaaacatttgtatcagataatggctaacgaactgaagatacctcatgtcgcggtgtcattgacctatatggtggtgcagggcgtagttgtggcgggatacctggtattgcgggagtacggatatgtatatttggcaggaagcatattgctgttgagtatattatatttgttgttcatgaagagattctttcatctgcaccagttttga

SEQ ID NO: 2001 - DNA, 963 bp, B.fragilis
atgaacattcttatttctggtatttgtgggtttgtggggactaacttgattaaagtcttaaaaaaggtgcatactctttatggattggatattatagatgttgaaaagcagatggacataaaaagattctcttggacagaatttgaaccttctgcttttcctcttcaaactctgcctaagtttgatgtcattattcatcttgccggaaaggcccatgatactaaaaaacaatcggccgctcagtcctattttgatatcaataccggtctgactcaaaagatatttgacttctttttggagtcttccgccaagaaattcattttctttagttcggtgaaagctgctgccgatagtgtagtaggggatgtacttactgaagacgtgattccgactccggtaggaccctatggcgaaagcaagatacaggcagaggagtatataaagaagcattttacattctcaaacacggataagcaggtgtatattcttcgtccttgtatgattcatggtccgggtaataaaggaaatctgaatctattgtataatgtggtgaagaaaggcattccctggccattgggtgattttgaaaatcgccgttcatttacttcaatcgataacctatgttatgtgattgagggattattgacaaaagatgtcccttcgggtatttaccacatgggtgatgatgaagctctgtcaacgaatgaactgattgccatcatgtgcgaggtaatgggaaaacagcctcacatctggaaaatgaacaagcgttttatggaaggatgtgctggactggggactttactccacttgcctttgaataccgaaagacttcgtaaactgacggagaattatgtagtaagtaacaccaagataaaggttgctttggggattgataaaatgccggtcaccgctaaagaagggctgataaagactattcgttcatttgaagaaactgaataa

SEQ ID NO: 2002 - DNA, 762 bp, B.fragilis
aaagtaatatattattttatggataagagtggggctgatcctttgttttcgattattacagtatcatataatgctaaagaaagtattgaggatacgattaacagtattgttaatcaaacgtattcaaattttgaatatattattgttgatggaggtagtacagatggaacattagatataatacgaaaatatgaggataaaatttcatattggataagtgagccagataatggtatttatgatgcaatgaataaaggattggctatttgtaaaggtgaatggattaattttatgaatagcggggatctattttataatgatcatgtattggttgatatctatagatattgtgattttaaaaaatttcatattttgtatggtaaaacagtagtaaaggaaacaggaagagtcattgtacctcctttgaaaattagaaaaaagtattttttacttgatactatctgtcatcagagtattttttttaatcgatctatatttatggatttaggtacttatagtttagattataaaattatagctgatagagaccttttacttaaatcaattatcaatgaaaaaagatttttatatgttgatgtggttgtttccttgtgggagtctttggggttttctggaaataatttgaaattatttaaaaatgaagagaaattgttggttaatagaaatttcaatactgttgaaatctattttattcgtataaattataaatttagacaatttcttaataaattaaaactatga

SEQ ID NO: 2003 - DNA, 720 bp, B.fragilis
cgagccttccacagaggaagaagcttcctgatatcagcttttgccatggctttgttacgggaatataaagaaattgcttatcagtggggaatctggaaaacagaagagtccccggaagaacttttggcactgttgcccgatccggaaagatatgagcaacagttgacgcgcttttcttcacctcatcgtaaattggaatggctttccgtacgtgtattgctatatcagttgctgggggaggaaaagacaattgaatatgctcccagtggcaaaccccatttggcggattcttcttatttcatcagcatttctcacactcgcggctatgtcgcagttatactgagtcccgtgtccgaagtgggaatcgatatcgagcaatacgggcagcgggtgcacaaggtcgctcataaatatatgcgtccggacgagttgatttctgaatatcagggagaagatacctggtctttacttttacattggtcagcaaaagaagtgatgtttaagtgtatggatacttcagaggtcgattttagggagcatcttcgcatcatgccgttccaggtatgtgaacacggggagtttccggcggaagaataccgtacggaacataagaagaagttcatgatccgctatttgctgcatccggactttgtgatgacgtggcaagtgacatctgcgtattccgtgaatgaatgtgatattatgaagaaaatgcaatga

SEQ ID NO: 2004 - DNA, 1215 bp, B.fragilis
actacaatacatcagaaggaatctgggaaatcaagatgttcatccgtggagaatggatcacgatacatcgcctggatattttctgatcactttttctcttatctatttattaaactaaactttgctattatgaaaaaattaatgtttctggtggcagcaagcttatttgtgtttgctgcttgttccagcgaagatgattcttcacccgaagtgaatcctgaaaatgctgcaattacatttgagctatctgcggttaatggtctgacagacggaattggaacccggatgccggtgtatagccaggaggccacacagcatgtcactcgtgtcagtgtttatgcttttgtgcagaacggctcgacctatctgcatcaaaagacttatgatatcaccggctggaccgatggtactacctttaaacgtttcgctgttcccgatgcggataaacttcctgtcggcgtatataagtttctggccgtaggacgtgatgcaactgaccgcttctctgtgactacacccacttccggcaataccaattatacggatatgcttgcttctattgtgaactcgggcgatgaatcggaaatctttgcgggttcggccgatgcggaagtgatggcccagggaggaactcgtgtcagcattgagatgacccgtaaggtggccggtgtgctgggatacttcaagaatgttcctcaagtgctaaacggaagtaccgtgaagtatctgcgtctgaaggtcagcaactccaaccaacaggtgaacctgactaatggtgtggggatcaatacagcgcctactccttataatataatagacatggatctttccgggcaggctgtttccaacggtgtgtatgtaggtaacgatctttccggtcagggagtggtaaaagtgcctaattcgcaattgggaggttctttctatataccggttagtggcgtgagcatgactttgggactttatgacgcaagtggtgtagctatcaaggagtggactgtgagtgatactaacagttcgggagcaacacagttcaatctgatggccaatcatttttattcattgggtgtgaaaggtgctacgggcagtgtagatggtggaacaccggggaatccgggtgacgatgacgctccggtagatttattgaccgaccagaacattgtaatcactatcagtccggcatgggaactgattcataacctggtgatccagtaa

SEQ ID NO: 2005 - DNA, 1362 bp, B.fragilis
cttaaaaccaatattttggacccagacgcttatttatgccaattggcagaaatttttaacggaatatccgtaaacacaccttcattatcggcaataatagccattattctggcaggtttgctcctgctcgcctcgggctttgcttcggcatccgaaatcgctttcttctcactttcgccttccgatctgaatgatatagaagaaggcaatcatccttctgatgggaaaatcagcaatctgctcgcagactccgaacgtttgttggcaaccattcttatcacaaacaactttgtgaatgttaccattatcatgctctgtaacttcttctttatgaatgtctttgtctttcattcgcctcttgcagagtttttgatactgactgttatcctgactttcctcttgttgcttttcggagagattatgcctaagatctattcggcccagaagacattggctttctgccgtttctccgctccggtcatctatgtgttgcgtaaagtatttgctcctatctctgctgtgttagtacattctacggctttcttgaataaacattttgccaaaaagaatcacaatatatcggttgacgaactttctcatgcccttgaactgaccgacaaggccgaacttacggaagaaaataatatactggaaggcatcattcgttttggtggcgaaacagccaaggaggttatgacttcccgcctcgacgtggtcgatcttgatatacgtactccttttaaagatgtaattcaatgtattatcgacaatgcgtattcccgtatccccatctattcgggcacacgtgataatatcaagggggtactttatatcaaggatttgttgccccaccttaataagggtgacaatttccgttggcagtcactgatccgtccggcgtattttgtgccggaaactaaaatgatcgatgatcttttacgtgattttcaggcaaataagattcatattgccattgttgtggatgaattcgggggtacatcgggaattgtgacaatggaggatatcattgaagagatcgttggggagattcatgatgaatatgatgatgaagagcgtacctatacggtgattaacgatcatacctgggtgtttgaggctaaaacgcagttgaccgatttttataagattacgaaggtcgacgaagatgattttgacaaagtagatggagatgccgatacactggccggactgttgctcgagataaagggagaatttccggcactccatgagaaggttctctatcatcgatacgaatttgaagtgctggctatggatagccggagaatcctgaaagtgaagtttaccgttaacgagccttccacagaggaagaagcttcctga

SEQ ID NO: 2006 - DNA, 195 bp, B.fragilis
cttcacaaaaacatcaaatccgacatagatcttaatataggatataataatgcacaacgaaataagttgtatacaaagattaatatttttaaaatcagaatgatagaaagagatcaatatataataacatatttgcaacaagacaatagcgaaaatggaactatctacccgcttaacacctcgtccaacatttaa

SEQ ID NO: 2007 - DNA, 1113 bp, B.fragilis
ttaaacgaaaatgactacttttgtgcaaggataaagttaacaaaaagtagaatccgtccaaaaagcatgaaccggaatttcagcaatgcaatagagaattggtacaaggaatataaacgtgaacttccctggagggattcggcagatccgtatgtaatatggatatcggaaatcattcttcagcaaacgcgtgtggtgcaggggtacgattatttcgtccgctttatgaaacgttttcccgatgttgccactttggccgaggcggatgaagacgaagtgatgaagtattggcagggactgggctattattcgcgtgcccgtaatttgcatgctgctgccaagagcatgaatggggtgtttccgaaaacttatcctgaggtgcgcgccctcaaaggggtaggggagtatacagccgctgccatttgttcttttgcgtataacatgccttatgcggtggtcgatggaaatgtatatcgagtactgtcgcgttatctgggcatcgatactccgattgattctacagaagggaaaaaattgtttgcggctgtggcggatgaattgctggatagaaagaaccccgcattatacaatcaggctattatggacttcggagcgatccaatgttctcctcaaactcccaactgcatgttttgtccattggctgacagttgtgcggcgctggcaaaggggacagtggcggagcttccggtcaagcagcacaaaataaaaacgaccaatcgttatttcaattatatatatgtacgcatgggcgtgcatactttcataaataaaaggacgggaaatgatatttggagaaatctgttcgagcttccgttgattgaaactccggttgctgtttcggaggaggaatttttggcactgcccgagttaaaggcattgtttgcccccaaggaacttccggtagtccgttcggtttgccgggacgtgaaacacgtgctttcccaccgggtgatttatgccaatttttatatagtagatcttccggaagatagtcattcgtttgctgcttatcaaaaaataaaggctgaagagctggaacaatatgccgtctcaaaactggtgcatgcctttatagagaaatacatcgattga

SEQ ID NO: 2008 - DNA, 471 bp, B.fragilis
aattctgagaatatgtcagtaaataaagtgatattgataggaaatgtcggaaaagaccctgaagtgagatatttggatacaggtattgctgtagccagttttcctttggctacgaccgaccgcgcatatactttgtcgaatggtacacaagtgcccgaacggaccgaatggcacaatcttgtcctttggcgcggactggcagaaactgccgaaaagtatgtacataaaggtgataagctctatgtggaggggaaaataagaacccgttcttatgatgaccagaatggggctaaacgctatgttaccgagatttttgtggataatatggaaatgctcactccgaaaggtaccggttcgggatcgtatgctccggcacagcagcagactgctgctcccgtgagacctcaatcgcaacaaccgcagcaaccggtgtcttcgcaagataattcggcggatgacctgccgttttaa

SEQ ID NO: 2009 - DNA, 315 bp, B.fragilis
agtataaacctcacacaaaatgctataattaccagaaaagctgttatagttagatcattattaaatatttgctcaacattcaaaagtagattccatttaataaaacaattgataatcaaagatatcactaatataacagaaaagattagtgcagagtatacatatgatgtacttaccaattttcttgaatactcaatattatttacagccaaagattctgtcaatttatttttcaatccatttccgattccaatatcaaacaaacttaaccacgaaacgtcttcaccacgggggtggaaggatcagcgctggtct

SEQ ID NO: 2010 - DNA, 234 bp, B.fragilis
ctaatagcagattttatagcatcttctatgtatagttctctgttatataccggaattactatagataccaaaggattagtaacaagtgcattcatatattattgcaatctactaattaacacaaatttaaacttattaatatttgacaaaaaccgcatactacttaaactcttaaaattatatcgcctatataaagaccaaatatttcttaaagaaaaaagatttctcatatag

SEQ ID NO: 2011 - DNA, 2346 bp, B.fragilis
tattatgaagaaaatgcaatgataaagcgtatcctattattggcgatcgttattgggggtggtatgacaaccgttgctcaaaacagcatagatactttgtttatgtctgtcagtcaacgtttgtccgggcatccctctgaactcatctatttgcagaccggcaaagatatatatgaaacgggagaagatttatggtttaaggcctatcaattggatgccaaatcgttcgcgctgtcggaacaaagcgaaacgctctacttgcagatgcttaatgataaggatagtgtggtttgggccgaaaagtatcccatagagaaggggattgctgagggccatgtatatatagatacaaaattatcggagggcaattatcggttgggaacctatacccgccactcatattataatgatacgaccggaatatctccggaacgtaaaatcaggatagtcaggaatatcgctcttgattctttgccggagcatcgagagaagccgggtgagttccggttcaatctttttcccgaaggaggaaatctggtctcaggtttaccgttccgtttggcgtttaaagcgacgggtagcggaggatgtccggtcgatgtggaaggaacattgtatcaggatgaaattcctgttttgtcttttaaaagtagccacgatgggatgggagtcataccttttactccttcctccggcaaagaataccggatagagctggcgaacgggtatagttatgctttacctgaaatctatcggcaggggatggggctccggttatccgggcgggacgggaaacagcttgaattccttatttcccaaacggaaggattgtccgatcaggaggtatatctggtgggacagatacgaggaaccgtctgctgtgtggcaaaagggttgctgaaagatcgtttgaaaatgaagatacctctttcggagtttccttatcagggcatagcggagtttaccttgttcaatgcggctatgcagcctgtggcggaaaggttggtatatgtgcatccggaaaagaagcttcatattgatattgtaacggagaaagagagctatgttcttcgggaaaaagctgcattgaaagtaaaagtgacagatgataatggacagcccgtgaaagccgatttgggtatcagtgtgtttgacaaagcatacagcaatccggatgaccgggtgaacatgctggcttattgttatttgtcatcacagatacgtggtgctgtctgccggccggcttattactttgacgagaagaatgctgatcgtatgcaggcaatggatctgttgttgctgactcaggggtggaggcgatacgtctgggaacttaacggagcggtccgtcatggtgagatgtttttgagggatgatgtaacgggaattcagaccttgggcagtaagaagaaaagtaaaggaacgggaggtgctaaacaacttattcaggtttcgggcgccgaaggaaattccacctatctgatgacggattccttggggcgttttacggtcgatactgatttgatgaagacacttcgtggcgggtatgtgtatctgaaacccatgttgtcgaaagagtttaaacctgaattggagattcaggattacttccctgccatcgatagcatacggagaaagaagtcttttgactgctcgctgataaattgtacacagagacccaaagaggagatttacgatgcaccggtcgtgagtggtgacagtaccattctgctggatgaagtggtcattgcccgcaaggctcgtaagccgttcagagataagcttatgggacgtctggatagtttggctcaaatgaatctgaatagtgtctatgtttgtacttcgtgtgggcttttattgaattataatccggattatcagggacatcatgcactggtgggagaaggtggatgtccggctaagggaaggaaacaaccggttgacggagaaacttataggatagccaagtataaatattatggggacgcaaaaggtgggggagtctattttagtgtggtcgatgcacattccgtggtttatcatgctgctgaatttaccgaagaggaactgctccgtatgaataatatgtggcgagtgaaagggtattacggtaagcgtgagttttaccaaccggatgaaatagatatgcagttgcctgtacctgatgcccgcaatacattgctatgggctccgtccgtagtgactgacgaaaaaggtgaggctaccgtttctttttattgctccgacattaataccggttttattggagtggcagagggagtagatggaacaggacttttagggactgatcaatgtgagtttagagtgatcaggagagcagactaa

SEQ ID NO: 2012 - DNA, 789 bp, B.fragilis
aatcatattttctcttttattgctatgaatccgattctttcatttataattattgagtatcattcgtttgatgatattgttgaatgtattgctactatccgttcttctacttctttatcatatgaagtaattgtttcttctaattcatgttatttattagaagtgcaggaaagaatattaaagaaaatggaacacgtcaaatgggtctttaattctaagaatgggggctttgcttatgctatgaataggggaatagagaaggcagttggtgattttttagttataatgaatccggatgtgagaataaaatatggtatagaatacatgttcgattttttatactttaatgaacaggtaggtatagtgtcgcctaaaatagtaaactctttaggtgaggtgcaggatagttttcgtaaatttctgacaccgtctaattttattctgagacagttaagacgaattttttatagacggaatgaggtgattacgatgaccaaattagaaaatgtagattgggtaattggagcttttatgatgatttctaagaaagcttatgaagcagtttgtggcatggatgaaaaatattttttgtattgtgaggatatggatctttgtaagaagatacatgataaaggctataaagtaatatattatcctgatgctgttgtggtatatgaagggactcgttctgcaaggaaatcattgaaatatgcttgtatatttttgagttcattactacactattggagtaagtttggatttaagagattgacttctgtatttggataa

SEQ ID NO: 2013 - DNA, 333 bp, B.fragilis
aataaaacaagatttaaaagtaagaagattatgactgaaaattatgaactgatagataatgaagaaaaacatcaatatgaatttcatgttgaaggttatgttccccggatagaatacataaaatctttaaatggagagatctatctgacacataccgaagtaccggccgccttgggaggacacggaataggttcacaacttgcagagaaagttctcactgacattgaacggcagggattgcgcctggttcctctctgtccgttcgttgcgggatatatacataagcatccggaatggaagcgtattgtacttcgtggtattcacattcaataa

SEQ ID NO: 2014 - DNA, 957 bp, B.fragilis
attaaaactatgaatattttgcatgatacgtgtcgtttagtttttgtgtatttggggcgtttgcctgaatatgttatatattcattgaagataaattcgaaatataatagaatcactctattgcatgattgtgaaattcaaaatcatgttgcaaatgttgaatatataaatatcgatgatttttatgatagaagacagtttgttaatttgatagcggaaagtcctttgaaaaattttcgtgacggtttttggtacaaaacgactgaaagattttatgtattaagatcttatatggatcattataatgttcatgccatctttcatgcagaattggataatatcgtttataacttggaaggtgtatctatatctctagataaaattggcaatggactattttatcctatattgaataataaaaaagcagcagcgtcttttatgtacataaattcgttttcagaattagatgctttaataggttattttaatgagcaaaaaacttttaaagatgacatgcaattattggcagaatatgcatctgcatcggtaaatgtgttcccgttaccatctgaaaattccttatgtaagatgcctgtatctaatgaagtacaatgcatctatgatgcagcttcaattggacaatatttattagggatagatttcaggaatgcaagtcgtcctatttttaatggatttcagaatgagaattgtataattgatttatctcaattgaaatttattcaagatggtgataaaggaattttgatgttttatgatcaagctatctatctccttaagaatattcatgttcatagtaaggtttttaaacgaatgtatctaagtgaatcttatgtgcctcgtataatgaaaaaaataaatggtggaaaaaaaagtttaatgtctttgaattttaagaatatgatcaaattgtttttagataaatcaaaattactttaa

SEQ ID NO: 2015 - DNA, 186 bp, B.fragilis
aatgttataatatttaaaaacaatattgtatttagtaacatcagcaggaccaaaactattagctataagaaaactattagtctggaatattacaatagcagatatctgtataataaaaaaattaataccaagagaaaagatttcagaaaaatgctgtttatcagaaaatctaatacaaggtcttaa

SEQ ID NO: 2016 - DNA, 765 bp, B.fragilis
gaactgataataatgttatattctaaagtttcgataataacggcctcatataattcggaagcaacattagaggctactatagagtccgtatacaatcagacttatcaagatattgaatatattataattgatggtgggtcaagtgataaaacagtatcaataatacaaaagtttgaacctttgttttcagggcgattgaaatggatatcagaacccgataaagggatttacgacgcttggaataaggggttggaaattgcaacaggtgaatggattgcttttcttggaagcgatgatatttatttacccgactctatacataaatatatgaatgttttgatttcaaaaaaatgtgtaaactttatatcatctaagtgtaaattagtaaatagtgaattaaaaacattaatgatttatggcaaaccatggggaaagttgatgaattcttattgttgcatagcacatgtgggttgtatgcataaaagatgtttgtttgataattatggatcttttaatagtgattacaaaatagctggagattatgatttccttttgcgtgtaaaagatgtaataattccatattatttacctgaaataactgcaatagttcaagatggtggaattagtaatcggaatatattaaaagtttgtggtgaaacgttgaaaataaaagtatctcataaaaccaagaatctttatttctctttatgggattattgcgtagctgtttttaaatattatgttcgttcttttatgataaaatag

SEQ ID NO: 2017 - DNA, 1581 bp, B.fragilis
atatctaaaattatgaaacgaccttacttactattagcctgtctttctcccgtagcttgcctgatggccgcaagtggacaaaaaggaggaaaaaacaaacagaaggtgaatgaccgacaactgccgaatgtggtgtttatctatgcagatgatttgggatatggcgatctggaatgttatggagctaaaaatgtacaaactcctaatgttaaccgtttggcatccgaaggtattcgctttactaatgcgcatgctactgcggctaccagtactccttcacgttactccatgcttacgggagaatatgcctggcgtcgtccgggaacggatgtagcagccggaaatgccggaatgattatccgtccggaagattacacgatggccgatatgtttaaaaattccggttatgtgactgctgctctcggtaaatggcatttgggactgggggataaaagcggagagcaagactggaatgctccacttcccgctgcattgggggatttgggatttgactattcatacattatggctgctactgccgaccgtgtgccctgtgtatttattgaaaacggaaaagtggcaaactatgacccgagtgcgcctatcgaagtcagctaccgcaaaccttttgaaggagaacctttagggaaagatcatccggagctgttgtataaccagaaacacagtcatggacatgatatggctatcgtaaacggaatcggccgcatcggttatatgaaagggggaggcaaggctttatggaaagatgaaaatattgccgactcgatcactacacatgccatcaactttattcgcgaacataaggatgaaccgttttttatgtattttgcaacgaatgatgtgcacgttccacgctttccacacgagcgtttccgtggtaagaatccgatgggggtgcgcggagatgccattgtacagttcgactggagtgtagggcaaatcctggaaacacttgacaagctgggactttctgaaaacacattgattattctttccagtgataacggtcctgttgtggatgatggttatcaggatcgtgcagaggagttgctcaacgggcacagtccggcaggtccgctgcgtggcaacaaatatagtgctttcgaaggtggaacccgtattcccgccattgtgcgctggcctaagaaaattactcagccgcaggtgtcggatgtattggtttcacaaatcgactggctggcctctttagcttccctggttgatgcaagggttcccaaaggagcggctcccgatagttttgaccgtctgggcaactggctgggaacggattctaccgaccgtccttgggtgattgagcaagcctctaaccacacactgtcagtacgtaccaaggactggaaatacattgaacctaacgacggccctcacatgataacctggggacctaaaatagaaacgggtaatctgagcattccgcaattgtatgacatgactaaagattatgaacaggagaatcttgcagagaagaatccagccaagctttttgaattgcaaaccattttgagaaaagtgcgcaataaaacttatagagctttataa

SEQ ID NO: 2018 - DNA, 900 bp, B.fragilis
attaaaaagatggaaatagacttagtatttgttacaaagatagatcatttatatgtgttaaatttggcattgaagaagatggtgatgctaaatgatattagatctgtttttattattactaataaaaaatattttaaatactttccagtaaggaaggatataaagattaatctgattgatgaagattctgttttaccagatatgacattgaatcagttaagcaaattgtctttgccattttttccaaaaagatcaggttggtattttcagcagtttttgaaacttggaatctctaaactagatgatttgtcagagaattatttagtactggatgctgatactatatttttgcaaagaattccattatttgataatggacgttttgtttttactaaagctcaagaatatcataaaccttactttgaaaattatataaatcttctgaaagaaagtccatcccgagaattctctttcatttctcaatatatgttatttaacaaaaatatagtgactgaaatgttgaataagatagagtctaattttaattttgagaatcattggaattggataattattaataatcttttaggtgatgatgcgagtttatttagtgaatatgaaacctatgggaattatataaagaatcattatccagaaaaagtctgtttcttagatttaaaatggcttagagaaggttctaaagtgcttggttctttgtttcctaaaatagaagatattgagaagctgcatggatattattttgtttcatttgaattaaatacagtcggcgcaagtttttttactaaagtgaagaaacatcttttttgctttttatatcctcgtttttcttttctgaaaagaataatttacaaagttttaccctatgaaattaataattaa

SEQ ID NO: 2019 - DNA, 876 bp, B.fragilis
actttagagattatgaatagaagagtaatacagatcttctgcatggtagttggcatggtacttgcttcctcttgcggagacgaatgtccggtagaacaaccttactcggttagggtatctgttaaggacaagaactatttgaatatatcgcagtttccacagttgagcccggtagacgaaaatctgcctttccggacttatgcgggaactctctattacgccctgtacgatgcatctaccggagcattgatcagagagtcggcggtcgtctctacggaaggtgaagaaaaggaatacacccttacttttccgggcgtacccgacggtgactacaaattggccgtatggggaaatctgaccacggactatcccgccggtatcttgcatcaggatgggaaggaacatacggatatttatgtgacaagcggggacttgcatttctctcccgattatcagacagaagaattgacactggaacgcacgaagggaaagttgttactgctctgttcaaatttcccgtctgagataacacgcattgaacagaatgtaagtcatgtttatcagtcgacggatgccgccctcaactattccggaagcactcaagttgacaaaaatgtgccgttcaccagtgtcctggagacattgcttgctcctacttcggcagagggacattccaaattaactttgactttctataccggtggtacacgtgcatcagaaactccatatctgaaattgccggtgatggagatggatatgcggcgtaatgaaataactgctgtttctatagactacaatacatcagaaggaatctgggaaatcaagatgttcatccgtggagaatggatcacgatacatcgcctggatattttctga

SEQ ID NO: 2020 - DNA, 372 bp, B.fragilis
gttcacaacttgcagagaaagttctcactgacattgaacggcagggattgcgcctggttcctctctgtccgttcgttgcgggatatatacataagcatccggaatggaagcgtattgtacttcgtggtattcacattcaataatataaaaacagttatgggaaaacaaatagaatacagcaatggcgaactgaccattgtatggcaaccggaactctgccggcatgccggaatctgcgtaaagacactgcctaacgtatatcacccgaaagaacgtccgtggataaagatggagaatgctaccacggaagaactgattgcccaaatcaaaatgtgtccgtcgggagcgttgagttataaactaaagaaataa

SEQ ID NO: 2021 - DNA, 207 bp, B.fragilis
agattttatgtattctatccggggaacataaccttcaacatgaaattcatattgatgtttttcttcattatctatcagttcataattttcagtcataatcttcttacttttaaatcttgttttattctacaacatttagaggataaactttgtttcctcctcttgtttatttatgaatcatttaaacaattggatgacgggatataa

SEQ ID NO: 2022 - DNA, 1584 bp, B.fragilis
gaaatagaggtgacaagcgaactagtagtagacgtacagcccaaagaagtatccatcgccctacttgaggacaagagtctggtggaacttcaaagcgaaggaagaaatatttctttttcggtgggcaatatgtatttaggccgtgtcaagaaattgatgcccggactgaatgcttgcttcgtggatgtcggttatgagaaagatgctttccttcattatttagacctgggtcctcaatttaactcactcgaaaagtacgtaaagcagactttaagcgacaaaaaaaagcttaatcccatttcgaaagcaaccctgcttcccgaccttgacaaggatggcactgtagccaatacattaaaggtaggacaagaagtagtggtgcaaatcgtaaaggaacctatctctaccaagggaccacgcctgacttccgaaatctcgtttgcaggaagatatctggtactgattccttttaatgataaggtttccgtttctcaaaaaattaaatcgagcgaagaacgtgcgcgcctgaaacagttactgatgagcatcaaaccgaaaaacttcggagtgatcgtacgcacagtggcagaaggcaaacgtgttgccgaactcgacggagagcttaaagtattgctgaagcactgggaagaaagtatcaccaaggtacaaaaggctacaaagtttcctacactgatttatgaggaaaccagccgtgccgtagccttgttacgcgaccttttcaatccctcgttcgaaaatatctacgtcaacaacgaagcggtattcaacgaaatcagggattatgtgacactgattgcccccgaacgggcaggcattgtcaaattatacaaaggtcagcttcccatttatgacaattttggtatcaccaaacagattaaatcgtcttttggtaaaacagtatcctacaagagtggtgcctacctgattattgagcacactgaggcgcttcacgtagtagacgtgaacagcggtaaccgcaccaagaatgccaacggacaggaaggtaatgcactcgaagttaacctgggagctgccgatgagttggcacgccagttaagactaagggatatgggtggtatcattgtggtggatttcatcgacatgaatgaagccgaaaatcgtcagaagctttacgaacgtatgtgtgccaatatgcaaaaagacagggcgcgtcacaacattctgcccttaagcaaattcggactgatgcaaattacacgccaacgggttcgcccggccatggacgtgaacactacagaaacctgtccgacttgctttggtaaaggcaccatcaaatcgtccatcctctttacggacacactggagagtaaaattgattatctggtcaataaactgaagataaagaaattctcactgcacatccacccgtatgtggctgcttatttgaatcagggacttatgtcgctgaaacgcaaatggcagatgaaatacggatttggtattaaaattattccgagtcagaaactcgcttttcttgaatatgtattctacgattcacatggagaagagattgatatgaaggaagaatttgagattaaataa

SEQ ID NO: 2023 - DNA, 624 bp, B.fragilis
atcaataattcggaaagtatgagatatttattgatgaactatggggtattaggtgtaatacgtttggccttagattttattggtacaaagattgcttttagaaagtctagattaatacgtttcccaattgatataagagggagatcatttattgattttggtagcaatctcacaacaggtcgatattgtagattggaagtttatcctatagaacataaaaaaggaatcttaaaaattggggataatgtagaaattaatgattttgtgcatattgctgcaagattatctgttcagatagggaataatgtattaattgctagtaaagtgtttatatctgatattcaacatggctgttacaattcaaataagatgttcaacgattgttatcccgacatcccacccaaagaacgctctctatttgcggaaagtgtatttgttggagataatgtttggattggagaatctgtttcaattttagctggagtaaaaataggtgatttttctataataggggcaaattcagtagtatgtaaatcaattccttcttattcgatagctgttggtaatcctgctactgtaattaaaaaatttaacaaaacgactaataagtgggaaaaggtgtaa

SEQ ID NO: 2024 - DNA, 1008 bp, B.fragilis
attcggttatccgactatttacacaatttatatttaaagaagatttgtaaactaaaaacaaggaataagatgaatgaaacattaacagtatttatgatttcggagattgaaaggctccgtgaagagggacgtgaaccggcccggcgtatctaccataatatgctgcgtacgctcagggagagtgcaggaaaagaggagatcggatttgaagaggtgactccggtgtttctgggcaagtatgaacattggctgctgggcaagcggttgagctggaacacggtatcgacttatatgcgtgccctgcgtgcgggctacaaccgggggatgaaggggcgtccgggatatgtcaccgggcttttcgataaggtatacaccggtacgcgctccgacgtgaagcgtgccgtggatgcccgcacggtggggcgtatgatccgcatgtcggggtgtccggatgaatcggcctcggcgaaggctgtggactggtttgtactgatgtttatgctgcggggcatcccgtttgtcgatctggcacacttgcgcaggagcaatcttgacaagggggtgttgacctactgtcggcataaaacggggcaggaggtcagcattagcgtgccccgtgaggcgatggaaattatcaataggaggatggttgagaactgccatccgagttatctgttgcctattttggggcagccccgcacccgaaagcggcatacaaagaaggcattgactccttatcaggagtaccaatatgcgttgcgtaacctgaaccgccggttggaacgggtgtcggtggatttgagattgggcggcaggctcagttcatacaccgcgcgccacacgtgggccacgattgcctttcatcaggagacgcccgtgggagtgatcagccgtggactgggacactcttcggtaaaagttacggaaacttacctgaaacctttcggggatagggaagtagatcggacaaacaggaagatactcaactatgtgctgaatgcggtttaa

SEQ ID NO: 2025 - DNA, 1590 bp, B.fragilis
cttcaatgccccatggatacaccgatcaatgccccgcttagaaaactcccgatagggatacagagttttgagaaactgcgctccgaaaatttcctttatgtagataagaccgcattgatttatcggctggctcaagcaggcaatccctgtttcctgagccgtccccgccgctttggcaaaagcctgttgctttcttctttcgaggcgtactttcaaggtaagaaggaactcttccgcggattggctatcgagaaattggaaaaagagtggctacaatatcccgtgctgcatctcagcctcaatgcggagaagtatgacagtcgtgaggggctgatcgatatacttgagcggcagttgcggcagtgggaagagttataccggacgggaagggaaggtattacgcactccggacgtttcatgaccgtcatccggcgcgcctgcgaacagacggggcgccgcgtggtggtgcttattgacgaatatgacaaacccttgctgcgttcgttcgacagtcaggagttgcaacacgacttcagggagacgctgaccgctttctatactgtgctcaaagatgccgacccctggttgcagttcgtcttcatcaccggagtgaccaagttcgcgcaaatgggtattttcagtaatctgaaccaactgaacgatatcagtttcgacctcgactataacaccctttgcggcatgacccgtgcggagatagaagctaccttctctccggaattggaagctctggcagtgaaaagtaatgcgacctgccggcaggtgatggatcggctgactcgccaatatgacggataccggttcaccaaagacgaggaattcacctccatgtacaatcccttcagtgtgttgagtgccttgcagaagcgttcgtatggtaattactggtttgccagcggcacgcccaccttcctggtggagatgctgcagaagaccgatttcgacttgagggagatggagggtattgaggtgaatgaggcttcgctgagcgatgaccgcgcggatataaacaatccgatacccatgatttatcagagcggatatctgacgattaaggactacgacgagcgcttccggatgtacacgctggggttccccaacgaggaggtgaaatatggtttcctcaacttcgtcagtcccttctacactcctatagcccagacagacacctcgttctatatcggcaagttcatccgcgagttggagagcggtgatgtggacgctttcctcacgcgcctgcgctgcttctttgccggtatcccctacgacctaaacgaccgcacggagcggcattatcagacggtgttctacctcgtcttccagcttatggggcagtttacggagacggaggtccggagtgcccgggggcgtgccgatgcggtggtgaagacaccggactacatctacgtgtttgagttcaagctgaacgacagtgccgaggctgccttgaggcagattgatgaaaagggatatctgctgccctatcaggcggacggacggaaagtagtgaaggtgggtgtagccttcgagaaggaggaacggaatattggagagtggatgataggaggatga

SEQ ID NO: 2026 - DNA, 207 bp, B.fragilis
acccgatccgccgcaccgggcattctccggaatttaccacgaatcttgaagtccatgtatgttgccgtttgggccccggcccgtcatcgtcaccgaagtggtacttggccttttactgataataggtatttagatccgggtggtatctttggtagtacaacacgtaaaatacagaagaaaatgttatctttgtatttacgagtataa

SEQ ID NO: 2027 - DNA, 315 bp, B.fragilis
agactgcacgaacaagaagaaacggtaaaaaaagacatccgtgtgctgcggtacctgatagccaaggaggaagaggccgcctcaccacaagccccccggaaacgaaaaatcccccaaaagcagataaacgacttttttacccggatcgccctgttttacgaagatctgcaacggcgcctgaacctgcgcatcacttatcgctgcttctgccgctggctctgcacccgctacgagttcgagtcacgctatcacgaccgccacaaactgtcgccttgcacgatactggggtattttaagagagaaagaggaggataa

SEQ ID NO: 2028 - DNA, 918 bp, B.fragilis
cattgcgcccgcgtcggttccttccagccccgtggtgaagacattcgttttgattgggcggtgaaacgcctgttgcgtaacaaggccaatttcggtgtgttggagggttttctcaccgttttgctgggtgagcccatccgtatcgtcgagattctggagagtgaaggcaatcagttgaatgaaacggataaattcaaccgtgtcgacataaaggcgcgtaacagcaaagacgagatcattattgtggaggttcagaatacccgtgagatttattatctggaacgtattcttttcggtgttgccaaggcgatcacggaacatatcgagttgggtcagctctactctgaggttaagaaggtgtattccatcagtatcctctactttgatatcggtcgtggtactgattacctttaccacggtcagaactctttcgtgggtgtccacacgggcgattttctggaggtgagcaccaaagagaaggacgccatcgtccgtaaattgcctgccgagatctttcctgagtatttccttattcgtgtgaacgagttcaataaagtggctgtcacgccccttgaggagtggattgaatatctcaagacaggtgtgatccatcccgacaccaaggctccgggactagaggaagcccgtcgtaaacttgtctattataacatgaataaggcagaacaattggcttatgatgaacatatcaatgcgattatgattcagaatgatgtattgagtacggcagctatggagggccgccaggaaagtcttgccgaaggtcgccaaggagggcttgccgaaagtcgtatgggagagaagcaagcgaatgccccggagattgaagcattgaccctgccggtcgaaaccatctgtcaggtgacaggattgtccgccggagagatagagaacttgtaa

SEQ ID NO: 2029 - DNA, 225 bp, B.fragilis
atccgggtggtatctttggtagtacaacacgtaaaatacagaagaaaatgttatctttgtatttacgagtataagaaaaataaagaagagtgccaattgttgcatcccttacattttgtaaccaagtgtgagaatctaaaaaataattgtgtacatttgcaaaagactaacttcaatgccccatggatacaccgatcaatgccccgcttagaaaactcccgatag

SEQ ID NO: 2030 - DNA, 1530 bp, B.fragilis
atgttgaattttaattgggtaaaaatgaaaaagacaatctttttaagtactataatcttattgctgacagcgtgtcaggattatctggaaacaaatccggactctacttttgatgtacaaatagacagtgaggacaaaattgccgaactgcttgccggagcatatcccgaggccagttattttgcttttttagaagcgcgtacggacaatgtgggagaaaggactaacggcattcattcgcgactgaatgaagctatgtattattgggaagattacgatcaggaagatttggatactccgctaaactattggaatgcatgttatgccggaatcgctcaggctaatcaggcgttagagttacttagtaaataccctaaaagtgaccgggtaaaagctttgtatggagaagcgtttctcttgcgtgcttatctgcatttcatgttggtaaacatctgggctgagccttatggaactaccaaatcggcaacagccccgggtattccttatttaacccggcccgaaaaaaatgcgttggtggactatgaacgaggaacggtgaaggaagtgtatgaaaagattgaaaaagatctgaaactgggtctttcgttggtgaatgacgattattatgttaaaccaaaatttcatttcaataaaaaagcggcctacgcttttgcttcgcgtttttacctgattaagggagaatgggacctggtggtctcatactccgattatgtgctcggtgttgacccaaagccggtcttaagaaactggcagaagtacaaaaaagaatttaattctaatcataaatatctctatattcgatacgcaagtgttgatgaacctgccaaccttttattgactactacggagtcaagagtggcacgtaatattccttcggaaaaatatggagtgaccattcaaagtgccgaaaaggtgtataatgaacacgggatagacggatgctttaacttccggaaaatgaagatgcagtcattctttctgtttaactataacgacggacgtatagatgacgggcaatatatagccaaatttgacgagctttcattatccggctatacggggatacgtcccagagggttatatgttaccaatgttttattctccactgacgaagtgatgctcaaccggatggaagcgtatacaatgctcggagagtatgataaagcaatagataatctgttggtttacttgtctgtcaaatatggagtgtatccctcttgcggccgttcgacttatacgcagacaagcagtgaaaactatcaaatctataccccattttacggaatgagtatcaaccaactggcgttggtgaaaatacttttaggtttcaggagacaggagttcttacatgagggtttgagatggtttgatatacgccgcttttatatatcggtaaaacgcacttcaaagtataaattctacagaccattggaaaaagaagattccagaaaacttttgcaaataccggcagaagccattaaccggggactggttcctaatccccgatag

SEQ ID NO: 2031 - DNA, 1089 bp, B.fragilis
atatttgattttaccttaagaaaaaatatgaaaaagatgaattatttattgaaatgtctattcttgtcctgtctgttgataagtgttgtggcatgtaccgacgggataaatgaaacagtgataagtgcgtatcagctcccggtattgccggaaccttcgtataaattctcaaggaacggagagagttctgtaaatgtacttgagtgtggatttttgaaatctcctatcgatagaattttttcggaatacatgaacgaagcgcgtatgagtacaaaaagggattatgacgaggcactccggatttatcatgaagggaacttcgggttaaaaccacaaaaagaggtttctgcttcttctaaacatctgaaggatagagataagattctgaaagatattgatgcttggtttgaaacttccgcacgtattgccggcttgggagcgaatatcccttcttacgaacatagaaacagggaagccgtgaaaggcttgacaggatatgtaggaaatggcataggagacaaagatatctgttatgtggatgaaaggggaattgctgtagctgaagtttataaatatgctattatgggagcaatatatctggacaagatactcaacatacatttgagtgagcaaatattggaaaataacgaggtacttgtacggaatgatctgacccagctcttgcccggtcacaactatacggagttggaacatcattgggatctggcatatggatattacgacttctggaaaacattggcccagtccgatggcttaccggccttaaaagattgtcatctgcgtatctcccgctcctttgtcaaagggcgcgctttgatgacgacttcccaatatgatgaaatgcggttgcaagctgataccatcaggcaagaactgtcacgtgtagttgcgataagggctatgcatctgctggtcggtccgaatacattggccaacttaaaggaaaatcccaggcgggcgttccgtcttctttctcaggcttacggcttgatctatgctgcacagtttgcacgcaatatggaaggaaaatcattgtcttcaccacggggctggaaggatcgacagtga

SEQ ID NO: 2032 - DNA, 204 bp, B.fragilis
gaaagaaataacgagcaaatacagacttcttcgaaaaaagtatctgaaattcacttttctaataattgttttcatatgcttgattttattcttgaatcatcttctataatactctatcggggattaggaaccagtccccggttaatggcttctgccggtatttgcaaaagttttctggaatcttctttttccaatggtctgtag

SEQ ID NO: 2033 - DNA, 1035 bp, B.fragilis
ttcaagaataaaatcaagcatatgaaaacaattattagaaaagtgaatttcagatacttttttcgaagaagtctgtatttgctcgttatttctttcctattggcgggctgtgaagaggaggcatccctatctgcccggagtgtggtggaggcgggtgagacagagcgtgagaagacagagttggataaatggatactggatacattcacccgtccttacgggattgaggtggaatatcggtgggacaaaaatgcagtgcagaatggaagctatatctacccgccggaagttgccaatgtaaaaagtgtgctcaataccatcaaaactctatggattgacctctatacagctcctgaattgggaggagataagtttctgttgggaaaaaatcctcttaaaatatacatgtatggaggaagaaatgtagatggaaacggaatggaactattagataatcttgaagcaacgactaatgagatgtttctatataacgtcaacgagtttaatccccaagatgaggataaggtcttcattctgatgcgaagcgtacatcaccagtttgccagacatcttatggaacttttcccctatgacagaagcaaattcctatccatcagcagaaacaagtatatcgaatcgactaaatctattgcatggattttcaaaggagagacgcaagggcgcagagggtttattctggctggttatccgaataagaaaggtttctttacctttcattctctcctttcacctgaaaaagattttgcggagataatcagtttgaagttgacatatggacctaaggatttgcttcaggctttggacagagccaagactccttacaatgccggctcggataaagatcttcaaaaagaatatgatgaacaagcgcttcaggcatataaagaattggtagaaaagcaagcatttgtagaagactactttagtaaagaaattaagatttcgcttaactaccttcaattaataagcatgaagcaagtaaaggaatttattaataaaaataagaaagaatga

SEQ ID NO: 2034 - DNA, 1038 bp, B.fragilis
gaaagaatgaaactaggatttcaaatacttatcctaatggtgttttgcttctcctgtaaagatgaaaaggttttcgactcgtctccttcagagcgcaatgcaaaccatatcggcgaactgagaaaggaacttgtaaatgctccttatggctgggctgtcacctattttccccgaacggattctctattgtttacaaatgtgaatgaattgataactcttcccaaagggatatttgaagacaagaacaaatatggatatggtggacactatttcttaatgaagttttccgaaaatgggatcgtagagacggtggccgactataatgaggagagcctgacgaaaaagctgcaaagtgagtttgaagtgagccaaaacacatttacgcagttaagttttactacttatacctatctgcattctttggtgaatgaccgctttaccggctcttcggattttctttatacgggaaaagatgttgatggcaacctgatatttaaaacatcttcatatatagagcctgcaagggaatatatcatttttacaaaattgaagaatgatgaaagttggcaggaggacatccaaaaatcatatgacaataaattgttctttgagaagatgaaaaatcctcagctaatcattcgtagggcgggacgagtttatttccatagcgatgtacagatgaatgtcacttatggaggggatggaagtgtgaatggaaagcaacctccagaagtatatcagcgttatcgtctgtttcttgcgagagattatttcgcttctcagggatggttgggaaataaagtaaaaggattgggttcggggtatgtgggaacagccgccggtctgactttcaagcccggtatacgttatagtgaaacgtatatcttctatgattttcgtagagaaggagagagatttgtttgcgaactagtgaaagtagttgacccttacagcaaaaaaatacattgggtcagcaagcatcttgctccctatggcgaagagagtggagttatagctgaaatccgggatgaaatttaa

SEQ ID NO: 2035 - DNA, 684 bp, B.fragilis
ctgaaatccgggatgaaatttaaattagaaaacaacaggataaatatgaaacatgtatggataataagttgtctgctgtttgtatgcagctgcaacacggtaagagaagattttgtagtaaatgaagattatgagaagttgtttccatccaaagagatagagaaacctgaaaacaagcgcggagagttgcttgtacaattgtgtgatcccgatcaggcattggagaactataaatatcccggtaccgaaactccgaatggtgctgaccaatataaaataaccctgatgtgttcgtttcaggaaaaacgctgggatggtaatcttactaaagatgtcagtgctcagtacaaagtgaaatatattaatgaaaaaaaagaattggtgacgatcagttgtggaaagagaaatataggaaatgccggagaggatgctgacggattaagacccaatgtaatgtttaacggcgagaagttggaaatttcttttaatgtacattcgggttttcctctgtatctgagtgtttccggtgagggacccagatcatccaatataagagcaagtatcacagctgtctccactgatggactggtcgaaattcccagcctgcagacagagcaatatcaaaatgaggaggggattaatccactgaggtatccatattgtgaatatttgattttaccttaa

SEQ ID NO: 2036 - DNA, 1941 bp, B.fragilis
  unsure (11): Identity of nucleotide sequences at the above locations are unknown.
ctgggcttcgntaacattctgaatgaatatgaaaacaattacctgaaaacagaagtgctggatctgaaattacagggtgaactttcatacaggctcaatgatcatattgaagtaaaaggcttggcaatggtgcgtcacgccgtaaccaagagttcacattttattgctgaagcatccaatgtggtacaggcttttcgtgccaatgagactccttacgtagccagagaaaacatttatctattgaagaataaagacgatccgatgcaactgcccggggtagcattgacacatggggggatattcaataagacggaaacttccttgcgaagctatctgggacgtttggctttggattataacaggcaactgagtgaacataacatacgcgctttcggatttactgaaatacgatatgccgatcgcagcatgaatccttttcaaggctatggaatacaatacgacagaggtaatcaggtcttttccaatcccctgatttttgaaaagctggccaatgaaggagatacttatttttctttaaccgaacgttatgaaaggggagtgacattatcgggcagcgctacatacggatatgccgggaaatacattttcaatggagtattcaattacgaaggggctaatactgcaggtaaatatagccgttcccgctggctgccaacctggaatataggagccaaatggaatctggatcaggagaagtttatgagaaaacacactaccatttcaaggctcgccctgcgtacgagttatgggttaaccgctaaaatgaatgaacaagctgttaactctaccacagttttcaagcatgtgatggtcaaccgtactcttttgaaagatagggagaatgcattgcgtattttacatttggaaaatcgcgatctgacatgggaaaaaatgtatgagttgaacttcggtcttgagctcggactgtttggcaatcgtatcagtgcgacattcgatgtgtaccaacgaaactcgtttgatctgatagaccttattcgtacctccggtgtgggaggtcagtattacaaatacgctaatttcggagatatgcgtacgcgtggagtggaactggccatacagacacaaaatatattgactgacaaattcagttggtctaccacagtcactatcagcggtatgaagcagaaaataacccggttactgaatacccctaacacttttgatatggtggccggaaccgggcgtggtaacatagtgggttttccacgtggatctctgttctccttcaattttcagggacttaacagcaatggtctgccgaccttcgatttcggactgtacccctccaacaaaggagcaaatagcgagatttcgggagctgactttttggatgcacaatattcaaaatcataccttatttaccatggccctattgaaccccaatatataggaggtatatccaatacttttaagtataaaaattgggaattctcgtgttttgttaccatgcaggcaggtaataaaattcggatgaatccttcttttgatccggcatttgccgatcttaatgtattttccaaggagtactacaaccgttggttgaatcccggtgacgagcggaaaaccaatattcccgtaattccttctcaagatctgatacacaatatcggaaaagaaaatatagaaaaagcctacaacacttataactattcacaaaacagggtggctgacggtagttttgtgcgtatgaaaaatatctcgttgggatatcgtttacctcaaagattcctttcacatcttaaaatcaaacagatgaacgtaaaggtgaatgtgacgaatccgttccttatctattcagacaggaaactgaatgggcaagatccggaattttatagatcaggaggggtttcattgcctactcccaagcaatatacgatgacattgaatgttgaattttaa

SEQ ID NO: 2037 - DNA, 741 bp, B.fragilis
ccgttgtgggtcatagacggggcagtatacgaggatcttgtttcacttacacttgatcaattggcttccggtgatgcggtaacccttatcagttcggctgttgccggactgaatgcatctgatatagaagatattcaggtattgaaagacgcctcggcaacttccatctatggtgcccgggcattgaacggagtgatcgtaattaccacccggtccggtaaaagaaatgcaccgaacagattttcttattcttatgagttaagtatgcgatctattccttcttatacaaatttcgatttgcttaattctcaagagagtatgtctgtttatcaagagatgggcagaaagggatatttctctttgcaaaatacgctatatggtcgtcgcagcggagtatattatcagatgtataaggcacttaataccattgatccggctaccggtcaatattatctggagaatacggatgatgtcaaaagggcattcatgcgtgaaagagagtatgctaacaccaattggtttaaagaactgtttacacataggcctatccatacacatactgtgaccttttcagggggaggggagaactctgcaatgtatgcttccatcggtttttatgatgacagaggatggactttggccgacaatgttaaaagaattacggccaacatcaagaactctttttactggaacgaagataagataaaggctactatatccgcacaagggaaatctacgtaa

SEQ ID NO: 2038 - DNA, 513 bp, B.fragilis
gaaagcttatctttatgtcatatagattgtgtatctttgcacgcgaaaacaaaaaaggataatatgtgtggaatcgtaggctacattggtaagagagaagcctaccccatccttatcaaggggctgaagcgactgaagtatcgcggatacgacagcgccggggtagcgatcatcaacgacaaccagctgttaaatgtatatcggccgcaaggcgaaacgttcgtgtttgcttctgacggcattatcgagactcccaccgttatcctccaagaatttccatcccaaagttacatcttccgtaacagtacctatacagaggtacccgtttattccttttcttctttccgcccgatgcatcagttttgtaagataacggcttctcgtgcagtgaggccggaaacattaaagtgctctgattcgttgataattagagaggctttttctgacacactgttgcaaggcgggaaagatgaagcgaccgggataagggaagagagtgtgactatggagtga

SEQ ID NO: 2039 - DNA, 339 bp, B.fragilis
aaacataaatcctttaaaacaattacaattatgtgtggaatagcaggaatcttcaatataaagattcagagcagggaactcaggaacaaggctctccgaatggcacgcaaaatacgtcaccgcgggcccgactggagtggaatgtattgtggcggaagtgccatcctggccacacgagcgcctttccatagtcgatccgcaaagcggaggacagcctcttttattcatccgaccggaagcaagtactggcggttaacggcgaaatctataaccaccgtgacatccgcgcccaatatgccggccgctacgagttccggaccgggagtgactgtgaggtga

SEQ ID NO: 2040 - DNA, 570 bp, B.fragilis
gatatgaaatcaatgaattattctcttatccgcactatttgtgcgcttgtcatcggtctggtactggtactctggccggatgcggcaattaactatattgtcataaccatcggcgtcctgttcctgattccgggatttattgtgctgatcggctatttcggaacaaagccggaaccgggtgtgtcccgccgtttccccatcgagggagtgggcagtctgctattcggactttggctggtcacgatgccggggttctttgccgacgtactgatgttcctgttgggctttatcctgattatgggaggtgtgcagcagattgcctctctttcgatggcacgtcgttggacgcccgttccgggaggtttctatgtgataccggtcttgatcctgatagcgggtatcgtagccctgtttaatcctaccggagcacgtaatacggcctttatgattatcggtgtcagtagtttggtttatgccgtctccgagctgatcaactggttcaagtttgcccgccgtcgtcccaagactcccctgaaaggagagattgaggatgcggagattatcgaataa

SEQ ID NO: 2041 - DNA, 663 bp, B.fragilis
gactcagtgtcactctgtggtgaacccaactttaaacccaaaatgatgaacgacaaattaataaaagtctgcgggatgcgcgaagctgaaaatattcgtgaggtagagcaactaaaggtggacatgataggctttatcttctatccgaaatctccccgttgcctctacgaacttcctgcctacatgccggtcaaagcaaagcgtgtcggtgtctttgtcaacgaagacaaaaaggagatcgaaatatttgccgaccgtttcagcctggattatatccagctgcatggcaatgaatcgccggaatactgtcattcgctccgggctaccggactgcggctgatcaaagcgttctccattgcccgaagaaaagactttgaaaacatcggaacttacgaagagtcctgcgactatttcctgttcgacaccaaatgcgaacaacatggcggctcaggaaatcagttcgactggagcatgttaaacagctataaagggaaaaagccttttctgcttagtggaggcatcaatccatacagtccgccgacactgaaagagttgcgccatccacaactggcaggcttcgatctgaacagccgtttcgaaacaaaaccgggattgaaagatgtggaaagactcaggcactttctggaggaactgaggaaataa

SEQ ID NO: 2042 - DNA, 2325 bp, B.fragilis
ttctactatccaaaaatgaaaatgaagaaatatatatttttcctcgttagcctgtgctgtgccctgttgcctgctatggccgaccaaccggaacatccggaactgaaagcgtctgatgccaatatcatcggccatgtactcgataaaaaaacaggtgaacacctctcttatataacaatcgccctgaaaggaactaccatcggtacggtgacggatgccaccggacactatttcctgaaaaaccttcccgaagggaattttgtgctcgaagccagttcggtggggtataaaaccatcagtcgcaatgtcagtctcaggaaaggaaagacacttgaagaaaattttgagttggaagaagatgccgtagcgcttgacggagtggtagtgtcggccaatcgcagcgtgaccaaacggcgcttggcacctacattggtcaatgtggtagatatgaagatgtttgagaatacaaactcgcctacactttcgcaggggcttaacttccagcccggtgtccgggtcgaaacgaactgtcagaattgcggtttccagcaggtgcgcatcaatggactggacggtccgtatacacagattcttatcgattcgcgtcccatcttcagtgccctttccggtgtttacgggttggaacagattcctgccaatatgatcgagcgggtagaggtgatgcgaggcggaggttctgccctgttcggttcgtccgctattgccggaaccattaatatcatcaccaaggagccattgcgcaattcggggcagttggcacatactcttacttctatcggcggcagctcgtctttcgataataatacttcgctgaacgcatcgctggtgaccgatgatcatcgggcgggactttatgtgttcggacagaaccgtcaccgggatgcgtacgatcatgatggagacggttattccgaaatgccgaaacttaaaaaccagacagtcggcttccgttcgttcctcaagacaagcacttattctaagttgacatttgagtatcatcacttacaggagtttcgtcgtggcggaaacctgctgaaccgtccgcctcacgaggctgacattgccgagcagattcagcactccatcaacggcggcggcttgaaattcgattattttgctccgaatgaaaaacaccgtctgaccgtttatacttcggcacagcatacggaccgcgacagttattatggcagcaaaaaagaccagaacgcctatggaaagacaacggacctgacatttatcggcggttctcaatatgtgtacagtttcggtaaatgccttttcatgcctgccgacctgactgcgggattggagtataaccgggataacctgaaggacgatatgtggggatacaaccgttatacgaagcagacggtaaatattggtagtgcttttttgcagaatgaatggaaaaacgagaaatggagcattctgttgggcggacgtctggataagcacaatctgatcaaccatgttatctttagccctcgtgccaatctccgtttcaatccttccgaggacattaatcttcgcctgagttattcgtcgggcttccgtgccccgcaggctttcgacgaagacctgcatattgagaatgtaggcggaacggtgtcgatgattgagcgtgccaagaatctgaaagaggaaaaatctcagagtttcagcgcttcagccgatatgtatcatcgtttcggtgcttttcaggtaaacttcctggttgaaggtttttataccagactgtcggatgtatttgtactcgagaacattggagagcgggacggcattcttatcaaagagcgccgtaacggatcgggagccaaagtattgggactgtcgatggagggaaaaatggcttatctctctttgttccagttacaggcaggagtcacgttgcaacagagccgttatgacgaaccggaaaagtggagcgaaacggcaccggccgagaagaagattttccgtacgccgaatacctatgggtactttacggcaacgtatacgccgatcaagcctctgtcattatccctgtcgggcacgtacaccggatcgatgctggtgcagcacatggccggttatattgacaaggatgtggcggtgaatacgcgcgatttcttcgatatgggagtcaaggtggcctatgatttcaaactttataaatcggtggacctgcaattgagtgcaggtgtgcagaatgtgttcaatgcttatcagaacgatttcgaccagggagtggagcgtgactccggatatatttatggtccggctgctccgcgaagctatttcgccggaataaagatcagctattaa

SEQ ID NO: 2043 - DNA, 645 bp, B.fragilis
ccaactctcccgattatggcactgaaagagaaaatcaaacagaatcccgcactgaaacaagctgtacaccgttttattatgcatccggtaaaaacacgtcccaactggtggatacgtatattctctttcctctacctaaaacgtggaaaaggctctgtgatttaccgtagcgtacgccaggatcttcccccattcaatctcttctctctcgggaagtattcggtagtggaagatttttcgtgtctgaacaatgctgtaggcgacctgattatcggggaatatacccgaatcggactgggcaacaccattatcggccccgcaaccatcggcaaccatgtaaacctggcacagaatgtaaccgtaaccggcctgaaccataattatcaggacacaggcaagcggatagacgaacaaggagtaagcacacaacccatcacgattgaagatgatgtatgggtaggtgccaattcggtaattttacccggcgtgacactgggcaaacattgcgtagtagctgccggaagtgtagtcagtcgctccatccctccctactctgtctgtgccggcagtccggctaaagtagtcaaacagttcaatccggagagccgaacctgggaaaaaacagtctcaaaaaacggaaagtaa

SEQ ID NO: 2044 - DNA, 633 bp, B.fragilis
caatcgccccctcccctccccatttatagtgatagctaccctgctatttccattataaatggggattttctatttctgccggaccgcctatctttgccgtatcatttaaaaacaagatcagaaatgaataagattggagtattttacggttccacaacggggactaccgaagatgtagcccaccggattgcagaaaaactgaacgttcccaatggtgacatccacgatgcctcaaaactgaacgacgagttagtgaaagaatatgatgtattagtactgggcacctctacgtggggagcaggcgagcttcaggatgactggtacgacggtatcaaagtgctgaagaaggctgacttgtctcacaaattcgtagccctcttcggctgtggcgattcagactcttacagtgacaccttctgcgacggtatcggcatcttatacgaagaacttaaagacacccactgcaccttctgcggggcaaccgatccgtcgggctacacattcgactcttctgttgcggtaatcaacggcaagtttgtaggacttcctttagatgaagtgaacgaagatggcaaaaccgacgagcgtatcgctcaatggactgaagccttgaaaaaagaatgtatcaactaa

SEQ ID NO: 2045 - DNA, 1461 bp, B.fragilis
aactcggtgttactctatggtgaatccaaaatcaaattaaaaagaaatgaaattatgaatgccttcaattataccacccatagcaagcaagtcctgggcgacctgcacactccggtaagcatttacctcaaagtacgtgatatgtatccgcaatccgcattaatggaaagctcggactaccatgccggagaaaactctctctcgttcatcgccctctgcccactggcaagcatcggcatcaacagtggaatcgtaaccactacttaccccgacaatacccgccgggaagaaccgctcagccaatcgttccgggtagaaaatgcgctcaaccgctttatcaaccggttccatgtggaaggagacgacaagaaattctgcgggctatacggctacaccacgttcaatgccgtgaagtattttgaacacatccccgtgaaagaaagtcatgacgaacagaatgacgctcccgacttactatacatattatataagtatatcatcgtcttcaatcactttaagaatgaactcactctggtagagatgctggctgaaggagaagaaagcaatttgtcacaactggaatcggccattgaaaaccgtaactatgcttcatacaatttctctgtgaccggccctgtcaccagcaccatcaccgacgaagaacacaaggcaaacgtacgcaaaggcatcgcccattgcctgcggggagatgtcttccagattgtgctttccagacggtttatccaaccttatgcgggtgacgacttcaaagtgtatcgtgctttgcgaagcatcaacccctctccctacctgttctatttcgatttcggcggctaccgcatcttcggctcgtcacccgaaacgcattgcaaagtggaaagcggacaggcgtatatcgacccgattgccggcaccacacgccgcacgggagacaccatcaaagacaaggaactgacggaagctcttttggctgatccgaaagaaaacgcagaacatgtaatgctggtggacctggcacgcaacgatctcagccggaattgccacgacgtacgggtagtattctacaaagaaccccaatactacagccatgtcatccatctggtgagccgcgtcagcggtgctctgaacaacggagcaaatccgctcaagacctttatcgacactttccctgccggaaccctgagcggtgcgcccaaggtacgtgccatgcagcttatcagcgaaatagaacctcacaaccgcggagcctacggaggttgtatcggcttcatcggcctgaacggagaattgaaccaggcgataacgatccgcactttcgtaagccgcaacaacgaattgtggttccaggccggaggcggtatcgtagcacgcagtcaggacgaatacgaactgcaagaagtcaataataaactgggggccctgaaaaaggcaatagacctggccgtaaaactaaaaaactga

SEQ ID NO: 2046 - DNA, 210 bp, B.fragilis
aattacccgccccacatcagaaaagccataaaggcttttctttattacctcaaaattcctaaaaacacaatcttctttttacctaaaaaactttcaataacctattcttcttttacctttaaaaatctttacctaattgaaaatcacttgaaactttttaataccttaaatctttatctaatacctaatattctattttaccttaaatag

SEQ ID NO: 2047 - DNA, 1023 bp, B.fragilis
gagcgaagcacgatagtaacaatcaatattaaaaacgtagaacgtatggaaaacgtagttcctccgttcaaagtagacgttgccggtacttttcttttgcccgctgcattgagagaagcccgtgagcaatatcgaaacgaacaaatcagcctgctgaccttgcgtgctgtcgaagatgccgagatacggaatctggtagacagactgaaggcagaagggttgaaggtggtcactgacggccgtttccgcagtgatgcgtggccgctcgactttatgtgcggattggatggtatccggttccgggatgacagaaagacctctgtcgaactgaccggtcggatcgatgtacatcaccatcctgtgctcgatgattttgtctttcttaccggggtgaccggtggagatgtaatagctaagcaagtgcttcctgcgccttcgcgcctgctggcagaattaatgaaagacgcaaaccggaccgaactcgattcggtctatcccgaccgtgagatactgttggtagaccttgcacagacgtatcagaaactgattatggaactgtacagatcgggatgccgttatctgcaactcgatgatgcaacgcgtacggtgacggataacgcgatccgtgtcaacaacatggcattggagaatcttcccgccgatcttttcattgcttttcattcacctaccgagatgcttttctcgctacagggaattcatgcttttttcctcgattacgattcggaatgttgcggcaagaaccgtttgttgtggttcatccgcgagaagcaatctgtgtttggcttcgtactttcccattatcccgtggaggaagagctggaagagttgagagccaagatcgaccagatcatacgttatattccttcgcaccgtttctcgctgtgcatacccaatgccgaagtgttgccttcggaatcttatgaagctgccgaagaaaaacagtggcatacattgaaaatggctgaaatggttgccggagaactctggccggaagaaggatag

SEQ ID NO: 2048 - DNA, 1350 bp, B.fragilis
agtaagggcacgccactccggttgatccactccgatacggtcgagcatggcggagaatttgtcgcggtcctcggcattgtcgatgctctgggcggatgttccgagaatgtggatgttctgggcatcgagacgcagggcgagattgttaggtatctgtccgccggtggaaacaatgactccgtacggattctccagttcaaggacatccatcacgcgttcgaatgtcagttcgtcaaagtaaagccggtcacacatatcatagtcggtcgatacggtttcgggattatagttgatcatcaccgaacgccatccttccttacggatcgtattaagcgcctgcaccccgcaccagtcgaactccacggaagaaccgatccggtaggcacccgaaccgagaacgacgatagaacgatggtcacccaggtaagtgacgtcgttggctgtgccgctataggtcaggtaaagataattggtctgtgccggatattcggcagccagcgtatcgatttgcttcaccacgggaacaatgcccaggctcttacggtaattgcggacataaaggctgccgtcttccatatcgccttcgtagccgatggcacgtgcaatctggaaatcggagaatccctgacgcttggcttgcttgagcaggtcggcaggcaagtcggctatctgcttgtgattgttcccccactgatggagttcctcagaagtattcatgatattcatcaatttctggaggaaccacttgtcgatcttagtcagttcgtgcacctgatcgatggtatatccggcacggaaagccttcgagatgacaaagatacgtttatcggtcggttcgtgcagtgctttgtcgatgtcggggataacgagttccttgttttccacaaaaccatgcatcccctgtccgatcattcgcaagcccttctgaatcgcttcctcaaaagtgcggccaatggccattacctcaccgacggacttcatcgaagagccgagttccttgtccacaccgtggaacttaccgaggtcccaacgcggaattttgcagactacataatcgagtgccggctcaaagaaggcactggtggttttcgtcacagagttcttcaggtcgaacaacccgtagccaagtccgagttttgcagccacaaaggcaagcggataaccggtagccttggaagccagggcagacgaacggctcaggcgggcattcacctcgatcacgcgatagtcttcactttcggggtcgaaagcatattgcacgttacattctcccacaatgccgatgtggcggatgatgcggatggcgagctcgcgcagtttatgatactccttattggtcagggtttgtga

SEQ ID NO: 2049 - DNA, 2442 bp, B.fragilis
gcaaaacaaacaggtatgaaaacatcaattaacaaactatgtattgctgcgtcgatactggttacggctgcgggcatatccgcttgtgtagacgacaacaaaactctctatgatccggagtataagactcctaatccgatggaggaaatcagtgcaccgaccggatttgactggtcgtcgacccatgccattaaattcaatgtagaggttaacgacgaatttgacggacagtattattataccgtagaaatagtagataaaaacccgcttgaagcaacgacagaagagccctataataccttagccaaaggagttgccaggaagggagaaacttatcagaccgaagtggtatcttccaaagataccaaatatctttatgtccgtcagactgacccacgtggcagagaccggattaaacaggtagaaatagacgagtcaacctcccatattcagtgctcttttacaggtacatctgcaatcaaaacgagagcttttgcaaccaccaaggggaataacggaggaattgacattccgaaaagaacagaacaaaactatgacatcagccgggctatcccggtaacaagtccttcacaggttctgcaaggaggccaaacctatattgttacgggaaacttttcaggtaaattcacagatatctctctcagcaactcgaacaaagcgaccgtctatatacaagggacctgggaactggcacaggtcacccaagacttcctggatattattgttttgaaggatggaaagattaatggaaaatatctgatgctgcagaatacaagtactttaacaatccaatccggagcagaagtatctttatccgatcaattgatatgtaacacatacagcactatttgcaatttcggtgatctgaaaacaaagaatatgaaattgaacaccaacgatattctttacaatggacacaaaacggacatcacgaacagtctggatgcttcgcaaggaggcaacatccacaatttcgggaaactggatgtagagaatacgataaagctaaatacgccttccattgtatataatgcgccagaatgtaagatagaagctaagacatatgaagctgcgggaagtacgaatgtgaacttcggcgaaatggaatttgatacttatgatagcggtaaagcgggaggttcgctatataacaattgtatgctgtttgtagagcacatgaaggcaggcggcatcgtttatctggatcatggagtgatagccgaagaaaaagaagacgatgaagagaacgaactcttcgaagaagccgatgatattgagttctatgacaatgctaaagtgactttagcgaatggttcgatgataaaagccaaaaatataattgctaaatccggtttatcggttaacggtgaaggcaatgaaacctctttattaaaagcgaccgaaaaagtacaaatccaaaattgggatgtccgttttaatggcagattgtgtatcaccggaaagatcagttgctccaatccggacatgtatcaggcaggaagtgaagtaaccttctccgaaagtccggacgtaatcattaccggctgcaacggaaaagcagaggtacccgatccggctcccgagccttccgatccggtgttccccatcattgtagatgacaatcataactatacatatctgtttgaagaccaatggcctttgtatggagattacgatatgaacgatatcgtactggaggttaaaaagaggaaaataagcatagataaacacaataaagtcaccgaattcgatctgtctgtcgaactacgtgcggtcggtgcgcagaagacaattgccgcagcgatcatgtttgatgaaattccggcatctgccgtcacacaagctgtcacctacgccgacaattatcagccggtatcttttgagctgacagacaaaaacatagagaagggacaagagtatgcagtagttcctctattcgacaatgcacatgcattgatggaacgtccgacaggctcgtttgtcaacacgatatccggaagtgacaacaatcaaaagaatacccagaccattcatttcacactcagattcgactcgtctgttgcaccaagcagtgatgctcttaatatcaataacttgaatatttttatcatcacagacaggggaagcaaacgaaaagagatccacgtagccggatatcggccgaccctactggcaaacactgagttattcggagggaataacgacgcctcttctctcaatggaaagaagtattacatcagtaaagataacctggcttggggaatcatggttccgacccaatttaagtggccattggaatatacacagattcaaaaggcatattctcaattcgccggatgggtcaccacgggcggagcggataacaagaaatggtggaacgattttgataacacaaaagtgttccaaaccaataaaaattaa

SEQ ID NO: 2050 - DNA, 306 bp, B.fragilis
gggaaaagaacagattcaggaaacaatcaattactacatgaccaatgcccggatcatgaaagagggcctggaatctaccggcctgaaagtgtacggaggggtgaacgcaccctatttatgggtaaaaaactccaaaacggaacaagctcgtggcgcttctttgaccagatgctatacgaagacaacgtagtaagaactccgggagtcggattcggccccagtggagaaggatacatccgcctgacagcatttggcgagcgggatgattgtatcgaagcgatgcgacgcatcaagaaccgactgtaa

SEQ ID NO: 2051 - DNA, 1341 bp, B.fragilis
aacattattgcaaacaattggaacctgcttgcgtgttcttatttcctatctttgtcgaaaagaagaattaataggaataggaatatgaaacgagttatcttttctttgtctttttccctgtttgccctgctgatgtatggacagatcacccttgaagagtgtcaacggaaaacccgggaaaactatccgctggtaaggcagtatggattgatagagaagacaaaagaatataatctggccaatgcgtcgaaaggttatctgcctcagtttaccctttcgggtaaggccagttggcagagtgaggttacggaattgcctgtacaggttcccggagtagatatcaaaggtttgccgaaagaccagtatcaggtgatgctggaactgaaacagaacatttgggacggcggtgagattcgttcgagaaaagagcaggtcaaggcatcgtcggatgtggaccgggagaaattgaacgtagatatgtatgcacttaccgagcgggtgaatcaagtgtatttcggaattctgttactggacgaacagttaaggcaaaaccaactctttctggaagatctggaacgtacccataagcagatttcatcgtacattgagaatggcatagccagccagtccgatctggatgctgtcagtgtggaacagcttaatacccggcaaaagcggatagaactgacctcctctcgtcaggcctatctgtctatgcttgcattgctgacaggcgaagagatgcctgccgggatctctttgcagaagccggtgccggaatgggatataccggtgatagcgaataaccgtccggagctgatatggtttgatgcgcaaaacggacgtttacaagtgcaggaagaagctttgaaaactcagctgatgccacgtttcgggctgtttgttcagggagcatacggtaatccgggacttaatatgctgaaaaatgaattctcgccttactatgtggcaggagtccgcttgtcgtggaacttcggtagtttgtatactttacgcaacgaccggcgggtgatagctgccaatcgtcagctgttggacagtaaccgggatgtgttcctgtttaatacccgccttcaggcaacccagcaggggagtgccgtagagagtgtgcgccggcagatggcggacgatgacgaaataatccgtttgcgaaccagtatccgcaaggcctcggaagccaaagtggccaatggtaccatgaccgtaaccgatatgcttcgggacatgacttccgagaacctggcgcgacaaaccaaggcgctgcatgaagtacagctcttgatgaacatgtatcaactgaagtatacaacgaataattaa

SEQ ID NO: 2052 - DNA, 1296 bp, B.fragilis; identical to SEQ ID NO: 845

SEQ ID NO: 2053 - DNA, 1155 bp, B.fragilis
acgaagcatttattaactacatcgagcaggtgtaccaattttaaaagaaaggtgaacttaaataaagaaaagataagaatgaagaatgtgactttgatccttgacgacgggagccgtttccacggtaagtcgttcggttacgaaaagcccgtggcaggtgaagtagtgttcaataccgccatgaccggttatccggagagtctgaccgacccttcgtatgcggggcagttgatgacactgacgtatccgctggtgggcaactatggtgtacctccttttagcatagagcccaacggactggctacgtttatggagagcgaacgcatccatgccgaagctattatcgtaagcgattactcacaggaatacagtcattggaatgccgttgagagtctggctgactggctgaagcgtgagcaggtgccgggcatcacagggatcgatacccgtgagctgaccaaagtgttgcgtgaacatggggtgatgatgggacggatcgtatttgacgatgaaccggagagtgctccggaagctgtatacagtggagtgaactatgtagacaaggtttcatgcaaagaggtgatccgttataacgagggggcggacaagaagaaagtggtgcttgtggattgcggtgtgaagacgaacattatccgttgcctgcttcgccgggatgtggaagtgatccgtgtaccctggaattatgatttcaatcatctgaagttcgacggactcttcatctccaacggaccgggtgatccggatacgtgtgatgctgccgtgcagaacatccgtaaagcgatgcagaatcccaagttacctattttcggtatctgcatgggtaaccagttgctgagcaaagccggaggggctaaaatatacaagctgaaatacgggcatcgcagccacaaccagccggtacgcatggttggcacggaacgttgtttcatcacttcgcagaatcatggttatgcggtagacaataatacacttggcaccgactgggaaccgctgtttatcaatatgaatgatggctctaacgaaggaatacgccataagacgaatccctggttctctgcacagttccatccggaagcagccagcggacccacggatacggagttcctcttcgacgagttcgtgaagttgctctaa

SEQ ID NO: 2054 - DNA, 696 bp, B.fragilis
tctcttgtttataggatgtttacgagaaaatatcttctctgtgaaactctgtgtcactctgtggtgaatcccccaaacaatttcaaaacaatgaacaacgagataaatacccttaacagacagaaaggagcgattctccttctggacaattatgactctttcacctataacctgctgcatgtggtaaaagaacagggagtgaccgacattgaagtattccgcaatgacgagataacactggacgaggtggaacgtttcgataagatcatcctctcgccgggaccgggcataccggaagaagccggactgttactgcccatcatccggaaatatgcggcaaccaaaagtatcctgggagtttgtctgggccatcaggccatcggcgaagcattcggagccacactcgaaaatctgacggaagtatatcacggggttcagactccggtcagcatattgaaagaagatatcctcttcaggggattgggacgtgaaattcccgtaggacgctatcactcctgggtggtgagccgcaaggatttccccggatgcctggagatcacggccgaaagccgggagggacaaatcatggcattacggcaccggacgtacgacgtacatggcattcagtttcatcccgaatcggtgctgactccacagggaaaagagataatcaagaacttcttaaacaaccgataa

SEQ ID NO: 2055 - DNA, 294 bp, B.fragilis
tgttggtttctgtttttaaataaattatatctgagaaacaatataaataacaaaatgtttaaaaagagtttccttttcaaacgatcaataattcttccttacatctcatgtacatataatgtacatctgttagggccaaaagtccaagggccattctatgcgccaattgaatcggagaagaaagataaaaagacagcaataacatctaataatcaaatagttacaaataacaaccaacaaaaacagtggactaaaaaaagcagaaaggtgaacagtaaaaagaatacgatttaa

SEQ ID NO: 2056 - DNA, 1497 bp, B.fragilis
gtgagtatctacccgctcaagggattttttttcgggcccccgaaaaagtatgtttggggacatgcctataataattcaaaaccaagtcttccaatatttcaaattaattatctacatttacggtcatgcaaaaagacatggcatttacaaacagaacgtacacaacataaaaaaacatctacaatgaaaaaaatcctattcttattaacgatccttgtttcagttcccgctttttcacaaagcgccgatgaacgtataggagcttttttaaatcaagcggattggttcggacttgaaaaaaactatccgatactaaaagactccatgcaggcggatttcctaaagctaatgtccgaggcactgatcggctattacttcaatcgtccggatgaagccctgcaaagcatccataaactactggtcaaccaccaagccgagattggcggtcaaaatgcacttaacatggctatcctcgcatgtcagattgatggtctcaaagggaattatgccacagccgcacaaaactcgcgaagcattatggaacaactcaaacagcaaaatgcagaacaaggaatgtacaaaagcctcgaaggtatctgttatttctatgatcagttgaagaacattccggctctgggcatcacatgtccgcaagaggatatcatcattcctgtcgatatcgagaaagtgaagttaccgacaagcatcgagcccaaaggatggcgcggtacgacaattctaatacctgtgaccattaacggaaaaacctatcaatttattttcgatacaggagccggaacaagctacatgtcgcaacgcatggctaaagaaacaggtgtacgcattttaagtgactctttggtaataaattccaatttacccggagccatgacgggaaatttcggaactttggagaatatgcaaatcgggagcattactttccataactccctcatcaccatagcaccccccaatgcgtttgacagtattatgatagttgacgcggttctcggtatggattttatcggcttattcgatgaagtccgcatttatcccaaagataaaaaaatcgtttttcccaagagctccacacctctcccatcttacggacgtaacttgatgaaggttgaccgtgcactgaagttgaaagcccaggcaaacggcgaaacacttatgctgcatttcgatacgggcaacagcacagccggattgttttatcagtattacgaaaagcataagaccgaattcgagagtatcggcaaaaaagaaaaaataaccggtggcggattcaatcatgtcgttacaaaagatatattacgtttgccttcattcgatatggagattggagatgcaaccgcccacttaaaaaatctcgcagtggatattacccccaacggcatcccggccgaagatgacggaaacatcggcatggatatgatcaatcaatttgattgcgtaacgatcaatctaaaagacatgttcttaaaactcgaatag

SEQ ID NO: 2057 - DNA, 1089 bp, B.fragilis
aattgttatctttgtcgggaaaatagcaaaaatgacacagatatgaaagcagattacccctccgtactacttatttatacgggtggaactatcggaatgatagaaaacccagaaaccggtgctctggaaaattttaatttcgaccatctactaaaacacgtacccgaactaaaaagattcaattatcgtatctcttcttaccagtttgatccccccatcgactcctcggatatggaaccggcattttgggccaaactggttgaaataataaactacaactacgattcttttgacggctttgtgatcctgcacggcaccgacacaatggcctatacagcttctgctctcagtttcatgctcgagaatctgagtaagcccgtcatcctgaccggctctcagctcccgatcggtacgctgcggacggacggtaaggaaaacctgattacagccattgaaatcgcggcagccaaaaatccggacggtacggccatcgttcccgaggtctgcatcttttttgaaaaccatctgatgcgaggcaatcgcacgactaaaatcaatgctgaaaactttaacgctttccgttcattcaactatccgccactggcccgggtaggtatacatattaaatatgaacccaacctgattcgcaaaccggatttgagcaagcccctgaaaccacactatctattcgataccaatgtagtaatactcacgcttttccccggaatacaagagggcattgtttcggcactgcttcatgtaccgggactcaaagcagtggtactcaaaactttcggatcggggaatgctccccaaaaggagtggttcatcagagaactgaaagatgccaccgaccggggaatcatcatcgtcaacatcacccaatgcgcttccggcgccgtcgaaatggaacgttacggaacaggaatccaattactgcaggcaggggtgatcagcggctatgacagcacgccggaatgtgcagtgaccaaattgatgttcctcttaggacacggactcgataataaagagatcagatacaagatgaactcttgcctgatcggtgaaataactaaaagggtcgaataa

SEQ ID NO: 2058 - DNA, 1161 bp, B.fragilis
atgttacatctcatttatattgggagacatgctgatactatcgaacaattctctaagatagctgaaggggcattttatgccattcaaaacagtagaaaagcaagcgaatttatcgataaaatacgtgagaaatatgacatagtgattcttttcgagcaacggatcatctcaaaagacatccccgaaatccaatatctgagaaagaaatttccgggagtatatatcgctctcgttacagagggaatcaataaggaagaccgacccgcttacctgaaggccggtatcaataattcaataccatttaattctacccccgaaacttttaaagacataacggagtttatgatgcggcgcaagcagcaaaagattaatgatatccacaaaaaaggagcaaatctactgttcttcaagctccctttatggaaaagattatttgatatcgtcttctcttctatcgccatattatgtttgtcgccaatactgataattacggctgtagccatccgcctggaaagtaaaggtgctgtggtatacaagtcgaaacgggtaggaagcaattataaaatattcgacttcctgaagttccgctccatgtacactgacgcagacaaacatctgagagacttcaaccagctcaatcaatatcagacagaagaagaaccggaactgagcggagaagagttcctgatcggtgacgatatagaactgaacgaagaagagaccatgttaatttcagatgacttcatcatatccgaacaaaactatacaagcaaaaaatcgatagaaaaaaagaatgcattcgttaaattggagaatgatccccgcatcaccaaagtaggacgcatcatccgcaaatacagtatcgacgagttgccgcaattggtcaatatattgaagggagatatgtctatcgtaggcaaccgacccctcccgctttacgaagcggaactgttgacaagcgatgaatatattgaccgctttatgggaccggcaggactaaccgggctttggcaagtagaaaaacgcggaagcagtggaaagttgtctgccgatgaacgtaaacaactggacattaaatatgcccaaacgttttctttcttactcgacatggagattatcctaaggactttcaccgcgtttatacaaaaagaaaacgtataa

SEQ ID NO: 2059 - DNA, 423 bp, B.fragilis
cgttgttaccattatattcctataaatagggattgttccattatggaaaatttctatctttgccccaaacttaacggaatgaaccaagggtccctgaaaataatgagagggtttcggcctgtgctatttaattgggacatgccaggtatcacactctttactcactcgcatgtagtgaatggggtgaccatggtccattcgcacccgtttaagaaagcctctccccatagtcacaccccggtcgaatttcaattgattcatctgctgaaccacgtggtgactacggaagccggtatcttttttctctctctccagtttattgcttgtctgctctataccctttcgtggcgtccggatagggcaggatactgttcgtccgtcgtgggcgtggtatctttgcgggcacctcctgccgggaggtag

SEQ ID NO: 2060 - DNA, 903 bp, B.fragilis
ttacacttacataaattaaaaataaagatgaaaaagttatttgcattattattcatttctatgatttcgggaatgataatggcccagatcccggaggtttcgggcactattgtgtttaaaaaggacggacagcccgtcgttggggcattggtgagcgtattaggaacagatatcagcaccatcacagacgtcgacggacgttttactctaaaagaaatccccgaaaaggcacagagaatacgggtaaaatacatcggtatgcaacccaaagacgtaaaaataagacccataatgaatgttaccctcgacttagagaaaaaactggcattctttatacaagccggggttggagtcagcggatacaatcttgaaaacaataacgaagacatctatggaggcaacaatcatttatacatccagggcggagtcggattgaactataatttctcaacctatttttcattgcagccttctgtcaatgtggtggccaaaggttgtaagaacatgggcagaagaggctccgatggccaaggagaaatcactgtcgaccctgtatatctggaaatccctgtcctgatagccgcccgcttcatcatatcggatttcggccgactgattttcaatgcaggcccgtatgccgccatcggaatagccggcaaaggaaaatacactgacgaatgggaggggacaagcatgaaattcgatctgtttagcggtgacgaagccgttctcaaacggttcgatgcaggagtgcaggcagggtttgcttacgaaatcaaacacatcggtttctcgtacactttcggatacggactcctaaaaccatttaaagaatggaataaagaatggggagcgactccacacaacatcagccacaacttcggacttaaatatatattctga

SEQ ID NO: 2061 - DNA, 1206 bp, B.fragilis
ccccaaatacaaataacaaataaatataggattatgaaaagttttttagttgatcaggatggctattacggagaatttggaggtgcttatgtacctgaaatcctccacaagtgtgtagaagagttgcagaatacttatctcgacgtaatagagagcgaggacttcaagaaagagttcgaccaattgttgcgtgactacgtaggacgcccttccccactctatccggcccgccgcctgtcggagaagtacggttgcaagatgtatctgaaacgggaagacctgaatcacacgggtgcccataaaatcaataacaccatcggacaaattctactggcaagacgcatgggtaagaaacgtatcattgcggagaccggtgccggacagcacggggtggcaacagccacagtctgtgccctgatgaacatggagtgcatcgtatacatgggcaaaacggatgtagaacgccagcacatcaatgtagaaaagatgaaaatgctgggagcgacagtcgttccggtcacttcgggcaacatgactctgaaagatgccacaaacgaagccatccgagactggtgctgccatccctcggatacgtattacatcatcggttctaccgtagggccgcacccatatccggacatggtggcccgtttgcagtcggtcatcagcgaagagataaaaaaacagcttcaggagaaagaaggacgtgactatccggactatctgattgcctgcgtgggcggaggaagcaacgctgccggaaccatctatcattatatcgacgacgaacgggtacggatcgtattggccgaagccggcggcaagggaattgaaaccgggatgacggcagccaccatccaactcggaaaaatggggatcattcatggggcacgtacgtttgtgatccaaaacgaagacggacagattgaggaaccttattccatctccgccggactggactatcccggtatcggcccgatgcacgccaacctggcagacaaaaaacgggcaatggtactggctgtcaatgatgacgaagccatccgtgccgcttacgagttgacccggctggaaggaatcattcctgccctggaatcggcccacgcattgggagccttggaaaaaataactttcaagccggaggatgtagtcgtactgacggtatcgggacggggagataaagatatagaaacttatctgggataa

SEQ ID NO: 2062 - DNA, 273 bp, B.fragilis
atctcaaaacaatctcgaacaaaattcagacagattctaaaacaccctgaaataaagatgattaaagcatttttgaaaaagaaccgactcacatttatcggtctcgtcattggagctgtaggaggattcctgtattggaaatacgtaggttgcaccagcggaacttgtcccattacctcttcaccggtcaacagtaccctttggggagctgttatgggcggcctgctcttgaatctttttaaaacagacagtacccctaaaaaaacaaactaa

SEQ ID NO: 2063 - DNA, 252 bp, B.fragilis; identical to SEQ ID NO: 860

SEQ ID NO: 2064 - DNA, 315 bp, B.fragilis
aaaccatataaaagtttattcaaggaaaatttaaacaggttcttaattaattgttttcttataaaacaaatttccaacggaaagtactacggggataacattctttatggaatgaagaaggaaggaggtagtaggtgtgttgtatccggtagagaggtagttcggttggggggtgaattgatttcaccacaaattgaaacagagtcctacggagttttctgttattttcttctctgtggaactctgtgttaccctgtgatggtgagactttctaatagttcatctccctatgccattaatgtattggcccgatga

SEQ ID NO: 2065 - DNA, 1149 bp, B.fragilis
cctatggataattttatttttcagaatcccgtaaaactgatcatgggacgcgggatgatcagtcgcttgagtgaagaaataccggcggacaaacgggtgatgattaccttcggtggtggtagtgtgaaaaagaatggtgtatatgaccaggtgaaagaagcactgaagaatcatttcacagtagagttttggggaattgaacccaacccttccatcgagaccttgcgtaaggccatcgctctcggaaaggaggaaaaggtggactatctgcttgcagtaggaggaggatcggtcattgatggcaccaagctgatttccgccggactgctgtatgacggcgacgcctgggatctggtacttgccgggcgtccggtgacccacaccgtccctcttgccactgttcttaccctgcctgccacaggatcggagatgaatagcggagccgtgatttcgcgccatgaaaccaaagaaaaatatcctttctattccaattatcctctgttctctatcctcgatccggaagtgacgtttactttgccgccccatcaggtggcttgtggaattgccgatacgtttgtgcatgtgatggagcaatatatgactactccgggacagagccgggtaatggaccgttgggcggaaggcattttgcagaccttgatggaaatagctcccaagatccgtgagaatcagcacgattatcagttgatgtccgattttatgctgtcggccactatggcactgaacggctttatcgccatgggagtatctcaggattgggctacacacatgatcgggcatgaactgactgcgttgcatggcttgacccacggacacacactggtcattgtcttccccggtacgttgcgtgtgctccgtaaagcaaaaggcgacaagattctgcaatatggagagagggtgctgggcattacgtccggaagccgtgacgaacgcatcgatgaagctatccgccgcaccgaagaatttttccgttcactgggattgaccacccgcttaagtgaagagggcatcggcatggaaacaattgacgaaatagaacgccgcttcaatgaacgtggcgtgagatatggcgagaatgaagatgtcaccggagcggttgcaaaggaaatactgaaaagctcgctatag

SEQ ID NO: 2066 - DNA, 3255 bp, B.fragilis
accaaactcaaaaacattataataatgaaagaaaacaatataaagaaagtactgctgcttggttccggtgccttgaagatcggtgaggccggtgaatttgattattccggttcccaagcactcaaagccttgaaagaggagggcattgaaaccatcctgatcaaccccaacatcgctaccgtgcagacatcggaaggcgtggccgaccagatatacttccttcccgtgacaccctactttgtggagaaggtgatccggaaggaacgtcccgaaggcattatgctcgcctttggcggacagacggcattgaactgcggggtcgccctttaccgcgaagggattctggagaaatataatgtgaaagttctgggaactcccgtacaggccattatcgacaccgaggaccgtgaacttttcgtcgacaagctgaacgagatcgatgtgaagaccatcaagagcgaggcggtggagaacgcagaagacgcccgtcgtgctgcccgggaattaggctatccggtcattgtccgtgcagcttacgcactgggcggattgggttcgggtttttgtgacaatgaagaagaactggacctactcgtggaaaaagctttctctttctctccgcaggtattggttgagaagagcctccgtggctggaaggaggtggagtacgaggtggtgcgtgaccgttttgacaactgtatcacggtctgcaatatggagaatttcgacccgctgggcatccataccggtgagtctatcgtgatagctccttcacaaaccctgaccaataaggagtatcataaactgcgcgagctcgccatccgcatcatccgccacatcggcattgtgggagaatgtaacgtgcaatatgctttcgaccccgaaagtgaagactatcgcgtgatcgaggtgaatgcccgcctgagccgttcgtctgccctggcttccaaggctaccggttatccgcttgcctttgtggctgcaaaactcggacttggctacgggttgttcgacctgaagaactctgtgacgaaaaccaccagtgccttctttgagccggcactcgattatgtagtctgcaaaattccgcgttgggacctcggtaagttccacggtgtggacaaggaactcggctcttcgatgaagtccgtcggtgaggtaatggccattggccgcacttttgaggaagcgattcagaagggcttgcgaatgatcggacaggggatgcatggttttgtggaaaacaaggaactcgttatccccgacatcgacaaagcactgcacgaaccgaccgataaacgtatctttgtcatctcgaaggctttccgtgccggatataccatcgatcaggtgcacgaactgactaagatcgacaagtggttcctccagaaattgatgaatatcatgaatacttctgaggaactccatcagtgggggaacaatcacaagcagatagccgacttgcctgccgacctgctcaagcaagccaagcgtcagggattctccgatttccagattgcacgtgccatcggctacgaaggcgatatggaagacggcagcctttatgtccgcaattaccgtaagagcctgggcattgttcccgtggtgaagcaaatcgatacgctggctgccgaatatccggcacagaccaattatctttacctgacctatagcggcacagccaacgacgtcacttacctgggtgaccatcgttctatcgtcgttctcggttcgggtgcctaccggatcggttcttccgtggagttcgactggtgcggggtgcaggcgcttaatacgatccgtaaggaaggatggcgttcggtgatgatcaactataatcccgaaaccgtatcgaccgactatgatatgtgtgaccggctttactttgacgaactgacattcgaacgcgtgatggatgtccttgaactggagaatccgtacggagtcattgtttccaccggcggacagatacctaacaatctcgccctgcgtctcgatgcccagaacatccacattctcggaacatccgcccagagcatcgacaatgccgaggaccgcgacaaattctccgccatgctcgaccgtatcggagtggatcaaccggagtggcgtgcccttacttcacttgaggacattaactcgtttgtcgataaggtaggtttccctgtgcttgtccgtccgtcatatgtgctcagcggtgcggcaatgaacgtatgctccaatcaagaagagctggaacgctttctgcaactggcggccaacgtatcgaagaagcatccggtagtggtcagccagttcatcgaacatgccaaggaggtggagatggatgctgtggcacagaacggtgaaatcatcgcttatgcaatctccgaacacattgagtttgcgggagtacattccggtgacgccactatccagtttccgccgcagaagttgtatgtagagacggttcgtcgcattaaacgcatcagtcgtgagatagccaaggcgctcaatatctccggcccgttcaacattcagtatctggctaaagacaatgatataaaggtgatcgagtgtaatcttcgtgccagccgttcgttccccttcgtcagcaaggtattgaagatcaattttatcgaacttgccacgaaagtcatgctcggcctgcctgttgagaagccggagaagaatctgttcgaactcgattatgtcgggatcaaggcgagccagttctcgttcaaccgccttcagaaagccgaccctgtattgggagtggatatggcttcgaccggtgaagtgggttgcattggcagcgatacttcctgtgccgtgctcaaggctatgctttccgtgggttatcgcatcccgaagaagaagattctgctttctaccggaacaccgaagcagaaagtggatatgcttgaggcagcccgtatgttgcagaagaagggatatgatattttcgcgacaggaggttccagcaagttccttaccgagaatggtgtggagaacacccgtgtttattggcccagtgaagagggacatccccaggcactcgagatgttgcataagaaagagatcgacatggtggtcaatattcccaagaatctgactgccggtgaactggacaatggttacaagatccgtcgtgccgccatcgacctcaacatcccgctgatcactaatgcccgcctggcgagcgcgtttatcaatgcgttctgcacgatggacattgacgatatagcgatcaagtcgtgggaagagtataagtaa

SEQ ID NO: 2067 - DNA, 1188 bp, B.fragilis
aacataaacaatatgacaaacgaactggaactgaaatacggttgcaaccccaaccaaaagcccgcgcgtatctttattaaagaaggtgagttgcctatcgaagtcctgaacggacgccccggatatatcaatctattggacgccctcaacagttggcaattagtgaaagagctgaaagaagcgaccggacttccggcagctgcttcattcaagcatgtaagcccggcaggtgctgcggtagcagtagaaatgaacgacacgttgaagaagatttatttcgtagacgacatggaactctctccgatggcaactgcatacgcccgtgcccgaggtgcggaccgaatgtcatcatacggagactttatcgccctttccgatatctgtgacgaaccgactgcccgaatcatcaaccgtgaagtatcggatggcgtgattgctcccggctatactccggaagcacttgagatcctgagaaacaaacgtaaaggtacatataatgtcatcaagatcgatccggcctaccgtccggctcccatcgaacataaggatgtattcggaatcacatttgaacagggacgaaacgaactgaagatagacgaaagcctgctaaaggaaatgcctacccgtaaccggatcatcccggccgatgcccaacgcgacctgattatcgcactgatcactttaaaatatacacaatccaactctgtctgctatgccaaagacggacaagctatcggcatcggtgcaggacagcaatcacgcattcattgtacccgcctggccggaaacaaagccgatatctggtatttgcgccaacacccgaaagtaatgaatctgccctggaaagaaaaaatacgccgtgccgaccgcgacaatacaatcgatgtatacatctcggacgactacatggacgtactggccgatggtgtatgggaacaattcttcacccggaaaccggaagtgctgacccgtgaagaaaaacgtgcatggctcgatacccaatcgggcgtagctttaggatcggatgctttcttcccgtttggagacaacattgagcgcgcgcacaaaagcggtgtgagctacattgcccaaccgggaggttctgttcgtgacgatcatgtgatagaaacttgtgataaatatgacatagcaatggcctttacaggtatccgcctgttccaccattga

SEQ ID NO: 2068 - DNA, 942 bp, B.fragilis
aacaagaacaatatggcattagtaaacgaacattttttgaaattaccgggaagctatctgttctcggacatagcaaagaaagtcaatacttttaaaataacgcacccaaagcgggacatcatccggctggggatcggtgacgtgacccgtcccctgcccaaagcctgtatcgaagccatgcacaaggcagtcgaagagatgacatcggccgaaactttccgcggatacggccccgaacaaggatatgacttcctgatcgaagccatcatcaaaaacgattatgctccgcgcggcatacatctttcacctacagaggtatttgtcaacgacggtgccaaaagcgatacgggcaatatcggagatatcctccggcacgataacagcgtaggtgtcacagaccccatttatccggtctacattgacagtaacgtcatgtgcggacgtgccggagtattggacaccgaaagcggaaagtggagcaacgtcacttatatgccctgcactgccgaaaatcattttattccggccattccggagaagcgtatcgacattgtatacctctgctaccccaacaacccgaccggtacgacgctgacaaaggcggaactgaagaaatgggtggattacgcattggccaacgacaccctgattttgtttgatgcagcctatgaagcttacatccgggaaccggacatcccccactccatctacgaaataaaaggggccaagaaatgtgccatcgaatttcgcagtttctcaaaaacagcaggcttcacaggagtgcgttgcggatataccgtcgtaccgaaagagctgacagcagccacgctcgaaggagaacgcatccccctgaaccggttgtggaacccgccggcaatgcaccaaattcaacggtacgtcgtacattacgcaacgtgcggcagaagcgatctacactcctga

SEQ ID NO: 2069 - DNA, 1518 bp, B.fragilis
tcgatccgcaaagcggaggacagcctcttttattcatccgaccggaagcaagtactggcggttaacggcgaaatctataaccaccgtgacatccgcgcccaatatgccggccgctacgagttccggaccgggagtgactgtgaggtgatcctcgccctttaccgcgacaaaggtattcatttccttgaagagctgaacggcatcttcgcctttgccctttatgatgaagaaaaagacgaatacctgattgcccgggaccccatcggtgtaatacctttatatataggaaaggacgccgaaggacatgtctatttcggcagcgaactcaaagcgctcgaagggttctgcgacgagtacgaacccttcttacccggacactactatcacagcaaggaaaggacgatgaaacgctggtacacccgtgactggatggaatataaagaggagaacgacaagcaggcggacagccggtctcccacccggcagattcaggacgcccttgagaatgccgtacaccgtcaactgatgtccgacgtaccttacggagtgcttctttcgggcgggctggacagttctgttatctctgccattgccaaaaagtatgccgccaaacgcattgaaaccgatggcgcgagcgatgcatggtggccgcagctacactcctttgccatcggactgaaaggtgcaccggacctgatcaaagcacgtgaagtagccgaatacatcggtacggttcatcatgaaataaactacacccttcaggaagggctcgatgccatccgggatgttatctatttcattgagacatacgacgtaactaccgtccgtgcttccacaccgatgtatctgttggcacgtgtcatcaagtcgatgggcatcaagatggtattgagcggtgaaggtgccgacgagatcttcggcggctacctttatttccacaaagcacccgatgcccgtgcctttcacgaagagaccgtacgcaaactgtctaaactgcatctatacgattgccttcgcgccaataagagcctcgcagcatggggtgtggaaggacgtgtccctttcctcgacaaagagtttctggatgtggccatgcaactcgatcccgaaataaaaatggctccgggaaaagtcatcgaaaagaaagtcctgcgcgaagcctttgcggatatgctcccttccggcatcgcctggcgccaaaaagaacagttcagtgacggtgtggggtatagttggatagatacgctgaaagagattaccgcaacggctgtcagtgacgaacagatggcacatgccgcagaacgttttcccatccacacccctatgaataaagaagagtattactaccgcagcatcttcgaagagcacttccccagtgaaagcgccgcccgcagcgtgcccagtatccccagcgtagcctgttcgacagccgaggcactggcatgggacaccacattcaagaacctgaacgatcccagcggacgtgccgtaaaaggagtacacgaagaagcatattaa

SEQ ID NO: 2070 - DNA, 855 bp, B.fragilis
gggagtgtaaatgaagagggttcgcccgagggtttgttgaggaaagtccaactgatacgcattcccctccggctgggcgaggacgctttcaccaccggagaaatatcagaagggaaagcagaaaaactgatccggctgatgaaagcctacaagcaactgatgaaaatattcgaagtttcggattaccgtgcctgcgccacatctgccatgcgcgatgcacgcaacggaaaagaaatcacgcgcaagatagaaaagaaaaccggtatccgcgtcgaaatcatcgacggtcaggaagaagcgcatatcgtctacgataaccacatcgaacagctttttgcttcgggccagaattatctgtatgtcgatgtcggcggcggcagcacagaaatcaatctgatctgtgactccgaactcaaaagttcacgctcctacaacatcggaaccgtgcgcatgctcagcggcatggtgaaaaacgaagaaaaagagcaaatgcgaaccgacctccaggcattggctgccgaatatactcccatacagatcataggatcgggaggcaatatcaataagcttttccggctggcggacaaaaaggataagaaacagtctttcctcccgattgaatcgttgaaggaaatctgcgaaaccttgaaagcgctatcaaaagaagaacggatcaagcagttcaaactgaaacccgaccgggcggatgtaattgttccggcagcggaaatttttctggaagtggcaaaacaagtaaatgcaacgggaatcacagtcccgacaatcggactgtcggacggtatcatcgacagcctctataccaagaatatgcgcatggaaacggacgctaaataa

SEQ ID NO: 2071 - DNA, 996 bp, B.fragilis
atatgcccaaacgttttctttcttactcgacatggagattatcctaaggactttcaccgcgtttatacaaaaagaaaacgtataaccgtacgatatcggatcatggatacttttattcaaacaacagatttcatcttatttctatgcttcagtctgatgactgtttatctgggagttttggcaatagcagcttctctaagaaacgacactccatatccccaagcaggaaaaagacatagattcgccattctggttcccccgggtagcacttccctccccttaccccattatccggaagagctatatcaagtattcacttatgaagatctgacagaagctatagccgcactgaatgaaaatgatttcgatggtgtagtcgtcctgggagaaaccacccggatcgaacctgccttcctggaggaaatcaacagcgttttcgatgccggcatccaagccattcaactccgtcacatcacggaaaaacgttcgacccgcaaacaatactttcaggctctgaacgaagaaatcactcaggccctgttcgggacaggggcaacccgcctgggagtgtcatcggctttatacggtgcggacatggtattggacttgaaatggctgaaaaagaatcaaaagagccgcaagagcaatctggaaagaagattagtccggcaaggtattttcgtggaatatctggaaaaagtgaaagtttatagcagcgacatacgtgctccacgctataaagtaagattttccaaagcgctccgcgcacttccggaagcaatattcactgcccactgggattattgcaacaaaatactcagatggattcttccttcccggaaaacgaatttaataagtattgcacttattgcaacggcattgctttgctacgactggagtctgtctctgaagtggtggagcttactttatatactgatgttcatcatttgtctggctatcccggattatctggtacgacaaaaaacaaaaaaataa

SEQ ID NO: 2072 - DNA, 498 bp, B.fragilis
aaagcagaaaaaatgaaaaagagcattcttatccccttcctattcatgggactgttggctttcgcatcttgcaaaggaacatccgagaataaatcgaccaccgctacagatacggtacaagccgaaaagccacaatcgggcaccattcacctgacccgtgcggaatttctgaaaaagatagccgactacgaaaaccattccaaagagtggaagtatctgggtgacaaaccggctattgtcgacttctacgccgactggtgcggtccctgcaaaatggtggccccgatacttgaagaattatccaaagagtatgccggaaagatttatatctataaagtaaatgtcgataaagagccggaactggcaagagactttggtattcagagtattcctaccatttggtttgtgccgatgaaaggcgaaccccaggtcaatatgggagctttatccaaggagcaattaaaaggatacatcgataaagtattattgaaacaatga

SEQ ID NO: 2073 - DNA, 846 bp, B.fragilis
acggatagaaaagctatcacccatcaaagaaacatgaaagatatattatctgaaatcattgccaataaacgttttgagatcgacctgcagaaacaggccatcccatcggaacagcttcaggagaagttatctgacgaggtacagccgggctactccatgaagcaggcactggcctcttcggctaccggtatcattgccgagttcaaacgccggtctccgtccaaaggctggatctataaaaatgcatgtccggaacaagtcgtgccggactatatagccgccggtgcttcggcgctttctatactcacggatgaaaaattcttcggaggaagcctgaaggatattcgcacagcacgccctttggtgaatatcccgatcctgcgcaaagattttataatcgatgaatatcaactgttccaggccaaaattgtgggagccgacgccatattgctgatagccgccgcactggaggccgatcaatgtcatgcgcttgccgcaaaagcccatgaattgggactggaagtcttgctagagattcatactgccgaagaactgccatttataaataaggagatagacatggtaggtatcaataaccgcaacctgggcactttcttcacagatgtagagaattctttccggttagccggacagttgcctcaggatgcgctgttggtatcggaaagcggcatctcggatccggaaacagtgaaacgcctgcgtaaagccgggttccggggattcctgatcggagaaacgtttatgaaagcccaacagcccggacagaaattaaaagaatttataaacgacctgaattcaccacagagtgacacagagtctcactga

SEQ ID NO: 2074 - DNA, 717 bp, B.fragilis
ataaggtgtttgatggataaactgcaaaaatataagcctaccgataaaatgatcgaccttatcggtgataattattctcttttacaagttatgagccggtttggactttcgctggggtttggtgacaaaacggtgaaagaagtctgcgaaatgaataatgtcgattgtcagacgtttctggtagtcgttaacttcatggccgagggattctcgcgtatggacggcagtgccgacgatatttcgataccggccctggtcgattatctgagacaggcgcatatttattttcttgattactgcctgcctgccatccggaggaaactgattgaagccattgactgttcgcaggacgatgtctccttccttattctaaagttctttgacggatatatgcgggaggtacgcaagcacatggagtatgaagaaaagacagtgtttaagtatgtagatacgctgattcatggcaatgctcccaagaattatcagatcagcaccttctcgaaacatcacgatcaggtaggggaacgcctaacggaactgaagaacattattattaaatactgtcctgccaaggccaataccaatgtgctgaatgctgccttgttcgatatatatgcttgcgaagagggacttgaatcacattgcaaagtagaagattatctgtttgttcctgccattctgaaattggaaaggaggatgcgagaaaatgaaaaataa

SEQ ID NO: 2075 - DNA, 798 bp, B.fragilis
aagtatatgaacagaataaaccaacttttcgacagcaatcccagagatttgctatccatctatttttgtgccggctatcctactctcgaagggacaaccgaagtaatccgtactcttgaaaaacatggagtgaacatgattgaaatcggtattcctttcagcgatccgatggctgacggtatggtgattcagaatgccgccacgcaggccctccgcaacggaatgtcactcagactattgtttgaacaactgcacgacatccgtcgggatgtaaaaatcccattaatcctgatgggatatctcaacccgatcatgcagttcggctttgacaacttctgccggcaatgcgccgaatgcggcattgacggagtcatcattcccgaccttcctttcaaagactatcaggaacacttccgcaccattgcagagcggtatgacgtgaaggtaatcatgcttatcacccctgaaacaagtgaagaacgcgtacgcgagattgatgaacacaccgacggattcatttatatggtttcatcggctgccaccacaggagctcaacaagactttgacgggcaaaaacgtgcttactttaaaaagatcgaaaaaatgaatcttcgcaatccccggatggtcggtttcggtatcagcaacgaggctaccttccgtgccgcttgcgaaaatgcctcgggagccatcatcggcagccgttttgtcactctgctccatgaagagaagaacccggagaaagcaatcacacgcttaaaagctattttgaatttatcatccaatgatttgagataa

SEQ ID NO: 2076 - DNA, 1167 bp, B.fragilis
ttctgcatgaaaacctcttatctactcctgtcctccgctttgttgctgggatgcctatccgcttgcaacacttccccccgggaacctaaagctatggaagcaaacgatggaagcgtaactactatcgaaagcaacggaaacaaactgacggtatgtgacttatcggctgtaaaagacacgatagaagtgccgctcagcgagtttgtggaagactgtcgcatcgtgcgttttgagacctctgaagaggcatacttcaaagcctggtttatcaatgctaccgataagcatatcggtatccgccagggaaaccaggatgtgtttaaactgtttgacagggatggtaagttcctgtataatgtcggttccgtaggaagcggtcccggtgaatatgacaccaccctctacgatgaatgcattgatgagaagaacggccatatcttcttcacaccttttgtggggaaaagaatcatgatgtatgatatcaacggacaatggattaaagatattccgcttcccatgcaaattaataaagcgaaaatatgggtgaatgaagacggaagcttatctgttgtacacatgcctttcgaggaaggtgagccccttgctttcagggtggataccgaagggaatatactaaaccaaattccggcaactgccgcaacgaaggtgatgaacttcgacggagaggttttctcttataggaactgtggcgatttcgatttcttccataccggtatagatactcttttcacttacgattccgccggcaataaactgttgccgaaattcacgatgactttcccgaatatgaatgagaagccgatacatttatattacagacttccccatcatttcattgtcacctactggggtaataagggagagggaggtggagatgtcttggtagacactgagaagaatgcttcttcttatttccgccttgtgaacgacttttacggtaaccttcctattccggctccgggccatagcttttatcgcggatactttatacagagtctggaaccgggacagttgattgaaaagatagaaaaacagatcgcttccggcaaatgctccggtcaggatgaacagaaactcaaggaactggcggctactttgactgagaatgataataatgttctgtttatcggaaaggttaagaaataa

SEQ ID NO: 2077 - DNA, 222 bp, B.fragilis
atgcaacgggaatcacagtcccgacaatcggactgtcggacggtatcatcgacagcctctataccaagaatatgcgcatggaaacggacgctaaataaaacgggtcaccacagattacacagattaacacagattatttatcgtgttgattcatggtataaaagaatctatgcaaatgtgagctatgattcaccacagattacacggattttcacagattaa

SEQ ID NO: 2078 - DNA, 810 bp, B.fragilis
attgcgttactttttatatctttgaaggcgaaccaaaaactgaaatatatgaaaattaaaaaacttctgtttgcctctgccctgcttttctcagcatacaatgcctctgcgcaaactcaggtcattgcccatcgcggattctggaaaaccgaaggttctgcgcaaaacagtatcgccgccttgctaaaagccgactccatcggatgctacggttcggagtttgatgtatggctggcagccgatgaccagttagtggtcaaccatgaccccacatttaaagggaaaaggatggaaaactcaccttccaccgcactgacagccatcaaactcgataatggggaaagcctgcctacccttgccaaatacttgaaagcggcacaaccgctacacacccggttaattcttgaactgaaagcacacagcaccccactccgcgaaacgaaagccatcgaaaaaatcgttgccctggtcaaagacatgggactggaggaacggatggaatatatcaccttctccctgcatgccaccaaagaatttatccgcttggctccggaaggcactcccgtctactatcttgatggtaacctgtcacccaaggagctgaaagaactggggtgtgccggtccggactatcattacaccgtattccgcaaacatcccgaatggattcaggaatgccatgatttgggcatgaaagtgaatgcctggaccgtgaacaagacggatgacatgaaatggctgatcgatcgtaaagtagatttcatcaccaccaacgaaccggtacagctgaaaaatctactgaaaaaataa

SEQ ID NO: 2079 - DNA, 1884 bp, B.fragilis
atggaacaactgaaacatgaatgtggcgttgccatgatacgtttgcttaaaccgctggagtactatgaaaagaagtacggaacgtggatgtacgggctgaataagctctatctgctgatggaaaagcagcataaccgtggtcaggaaggtgccggtctggcgtgtgtgaaactggaagtaaatccgggtgaggagtatatgttccgtgagcgggcattgggttccggtgccatcaccgagatatttgagacagtacaaagcaacttcaaggatctgagcaaagaacagttgcacgatgccgcgtttgccaaacggacgctgccttttgccggagaagcttatatggggcatctgcgttactcgactaccggaaaatccgggatatcttatgttcatccgtttctcagaagaaataactggcgggcgaagaatcttgctctttgcggcaacttcaacatgactaatgtggatgaaatttttgcccgtatcacagccatcggccagcatccccgtaagtatgccgatacgtatattatgttggaacaagtggggcacaggctcgaccgtgaagtggaacgtctctttaacctggctgaggctgaaggcctgaccggcatgggcgtgacgcattacattgaggaccacatcgaccttgccaacgtgttgcgcacgtcgagtaaagaatgggacggggggtatgtgatgtgcggactgaccggtagcggagagagctttgcattgcgtgacccgtgggggattcgtccggcgttctggtatcaggatgacgagattgcggtgcttgcttccgaacgtccggtgattcagacggcactcaatgttccgataggagaaatcagggaattactgccgggacaggccctcctgatcagtaaagagggaaagttgcgtacggcacagatcaataaggcacgggagaagaaagcctgttcgttcgagcggatctacttctcgcgaggcagtgacgcggatatttacaaggagagaaaacaactgggtgagaaactggttccgaacatcctgaaagcgattgataatgacctcgaccataccgtcttctcgttcatcccgaatacggcagaggtggcattttacggtatgcttcaggggctggacaattatctgaatgaagagaaggtgcggcagattgcgagcctgggacatcatccggatcacgatgaactggaagtgattctgtcccgccgtatccgttcggagaaagtggctatcaaagatatcaaactgcgcactttcattgccgagggcaatagccggaatgacttggcagcacacgtatatgacatcacatacggcagtctccgttccggtatcgacaatctggtgattatcgacgacagcattgttcgcggtactactctgaaacagagtattatcggtatcctcgaccgtctgggaccgaagaagatagtcatcgtctcttcttctccgcaagttcgctatcccgactattacggtattgatatggcgaagatgtccgaattcatcgcctttaaagctgcaattgaattgctgaaggaccgggatatgaaagatgtgatcgcatcggcttaccggaagtcgaaagatcaggtgggactgccgaaagagcagatggtaaactatgtgaaggatatttatgctcctttcaccgatgaggagatttcggaaaagatggtggaactgctgacgccgaaaggaacgaaagcgaaagtgcagattgtctaccagccgctcgaggggctgcacgaggcgtgtcccaatcatacgggagactggtacttcagtggcaactatcctacaccgggcggggtgaagctgctgaacgaagcatttattaactacatcgagcaggtgtaccaattttaa

SEQ ID NO: 2080 - DNA, 1059 bp, B.fragilis
aaaaacaaactaatcacacctcttatgacaaccacaaacgaacaagaacaatcgagagcctacatacttgcaggcatctttacgctctcactacgtcttgtagtgggatggacttacttttcggctttctggcgacgcctcgtactcgagaataagctgataccggacagtgccggatacatcggagagaagtttaaccatttccttcccaattcgataggtatccgcccggtcatcgaatatctggtatcgacacctgatatgttatggtgggcaatggtgatttttactcttgtagaaggtatagtcggactgctttatatgttggggttcttcacccgtctgatgagtatcggcgtattcagtctggccaccggcattctcctggggtcaggatggttgggaaccacctgtctggacgaatggcagatcggtattctgggtgtagccgccggtttcaccatcttcctttccggcggaggaaagtactcggtcgaccatctgatagagcggaaattctctttaaagaagaaagcagcctggctgtcatggctgacttccggagaattgcctgtaagcgccaagcgatttgccaatgtcagcgtggcaggtgccatcgttatcttcacactgagcctatataccaaccaagagttccacaatggcgtctggggcccccttcataacaagtccgtcaaaccgaaaattgaaatatccgacgcacaaatagagaacaactctctgtcattcagtgtttatcgcgttgaaggtgtcgatgtatacggttctttcctgattggtatcagcctgaagaatgccgatggagacattgtgctggaaaagaaaggagaagaattagcagacttcccgatcggaaatatcgataataaatacattgcccgggtagctccgggtaagcacagcctggtaatcccactcggaagcaaagcgacccttacaatcgatgatacggctataggcggtttgcccaaaggaaagtatgaattagtactgaccgacatcagtggtatcacctggaaaaaagaaatcatccattaa

SEQ ID NO: 2081 - DNA, 360 bp, B.fragilis
aaaccggaactttttctgctgcctgttgttgagagtacatataaatcaataaagagtgtaataatgaatatagcagagcaattggatgccgtatccggaacgaaccgtctggtattggtggaattttatgcagactggtctcctcattatgaatggctggaacctgtagtacggacttacgagaagcaagtttccgaggtgattaaagtgaatatcgtggaggacaaggcagtggcagattcgttcaatatcgagacagccccggcttttattctcttgcagcgcgggcacgaattgtggagacaagtgggagaactgaccatcgatgaacttaaactggtattggaagagtttaaatag

SEQ ID NO: 2082 - DNA, 2079 bp, B.fragilis
actcttatccgaatgaaatcagacgaagcgaaacgtaaaaagctttatgtagaacgggacatcagttggatgtatttcaatcaacgcattttgcttgaagctgcccgcccggaagttccgttactggaacaacttacctttctgggcatttactctaacaatttagacgagttcttccgcgttcgcgtagctacactgaaccgcattgtagagtacgatgacaagaacatccgtgaagagcgtgacacggccgcacgcaccttgaaacagatcggaaagctgcacaatcaatactaccggcagtttgaagaaacgttcgcttcgatcatggagaagttaaagcaagaaaacatccacgtcatcaaagataccgaactgacaccggaacaggaacacttcatcacttcactctaccggaaccggctgaatgggtctaccaatccgctctttcttactaaaacgtcccgtcatacggacgaccagaccgatgaagacatctaccttgccatccgcctgttgcgcaaagacagtgagggaaaagtgaaaatgaaagattatgccgtcatcgggctccccaccgccgagttcggacgcttcatccgcctgccggattcggaaggcaaaacctatctgatgtttctggacgacgttatccgctactgcttgccgatgatcttcataggcatgaattatacggactatgaagcttacactttcaagttcaccaaagacgccgaaatggagatagacagtgatctgcgtacaggtgtgctccaaaaaatatcgaaggggatcaaaagccggaaacggggcgaaccgatccgtttcgtctatgacaaagagatgccgaaagatctgctgcgaaagctgaccgaccgcctcaacgtggataaaaacgacacccgtgtagcaggcgggcgctatcataacttcaaagacctgatgaagtttcccgactgcggacggtccgacctgaaatatcctgcctggcctcccgtcttcaaacaggaactgaacgggacggaaagtatcctgagactgatcaggaaacaggaccggtcgctgcattacccctatcaatcgttcgataccgtgatccgtgtattgcgcgaggcagccatcagcaaagaagtgaaaagcatcaagatgactctctatcgcctggccaaagactcgaaggtagtgaaagctctgatctgcgccgcacaaaacggaaaaaaagtaacggttatcatcgaattgctcgcccgtttcgacgaagcgtccaacatcagctggagcaaacgcatgcaagaggcaggaatcaaagtgatattcggagtggaaggtctgaaaatccactccaagctggtacatatcggaacacggtttggcgacctggcctgtatcagcaccggaaattttcatgaaggaaacgcacggatgtataccgatttcaccatcatgacagcacatcgctccattgtgagggaagtagaccgggtattcgacttcatagagaagccctacctcccggtgaacttcaaggaactgctcgtgtcgcccaacgatatgcgcaaacggctgacagccctgatcaaccaagaaatcaagaacaagcgacagggaaaagaggcatacatccttgccaaagtgaaccatattaccgaccggatactgatacagaaactctacgaagcttcgacagccggtgtacaaacagacctggtggtccggggcaactgctccctggtgaccggcatcccgggagtcagcgacaacatccggatcaacggcatcatcgaccgttatctggaacatccgcgcatcttcatcttcgccaacggaggggaagaaaaatactatataggatcggccgactggatgccccgcaatctggacaaccgcatcgaagtgcttacgcctgtatacgacaaagtgatacaagcagaactgaaacgtgtggtctgctacggacttcgcgacacggccaaagggcgaatcgtggacggaagcggcgagaacaagacttgggaaaacagcgatgcacctttccgctcgcaggaagaattatacaaatactataaagaatcagaatga

SEQ ID NO: 2083 - DNA, 228 bp, B.fragilis
aatactacccgtacgtcgtggcaattccggctgagatcgttgcgtgccaggtccaccagcattacatgttctgcgttttctttcggatcagccaaaagagcttccgtcagttccttgtctttgatggtgtctcccgtgcggcgtgtggtgccggcaatcgggtcgatatacgcctgtccgctttccactttgcaatgcgtttcgggtgacgagccgaagatgcggtag

SEQ ID NO: 2084 - DNA, 1644 bp, B.fragilis
ttcttcctgcgagcggaaaggtgcatcgctgttttcccaagtcttgttctcgccgcttccgtccacgattcgccctttggccgtgtcgcgaagtccgtagcagaccacacgtttcagttctgcttgtatcactttgtcgtatacaggcgtaagcacttcgatgcggttgtccagattgcggggcatccagtcggccgatcctatatagtatttttcttcccctccgttggcgaagatgaagatgcgcggatgttccagataacggtcgatgatgccgttgatccggatgttgtcgctgactcccgggatgccggtcaccagggagcagttgccccggaccaccaggtctgtttgtacaccggctgtcgaagcttcgtagagtttctgtatcagtatccggtcggtaatatggttcactttggcaaggatgtatgcctcttttccctgtcgcttgttcttgatttcttggttgatcagggctgtcagccgtttgcgcatatcgttgggcgacacgagcagttccttgaagttcaccgggaggtagggcttctctatgaagtcgaatacccggtctacttccctcacaatggagcgatgtgctgtcatgatggtgaaatcggtatacatccgtgcgtttccttcatgaaaatttccggtgctgatacaggccaggtcgccaaaccgtgttccgatatgtaccagcttggagtggattttcagaccttccactccgaatatcactttgattcctgcctcttgcatgcgtttgctccagctgatgttggacgcttcgtcgaaacgggcgagcaattcgatgataaccgttactttttttccgttttgtgcggcgcagatcagagctttcactaccttcgagtctttggccaggcgatagagagtcatcttgatgcttttcacttctttgctgatggctgcctcgcgcaatacacggatcacggtatcgaacgattgataggggtaatgcagcgaccggtcctgtttcctgatcagtctcaggatactttccgtcccgttcagttcctgtttgaagacgggaggccaggcaggatatttcaggtcggaccgtccgcagtcgggaaacttcatcaggtctttgaagttatgatagcgcccgcctgctacacgggtgtcgtttttatccacgttgaggcggtcggtcagctttcgcagcagatctttcggcatctctttgtcatagacgaaacggatcggttcgccccgtttccggcttttgatccccttcgatattttttggagcacacctgtacgcagatcactgtctatctccatttcggcgtctttggtgaacttgaaagtgtaagcttcatagtccgtataattcatgcctatgaagatcatcggcaagcagtagcggataacgtcgtccagaaacatcagataggttttgccttccgaatccggcaggcggatgaagcgtccgaactcggcggtggggagcccgatgacggcataatctttcattttcacttttccctcactgtctttgcgcaacaggcggatggcaaggtagatgtcttcatcggtctggtcgtccgtatgacgggacgttttagtaagaaagagcggattggtagacccattcagccggttccggtagagtga

SEQ ID NO: 2085 - DNA, 1029 bp, B.fragilis
ccgcgcatgcgtaacattgaaaaaacaaactatatgaaacagattctatacaaattattcgaacatcaatatctgggtcgcgacgaagcccgcaccatattgcagaacattgcacaaggcaaatacaatgatgcacaggtggcctcgctgatcaccgtcttcctgatgcgtaacatctcggtagaggaactttgcggatttcgtgacgcactgcttgaaatgcgggtcccggtagatttgagtgagtttgccccaatagacattgtgggaaccggaggggacggcaagaataccttcaacatctccaccgcggcttgcttcacagtagccggtgccggatttccggtagtcaaacatgggaattacggtgccacttccgtcagcggagccagcaacgtgatggaacagcacggagtaaagttcaccgaccatacagaccgcctacgccgctcgatggagaagtgtaacatcgcttatctgcatgcacctctgttcaacccggctctgaaagcggtggcaccgatacgcaaagcattggccgtacgcacgttcttcaatatgctgggcccgttggtaaaccctgtcatccccacctatcaactgctcggagtatacaatctcccgctgctccgcctgtatacctatacctatcaggaaagcgctacccgctttgcggtagtacatagcctggacggatatgacgaaatctctctgaccgacgaatttaaagtggcgacatgtggaaacgagaaaatctacactccggagagcctgggcttcaaccgctgtcgggaatccgaactcgacggtggaaataccccggaagatgccgcaagaatatttgacgccgtaatggagggaacagccaccgaagcacagaagaatgtggtgatcgtcaatgcggcctttgccatccgggtgatttgtccggagaaaccgatagaagaatgtatcgccctggcacgggaatcactggaaagcggcaaggctcgggagactttaaagaaatttgtcgaactaaacggatag

SEQ ID NO: 2086 - DNA, 453 bp, B.fragilis
aacaaaaatagaatagcagttatgaaatcaatgaaatttataggatgtctatacttactggctttactttccgcttgtggaagcagaacttcggattatgatgccacgggaactttcgaagctacggaagttctggtttcggccgaagcttcggggaaactcttgtactttcatgttgaagaaggtacccggctgaaagcaggcgaagaagtagggctgatcgatacgctacaactctatctgaagaaactgcaattgcaggccagcatgaagtcggttgaaagccaacgtccggacgtcaacaaacagattgctgctacccggcagcagatcgctaccgcccggagagagaagagacgcgtggaaaacctgttgaaagccggagccgccaatcagaagcaactggatgattggggtcttcaccacgggggtggaaggtatcgcgttcatggc

SEQ ID NO: 2087 - DNA, 195 bp, B.fragilis
atgtatcggcttctcattcatattcgggaaagtcatcgtgaatttcggcaacagtttattgccggcggaatcgtaagtgaaaagagtatctataccggtatggaagaaatcgaaatcgccacagttcctataagagaaaacctctccgtcgaagttcatcaccttcgttgcggcagttgccggaatttggtttag

SEQ ID NO: 2088 - DNA, 912 bp, B.fragilis
atagatataagacatgctttttataaaaacaaaagtcaaaaagacatatctttgtgcagtaacaatgcaaaaggatacataaatcaaccaatattgataaaaatggcaagagcgattcaattcaccaagatgcatggaacagggaatgattacatctatgtaaatactctcagatttccaatcgcccgtcctgaaaaggcagccatcgaatggagtgcttatcatacgggaatcggaagtgacggacttgtgttgatcggacactcggataaagcggatttcagtatgcgcatattcaatgccgacggttcggaggccatgatgtgtggcaatgcaagccgatgcatcggcaaatatctctatgaatacggactgacctccaaaaacgttatcacactggacaccctctcgggcatcaaaatattggaactacaccttgaaggacggaccgtggaaactgtaacggtcgacatggggataccactggaaaccggtacgattgacttcgatggcgaatttccgttcctttctacccaagtgtcaatgggcaacccgcatctcgtcacttttgtggacgacatccggatcgtcaatctttcggagatgggaccgaagctggaaaaacatcctctgttccccgaccgtacaaatgtagagtttgcccagataacgggagagaatacaatccggatgcgggtttgggaaagaggatcgggcatcacacaagcctgcgggacaggtgcctgcgctacagccgtagccgcacacctcacgggacggacggggcgaaccgttaacgtagtaatggacggaggcacactgaccatagaatgggacgaagcaacaggccatatatctatgaccggaccggccgtaaaagttttcgatggaaccatagaactgagagaatag

SEQ ID NO: 2089 - DNA, 183 bp, B.fragilis
ttgtatcgaagcgatgcgacgcatcaagaaccgactgtaatgacagacagtcatgtcaccacagattacacggattttcacagattaataatttatttcattgaaaatcagattaaaacatctgtgttaatctgtgtaatctgtggtgaatacttgccccatctttcttctattattcgataa

SEQ ID NO: 2090 - DNA, 201 bp, B.fragilis
  unsure (103),(104),(105),(106),(107),(109),(111),(112),(113),(114),(115),(119),(120),(121),(122),(123),(124),(126),(127),(128),(129),(132),(133),(134),(136),(138),(139),(140),(141),(142),(144),(148),(153),(171),(178),(179),(180),(181),(183),(189): Identity of nucleotide sequences at the above locations are unknown.
gaatataatggtaacaacgctatcgggccaaatggttacacctttttaatctattttggatttttccgcctccaggcggcttataaaaaaaaaaaaggggggnnnnnanannnnncccnnnnnncnnnnaannncncnnnnncnaatnctttnccacctttattcaccaanatatccnnnncntttatncccaaaaactaa

SEQ ID NO: 2091 - DNA, 279 bp, B.fragilis
accggttgtggaacccgccggcaatgcaccaaattcaacggtacgtcgtacattacgcaacgtgcggcagaagcgatctacactcctgagggaaaagaacagattcaggaaacaatcaattactacatgaccaatgcccggatcatgaaagagggcctggaatctaccggcctgaaagtgtacggaggggtgaacgcaccctatttatgggtaaaaaactccaaaacggaacaagctcgtggcgcttctttgaccagatgctatacgaagacaacgtag

SEQ ID NO: 2092 - DNA, 633 bp, B.fragilis
aattggaaaggaggatgcgagaaaatgaaaaataatgaatcaatccgtatagctgtcgccgagacttcggtgatcatacgcagtggtctgacactggccctgaaacgtttacccaatttaaagattcaaccggtggagttgttgtcggtagaggcgcttaatgattgtctgcgtacgcagtttcctgacatactggttgtcaatcccacctttggtgacttttttgatgtggcgcgtttccgtgaagagactgccggcaaaggaatccgggtagtagcgttggtcagttcgtttatcgatgcttcgttgctcagtaaatacgatgcgtctttttctattttcgatgatttggaggcattggccaataaaatcaatcttttgcagaatatcgagcccgaagaagaggaggacagtcaagagaatttgagccagcgtgaaaaggagattgtgatttgtgtggtgaaaggaatgaccaataaggagatagccgaaaagctgttcctctccattcatactgtgattacacatcgcagaaacatcagcaagaagttgcaaatacacagtgcggccggtctgaccatctatgctattgtaaataagctggttgagcttagtgatgtgaaggatttatag

SEQ ID NO: 2093 - DNA, 1137 bp, B.fragilis
aataaccatatctctgtttttacaactatgaagacacataaactgctattcgtcacactgctgggcactgtctgcatctcctgtggtcatccgtctcacaaaaccggaagtgagaaggaagcgctgggcaaactcctttttcatgatacttcactgtccgagccacccgggcaatcgtgtgccacctgccatgcttcttccaagggatttgccgatgaacaagcccgtgccatatccgaaggagccgtccaaggactcttttcccagcgcaactccatgtcagtgtgctatgcggcctttgtgcccgaattgcattatgacgatgatgacgaaaactatgtgggaggtttgttctgggacggtcgttctccctccttgcaggatcaggcaggcattccgctcttgaatcctgtggaaatgggaaatagggacaaacagatggtggcggagaaagtgaagcggactccgtattatgaccggatagtgcagatatatggagagacagaacatgccgattctttgtttgcccatgttacggacgcattggccgcttatcaggcatccaaggagatcaatccctttacatccaagtatgatgcgtataaaaaaggaaattatcagctgaccgaacaggaagcgagaggcaaggaactgttcaaagataaggggcagtgtgccgaatgtcatatcctggaccgtgacaaacgtgcgcatcgcacgctgtttaccgatcatacttatgataatctgggcattccgaagttgccggatcatcctcactataaggtagcggcagaatattttctgttagctgcggattcggttgatctgggactgggagccattgtgaatgccgaaagcgaaaatggcaagttccgtgtacccacgttgcgaaatgtcgaactgacggctccgtatggtcataatggctattttaagacactcgaggagattgtacatttctataacgtgcgggatgtgagtgatgaatttcctcctgccgagtatcctgccaccgtgaacaaggaggaactgggaaacctcggactgacacaggaagaagaagccgatatcgtggcatttatgaaaacactgaccgacggctatatgaaagtgcataaatcggagaagcgctag

SEQ ID NO: 2094 - DNA, 432 bp, B.fragilis
gcatactccatacatatcaagagaacaaacagcaagacaaacaacataactcttactaatcacattatgagaaagctaatattacttgttgacgataaagaaactatcgctaaggtcgcatcaatctatttaggaaaagattatgatattcaatattttcccgaccccatccacgcacttgaatggctacatgaaggaaaaacacccgatctgattatatcggatatacgcatgccgctgatgagaggggacgaatttctacattatttaaaatgtaatgagttgttcaaagacatacccgtcatcatgctttccagtgaagaaagtaccagtgaaaggatcaggctgctgcaagaaggagctgtagattatatcctgaaacctttcaacccaatggaactaaaaatacgtgtcaaaaaaatcatagaataa

SEQ ID NO: 2095 - DNA, 405 bp, B.fragilis
aaaaagaatgtatcaactaatttaaaaactccaacgaacgttatggctatcgaacgaaaggttccgggtgaaatacgaattttcctgaaccatgtatacgaattcaagaagggagtacgcaacatggtactctatacgatgaacaaggaacacgaagcctttgccatacgccgtctggaaagacagaatatcagctacctgatacaagaagtaaacgccaataagataaatctgttctttggtaaggccgaatgtatggatgccatacgacatatcattattcggcctttaaaccatctcactccggaagaagatttcattctgggtgccatgctcggatacgacatctgccaacagtgcaaacgctattgcaacaaaaaagggaatataaagattgccggctga

SEQ ID NO: 2096 - DNA, 966 bp, B.fragilis
aatatgctattctttatatcggacctgcttataaatcgtatattttacctaagtttgccgtgtgataaaaacagatttatggaaaagatcaaacctctggaactggcgctcgacctgctgaaacacagcaatatcgtacgcaataacgaatatcgctttgtcacccccgatttcgggattgtcatcagcttcacccatatggaaagccgcctgttccgtctgggacagccctaccggctgaaagaaggaagaattatccggggactacgcggcaaagcccggatcacaatcaacctgatagagtacaacatatatccccaaaccattgccacattcctccccggctctatcatcgaacttttggagttcacacccgattgtgattttcagatgattgcagccgacaaagatttccttccgctcctgcgaggcgaccagctctttgaatcgcatacacggcaaaaccttgtcatgcaggtgacggataccgaatggaaactgtcagatgcatatttcacgctgatatgggacacggttcaggaagtccctttccgccgggaagtggtgcagtatctgctcgcagccttgttgcacaacataaagtatatacgcacggaagaagcgaacgacacttcccgcaggttttcacatcaggaagaaatattctggcggttcatcgcattggtgaacgagttcagcaaaaacgaacgcaccgtgggcttctatgccgacaagttatgcctgaccccacgttacctgaacaccctgatccggcaggtcagtcaccagacagtaatggaatggatcaaccagtccgttattctcgaagcaaaagtgttattgaaacacagcaatctgcttgtttaccaaatctcggacgaacttcattttccgaatccctctttcttctgcaagttctttaagcgaatgacgggaatgactccacaggaatatcaaaaaaggtga

SEQ ID NO: 2097 - DNA, 237 bp, B.fragilis
cgggcccctcctgagatgcggctttggaaactctccatttgggaggatgggtacacaatcccgtgcgtgtgttattatattgaaaaagaggatgtgtacgagcttgtggacggctatcacaggtataaggtcatgatgacctcgcccagaatatacaagcgggagaacggactgttacccgttaccgttatccgtaaggatctggccgagcgtatgagcctctaccatccgtcataa

SEQ ID NO: 2098 - DNA, 369 bp, B.fragilis
tgcaacatcgcaccgaacaccaagatatcaggaggaaaaaggatatcaagtcacgtaccacatcgtcgaaacgatgtcgggttgatttttcgtagtgtcgcttcttcactcgccaacgcaaagaatcaactgggaaacttctaccgcaggatacgttcaagagccggaggtaaagccgcagtcattgccactgcccacaaggtcaccgagatattctttgccatggttgcaaaccagacaccttataatccggaaaaagtaggtatagatgaaaaagtattactcgagaagcggattacgagatacaaacgtgaattagaacgaattacagggatgcatatagaaattggcaatgcatgtgttccatag

SEQ ID NO: 2099 - DNA, 273 bp, B.fragilis
ctgcctggctatatcgatcacggcggcactgggattggcaagccctccaagcttcaaggctttaagcagcttctcctcactgatattatgcaggccaaccaaagacttgccgccgtcatcctggctgatctccctaaaccggatgtcatcctgactctcaaggaagctgcccgtattctggctggcggattttatttggttggcggcaaacgagatataatccaccgtgcggtcattttcggaacccatatcggcactgtccgccacatctga

SEQ ID NO: 2100 - DNA, 3138 bp, B.fragilis
gtaaacaagtatttctctttaataaccaatcaagtaacatacttattctttcatggaatggaacaaatatccgaatatcttttcacaaccgaggaacaggctgtcatagcccgcagtaaggcggaaggcagttacatgaaagctccgaacggacaggcaaccaacctgaatgaaaagcagtgggcacaggtacgtacccgggcattcagggattggttcggggattgggagaactgtccggatgaagcatcaaaagtcagagatgccaatggggaacctctggtggtgtatcatggaagccgagaaaacttttacgaattcaagcggtggacagacggtcttataaatagtgggcattttttcagcccggacaggaagaacgccttaggatatggcggcaacatctatgatgtgtacctgaacttgcgcaatcctttggaagtggatgcccaaggggcaaatttctcctccatagaatacggcggcgagaaagtggcggcatccgatttgggcaatttggcggaaatggaagggtatgacggggtggtgatttcagatgtggcggacagtgccgatatgggttccgaaaatgaccgcacggtggattatatctcgtttgccgccaaccaaataaaatccgccagccagaatacgggcagcttccttgagagtcaggatgacatccggtttagggagatcagccaggatgacggcggcaagtctttggttggcctgcataatatcagtgaggagaagctgcttaaagccttgaagcttggagggcttgccaatcccagtgccgccgtgatcgatatagccaggcagtcacacgaagaatacggcgagatctcccttgtgttgccctcttccatgattgacaaacgcaccggaaggaatgccggaacattcagcggagacgcgtggacacccgtttatccgcaaatagaaaggcagttttccggtgacggcagcgggcgtgtccgggatgccatttccaggctgccgcaagagatgcaaccggatgtacgcagtgcctggaataattacatggacgggcgcgacgaggggagtgcgttcgcttatcagtttttatatgaaagaggcgaggcacccgaattcaggaaggtggagccgctctttggggaacatctgcggaaccggatatctgccatcgacgcgctcgataactatgatgaacgcaacacggccctgctggaggtttatatagaagaaaacttcggtggtgatcagacaaaattcaaagattatatcgaaacaaggaaacgggtattacaggataaaatacaagcgttcccggaacaaaaacaaaaaggtttggcttacagaaaagctgtccagaagctgaatgatatagaagaaaggggctatgaatacagttccgtacaagacttctatgacagggtgaagaccgatatccgccaggccggcagtgttgatacctatcataccctgcaggacgctttggataagatcaacggatcggaagcgctaagccggcagtatgcggagtggaaggaaagtcttgcggacaaatacggtatcaaagaggtcctttttaaaggttatactccggatggtatcaggatctatcttccccataccctggagaatgtctccgggttaatgaaacagcagggcctggccgccgcgaccggctggggaggttccttctctaaatttgcagccgctcttatgaagccggtcggaacactggacggtattcgccggcagaaggggaaactgatcactgaccatagtgacctggaggcattcagggacaaatggcaggaggtctactttgatctgggaatcaagcttaacccgggtggcggcacctttgatgataccggcctttaccgtgtggaggatatcgcgctgaaacctgatcccggaagttttgccaaacgtgagtacggggtggaacttacccgggaggatgtacggcaacttaaagagatggttgatgccatacagaacgaatgtcccgccatgtattttgagaccaaattcgagcggccggtctatttgaatgaatttgtagcggcaatcgtaccggagaatgtaaatgaagacgtttccaaatcgatccgtgaaagcgggctgcaagtgtttgtttataaacccaaggatgaatcctcgagaaacgaggctgtgaaactggcgtcggaaattaaaggtgtgcggttccggcttgcgggtgggacgggagccttcactcctgcctgtacagcaagcgggcaggttttcctttccggggatgaacggatggcggaactctcccgccatgccgttttcctggcccgcaaacagcacatccccgtgaacatcatccattccatcggcgaggtggattctcccaaagtacgtgcccttattgcgggcgggaaggatataaggggatggtatgacatcccttcggaccgtatctgcctgtacctgcccaaagcgcgcggcaaggaggatatcgagcgtaccctgctgcacgaaggagtggggcattacggcctgcgcagactggccgggcggaagcatatggacgcgttcctggatgacatcttcgccggatgcggggaaaaggtgcgcggggagattatccggctggccggtacgggaaaaatggatatacgtaccgctacggaagaatacctggcacaaatggctgaaagcgggacggatgcccgtgtatgggacaagatccgccttgccttcaggaaccttctgcggaagttaggtttcagcatcgaggttgatgacagggagctgaagggtctgctcgcggccagccgggaaaacctgaagagaacggcggccacccgcataccggaaaagatacagaccccgaaaggagaacttgagcttacccccggatatgccgccggatctctcagaagtaaagacggagtccgggatgtcacaccgttcctgaaggagatgaagagggccgggctgaagccggcctccctcagtccggaggaatggaaatctcttttcagcggtaaaggaatagcgcttcccgacggcaggatgcttatggccgtaaaggaaccggccggatatggactgaagataaccgctccggctctccggagtatcaaaacggcagaaatggaaatataa

SEQ ID NO: 2101 - DNA, 381 bp, B.fragilis
agaattatgcaagtttgtgtaccgatggatcgtgccaaagataacaaccgagccttcggtgcatacacatctgacctacacgccatattggaatgggttagagaatgtggtataaaaacagtcgcaatggaatccaccggtgtttactggataccattgttctgccgactgcaagatgacggactggatgttgtattaaccaacgcaagggacataaaaaacataacagagaggaaaaccgacgagtcggatgccgaatggctgctgttgctgcaccagtacgggttgctcaagacaagttttcagctgcacaacgacgccaaacggatgaggacactcacccgccatcgtgatactctctcccgtgagcctcaagcgtag

SEQ ID NO: 2102 - DNA, 423 bp, B.fragilis
ccccaaacaaaccatgttatgttgaatgaaaacaaccggtcctcggaccggatcctgaccgagaggatcctggacgatccagacatgatcctgaaaattgagaatccttctctgaagcagcagatggctgccgtacagaagaaacctgagctgatcgccagcttgccgcttgcgggagaaaaggtgcagcttgcggcggttatcgcctgcccagaaagcatcctgcttgtagatactcccgcacctgccgcctgcttcatggccgtggaacggatgctcaaggaggaacttcttcccgtgccgggtgttctgaatgcggcaagggagttgatactgcagatgaagaaggataaagccgatggaagatcaagcggagccgccattgagaaattcctggatgaagtcaaacccattaaaaactaa

SEQ ID NO: 2103 - DNA, 468 bp, B.fragilis
attagaacgaattacagggatgcatatagaaattggcaatgcatgtgttccatagaagcaatagaagcagtaaaacgctgtcggcaagcaggttttcaaaatatcagcatcgatctgatttatggtttgcccggagaaactgaccaacgctgggcacaggatttacagcaaactgtcagtcttaacgtggagcatatttccgcttatcatccgatttacgaagaaggtacccctctttacaaaatgctgcaacaacactctgtatttcaagtggacgaggacagtagtctgaacttcttctccacattgatagacactctttctgctgccggatacgagcattatgagatttctaacttctgcaaacctagaatgtattcccgatacaatacttcttataggcaaggtatcccttatctgggatgcggtccgtccgcacattcctttgatggagactcgcgcgaatga

SEQ ID NO: 2104 - DNA, 255 bp, B.fragilis
aaaatgcctgagcctatccggccggacacaaaaaacggcaaggtactgaacttactgcctaatgttattttttatggtatctttttattattctacaattcgcgatcgtttttccaaactgttgtggatcctagattgaatcatattctatacaaaaatgtaatatatattgttataagaaaaaattttgtgagcgcccccaatgattggcatcgcaacagcttcaattgtcagccgcttgatatcaccgaataa

SEQ ID NO: 2105 - DNA, 1611 bp, B.fragilis
attgttatggagaatcttattccttatatcaagcttattattctggcactggcctgcctggtgacgggagtttgcaccctgagccggaaatggtatgtcaacctggctgtctttcttatatgcatagcgggcgagaccttcatggcatacctgttctttcccgcatacgcattatggccggcctgcggttcggtggccatattcgctttctccaccgcatgggaacatctcaagccttcaggacggaaagagaacaagtctccgatcaggttgcccgtcatttccggggttccataccgccatctggaattctattactattattccaatttcctggtctatggaggggccggttcgggaaagacaaagagtatcggcaaatggctgctggaggaatatatcaagctgggcttcgcagggttcatctacgattttaaggacgtggactacacgcagacggcctataacctgacaaagaagtacggttacccgcacaagttttactacgtgagtttcgacaagccggaacgttcataccggttcaacccgctcaaggtggtaaaggaccgtaccgagctgatgcagctcatggaagatgtcctgctcgcactgcttcccaagggggaaaagcagaatgaatgggtggccgggggattgggcatcctgcgcggggtagccttccgcttttgggatgaatttcccgagtattgcacgctgccccatatcatggcctttatcatgaccgcctctaccaggcagctgtccatattcctgcagcagaacctcgttgcggaaatgatggccggcgcgtatctcaaggccgaaggttccgagaagacccaggcatcctacctttccaccctgtgtaacaacctgtcgaccatttcacagaacgaagagatagcctatatcctttcaggggatgattttgacttcaacctgatcgatccggaagatccgaaactgttcgccatcagcaacaatttttccaagaattcggtctatgccccggtgataggcatgcttatgagcatatccacccgccagttcaccatgcagaacaaagtgcctttcgtctatttcctggatgaaatgacaacggtcaatatcaagaactttgagacgctgccttcggtcctgcgcgaatacaaggtcggctttgtgctgcttacacagtccggcgcaaaactggaagccctgtatggtaaactcgaccgggcctccgtggaagccaatttcggaatccagttcttcgggcgtaccaaggatgtggaagccctgaaatattatccgcagatgttcggtaaggaggaaaaggaaagaaaatcccggagcacgggaaaaagcggcagcagttcgaaccggagcgttaccatctcttcccagaaagaggatatctaccagggaagggattttgcggatctcgagccgggagagttcatcggatccgccacccgtgccaatgtcagatatttcaaggtgatgctcggggagtttaaagaaaaggatgaaaaaccccttcccgacgtccgggttctggagccggaggagattaccaggaatttttcccggatacttgcggaggtccgcagcctttttccgtgcgaataa

SEQ ID NO: 2106 - DNA, 690 bp, B.fragilis
ttaagaatggatactgaaagaaatatgcagtcagattgttacttttgcaaaaaaaactatttttgcgaattgtttatcttaaaaatacatagaatgtcgacacatggtagcctttcggaagtggaacgattcaatcttttgtataaaagttcgtttaataaggtttgcaactttgcatgcttttatgtgcgcaataagcaagcttctgaagacatcactatggacgccttcctgcaactgctcgaaaccatgaaggtggaatcggttgataatcccatggctctccttatcaccatcgtgaaacataaatcgttggattatctcaaaacacaagtacgacgggaagataccaaagatgatcttatacaatggaaacagcgcgaactagctatccgaatctcaaacttggaaggctgtaatcccagttatattttctcacaggaaatcaaatctatcgtaatgaaaaccctcaaccaattatcggaacaaaccaaaaaggtattcattatgagccgttttgaaaataaatcgggaaaggaaattgcccaaactctgggcatctcggtcaaaggggtagattatcacatgaacaaggcccttaaagaacttcgtgctgccctcaaagactacctccctatcttaacttggctctgttttatgaacccaatcaataaagggtggatttcttaa

SEQ ID NO: 2107 - DNA, 474 bp, B.fragilis
ataagcaccagtatatgtatgaaatgtatgcctatgaaactgaaagtacgaatatttgagggaaaatctcccgaactttatctggccgtagggcactttgtacttagtcctgcatgtctgcgggagaataacaactacccttataaatcctcccggatgtttacctggcatgttctctaccatgaaggccaggtagtggctttcatgcctgttgagagaaaactcgatggtggttataaaattgataattattatgccactcccgatagggagagggggaaccagttgctgaagctgttgaaaagcgtgatcaaggagtcgggcgatgagacttcccctttgcgggcgaccgttcagaaacgggatgtcggaattttcaaatacatgaatttcatcacgatccgggaaaccaagttatatgttatgatggaattggtacgtatgggttccgacagtgggaaacaggatggctga

SEQ ID NO: 2108 - DNA, 309 bp, B.fragilis
gtgttaatgaggtcattagaccgcggtggaacttccattccccagaaaggcgaagcgtatgacctgaacggcgatggtgtaaaagatgtagctgtggtggataaagaaccgccagccggtgagaagattaagggcgtacaatatgtggtaattggtaaaaccaatcgtttgtccgaaggtgatcacggatatattgaatttggctttaaccagggacgtaaatgggatgataaaaaatacttgcgtccgataccgttgacggctactcagataaatccggctttattgcctcaaaacccaggttggtaa

SEQ ID NO: 2109 - DNA, 1272 bp, B.fragilis
  unsure (36),(149),(1025),(1084): Identity of nucleotide sequences at the above locations are unknown.
aagagaatgggaggaactcggatgaatgtatatcangcgttgcgggagaggatcagaagaatcttcggcgagtatgattatgtgtacctttctttttcggggggtaaggacagcggtgtgctgctgaatgcctgtgtggagcatatcangcaatatggaggtcggatgggagtattccatatggattacgaagtgcagtattccctgaccacgaagtatgtggatgagatgctgtcttcgaaccgggatattctggatgtttaccgctgttgcgtgcctttcaaggtcggttcggctgcatccatgtaccagagattctggcggccctgggacccttgtgtccgttgggtcagggagatgcctgtggaatacctgggtacggaagcatttgatttttatactccgcagatgtgggattacgagttccaggaatgtttttccttttggctccgcaagcaacttggagtgcaaaaagtggcatgtctggttggaatacgtacccaggaaagctttaaccgttggagaacgatctatcgtagcactccgggcccttcagccgactggatatgtcctgtcgatgagggcatagacaacgtgtatccgttgtatgactggcatactacggatatatggactgccaatggccgtttccgttggaaatacaacaggttgtatgacctctattatcaggcgggtgttcctctgaacagccagcgtgttgcgagcccgttcatttcccaagccatcccgtcgctgcatctgtacagggtgatcgagccggagatgtggggcaagatgctgggacgtgtgaacggtgttaattttgccggggtttacggtaactctgtagcgatgggatggcggggtgtcaggctgcctgagggaatgacctggaaaaaatatctttttttccttctggacacccttcctgaggatgccaggaacaactatctggataaactggaggtaagcgtgcggttctggcgggagaagggcggctgtctggcaaaagaaacgatcatganactcaagaggttgaatatccctttcgaacttggcgggacatcgggatacaggacgcacnaagctcctgtcaggatggaataccttgatgacatagacctgcctgaattccgtgatctgccctcttacaagcggatgtgcatctgcatcctgaaaaacgaccattgtgcaaatcatgggctttttaccgaacaaagcggagaaagaacgccgacgccagacgatggccgagtacgaatcttattttaa

SEQ ID NO: 2110 - DNA, 891 bp, B.fragilis
ttggatgctatttctctgacagaacacatcgaatatcgtcctcataaaaaagatgttgtggcagatcataaccgttcgttcgatctttgtcagaagcaggctgaaaagctggggatacttttaatcagaggcagcgagattactcgtccgatggctcccggacactttaatgccatttttcttgctgactccaatccattggaacaaaaagagtataaagacgctttcaatgaagccaaaaggcagggagcatttatcttctggaatcatcctggatgggctgcccagcaaccggatactactaagtggtggcccgagcatacagaactctataatgaaggttgtatgcatggcattgaagtagcaaatggccctctgtatatgcccgaagccattcaatggtgtttggataagaatctgacaatgattggtacttctgatattcatcaacccattcagactgattatgatttctctaaagacgagcatcgtaccatgacattcgtctttgcgaaagaacgttccttgaaaggcatccgtgaagcattggagaatcgccgcactgctgcttattatcgagagttggtgattggacgtgaagacttgctccgtccattctttgaaaaatgtgtagaaatagaagagatcagccgtaatgagaaaggagtgacactctctataaccaatactacggatttagtcctgaaactgaagaagacggcacatgatacttctctggtctattttcgggatatgacgctgaagccgcatacacgttatagtgtccgtatcggatttgataatggcatcaaaggaggagatatgaattttgaagtgacgaattttatagtgactcctgataaaggattggagtatactatttctctgtaa

SEQ ID NO: 2111 - DNA, 357 bp, B.fragilis
attatgaatatggataagaatgattctttcgacgggcccctgcaggagggcagacatacgaccctgcgttccttttcctggggaaacagggagtttaccatttcctcagacaaaatcagcctgtatgtggggggcataccctatgacacgaagccgatgctggatattctccgcggatccggagtagatcccgggaaactctctcccgccaggtggatctctttgctccgggggcagcctacacgcctgccgggttgtgaaaagccgttcatgctgttcaaagccccatccggatatactctcaagtgcctggaaataaccaggggcaggaacagggctttccagacggaaatgtag

SEQ ID NO: 2112 - DNA, 381 bp, B.fragilis
ccacgaagtatgtggatgagatgctgtcttcgaaccgggatattctggatgtttaccgctgttgcgtgcctttcaaggtcggttcggctgcatccatgtaccagagattctggcggccctgggacccttgtgtccgttgggtcagggagatgcctgtggaatacctgggtacggaagcatttgatttttatactccgcagatgtgggattacgagttccaggaatgtttttccttttggctccgcaagcaacttggagtgcaaaaagtggcatgtctggttggaatacgtacccaggaaagctttaaccgttggagaacgatctatcgtagcactccgggcccttcagccgactggatatgtcctgtcgatgagggcatag

SEQ ID NO: 2113 - DNA, 210 bp, B.fragilis
gcctctaccatccgtcataaccgtgcccgtggaatgcataagatcgagcttatgacacggcttgtcggggaacttacgaggtctggcatgtcggattcgtggatacgcaggaacctgggtatggataaggatgagttgctgcgtctgaagcagatatcgggactggcggagctttttgcggataaggagttccggatggccgtagaatag

SEQ ID NO: 2114 - DNA, 210 bp, B.fragilis
atagataacatgaaagtaaagaaagtattagtatgtacgttccttttggcaacctgcctgatgaatgcacaggcgcaacgccggaatgaaattctggttcccgatttagatggatacactactttgaagtgcgatttccatatgcacactgttttctctgatggtctggtttggcctacagtacgtgtagatgatgcttatcgcgaatga

SEQ ID NO: 2115 - DNA, 1320 bp, B.fragilis
aaactaatcgtcatgcctaccattttagaacgcctgaccgcattgttcagccgggatatgcaggccgtactccgcaatccgcgtgccatcagtatgattgagaatccttccatacgggtccagatggctgccatccggagggataaaagtgtcatctgctttatagacaagccggtggaaaaagtacagctcgctgcagtcaggaatgcaccacacaatattcatttcatcgcttcgcccggtgagaaggtacaactatccgtcatccggcataaaccgggctacatcggttttatttccaaccctacggaaaaagcgcaactgacagccgttgaaaggaggcctgaatgtatctccctgataaataagcctgcggtaaaggtacagttaatggctgtcctgaaagatccggcacatattgcctccatcaaagaaccggccgaaaaggtacagctggcaaccgtgcagaagaacccggaatacatccgccacattgaatcacctacggtgaaagtacagcatatggctatccaaggcaacgcggataccctgcggcacatcaagtccccggcagataccgtacagttggcggcagtccaagccaaaggagaaaccatcaagtatgtgtccgaaccatcggaggctgtacagctggccgctgtcaggaacaatccaatgaatatccggtatattgagaaccctacggaaaaggttcagctgtctgtcctgcatgccgacagggaggcggctgcgcttatcagctctccttcagaggcagtcaggaaacaggctgaagagatgtacgggctgaagctggagaagcctgcggaccgggaagcggagccgtcatccgaagcgacggaatcttccgcgacacggcgcgcacccagaaaaaagaccgaacagagtacgcaatccacgcgaaaaccttccgccaggcaggttaagacggcaatagagaagttggacaaggaccttcgggaaatccaggaaatcccgcaggttaaaaacagggataaaaaacttatcaaggcctttgaggaattcaattcatccgccgtccccgaaaagaaaggatgtgacgtggagagtatcctcaaggaccttcgcgggaagggagtcaaggtggaagccatgaaagctgaagagtggcactccctgatgaatggaaaggccatccggccctcccttatatccggagcgtccaagccggccgcaaagggagcccccttcatgcttaccaagactccggtcgggtatgcggtaaaagctgtgaatacggtcaacagcctgacccggcaggccagtgccgacatgtaa

SEQ ID NO: 2116 - DNA, 642 bp, B.fragilis
gcctcaagcgtagttctacgtatgcagaaagccatgcagcagatgaagataaaacttacgcttgttttgtctgacattaccggaaaatccggtatacgtatcatcgaagccattcttgcaggagaacgtaatcctgataaacttgcagacatggccgacctccagtgcaagaccccgaaaggggaaatagccaaggctcttgagggtaactgggaagaagacctcgtgtttgtcctcaggcaaaactatgacactttcaaacatttctgcacccaacttgaccgatgtgatacggaactggaaaaactcatggaaaactatcgtacggaggttgccgaagcagggaggccgtcatacagtccgacaaaaaaacgtcgtgactaccacaaacgaaaacgaaccgtgggcttcgatgtggaaagaaaggcatatgacatgtgggaagtgaatgtttttgagatacccggcataagccatctgatagtacttgaactgatgagcgagttaggacgcgactttacccagaattcccatcctccaaacagttctacagttgatgcaacatcgcaccgaacaccaagatatcaggaggaaaaaggatatcaagtcacgtaccacatcgtcgaaacgatgtcgggttga

SEQ ID NO: 2117 - DNA, 309 bp, B.fragilis
aatatagcttcactaaatcagtatctttcatctgtagaacaggggcaacgacaacacgaaacagaacaactggacacacaaacccgctacaatgaatacatcatcacaggtctgcgcacaatgtggggaatatccacagaagagctgaacagtaagttcggtgaccgactttggaaatattgttcggaacaagccaaaccttatctggaaaatgggaaattaaagttgcataacgatcggttaaagctaaccagagagggcattttcgtctcagacggtatcatgagcgccctcttggaaatagaataa

SEQ ID NO: 2118 - DNA, 1563 bp, B.fragilis
tcaccgttaacggtccatcgttcaacaaccgttcatcgtcgatcgttcaaaacccttcctcgtttttttagccttttttatctattgatgtttgttcaaagggtgaattacggagaaatttccgtaattcctttcatttttcctctttattcacattattatttattacttttgcgggcaaattatgaaaccattattttatataatcacatggcaaatgtaataaagttacgtaaaggccttgacatcaacctgaaaggaaaagctgctgaagagctctcaacggtgaaagaaccgggattctacgcactcgtacccgatgatttcccaggagtgactccgaaggtggtggtgaaagagcaggaatatgtgatggccgggggacccttgtttatcgacaagaatcatcctgaagtgaaatttgtttcgcccgttagcggcgttgtaacaagcgtggagcgcggtgcacgccgtaaggtgctgaacatcgtggtggaggctgccgcagagcaggattacgaagaattcggcaagaaggacgtatccaaactcgatggcgaggctgtgaaagctgcactcttggaagctggtatgtttgcatttatgaaacagcgtccgtatgacgtgattgccgatccgacagtcgctccgcgggctatcttcatctctgctttcgacagcaacccgctggcacccgatttcgaatacgttctgaaaggggaagaagctaatttccagacaggactggatgccctggctaaaatagccaaaacgtatctgggtatcagcatcaaacaaaaatcgacagccctgacacaggctaaaaatgtcacagtaaccgtatttgacggaccgaaccctgccggaaatgtaggggtacaaatcaatcacgtagctcccgtagtgaaaggtgagacggtgtggactatcggcgcggaagccgtaatcttcatcggacgtctgttcaataccggacgggtggacctgacccgtaccgtagccgttacaggatctgaagtggtgaaaccagcttattgcagactgaaagtcggcgcactgctgacccatgtgtttgccggaaacgtgacgaaggacaaagagttgcgttacatcagcggcaatgtgctgacaggcaaacaagtgaagccgaacggattcctgggcgctttcgacagccagctcacagtgattcccgaaggtgacgacatccacgaaatgctgggatggatcatgccccgtttcaatcagttcagcgtcaaccgctcgtatttcagctggttgatggggaataagaaggagtatgtgctcgatgcccgtatcaagggaggcgaacgccacatgattatgtccggcgaatacgacaaagtattcccgatggacattctgcctgaattcctgatcaaagcaatcattgccggggacatcgaccgcatggaagctctgggtatctacgaagtggcgcccgaagactttgctttgtgcgaatttgtcgactcttcgaaactggaattgcaacgcatcgttcgtgccggactcgatatgcttcgtgctgaaatgatgtaa

SEQ ID NO: 2119 - DNA, 1083 bp, B.fragilis
ttaatgaaagcgttaagaaattatctcgataagataaagccgaactttgaagagggcggcaaactccacgcgtttcgttcggtgttcgatggcttcgaaactttcctgttcgtgcccaacaccacttcgaaatcgggagcgcacatccacgactcgattgatagcaaacgtatcatgtcgattgtggttatttcgttgataccggctttgctgttcggtatgtacaacgtaggttaccagcatttcactcacaccggagctcagggtggcttcatcgaaatgttcatttacggtttcctggccattctgcctaagattatcgtatcttatgtagtgggtctgggcattgagttcgtggtggcacaatggaagaaggaagagattcaggaaggattcctcgtttcgggtatcctgatcccgatgattgtaccggtagactgcccgttgtggattctggccatagccactgcattcgctgttatttttgcgaaagaagtgttcggaggtacaggtatgaacgtgttcaacgttgcccttgtgacccgtgcattcctgttcttcgcttatcctaccaagatgtcgggtgacgccgtttgggtggcacaagacagcatcttcggattgggtaacacggtagacggactgacagcggccacttcgctgggtgtggcgtctactgctaccgatcccaatggcttcccggctttctcgtgggatatggtgaccggtctgattccgggctctatcggtgaaaccagtgtgattgctattctgattggtgccgttattctgctgtggacaggtatcgcaagctggagaacaatgctttcggtattcgtcggcggtgcattcatgggatggatcttcaatactgtgggtcccgacactgccatggctcacatgccttggtacgaacacctggtgttgggtggtttctgcttcggtgctccgtttatggctaccgaccctgtgacatccgcacgtacggaaaccggtaagtacatcttcggattcctgatcggtgcgatggccatcatcgtcttcacgcgggtctccagcgcccgctctatttggtccgtccat

SEQ ID NO: 2120 - DNA, 1299 bp, B.fragilis
attatgtgttatgaattacatcatttcagcacgaagcatatcgagtccggcacgaacgatgcgttgcaattccagtttcgaagagtcgacaaattcgcacaaagcaaagtcttcgggcgccacttcgtagatacccagagcttccatgcggtcgatgtccccggcaatgattgctttgatcaggaattcaggcagaatgtccatcgggaatactttgtcgtattcgccggacataatcatgtggcgttcgcctcccttgatacgggcatcgagcacatactccttcttattccccatcaaccagctgaaatacgagcggttgacgctgaactgattgaaacggggcatgatccatcccagcatttcgtggatgtcgtcaccttcgggaatcactgtgagctggctgtcgaaagcgcccaggaatccgttcggcttcacttgtttgcctgtcagcacattgccgctgatgtaacgcaactctttgtccttcgtcacgtttccggcaaacacatgggtcagcagtgcgccgactttcagtctgcaataagctggtttcaccacttcagatcctgtaacggctacggtacgggtcaggtccacccgtccggtattgaacagacgtccgatgaagattacggcttccgcgccgatagtccacaccgtctcacctttcactacgggagctacgtgattgatttgtacccctacatttccggcagggttcggtccgtcaaatacggttactgtgacatttttagcctgtgtcagggctgtcgatttttgtttgatgctgatacccagatacgttttggctattttagccagggcatccagtcctgtctggaaattagcttcttcccctttcagaacgtattcgaaatcgggtgccagcgggttgctgtcgaaagcagagatgaagatagcccgcggagcgactgtcggatcggcaatcacgtcatacggacgctgtttcataaatgcaaacataccagcttccaagagtgcagctttcacagcctcgccatcgagtttggatacgtccttcttgccgaattcttcgtaatcctgctctgcggcagcctccaccacgatgttcagcaccttacggcgtgcaccgcgctccacgcttgttacaacgccgctaacgggcgaaacaaatttcacttcaggatgattcttgtcgataaacaagggtcccccggccatcacatattcctgctctttcaccaccaccttcggagtcactcctgggaaatcatcgggtacgagtgcgtagaatcccggttctttcaccgttga

SEQ ID NO: 2121 - DNA, 1068 bp, B.fragilis
atactgcggtgcactcttagcagacactacaactttttctgggatcagctggagaaggccaatcttttcctgcagggcgttatcgatacccgcgaaaagccgatggatgacaaaatggtggaatggctcttccgcaatccgctgagtgatggcggcacgtttaccggggtggccgacattgtctctaaatatggcctggtacccaaagaggtgatgcccgagacgaacagcagtgagaatacatcgcgcatggcagggctgattgccgaaaaactgcgtgagtatggtctgcaactgcgcgaccgcgccgcaaagggggccaaacagcctgcgctcgagaaggacaagacggagatgctgggcaccgtataccgtatgctggtgctcaacctgggcgttcctcccaccgagtttacctggacacgcaaggacgagaagggaaatccggtggagactgcacaatatacgccgatgtctttcctggaaaaatatggtgacaagaacctgctggataactacgtgatgctgatgaatgatccgagtcgcgaatattataaatgttacgaaattgattttgaccgccaccgctacgacggacgtaactggacctacgtcaatctgcctgctgacgaaatcaaggagatggccatcgcatcactgaaggacagcacaatgatgtatttctcgtgcgatgtgggcaaattcctgaactcggagcgaggattgctcgacgtgaacaattatgattatgcatcgctgatgggaactaccttcgggatggacaaaaaacaacgcgtgcagacgtttgccagtggatcgagccatgccatgactctgatggcggtagatgtcaaagataataaaccggtgaaatggatggtcgaaaacagttggggggcaaccaacggctatcagggacatctgattatgacggatgaatggtttgatgaatacatgttccgcctggtagtggagaagaaattcgcaactcccaaggtgttggaaatcctgaagcagaaaccaatccgtttgcctgcttgggacccgatgtttgcaccggaacagtga

SEQ ID NO: 2122 - DNA, 2439 bp, B.fragilis
atatatcatactagaagcttcttctacatttgtcggattccaagtccgatatatgttaaaagtgcagggagtttccatctgttcacatctttttcgacttttatttgtttcattggatacttttgccgtcgatataactatcgagtatctgaaagagagctggcagaaggtgtgttaaatcaaaatagttatacaatggtaaaatttaatgcaatgaagactaaacctttacgacttcttcggcagaagagagcctcctggctgaaaagtgtatttgtcctgacttgcctgctactgagcacatcggtggccatggctcaaacgaagacagtgacaggtactgttacagattcatttaacgagcccctgatcggtgcatctatcctggtaaaaggcacttctaccggggctgttaccgatatggatggcaaatactccatttcggtaacgcccaacgatgtactcgtattctcgtatgtaggatatgaaaagcaggaaatcaaagtggggcagcaaactgtgataaatgtcacgcttaaagacgactcacaaatgcttgccgaaacagtaattatcggttatggtagtgccaagaagcgcgacctgaccggttctatcaccaacatcaagggttcggaaatagccaacaaaccggcaaccaacccgttatcgtccctccaaggaaagatagcaggtgtacagatcgtcaactccggacaagccggtgccgatccggaaatacgtatccgcggtacgaactccatcaatggttacaaaccactgtatgttgtagacggactgttcaacgacaacatcaacttcctgaatccggaagacatcgagtcgatggaagtattgaaagacccttcctcactggctatattcggtgtgcgtggtgccaacggtgtaattatcgtaaccaccaaacgtgccaaagagggacagacgctggtcaacatcaacacctctttcggctggaaaagcgtagtagacaaaatcaaaatggtgaatgcaccccagtttaaggaactctataacgaacaaatggcaaaccagggaaatgccctgttcgacttcagcaactggaatgcgaatacggactggcaagacgagatcttccagacgggattcattacaaacaacaatgtcagcatcacaggtgcttctgaaaaacatagcttctatctcggcgtgggttactctcacgaacagggaaacatcaagcatgaaaaatacagcaaagtgaccatcaatgcaagtaatgattataagattaccaaagacatcaaagtaggcttccaattcaacggagcacgcatgctgcctgccgacagcaaaacggttctgaacgctatccgtaccactccggtggctccggtatataacgaagaatacggactatatacttcattgccggaattccagaaagcacagatgaataatccgatggtagacgtcaatctgcgtgccaacaccacccgcgcggtcaattaccgggcatctggaagcatctatggtgaagtagatttcctgaagcacttcacttttaaggcaatgttctctatggactatgccaccaatgacagccggacttacaaaccgattatcaaggtatatgacgcaacctttgccgggaacgttgctacgctcggaaacggaaaaacagaagtgagccagaacaagcaaaacgaaaccaaggttcagagtgactatctgttgacttaccaaaacagttttgccgacggtacacataacctgactgccaccgccggcttcacaacctattataattcgctcagcggactggatgcttcccgcggacagggcatcggactggtgattccgaacaatcccgataaatggttcgtcagcatcggcgacctggctaccgccaccaacggaagtacacaatgggagcgcaccaccgtatctatgctggcacgtatcatctacaactataaaggtaaatatctgttcaacggttcgttccgccgcgacggttcttcagctttcgcatataccggcaaccagtggcagaatttctactccataggtgccggatggttgatgaccgaagaagaatttatgaaagatatcacgtggctggacatgttgaaactgaaaggttcgtggggtacactgggaaaccagaatatggataaggcttatccggcagaacctctgttggagaatgcttttgctgccgtattcggcaaaccggctatcatctatccgggctaccaactggcttatctgcccaacccacgtctccgttgggagaaagtagaagcatgggaaaccggttttgaaaccaatatgttccgtaaccgtttccatttcgaaggagtatactataagaagaataccaaggacctgctcgccaccgtaccgggtctgtcgggaacccgtaccgggcatcggcaatcttggagagattga

SEQ ID NO: 2123 - DNA, 447 bp, B.fragilis
catatttttctttccttgtttcggcatcgaatgtcaaatagttcagcgggtcagcagggccgttcattcttccctgcccgattatacgtttgtgctatgggcaaacctattattaaaatcctgtatttccatcggcggagaaccaacgcaagcggatggtatcggttggaatatattttccagcgaggtaagaagactctacgttatgtgctttccactcgtgaccctgaatatttagtttgtttctgctccccctgcatggtcgaacgttcagaaatgattgtctttgtggccgaacttcttttagaaattcataaggtgaaatattcatatttaaaagttacgccaagttatgcctatgctactcctaaatataaatcccgaatcaaccaaatgtgcaaaaagagccgttatcacaaaacgcctgtcattatagacggactatag

SEQ ID NO: 2124 - DNA, 306 bp, B.fragilis
gtcgtactttatatggagcaatctccaaaagtacaaaacaagattactaaaatcttagaaatcttagaatatatagaatgtatcccgacgaagtatcttaaacacatagagggcacagacggcctgtatgaaatgcgtatcaccttaggtagtgatatatttcgtgtcttctgttttttcgataagggacgattagtggttttgctttccggttttcagaaaaagacgcagaaaacccctaaaaaagagatagacaaggctgtccgattgatggcccaatattatgatgataaaaaaaggaggtaa

SEQ ID NO: 2125 - DNA, 951 bp, B.fragilis
ttccacacccatattaatttcgtaatggggcaacagagccgtgaatcacttgattacgaaaaaataattttgaaaaatatggcaaatactaatatggaacacggagaaataatactataccaaccagacaatactataaaactggaagtgcgaatagagaatgaaaccgtttggttgacacaagcacaaattgttaacttattccagtcaagtaaagccaatatcagtgagcatataagaaatatatatgactcagatgaattatctgctgaatcaactgttcggaaattccgaacagttcgaatggaaggtaatagaaaggttacccgcattcttgaatattataatctggatatgattatttccgtaggttatcgtgtgaattccaagcgaggagtccagttccgccaatggtcaacaggagtacttaaagaatatctattaaaaggctacgcaatcaatcagcgcgtggagcagttggaaaacaaagcaaacacccatgaccggcaactggaagagttaacaaacaaagtcgactttttcgtccggacttcattacctcctattgaaggtgtctttttcaacggacagattttcgatgcctatgtcttttccgctcagttgataaagtctgcaaagtcatctttagtattgattgacaactttgtcgatgaaagcgtgctcttactattgagtaaacgtttgcccggagtgacttctatcatatataccaagcaagtaactccacagttagaattagatttgacaaagcacaacagccaataccccccaatagatatacgtacctaccagcacgcacatgatcgatttttaattatagataatttagaggtctatcatataggagcttcacttaaggatcttggcaaaaaactttttgctttttctaaaatggaaatgccagccaagataatcactgatttattataa

SEQ ID NO: 2126 - DNA, 270 bp, B.fragilis
catagagttaaagcttgttctttggatgtgaataagaagttctttaaatgcaaaagacttgttatctgcgcacaagaacctgacaacctgcaaaagacgttaacaatgttaattgaagaaaggtataaggatgaagataccggttcaggcggcgtaaactcacttccgaaacctgagctatcttattcagccggtgtctattttttttgtttgtatttttcggatagcttatctgttacagacagaaacccgctaaaactacggttttag

SEQ ID NO: 2127 - DNA, 183 bp, B.fragilis
gcaaatcataaacatcagtatataaaagaattaagtcttcaagaaagagccggaataaaaagacggattgtagaattgttccacatttatgaggagcagttctacaacccgctttacaaaacatcgatatcacaaaacaggaaccaagcattaaggcagatatgctgcaagaagacgaaatga

SEQ ID NO: 2128 - DNA, 366 bp, B.fragilis
gtcctcgataatgcttataccagtattttccaacgccagttgataccggaagaagtgactacgctagccaacacttcctttgcggcgacaagtggaaaagggggtactatcagcggtgtgcccagctctgcacagtatctctattttatggctaatatcaaaacagatgtcggtcaggtatttcccgctgtcgagggaacgacaagtgctgatgccagactacgcctaaatcgtttacaaggtacagcgcccagtgactggactgccaatgctttcgtagattattgtacgcctttggcttccgcattgagtttctatccggatgtaacgatctcaacaccgagatatccccgtatgagtgagtaa

SEQ ID NO: 2129 - DNA, 1494 bp, B.fragilis
  unsure (1467),(1468),(1469),(1470),(1473),(1474),(1476),(1483): Identity of nucleotide sequences at the above locations are unknown.
ccaatgagaaatttgagagcgatattgattgtattgttgtgtctgtgtggtatatatgtgcaagcacaacagttggaaataaaaggtttagtgacgtcatcggaggataaacagccgcttatcggagctacggttgccgtaaaaggggtaccgggaaggggagtggtaacggatatggatggccgttacactctgaaaatagaaccatcagataaaatccttgtcatatcctatataggaatgaaatcgtctgaggtcaaagtgccgaagaatggagtcttgaatgtggtgttgcaacccgaatcacttaatctggatgaagtagtggtgaccggatacggaaatttttcaaagtcatcctttaccggatcagctaacaccttacgggccgacatgctgaaaaacgtaccggtactttctgtagaacagaagttgcaaggtatgacaacgggggtaaacataacttccggttccggtcagccgggagctaaccagagcattcgtatccgtggtatggggtcattcaatgcatccaatgaaccgctttttgttattgatggtataccggtcacttccggcagtatgggagccggtacgggagctgatgccgcctatatgaataatgccaaaacaaatgtaatgagtacccttaatcctgccgatatcgagaatattacggtgataaaggatgccgccgccgcttctctttacggctcgcgtgccgcgaatggagtgattctgatcactaccaagaaaggagcggtaggacggactaaagtcactttgagtgccagcggaggtttttctaatgcagctgtcaacttccgtcccacattgaacggtgaacaacgccgtgaaatgatttatgaaggtctttacaactctgcagtagacaaggggctccaatctcccgaagcatatgcaaatgccaatattgatacatatgcaggaataccggaactgggatatactgactggaggaaagaactgatccgaaccgctcataatcaaaactacgaggtgactgcttccggaggcaacgagcgaactactttttatgcttctctcggctttaaccgtcaggaaggtttggtcgagaattctaatctggaccgttactctgcccgcctgaacatgacacataaaataggtagccgtgtcgaagtaggaggtaacatgatgttcacccagataagccaggagatgaacgaggagcgcggttccaatatcaatccctttctttgtgttgctgtatctgccacaccttctatgcctgtgcgcgacgcttcgggcaactatgtggggtcctatgcaggcaccaatgtgaatccgcttcgtgatatccgtactgactataaccgcagtcgtatgacccgtatgttttccaccggttatgcttcggtagatatcatcaaaggattgaaactgaaagaggtcttcaccggggctgcaaagggcgctcattgnnnnagnnantccaaanggttttctagg

SEQ ID NO: 2130 - DNA, 996 bp, B.fragilis
aagcatgggaaaccggttttgaaaccaatatgttccgtaaccgtttccatttcgaaggagtatactataagaagaataccaaggacctgctcgccaccgtaccgggtctgtcgggaacccgtaccgggcatcggcaatcttggagagattgagaacaaaggtgtcgaactgatggcttcctggagagatcagatcggtgactggggatactctgtcagtgcaaacctgactaccatcagcaacaaagtgaaaagtctggtacaggatgggtactccatcatcgcaggcgataagagccaaagctatacaatggcaggctacccgatcggttatttctacggctataaagtagccggtgtttaccaaaaccaagctgaaatcgatgcttctccggtgaacacactggcaaccgtcactccgggtgacctgaagtttgccgatgtaaacggagacggaaaaatcacaccggacgaccgtacaaaaatcggtgatccgactccggacgtaacctatggcatcagcctcggactctcatacaagaactgggaactcagcatggaaatgatgggacaaggcggcaaccagatctatcgtacgtgggacaactataattgggcgcagttcaactatatggaacaacgtctcgaccgctggcacggagaaggcacttcgaacacacaacccctgctgaatacgaagcacgccatcaacagcgagaactccgaatacttcatcgaagacggaagcttcttccgcatccgtaacctgcaactggcctacagtttcgacaaaactttgctgtcaaagatacgtatgcaggccctgaaggtttacgtcaacatacagaacctgaagacatggaagcacaacacaggttacacaccgcaaatcggtgggtcggccattgctttcggagtggacaacgggacatatccggtaccggcagtctatacatttggtattaacttaacattttgtcttcaccagggggctgca

SEQ ID NO: 2131 - DNA, 270 bp, B.fragilis
cacaccttctgccagctctctttcagatactcgatagttatatcgacggcaaaagtatccaatgaaacaaataaaagtcgaaaaagatgtgaacagatggaaactccctgcacttttaacatatatcggacttggaatccgacaaatgtagaagaagcttctagtatgatatatttaccttatgatggttgttggattctatataattgtatggaattatgtgctttaattaaagagcttttcgaattgcatctattatctaattgttaa

SEQ ID NO: 2132 - DNA, 207 bp, B.fragilis
actgaatatcgaagtaaaaatttaaacggtttcgcccggatgatagaaatatcacccgggcgaattatttatggccggtccattcaaagagctatatataaaacatacaacttctatcaaaaatctattaaggtattgatagccgccacggaatattactcactcatacggggatatctcggtgttgagatcgttacatccggatag

SEQ ID NO: 2133 - DNA, 306 bp, B.fragilis
aaaaaggaggtaatgatggatataacaacattagatcaatttaaagatgaaatttacggtgtaaaaggtacacccagacgagacaatttggagcgtgagctggaaacactgcgcattggcgttcaaatccgcaatgcccgtcagaagaaagaaatgacgcaggcacaactggccgagcgcattaataaaaagcgtacgtttatctctaaagtagagaatgatggaggtaacttgaccctgaaaaccctgatagatatagttgaaagggggcttggcggtaaactgaatatcgaagtaaaaatttaa

SEQ ID NO: 2134 - DNA, 1122 bp, B.fragilis
atacataagtttatgccaagaacagctaaaaaaggtttcacctattacgggttcgataccgatcatttttatgaccccaaagtcaagagactcaaaaataaattcgggatggagggctgggccgtgttccatttcatcgtgaacgagatccaccgcgtggaaggctattacatgatcatggactccgacggcctgttcgacgtctcggactattcccgcatggacgagcaacgcatcgcgggtattgtcgactattgcgccgagctggggcttttcgacaaaggactttggcggagccgccaggttcttaccagcgaggagatacagaacaggtatatgggcatctgcaagtcgatccaccgcaagccttccatctcggatgactacctgcttttgaacgcggctgccccggccgccacctcttccccgcaggttgccgctccctgtcccgccacccatacggcacctgttgcggaacccgtgcggagtggcgaaaaagagaaggatacggaactgatgcaagccattgcggattttaaacgcaggctgcaagaaccgaaaagctccgccggggtagttcgcgaagaatcgggaataattcgcgaaaatagaccacaaaataaaataaaagaaaatatatcctccccaaacccctccggagagtccagctacacaccggagagggaggaggagagaaattctctttcagggaagctccaatacctgggtgtggattccaatgtcatccaatgggtacggctcctgaaaagccgttatccggatttccctatcgagaaggcgatctctgacatggagcaaagcaatttccaactgaccaaggaaaattacctgtatcccctgattaagaactatatagccaagtataatgccgatcacggaagtgaagagcgtgccaggcaacaggaggagatcctgcgcacccggcgtaaaaccctcgagctcctgggcgttccggtgaaggaccagcaggaaatcctccagcttgcctccgttgcacccttggtactggatacagctctgaaggagacctggggcaacaaaaagatcaaaagccccaccatgttcctcctgagtcggatgcggagggctgtctcagcataa

SEQ ID NO: 2135 - DNA, 378 bp, B.fragilis
atcatggataccgaaaatttaaggaaaaaatacattttatggagcaatatcgttgatcttcgttctcgaggtatcaatataacaagaactgcacattgtcttggtgtttcacgcgatacagtgaaacatctgcagtctttgagttccgatgaactatttcggaagtaccaggagtcacgccggtgtaagctgcagaactatgagcaggccgtcgtatccttactcttcacttttccttccacttccagcagtcgtgtccacgactatttaaaagaacattatcctgattttccaaacgtctgtgataagactgtgcacaattacgtgcagtttatccggaagaaacaccatcttccattccggtcctgtcgtttatga

SEQ ID NO: 2136 - DNA, 630 bp, B.fragilis
tatatgccaactatctttcagattccgacttttatccagattctggagtttatcggaacattcgcttttgccattagtggtattcgtcttgcatctgccaaacaattcgattggtttggcgcttatgtagccggtgtggctgtagccattggcggtggtaccatacgtgatgttttattggatgtcactccattctggatgacgaatcctatttatttaatttgctcggcgctggccttgctgtgggttatcttttttcggaagcatttgatccacatgcacaatacgttttttattttcgatagcattggtcttgcgttgtttacagtagttggtatcagcaagacgatcgatttgggatatgccttttgggtagccattattatgggaaccatgaccggtgcggccggtggagttatccgtgatgtatttatcaacgagattccgttgatctttcgtaaggagatttatgccatggcatgtgttatcggtggagtcatttattgggggctcgatcgtttgggggtagatgccgccttgacgcaggtcattagtggctgctgcatttttgtagtacgcgctttggctgtaaaataccaaatttgcctgcctatcttgaagggggaataa

SEQ ID NO: 2137 - DNA, 312 bp, B.fragilis
aagaaaaatttaattcataaccgaatagaaatggatataaatcaaatgataaaaaaggcagatgatgcctatataaactataggcataggtgcgaatctctcgcaaaggaagcacaaaagtatattgattgggatgataaagtaagttgtgagcatctgccggcagacggtttgtgcatcttggcaaccgttcccagcgattgtaatatgagtggaatgcccgaatgtgtttgcccagcagatccattcttttcttctgtgaaagcaaaagaaaagattactccggatgaatttaaagaaattagtatttaa

SEQ ID NO: 2138 - DNA, 1341 bp, B.fragilis
aacatcacgtatggtaccaccgccaatggctacagccacaccggctacataagcgccaaaccaatcgaattgtttggcagatgcaagacgaataccactaatggcaaaagcgaatgttccgataaactccagaatctggataaaagtcggaatctgaaagatagttggcatatattaagttttttgtgtgcaaagaaacaaataattccgcaagaaagtgtaaatttgttccttgaaaattgtaagaatacaaagatgaagataacgattgttgccggggctcgccctaattttatgaaaatcgcccctatcacccgggctatcgatgccgcaaaggcacagggtaaacgtatttcttatcgcctggtatacacgggagtagagaatgataacagtttggacgcctccttatttgcagatctgcacatgaaagctcccgatgcctatttgggagtaaacggcaataacccgacagaactgactgcgggaatcatgatcgctttcgaacgtgaattgacagaaaaccctacgcatgtagtcctggtggtcgatgacctcacagcaaccatgagttgtgccatcgtagccaagaaacaaaacataaaagtagcacatctcgtagccggtacccgttcattcgacatgtctatgcccaaagagatcaaccgtatgattacagatggcttgtccgactacctcttcacagccggcatggtagccaaccgtaacctaaaccagacaggtacggaaaacgaaacagtctattatgtagggaatatcctgatcgatacgatacgttataatcgcaatcgactgataaaaccggtatggttctctgtgctggggctgaaagaacatgaatacattctgctgaccctcaatcgtcacgtactgttaaacaataaggagaacttacaggaattgatggaaacattgcttaaaaaagcaaatggcatgcccattgtcgcaccgctgcatacttatgtacgcgacgcaatcaaagcattggggatcaccgctcccaacctgcacatcatgcctacacagagttatctctctttcggttatctgatgaatcaggcaaaagccatcgtgactgactcgggcaatgtagccgaagaagccactttcctgggaattccctgcatcacgctcaatacgtttgccgaacatccggagacctggcgaacaggcactaatgaactggtcggtgaagacccggccgcattgggagcctgtatggacaaactgatgaacggagagtggaaacaaggaactttacccgaacgttgggacggacgaaccgcagagcgaattgtacaaatattattgggggaataa

SEQ ID NO: 2139 - DNA, 498 bp, B.fragilis
atggctattgaaaatacagagggctatcctcttatttcatggagagcatcaataattaaaactaaatatatgaatacccaacgtcaaaccggtacctgccgctctctttcggggcatgcccagcggcatgggcgcgaggtccgtccctcttatgagatcagcacttcgcaattttctgatatgaaagtcaggagactgacgcgtaattacggattcggtggatacagcatctaccgttatctggtgagtgaggccctctacaagggggagtatttccttccctggtgtgaggagaccgcgcgtgcggttgcctcttactggaatgcctctttggaagacattacccggatcgtggacggttgcgtacaggtcggcctgttcaatgacgaactgtacaggaagcacggagtactgacttctgccgccatccagcaggactacctcaagttatgcggcatgggctacatccaggaggagttcgctctttcggccagttga

SEQ ID NO: 2140 - DNA, 267 bp, B.fragilis
aacagtttagaaatgaaaataacaatatcagaaaaagtagagcaatttatttcagagcgtacagataaagcaggtggctactatgagtatatcgatgtcatagcacaaaaacatgccttagaagctgccgaaatggtaaagcaggaaacaaaagagaaatgtcaaatagcctttcgaaattttatgcttagagcaacacttgcaaatgtttccggtgaatcacttgactttgaaaaagagtttgcagatactatgagtcaaatttag

SEQ ID NO: 2141 - DNA, 963 bp, B.fragilis
tttgtcctggagaccctgaagcgtgaattctttgagaactataacaattatatgcttatgacatcacaggaagccaattcaatccccttggaagatattctttcccgctacggttacgaaccttcccggcggtacgggggatacgacatgtaccgctcccctttccgctgcgacagctctccgagcttcaaggttttcaggaacgagaaccgctggtatgacttcggagacagcagccacggcagggtcgtggatctggtcatgcgcatccagaactgctctttcccacaggctatgaaagagatcgaaggactgggcttttcctccggcatgattccgcagccaaggccggtaacggtaacggtacagaaagcctccgggatgactctcctgaaaatcattccggtggaaaacgggcacctgcttgattatgccgcttcacggggcatcgacgcggatatcgtccgtgaacactgcgtggaggtgcattactgcttcgagaagaatccccgcgagaaatacgcgctggggttcgccaacgaccacggaggtttcgaactgcgtaacagcatgttcaagggatgtgccaccgccaaggatattaccggcctggccgcaggcaacaggtcctgtgccgtttttgaaggtttcttcgacctgctgagtttcaagcaatacgcgaaggatcatccccagatgccggcactgagaaaactggacctgtgcgttctgaattccacttccatcgttgagcggtcaaaggattttctttcaaggtatgaaaaggtacacgctttcctggataacgacagtccgggacgcgaggccctgagaaagatgcggcatttccttcccaaggacacggtatttgtgaacgaagcggaacgcctgtatccgtcatgcaatgacttcaacgagtttttgcagaaaatcaagtgccccgcaagcgggcgggaaatgtga

SEQ ID NO: 2142 - DNA, 2193 bp, B.fragilis
gatgaagtgtgtatgaaacaacaatattctaaactattattagtaatcttccttctactctctgcgccacaggctttcgcacagttaaagggagtaatcaccgattctatttcacatgaaccattaatgtacatttccgttttctatgaagggaaaggagtaggtggcatatccaacgctaacggagaatataaggtggaaacccgcaaaggctggaatgagctgactttttctgcggtgggatatatcaccaagaaagtgaagattccggcgggtgccaaagaactcaatgtagtactctcaccggatgatgtaatgctggaagaagtggttgtaaaacctaaaaaggagaaatattcccgaaaaaacaatccggcagtagagtttatgcggaaggtaatcgaccataaaaaagctcagaagctggaaaccaatgactattaccaatacagcaaatatcagaagatgaagatgtcactcaatgacgtgacacccgagagtcttgagaaagggatctataaaaagttttctttcctaaaagaccaggtcgaggtttcgcccgagactaacaaactgattttgcccatctccgtacaggaaacatcttcaaaaaccatctacagaaaagatccggaaagtaaaaagaccatcatcgaaggtatgaactcaaatggcgtagaggaattcttctctaccggtgatatgttgggtactatcctcaacgatgtatttgccgatatcaatatctacgatgacgatatccgtctgttgcaacgccgttttgtaagtcccatcggaagcggggccatctctttctataaattctacctgatggataccgtgatggtagacaaaaacaaatgtgtacacctcacgtttgttccacagaaccctcaggacttcggattcaccggacacctgtatgtgctggatgattcaacctacgctgtaaaaaagtgcaccatgaatttgcctaaaaaaacaggggtaaactttgtggagaatctggatgtcgtgcagcagtacgaacaactccccaatggcaactgggtactgactgatgatgatatgaccgtagatcttttagtaatgaaagctatccaggggattcaggtaaagcggactacgaaatatagcaactatgtcttcgaacccatcgagccacgactcttccgactaaaaggcaatgttatcaaagaagcggacatgctcaccaaaagtgacgaatactgggccggagtgcgccaagtaccgttaacaaaaaccgagagtagcatggatcttttcatgaaccggctggagcaaattcccggattcaaatatgtcatattcggcgcaaaagcattgatagaaaattatgtggaaaccggaaccaaaaaacatccgagcaaattcgatttcggtccgatcaataccatgatatcgagtaactatgtggacggcacccgattccgcctcagtggtatgactacagccaaactgaatcctcattggttctttaatggatatggagcctacggacttaaagacaaaaaatggaaatatgagggcaatgtaacctactctttccgtaaatgtgaattcttcccctgggagttcccgaaacactatatctccgcttcttaccgttatgatgtcatgtcaccgatggataaatttctcgacacggataaggataacgtattcgtggcctggaaaaccactactgtcgaccagatgtcgtacgtacgggatgctacattgagatatgaaatggaaactctttcaggcttctcggtcgcagctatggcacgacaccggaaagacactccggccggtaaacttcaatacatccgtaacgatgctgccaaaacaattgttccggacattaccaccgccgaattgggattgaccttgcgttatgctccgggtgagacttttgtaaacacgaaacagcgtcggcgtccggtgtcgctggatgctcccatcttcaccctttctcacaccaccggattcaaaggtgtattgggaggagagtataatttcaatttgacggaagcaagtatctggaagcgcttctggctttcgtcttggggcaaagtagacgtcaccctgaaaggtggggcgcaatggaataccgttccattcccgttactcattctgccggctgccaacctttcatatattacccaaaaagaaactttcaacctgatc

SEQ ID NO: 2143 - DNA, 333 bp, B.fragilis
ctaatacctattcaaatgagtaaaatagaagatttagtaaaatggaaaactgtcgagacagtgactcctaattaccccgatggtgtaatctttataaaagaagacacgtctgtagaatttccattagctatggtcgcttttccacttggagggcatgagaatgggactaaaaagcaacgagagagagctaagttaatagctgctgcccctgaattactgaatgcattacaaggtatgctggaacggtttgattataatgatcaggctatttattcttttgctaccaaagagattgatgcagccaaagcagcaataaaaaaagctatagagtaa

SEQ ID NO: 2144 - DNA, 540 bp, B.fragilis
attttgcatatgggacatccaactatgcaagaaaatgataccgctaaattaacgcctacacgtatcatgcttctgatattgttcattgcaggaacaggtatcttcacacttcaggctcaaaaccgggaagaaaggaaagagctgaaggaacagactgtaaaagagaagattgaatcggaaaactatcggatcgacataaatacggcatacccgcgtaggggacgtatgattccattgacatcaatctattccgtaacaattcggaatgattctgtcttttcacaactaccttacttcggacgcgcttactctatcccttacggaggaggacagggattgatgttcaatgccccaatcgatcaatacaccatggccatgggaaaacgcggagctgcaaaaatcaactttaccgccaaaagtcccgaagatcagttcagattcaggataacaatctattccaacggttcatccagcatagatgtcgatatgcaaaaccgtgaatcgatcagtttttcaggtgacttgatattgccggaataa

SEQ ID NO: 2145 - DNA, 198 bp, B.fragilis
aggataaatatggcctggatggtaacccaaaagaatattaagattcatacctgcattgacggtatagattcagttgaagatgtcagagtgataatctcgcataagaaattgaaagctcttggtgcgaaacgtagagtttataaagacacgagagagagcttttttcttattgaatccgattgtgaaatcatcctctaa

SEQ ID NO: 2146 - DNA, 315 bp, B.fragilis
aagctcttggtgcgaaacgtagagtttataaagacacgagagagagcttttttcttattgaatccgattgtgaaatcatcctctaaacttgaaggtatgaagaaatatttagcaattgaaattcgtggtgaaatattcgttatgaatgataatgatgaattaggaggactgatagataatgatgtcccgtttacggtcattggtcatgtatgcaccgaagaatgtaatacaacatgcttacattaccgtcaaggtacgtgtccctgtaaaatcatgaaagatacttttggtaaagtaattcatgtttttgtgtga

SEQ ID NO: 2147 - DNA, 360 bp, B.fragilis
gctgtgacagcctgccggagggagtgcgaaaataaacagaccattaaaaacccaatattgataaaaatggaaatacgaggaaaaatcatcgccgtacttcccgtcaaggacgggatcggcaagactaccggcaatgaatggaaaagccgggaattcgttctggagacagaagagagcaaaccgcagagcgtatgcctgcagctgatgaacgccaacatcgagcggtacgccgtcgaggtaggtatgaccgtacacgtcaaatttgacatctccgcccgccagtgggagaaccgctggttcaatacgctgacagcctgggaagtgactgtcattaagcaaaaggaggaacagccggcatga

SEQ ID NO: 2148 - DNA, 1731 bp, B.fragilis
gcgctgtggcgaccttgtatccaaaaattatggctggcatttccttcccacccgggcagcggtgaatctggtgtacctgttctaacttttaagaaaatgagaaagacgagacgtatcataccttttgttttctgcggattactgatttcatgcaccacagagcgccgtctggcacgcgtacgtatctctcagccgcagatgaaggagacggttgcggataccggcaaacagctgcccggtcaaattgcctggacggatgacaaaggtgaagaacacctggtcaaacaggtatcccatgacagtgtcacaggcgaaaatatgacccttatcgaactctcggaagttactgtcatggcaaagagcaaacaggtagccgagagaaacggaaagatcaacctggactttctcgtaacggtccccggtgagctgatcaacaacaagtggcaggtccagctcactcccgtagcctataaaccgtccgacaccctgtacctggacaagatcttcctttcaggggccgactttgccaaaatgcaggagaaagggtacatgcgctaccgggcgttcatgaactccatcatcccggacagcctgtatatgcagcggctgctcgacagcaaaggctataagaaggcactggccgagctggaggaggaatacttccaggcctggaagcacgaggtcatcgccaaggagcgctgggtcgactggtcagacaagaccaatgcccggttcgcactgttcaactacaagatggaacgtaaccggcaggccattgccggatacaattccatcctggagtaccttcccgcctattggatgcgccgggaaatagacggcaaatacattccttccaaatggaagatgtttgccgaaggtaattataaaatccgcacgagaagcatcaccccggaagattcggcggccataacggaacgctttaccgattacaagaagatagccgagaaccagaaaagaaaggagcaggccggtgcgatgtacgaaaagtatgtgcggtttccttatgagcccgcacgcctggatacggtcatcaagcaaggcaacagcttcgtgtattattacaagcaggagcttcccgccaccgaaaacacgaagaagatagagctgacgcttgacggacagatcctctccagggacgaggtacggacccagcttccgccatcggacacgatcacctattatatctccagcatggtgcagttccttgaccgcacgccgcgttacaggaagaagatcattacccggaaggatgaagtcagcctgcgggcctatgtgacctataagagcggcagtaccgggttcgatgaaaagaccggaaacaacaaggcggagatcgacaaggtgttcgagaccatccgtggaatcaattatacgggagagttcctcatagacagcatccgcatgacggccacttcatcccccgagggcagttccgaaatgaaccttttcctttccagggaacgtgcgctggcactgaagaaataccttgccgcacgcacggaagaccgggaaggggtcgatacgcttttccgcccgcgctggaccggtgaggaatggagcaggctgcacgaactggtcctttcagatgacagcctggcaaacaaggccggcattttacgtatcctgaaagagacgaagaatcccgacagccgggaacatgccctgcgcgaatatgcttccgactacaaacgcatccgggaaagggtcttc

SEQ ID NO: 2149 - DNA, 357 bp, B.fragilis
gcaaaaggaggaacagccggcatgaaaaagagatcatttcttttgggaagcctgcttgccttcactctgggagtatcggcccagtcctattccctgcgtaccaacgtcctgggtctggctacgaccaacctgaacctggaggcatccatgaccctgggccgtaaatggtcgcttcacctgcccgtgcagtataacccgttccgcttcagcaggaaccggcagttccgtaacctatatgtcgctccgggtgtacgctactggctgctcgagagctatatggggccatttatcggcatgcacggcaccgccgggtacatacagtgtgggcaacctcttcggcagcaggtaccgctatga

SEQ ID NO: 2150 - DNA, 330 bp, B.fragilis
aggcacatgggatatgtatcgatcaaacggggatattgccgttctcagaagtacaggaataagtatatacgttggtactttgaaggagtgacaccgggactaagaggtcagtttgaagcgatgcgaagcacttcggcggaagaagtgcgtgtagccgctctggtgcattgccataacgctgttatagatagatacctggtaacaatcgggatgtgcagtgccaaagtacagcccagaaatacaaagacggactattcggcttaccactccggaatggatgacggacggagtatcagcctgcaccggcaaataaacggaggaaatgtatga

SEQ ID NO: 2151 - DNA, 288 bp, B.fragilis
agaatgaagggcacatactggtatgccgtggactatgccggcacggggcacctttttacctacaagcccgaaagggatgcggggatctggaacggggaggaggccctgcaggtttcccaaggggcactccgggaggtattccccaagatcacctggcaggactcacccgtagtggtaacactggaggtactaccctgtgaggagaccttccgcctgcgcctgtcaaagaactgcggttatatcctgagaaaatatctccgtttcccccgggaaggaaaaaacaaatga

SEQ ID NO: 2152 - DNA, 186 bp, B.fragilis
  unsure (8): Identity of nucleotide sequences at the above locations are unknown.
aggaaaanggggaatggggaaataaaggggagggggtggaagatgggaatgagatggtttcaaggaggttttgggagcaaattaagttggtgggagaaggggggggggaatgagggagaagcggaaaaacggaagattaaaatggcctggatttgtgaaccggtaaccgtacagaataatatatag

SEQ ID NO: 2153 - DNA, 222 bp, B.fragilis
gttcaccggatttatatcagccctactattggtgttcctgatatgaaaaagaaatcagagaagcaaaatatgaatgtgaaaaatatgaataaaataaacacagaaaaatctccggccattacgcttaacaaccggagactacacaaacaaaacaaacaatacatagctttatcttcccagaccaagctgacaaaaacattaaatattaggatacaaatatag

SEQ ID NO: 2154 - DNA, 417 bp, B.fragilis
accgtagacgtatcacgcggagaatggagatacaggataaaagacaggaacccattaaataacagccatatgtatttcatacattacatacagacatacgcatcggtgaaccggaagggaagcgagctccaggaatatgtcctgcagctcaaggacagcctgataaaggacagggaggtcctggatgacctgaaagaggaactccactgccggatcggggagcttgacgccaagtatccgcgtacacaacccctgcatctggatgcggcaagcggcagggatagcatccaatggatcatccacgtgaaaggcaagccggataacctgatatgtattatttcgattacgaaagtcagaaacctgctgggagaaggaaccggtttctttctcggggaaaagacaggaggtaaagaatga

SEQ ID NO: 2155 - DNA, 1296 bp, B.fragilis
  unsure (81),(138): Identity of nucleotide sequences at the above locations are unknown.
ttaaaatacaaatgtaaaagaataagtttgaattcatatcttttagtcagaaaactttttgaagcgatatttcggttaccntatagcgttctcctgtttgcttcacatactcttcgaggaattcctataatagcccgnacgtaccacgcctgcaggttgaccaatggcattacgctcgaacttgccgtccttcatcttacggatgacaccatcattgtacttcactatgataaattcgcccaaacgtttccaagtatcgaaagtgctttgcgctgtcatgtcggtatagttggtcagaaacttcacagccgtttccggattcttctcgtacaacttaacagcaactgcttcaataccttcctgtgcctcgttgaaggtggtttcaagttcgttctgcgtagcacgtacatcgccgatcatcaaatcgtagcggggatataccatgttggccacccagttgaaaatccaaaaagcggagttccaggagaaggtgatgtaatcggcaccgtctacacgcgtatagcataccggagctttggtagtacaacaatatacgggagtgaaaacagtcatgttggcatcatccgtaccaaaccaaagcacaccgcctacagcatcgggaagattggcacgcatctgagccacaaaaacgaaaccgctctgttgtgtagagatgggacgctcattgaaatactcctggtcgcctaccttgaaagtcagcggagagaggcggtaaggtgttttataaggtccggcaccaaaatcattgctgatgtcgagggcggttccttcataatggtcgcgcatggcattctttacatcctgaacggagagtttgcgtttcggctttacgaacagaggcatagggtcattggtctttccttggatataaggcagataggcttcaccttggtcggtaaacatattgaagtagctccacacacgggcttcacagaaacggcgggcaccgaaatcgagcggtgcataagcatcggcaaagctgaagtctttgttcacaccgctgaaatatcctttttcgcgggcaaaagaaataacgtcattagaatacatgcagttggccttgtcagccatatcgaactgatggatgcgcgactggttggcatgtgccgaaatgcagtcgtccggcactcggacagctacccatacggctccccggatgccgggacctttacctatcatctccataatccatatttcattgggatcggcaatggtgaagactcgccatgctgtaatatccgtattcctgcaccagttcagtgtcttcaccgcggg

SEQ ID NO: 2156 - DNA, 2292 bp, B.fragilis
aatctacacaaaggtatgaaaaataacactttgtcgggggcatattaccctaaaaatccccaaataaaacatttttttagaattatgagaattacattgttcctattgatggcatgtgttttttctttatatgccggaaattcctattctcaaaatacaagagttagttttgccatggataatgtaggactcaataaggtcctagaggagatagagagtcagacggattatctttttatttataatagtcagataaatgtaaataagctagttactattaaggcaaataagcagacggtttcaaaggtattggatcaaatattacagaacactggtattgaatataaattggaaggctcgcatattatattagaaaaaaaagtagaagaagttcacaatagctcgtccgccgttcagcaacagcaaactaaaaagataaccggaaaagttgtcgataagacaggagaggctattattggagcgaatgtcaaaatacaaggtacagataaaggaactattactgatctcgatggtaattttatcttggaggttgctccaaaggatgtgcttgttatcagttacataggctatttggatacgaaagttcccatagctgggcaaaaacagatccatgtggtgttgtctgaggataataaaatgttggacgaagtcgttgtaattggttatggtactacttctacacgcaagatggcgtctgctgttacagccgtgaaaggtgagaaactacaggacttgccatttaatagtgtagcagcttcactggccggacgtgcaacaggtgttattgtacaatcatcaggtggtgaaccgggatctgccccttctatctcgatccgtggcggtggcgcacctgtctatgtcatagatggtgttatttccgatgcttgggatttcaatacgttgaatccgaatgatatcgaaagcctttcaattctaaaggatgcagcatctctggctgtttacggttcacgggctgccaatggtattgtgatggtgaaaaccaaacagggaggtaagggaaagacagcggtgaattatacgtttaatgctgaattcagccaacctaccaaattactgaaaaagactcgtggttatgactatgcttacaaccaaatgcttgccggtatcaatgatggtttggacgaggcagatttaccttttaatcaggaagtattggatatcattaaaaatcagtcagatccttatacatccggacacgccgatacagattggctgggagaaggattgaaaactgttgctcctcaatacaagcatacggtatcattgagtggaagcggcaataaggtgaattactatatttctctgggtatgctcaatcaaggtagtatctatacttcgaatgcactgaactatgaccgctatacagttcgcagtaatgttaacacgacttttgataagattggtctgaaggtcagcctgaatctgaacggagcttatgaaaaaaaggaatacccctctttctcagcggcaaagatctgggaagatctttataaccagtctccactgaatccggcttacaataaggatggtacttatgccgcagttaccgaccatccgttggcggaaatggacaagcgttcgggatataacaggaactatggcaaattcataaatacccaagtagctgcggactggacattgccttggttaaaggagttaaccttgggtgctatgttcaactatcgtctgaacgactcacatgtgaagaaattcagtactaaggctcctcagtattacgcagatggagctgtatatccaataggtaaaccgacattgaatgaagaaggctattggggagagtcctacaatttcgaagtaagtgccgcttatgtgaaaacttttgccgaaaagcatacgattgatgctaaattcgtttataatgttgcagaaaatactggatggaattttaatgcatattgtggggaatacttatctacggttgtggaccagctatttgccggtgcagcatatacgcagcagaatggcggctattcggatgaaagaggacgtatgggattggtaggcctgttgaaatatgactttatgaatcggaatatcgtggaaggtagtttccgttactatggatcggataacttcactccaagacatcgttggggattcttcccctccggagcggaggcgtgggccatcagtgaagaacctttctttaaagagtgggaacaacatgtattcaatttgctcaaacttcgccctttcttatggacagacccgtacggaaaatgggagtaa

SEQ ID NO: 2157 - DNA, 213 bp, B.fragilis
tttgggggaaaaactgcacttcaggatttaattaaaaggggctttagggtgcctccggaaactgctttatcctgggattacgggggaaattcctttatactctgggattggaatattggctttttttcaactaatcgctttgtaaaaggtcaccttagaaatatttcttattaccgcaaacccaaaggtggggttaatataattccgcggtga

SEQ ID NO: 2158 - DNA, 1194 bp, B.fragilis
  unsure (1159): Identity of nucleotide sequences at the above locations are unknown.
cccgcggtgaagacactgaactggtgcaggaatacggatattacagcatggcgagtcttcaccattgccgatcccaatgaaatatggattatggagatgataggtaaaggtcccggcatccggggagccgtatgggtagctgtccgagtgccggacgactgcatttcggcacatgccaaccagtcgcgcatccatcagttcgatatggctgacaaggccaactgcatgtattctaatgacgttatttcttttgcccgcgaaaaaggatatttcagcggtgtgaacaaagacttcagctttgccgatgcttatgcaccgctcgatttcggtgcccgccgtttctgtgaagcccgtgtgtggagctacttcaatatgtttaccgaccaaggtgaagcctatctgccttatatccaaggaaagaccaatgaccctatgcctctgttcgtaaagccgaaacgcaaactctccgttcaggatgtaaagaatgccatgcgcgaccattatgaaggaaccgccctcgacatcagcaatgattttggtgccggaccttataaaacaccttaccgcctctctccgctgactttcaaggtaggcgaccaggagtatttcaatgagcgtcccatctctacacaacagagcggtttcgtttttgtggctcagatgcgtgccaatcttcccgatgctgtaggcggtgtgctttggtttggtacggatgatgccaacatgactgttttcactcccgtatattgttgtactaccaaagctccggtatgctatacgcgtgtagacggtgccgattacatcaccttctcctggaactccgctttttggattttcaactgggtggccaacatggtatatccccgctacgatttgatgatcggcgatgtacgtgctacgcagaacgaacttgaaaccaccttcaacgaggcacaggaaggtattgaagcagttgctgttaagttgtacgagaagaatccggaaacggctgtgaagtttctgaccaactataccgacatgacagcgcaaagcactttcgatacttggaaacgtttgggcgaatttatcatagtgaagtacaatgatggtgtcatccgtaagatgaaggacggcaagttcgagcgtaatgccattggtcaacctgcaggcgtggtacgtncgggctattataggaattcctcgaagagtatgtga

SEQ ID NO: 2159 - DNA, 1761 bp, B.fragilis
aatatagatagaaccatggggaatgaagaactaatcaaacaggtgactgagaaagccgaaaagtggctgaccccggcgtatgatgccgaaactcaggctgaagtgaaacgcatgctggagaacgaagataagacagaattgatcgaggccttttacaaagatctcgaatttggtacgggcggactccgtgggatcatgggcgtaggtaccaatcgtatgaacatctatactgtcggagctgctacccagggactctctaactatctgaacgcaaactttaaagatatgaaacagatttcggttgtagtcggatacgattgccgtaacaacagttctctgtttgccaagatctctgcggatattttctcggccaatggcattaaggtatatttgttcgaagagatgcgtcccactccggagatgtcttttgccatccgtcatctcggttgccagagcggcattatcctgactgcttcacacaacccgaaagaatacaacggttataaggcttattgggacgacggtgcgcaagtactggctccgcacgataagggcattatcgatgaagtgaataagattgcttctgctgccgatatcaagttccaaggtaacccggatctgattcagatcatcggagaagatgtcgataagatatatctggatatggtgaagactgtttctatcgatcctgaagcgatcgcccgccataaagatatgaagattgtatacactccgatccacggtacaggcatgatgctgattccgcgtgcactgaagatgtggggattcgagaacgtatataccgtgcccgagcagatgattaaggacggtaacttcccgacagttgtctctccgaatccggagaatgcggaagctttgacgatggctcttaatctggctaaagaaattgatgccgaccttgtaatggcttccgacccggatgccgaccgcgtaggtatcgcttgtaagaacgataaaggcgaatgggtattgattaatggtaaccagacttgtctgatgtatctttattacatcatcactcaatataacaaactgggcaaaatgaccggtaatgaattttgtgtgaaaactatcgttactaccgaactgatcaagaagattgccgataagaatcacattgagatgctcgattgctacaccggtttcaaatggattgcccgtgaaattcgtttgcgtgaaggcaagaagaaatacatcggcggtggtgaagaaagctatggcttcctggctgaggactttgttcgtgataaagacgctgtttctgcttgctgcctgattgccgaagtggctgcttgggccaaggataacggaaagactctgtatcagttgctgatggacatctacgttgaatatggattctctaaggaatttactgtaaacgttgtgaaaccgggtaagagcggtgcggaagagattaaagccatgatggagaatttccgtgctaaccctccgaaagagttgggtggttcgaaagtggttctgtcgaaagattacaagactctgaaacaaaccgacgcagcgggccatgtgactgacatcgatatgccggaaccatcgaatgtactgcaatatttcacagaagacggtggaaaagtatctgttcgtccgtcaggaacggagccgaagatcaaattctatatcgaagtgaaaggtgagatgggatgccgcaactgttttgctactgccgatgcagaagctactgaaaaagtagaagcagtgaagaagtcactgggtatttaa

SEQ ID NO: 2160 - DNA, 195 bp, B.fragilis
  unsure (54),(111): Identity of nucleotide sequences at the above locations are unknown.
aggacggcaagttcgagcgtaatgccattggtcaacctgcaggcgtggtacgtncgggctattataggaattcctcgaagagtatgtgaagcaaacaggagaacgctatanggtaaccgaaatatcgcttcaaaaagttttctgactaaaagatatgaattcaaacttattcttttacatttgtattttaattaa

SEQ ID NO: 2161 - DNA, 246 bp, B.fragilis
gaactatttatccaggaaaacgacagtgatcgtttccctgtcactctccctatcattgtagaaacgggaaaaatcagcacgcggataggagacattgtccgagtggaaggcactgcacaagtcctcggctttttagagaatagtcccaaaagaaatgccccatccaatgaaggacaaggcattccaataatattatggatacatttatacgatgctaagtatccgtcaaaagagtatttaaaatag

SEQ ID NO: 2162 - DNA, 945 bp, B.fragilis
tacattgtcatggacaaagatttactatataatttttataaaggaaaggtttccatagaagaaggacaaagggtcaaggcttgggtagaagcatcagacgaaaacgagcgcgctttctatagggaacgtaaaatttttgatgccttgatgcttaataatccgcttccggtaaagaaaacctcttttttcaattttacacattataaaaaaatagagtggctgaaaattgccatggctgtaatattgacatttctgcttagttatttctatcaggagtataaagccggtctggattcagtggcaatgagtacgatttctgttcctgaaggacaaagaaccaatgtcacattacccgatggtagtaatgtttggttaaatgcatgtacaacgatacaatatccgacttcttttaacagccgggagcgtttcgttatactaaaaggagaagcttattttgatgtgaaaaagaataaaagcagaccgtttatagtgcacacagatgcttatagcatcgaagtattaggtacgaagtttaatgtggatgcatatccggaaacagaaaaatttgaaactacattgatgcatggcagtgttaaggtcactttgaaagcagattcatcgcaaacagtaatattaaagcctgatcataaattgtcattagaaaaaggacggtttgtaatgactaaagtggaagattataatccttatcgatggaaagaagggcttatctgtttctctgacgaatcttttcctaatattatgaaagactttgaaaagtattacggagtgaaaatagtgatagagaataaaaatgtattgcagattaattttacggggaaattcagacaaaccgacggaatagattatgcgcttcgtatcttacaaaaaaatatagatttccaatatgagaaagataatgaaaaacaaattatctatataaaataa

SEQ ID NO: 2163 - DNA, 588 bp, B.fragilis
tcctatgtaatgcatattaagactaatccgaaagataaaatgtcttttaatcagctatataatgattatcagacacgttttttgaattttgctaatacctatgtcagagattgggatgtagcggaagatataacaacagaggcgttaatttattattgggaaaacagaaatactttatctgaagtatccaatattcctgcatatatacttaccatcataaaaaacaaaagtcttaattatcttcgtcatttgcagatacgggaagaacattctgaaaatattagaaaatatattgagtgggaactcaatgcacgtatcgtttctttagatgcttgcgaaccttatgaacttttagtcaaagagatgcaagagctgattcagcaaactttggataaattgccggagcgtacacgcaaaatatttattttaagccgttatgaaaacaaatcgtataaggagattgctgctctaatgaatatgacaaccaaaggtgtagactttcatatttgtaaagctttaaaggcattacagattaacctaaaagattattttccattatttctttattttttgatgaaatttcactag

SEQ ID NO: 2164 - DNA, 1890 bp, B.fragilis
gaagatagactaaaaacaatggaagagaacgaactgatacctgtagacaacaaccctgtagaatatacagacgacaacatccgacacctgagcgacatggaacatgtgcgcacccgtccgggtatgtacatcggtaagctgggcgacggttcgcataccgaagacggaatatatgtccttctgaaagaagttattgacaacagtatcgacgagttcaaaatgcaatccggcaagaagatcgaaatcagagtggaagagaatcttcgtgtcagtgtacgcgactacggccgcggtatcccacagggaaaactaatagaggcagtcagtgtgctgaacaccggtggtaagtatgacagcaaggctttcaagaaaagtgtcggactgaacggtgtcggcgtgaaagctgtcaatgctttgagctcaaactttgaagtacgtagttaccgggatggtaaagtgcgttgcgccacctttaccaaaggagagttggtgacagaccacacagaagatacggaagaagaaaacggtacttacatcttcttcgaaccggatgaaactttattcctgaattatagtttccgtcccgaatttatcgagacgatgctgcgcaattacacatacctgaacaccgggctggcaattatctataatggccaacggatcctttcgcgcaatggcctggtagatttgctgaatgataacatgacagctaccggcctctaccccatcgtacatctgaagggcgaagatatcgagatagcctttacccataccggacagtacggagaggagtactactcatttgtaaacggtcagcataccactcagggaggtacccatcaaagtgctttcaaagaacacatcgcccgcaccatcaaagagttctataacaagaatcaagactatactgacatccgtaacggactggtagccgccattgctgtcaacgtggaagaacctatgtttgaaagccagaccaaaatcaaactcggctctaccaatatgtcgccgggaggcatcacagtaaataagttcgtgggtgacttcataaaacaggaggtagacaatttcctccacaaacatgccgatatagccgaaatcatgttgcaaaagatacaggattcggaaaaagaacgcaaagccattgccggagtgaccaaactggcacgtgaacgcgccaagaaagccaacctgcacaaccggaagctgcgtgattgccgcgtccacctgaacgatgtgaaaggcaaaggactggaagaggaatcgtgcattttcatcaccgagggtgactcggcaagcggctctatcaccaaaagccgggatgtgaacacacaagccgtattcagcctccgcggtaagcctctcaactctttcggcctgaccaaaaaagtagtttacgagaacgaagaattcaatctgctgcaagctgcattgaatatagaagacggtatcgaaggcttacgctacaacaaagtgatcgtggctaccgatgccgatgtggatggtatgcacatccgcttgttgctgattactttcttccttcagttcttccccgatctgataaagaaaggacatgtatatatactccaaactcctctcttccgcgtacgcaataaaaagaaaacgctttattgttataccgaagaagagcgtgtaaatgctattaaagagcttagcccgaatccggaaatcacccgttttaaaggtttgggggaaatctcgcccgacgaattcagacactttatcggcaaagatatgcgtctcgaacaagtatcgctgcgcaaaacagacacggtaaaagaactactcgaattttacatgggtaagaatacaatggaacggcaaaactttattattgataatctggttatagaagaagacatcgcataa

SEQ ID NO: 2165 - DNA, 483 bp, B.fragilis
tctggttatagaagaagacatcgcataaacatgagaagagctatctttccgggaacgttcgacccgtttaccatcggacactactccgtagttcaacgcaccctgacattcatggacgaagtggtcatcggtatcggtatcaacgaaaacaagaatacatactttccgatcgagaaacgtgtggaaatgattcgtaagttctataaagacgaaccccggatcaaggtcgaatcttacgattgcctgacgatcgactttgcccgtcaggtagatgcccaattcatcgttcgcggtatccgtaccgtgaaagacttcgaatacgaagaaacaattgccgatatcaaccggaaactggccggcattgaaaccattctgttatttaccgaaccggaattgacctgtgtcagctctaccatcgtccgcgaactgcttggctataataaggatatcagtatgttcattcccaaagggatggaaatgtaa

SEQ ID NO: 2166 - DNA, 441 bp, B.fragilis
cataacaccagaatacttccttcgatccgtgtgatggtgcgtttggcaaaaaataatccgaaaaaccagagcagaatgcccgaaccgaccaaggtgaaaaggtcgaagttattgatgcctgtcagccgcaagggagtgatggaagcactgcatcccaatacaaagaagatgttgaacagattactgccgatcacattaccgatggctatttccggattctttttcaaggcagccactatcgatgtagcaagttccggtagggaggtacctccggctaccagtgtgagtccgataacagattcgctgacgccaaggtgccgtgcgatgttgcttgctccctctacaaaccattgtcccccgaaaataagtccggccaatccgcccagaatgaaaagtacggatttccacatcgggaggcttttgatttcctcttccggttga

SEQ ID NO: 2167 - DNA, 1146 bp, B.fragilis
atacaagctatggccattacaattaaaaaggtatcgacaaaaagagaacttaaaaaattcattcgttttaattacgaattatacaaagagaatccttattccgtacctgacctctacgacgacatgctgaatacattcaataagaagaaaaatgcggcattcgagttctgtgaggccgagtactttctggcttataaagacggaaaaatcgtagggcgcatcgcaggtattatcaatcaccgtgccaatgccacttggaacaaaaaagatgtccgtttcggttggatcgacttcatcgacgaccttgaagtatcttccagacttctgcaaaccgtagaagaatggggtaaatccaaagggatggagaacattcagggacctcttggatttaccgacttcgacgcagaaggtatgctgatcgaaggattcgaccaactcagtaccatggcaaccatctacaatcatccctactatccgcaacacatggagaaactgggatttgagaaagatgccgactgggtggaatacaaaatttatattcctgacgccatccctgagaaacaccagcgcatatccgatcttattcagcgtaaatataacctcaagataaagaaatatacctcatccagaaagattgcagccgattacggacaagccatctttgagttgatgaacgaagcttatagtccgctgtacggatactctccgctttcgcaacggcaaattgaccaatatgttaaaatgtaccttccgattgtcgacttgcgaatggtaaccctgatcacagatgcggaagacaagttaattgccgtaggcatttcaatgccttcactttcggaagcgttacagaaatcgcatggacgccttttgcccctcggatggtattatctgctaaaggcattgttcatgaaacgacgcgcaaaaatgcttgacctgctgcttgtagccgtgaaaccggagtaccaaaacaaaggtgttaacgctttgttattttccgatttaattccggtttatcaaaaattaggttttatctttgcagaaagcaaccccgaactggaaatgaacggaaaggttcaggcacaatgggaatactttaaaaccgaacaacataaacgtcgtcgtgcgtttactaagaagatagactaa

SEQ ID NO: 2168 - DNA, 972 bp, B.fragilis
tttaaaggtatagacatggatatattactgcttattggaggattactcctcattttgataggtgccaactgcctgacagatggtgctgcgtccgtagccaagcgattccgtattccttccatcgtaatcggcctgactatcgtagctttcggaacttccgccccggaactgaccgttagcgtatcgtccgccctgaaaggtagcgcggacatcgccgtaggtaacgtagtgggaagtaatatcttcaatacattgatgatcgtcgggtgcaccgctctatttgctcctatcgtaattacccggaatactttgcggaaagagattccgctatgcattctctcctccatcgtcctgctgatatgcgccaatgacgtttttctgaataaagcttccagcaacatactaagcatctcggacggactgattctgctctgtttcttcaccatcttcctgggctacacatttgccatagcctcacccacaaacaatactcaaccggaagaggaaatcaaaagcctcccgatgtggaaatccgtacttttcattctgggcggattggccggacttattttcgggggacaatggtttgtagagggagcaagcaacatcgcacggcaccttggcgtcagcgaatctgttatcggactcacactggtagccggaggtacctccctaccggaacttgctacatcgatagtggctgccttgaaaaagaatccggaaatagccatcggtaatgtgatcggcagtaatctgttcaacatcttctttgtattgggatgcagtgcttccatcactcccttgcggctgacaggcatcaataacttcgaccttttcaccttggtcggttcgggcattctgctctggtttttcggattattttttgccaaacgcaccatcacacggatcgaaggaagtattctggtgttatgctatatagcctacaccacctatctgatctatcagatttga

SEQ ID NO: 2169 - DNA, 921 bp, B.fragilis
  unsure (795): Identity of nucleotide sequences at the above locations are unknown.
acccatgtgatcatgaaaagaataatatacctgcttatcggtttgtgttccgttttgggactacaggcacagaactttggctcacccgccatgcgaaaattacaactggcagagttcgccatctctaatttatatgtagatacggtcaatgaaaacaaactggttgaatcggccatcatagaaatgctggcacagctcgaccctcattccacctattcggatgccgaagaggtgaagaaaatgaatgaaccgctccaaggcaatttcgaagggataggtgtacagtttcagatgatcgaagatacgttgctcatcgtacaaccggtgagtaatggcccgtccgaaaaggtaggtatcctggcaggagaccgtatcatcgcggtgaatgacacagccatagcaggcgtaaaaatgggaacagaagaaatcatgggacgcctgcggggccccaaagattcgaaagtaaacctgaccattatccgcagaggtgtgaaagaaccgcttttatttaatgtaaaacgagataaaattccaatcctcagcctggatgctgcttatatgattcagcctaaaataggatacatccgtatcaaccgttttggagcaactaccgccgaagagtttctaaaagccctgaaagagttacagaaaaaagggatgaaagacctgattctggacctgcaaggcaacggaggtggttatctgaatgccgccatcgatctggcaaacgagttcctgggacaaaaaaaactgattgtctacacagaaagaccttctgcacaacgcaatgaagtntttggccaaggcaacggaaacttccgtaacggacgtctggtggaattggtagacaaatattcgctttgggcagtgaaaattgggacaggtgccattcaagattgggaacaaaggaatggtgggtag

SEQ ID NO: 2170 - DNA, 627 bp, B.fragilis
agtaaagaaacaattaatgtaaagttaaactttaagagagaatttatgaaaagaaaattaatgctgttattgacttgcctttttatgggtataggtctagtaactgcccaaactcagaaggtaacaggtgttgttatttctgaagaagacgggcaaccagttgttggagcctctgtattggctaaaggcaccactgtaggtgttattactgatgtagatggtaaatttacattatctggtataccaagttctgcaaagactttgcagatttcatatattggtatgcagaccgctgaggtagcaattgcacctaatattagagtaatattaaaaacagactcaaaagcacttgacgaggttgtggtagttgcttacggaacacaaagtgctcgtacggtgaccgcatctgtatctactgtaagagcggatgctttgaaagatgtgccaagtgtaagttttgatcagatgcttcagggacgtgcgtcaggtgttagtatcaccactccgtcagcaggtgtagggcaggccccgattgtgcgggtacgtggtgtgaactcgattacttccggtacttctcctctgtatgttgtcgatgtcttcaccgggggtgcaatgattgctcgtggg

SEQ ID NO: 2171 - DNA, 1197 bp, B.fragilis
ttaaaaataaaggaaatggataaaattatttacagtttggtgtataataggaaaaagagcctgaataaaaagggtatggcattagtacaggttgaggcctatttaaacagaaaaaagaaatatttctctaccaaagtttacttgagtcccgatcaatgggattttaagaagagaatggttaagaaccatcctaatgcagatgctatcaatcacatgctttacgagtttatggcagaaatagagaagaaagagttgggattgtggcaacaggggaaacagatttcattggattcattaaagaattctatggaaaatcaagacgacagcacttcatttattgcatttttccgcaacgaaatagcaaaatcttcattgaaggaaagtacaaaacgcaatcatctctcaacattagaattattaaggagttataagaaggatgtgtcattttctgaattgacttttgaatttatatcctcatttgatcactatcttcagcaaaaaggatatcatactaatacaattgcgaaacacatgaaacatctaaagcgtcatattaatgtagccataaataaagaatatatggagatacagaaatatgcctttcggaaatataagatcaagagtgttgagaataatcatactcacctctctccggaggaattaggaaagattgaaagtctggaattggggggacggttcactaaactggaaaagaccaaagatgctttcctcttttgttgttatgcaggattacgatattctgacttcaccaacttatcccctgaaaacatagtgaaaatgcatcaagaaacttggcttatttataaatctgtgaaaacgaacacggaagtacgtcttccgctttatcttttatttgaggggaaaggaatagaagtcttgaataaatatcaagatgatcttgccgatttttttaagcttagagataattcaaatgtgaataaggagctattgatcatagcaaaattatcagggctaaataaacgtatttcgttccataccgctcgccataccaatgccacattattaatatacagtggagtcaatattactactgtacaaaagctattgggacataaaagtgtgaaaacaacacaggtttatactaatataatggacataactattgtaagagacttagaaaagtctaaaaataatcgcaaagtatcttatatgtaa

SEQ ID NO: 2172 - DNA, 471 bp, B.fragilis
aaacttaaaccgatgaaaaagaatctttattggatggcagcagcattcatcactttaactgctgtaggttgtacaaatgcgaagaaagccgatgtatctgcggcaggcagcgataccacacaagtgatagatatgcatactgccgaaacctctctcgattactatggagtttacaaaggtacggttccggctgccgattgtccgggcatagaactgaccctgacattgaagaaggatcgcacctatacgtatcattgggcttatattgaccgtaaagatgccgatttcgatgaaaccggtacgtttacggtgaaggataatctgcttacgcttactgaaaaaggaggcgaagtgtcttacttcaaagtgcaggaaggcagcctggtgatgctgaacaatgagaaacagcctgctaccggtactttggccgatgcctatgtattaaagcaggaagaggtgttcctcgattga

SEQ ID NO: 2173 - DNA, 2217 bp, B.fragilis
acacacttcacaaaaaaatatgcttgtatgcagagagccaaaaagaattatcttatttatgcggttatgttgctccttttcggggcgcttatttacatggctatcgaggagggagatcgtttttcacaccatgcggtagcatcgtcaactgtcgcagaagacactcctttcactatgttttgtcagtttgtcaccgacaacttacatcatcccttgagtatattgctgatacagatcattgctgtcctgctgatggtaaggcttttcggctttctgttcaagcacatcgggcagcccggggtgattggtgagattgtggcgggtattgtgttggggccttctgtgttaggctattttttcccagatgtgtttcaagcccttttccctcccgaatctcttaccaatctggagttgctgagccaggtcggactggttcttttcatgttcgtaatcgggatggaactagactttagcgtactcaaaaacaagataaacgaaacattggtcatcagccatgcgggtatattggttccgttcttcctcggcatcgtggcatcctattggatttatgaagagtatgcggctgcccagaccgcctttctgccgtttgccctcttcatcggtatctcaatgagtataaccgcttttccggtgttggcacgcatcattcaggaacggaatatgacaaagacttctttgggaactttggccattgcttcggctgccaatgatgacgttactgcctggtgtctgctggctgtagtcatcgccatagccaaggcgggaacgtttgccagtgccctttacgccatcgggctgacggctctttatatcattatcatgtttatggtggtacgtcctttcctcaagaaagtgggagaggtgtatgccaatcaggaggtgattaacaaaacatttgtggcgctgattctgctgattctcatcatttcttccacgcttaccgagattatcggtattcatgccctgttcggtgctttcatggcaggagtggtgatgccgcccagcatcggattccgcaaggtgatgatggaaaaagtagaagatattgcccttgtctttttccttcctcttttctttgcctttacaggattgcgtaccgagatcggattgatcaacagtccggcgctttggggtgtctgcctgctgctgattacggttgccgtagcaggaaaactgggaggatgtgctgttgccgcgcgtttggtaggtgagtcctggaaagacagttttactatcggtacgctgatgaatacacggggactgatggaactggtggcactgaatatcggatacgaaatgggagtacttccgccttctatctttgtaatcctcgtcattatggcattggtaactacttttatgacgactccgttgttacaccttgtcgagcgggtttttgcccgtcgtgaagaacgcttgtcggccaagctgaagctggtcttctgttttggcaggccggagtcgggacgcagcctgctttccatctttttcttattgttcggaaagaagatgaaagctgcccaggtcgttgctgcccattttacagtgggtacggatctgaaccccctgaatgcagaacagtatgcccgagatagtttttccctcgtggacgaaaaagcttccgaattgggacttagcgttgagaatcgttaccgggtaaccgataaattggtacaggatatgatccggttggcacgaaaagagcgtcccgatatgtttctgttgggagccggtagcaagtacaggccggatactgcgggaagcaacggagtgctgtggctctctctgtttcgcgataagatagacgatgtaatggagcaggtgaaatgtccggttgctgtttttgtcaatcgtggctatagcggcagctcccccgtctctttcgtactagggggagtgattgatgcttttttgttgacttatcttgaaagtatgttggaagggggagcacaggttcatctcttcctttttgatacggatgatgaagctttccggcaatcgaccgatccgatcctggcaaaatattcgtctcagatccggacacggccttttagtggtgctgccaatctgacttcggcagcgaaggatggcttgcttgtgatgagtcacttatcttatacgaagctgtccgaagaagaagaggtgttccgcgatttgccttcactgttggtcatccggaggcctaagaagggttga

SEQ ID NO: 2174 - DNA, 354 bp, B.fragilis
aatgagggcactacagccgccggtgaagacgccaatctggaacagacccgcctgcaacagcaaagtctgaacgagcagatgttgctggaactaacccgggcggccaataatcttgatgaggcgaaactagaaagcgagcttgccgaccgttctctccaacaggccgaggaaaacaggcgtgtcagcaaaaaccaatatgaagtgggattggaaaccctttccgaccatctggaaggacaagctttatggcaacaggcatacgaaacgaaagtgaatgcacatttccagctttatctgaattatgtggcttatttgaaagcggcaggtatattatataataagattaatttataa

SEQ ID NO: 2175 - DNA, 546 bp, B.fragilis
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtttat

SEQ ID NO: 2176 - DNA, 252 bp, B.fragilis; identical to SEQ ID NO: 860

SEQ ID NO: 2177 - DNA, 1077 bp, B.fragilis
cgattaaaaaaacagaataaaagaatgactggaatagaaaaaacagtaacgaataggtcgggggccggagctttggtgctctgtaccatacttttttgcttgtgcgcctgtacggaagatgcttcctatacggcaggagtctggtaccgccgttcggacttcgacggggtggcacgtaccgatgctgccggtttcacgattggcaacaaaggatatatctgtggaggttacaacgggaaaacaacccgtctggccgatacctgggagtatgacatcgacaatgactggtggacgcaacgtgccgatatgcccggtacggttcggaatgccgctacaggtttcccggtggggaataaagggtacatcactaccggttacaatcccgatcagaagtatctggccgatacgtgggagtacgatccggagacaaatacctggcggcaaatggatgacttcaaagggggagcccgttattatgcccttgggtttggcattgataattatggctatgtaggtaccggttacaatgataactatttgaaggacttttatcgattcgatcctactgcggcagccggttcgcaatggactatcgtgaatggtttcggtggacaaaagcgtcagggagccacagcctttgtgatcaatggaaaagcctatgtctgtggaggacagaacaacaattccgatgtgtcggacttttggcgtttcgatccttctgccgccacgccgtggacacaattgagagatattgccaataccagcgacgatgattatgatgacgattatacttctattgtccgttcttacggagtcagttttgtgatcgatggaaaagcgtatctgactttgggctctactgccggaggaagttattattcgaactattggatctatgatcctgaaaccgatctttgggaaggagacgacctgacagcgtttgaaggcagtacacgcatccatgctgtctgtttttctaccggaacccgggggatcattgcgacaggcggcagtggatcgagttcatactttgatgacacttgggagttgaagccttatgaatatgaagaagaataa

SEQ ID NO: 2178 - DNA, 1209 bp, B.fragilis
cccatgaaaagaaacctgattctattgcttactctttgccactccactttattaatatatagtcaaaataccaccaactccccgacttccatgttcggactgggcgaactctccaccggagaaggcggacaatactccggactgggtggagcaggaattgccttgcaaagctacaacttcctgaatacagccaatccggcctcacttaccgccatcgagggacaacgtttcctgatagacgccggagtaatgggagcttacaaggtatatacacaaaccgggacgagcaatcactcgctggtaggtaacctgaacaacctgagcatcggttgccgcatcactccacgctggtatggagccgtgttcatggcaccggtcagtagtgtaggctatgccatcacactggatcaggacatcacgggaaccggcagttccaccgtatcgtcactcttcgaaggcgaaggcggattgtctaaaatgggaatcagtacagcctatcggcttttcaagggattttctgtcggcgctaacctttcctacgtaaccgggaccatcaaacagacagaaacccagggaagtatcaatgtggaagaaagctcatacaagcatgccttttatgctgacttcggcttgcaatacaaattttcactgagccggaataagtacctcgtggcaggagctgtatacggatattcgcaagacctggcacaagacaataccttgtcggtaagcagcacatcgggcaacgaatcgattgacgaaagccaacgccatgtgcgccaatgcctcccccagtttgtgggagcgggacttgcatacaacagtccgcactggacgctgacagttgaatataaatatacggattggagtcgtatgaagtcatcacaaagcaacgtccgcttcgagaaccaacaccgattgtcggcaggcacagcctatacggcaggcaatatttaccggaatccggtgaaactgttactcggagcgggcgtcagcaactcttatatagtcattcagaagaagaaagcaaccaactactatgtcagtgcaggaagcaacttcactctgtacaacggcaacgttctctccctgggagtgaaatacagcgaccagcttcatctgcccaacggcatgcaacgggaacggggagtcacactctttttcaattttaccttttcggaacggacctaccgggcgaagatccaataa

SEQ ID NO: 2179 - DNA, 1401 bp, B.fragilis
atcgttccgattagtcgatcctttttttacagggaaaataaatcgtcttcttttgcggcaaaaatgatccgattcatgaaacgaaaaaacttatccttgttttttatcactctttttatatcactcctcgcctcttgtcgtgacgaactgtcgacggcgggaggcaaatgggtggaaagctccctgcgaaccatacaaaccgatacctgtaccgtacgcctcagcactatcctgagtgactctcttgccacatcgggtgacactgtctgccagataggaaccattgacgatcccgtctggggaaagatagaggcagctttctatgtcgaatatgacgtaccgacagtttcattcagtgaaaatgccgactacagattcgactccattaccatccggttctattcatcgggtaactatctgggagataccctaagtccgcaacgtatctcactgcacagtctatcggagaatctgtcattggacgaaggttatctgtacactacttcgaaggtgtcctatcactccactcccctggcttcctttactttcacccccaccccgggcgaaacaatccgggaacatgaaatccgcctccccgacgaatggggagtcgagtggttcgaacattttcaggccggttcacgtgagatggagtcgcaagagtacttccgcgactatttcaaaggtatcgcgtttattcccgaagaagggggaaattgtgtcaacggttttatggtgaacgactcaagcttatgcatcactctctattatcatcagacggaaacggatgccacggaactgtccgccgattttttacccaacagcgatctgaggttcaaccaggtcagttgtgaccgcagccggaccgcactctcctctttgcaaagtggactcaacaacgggcttccttcagaaaaatcggagcaccagtcctatctgcaagggttgaccggcatgtatatcaatattgattttccatttctcaatgacctgcgtgccgaaggcaggctggtgaccatcgaaagcgccctgctccggctatatccggtaaaaggaacttatggcaaacagtatccccttcccgaatcgctgacactgtatacagccgatgaaaacaatgtgacggaagatgtagtgactgatatttcaggcagttccgtacaaaccggaagcctggtgacagatgaaatgatgggagaagatacctattactctttcgatatcacctctttcctgcaaagcaatctgggaacggtaggatacaaccggaagattcttcaactgatgctcccggacaacttattcttcactaccctgaacggagtcgtattcggggatgccggacatccggacagcaatcccgtgaaactaaccctactttataaaacatataacccatga

SEQ ID NO: 2180 - DNA, 264 bp, B.fragilis
  unsure (27),(44),(46),(159): Identity of nucleotide sequences at the above locations are unknown.
ggccgccgcgcgaggcccatcgctgcntgcaccatgggagagananctgtggacgaggaagtacccgtacttttcgagtatcctttaatgaacgatgtcatgcggattgtaaaggaggaggaaccggagattctgtctcagtcgtatgatatggatgcnagcatgacgcttcgtatccggcagtcggcaatgccccgtttaaggtcccggctggagaaagtggagactgcccgcattacagatgaacaggaaggaaatggatag

SEQ ID NO: 2181 - DNA, 1260 bp, B.fragilis
tctgcagttcttatggcaacaataaaaccatttaaaggcatccgtcctccgcaggacttggtagaacaggtcgcttcacgtccgtatgacgtgctgaattcagaagaggctcgtgcagaagctgccgggaacgataaatcattgtaccacatcattaaaccggaaatagactttcccgtcgggacagatgaacatgatgagaaggtgtatgcgaaagcggcagagaatttccgtctgttccgtgataaaggatggctggtgcaggatgacaaagagaattattatatctatgcccagaccatgaatggcaagacacagtatgggctggtggtgggtgcttacgtgcccgattatatgaacggtgtcatcaaaaagcacgaactcacccggcgtgacaaggaagaagaccgcatgaagcatgtccgtgtgaacaatgccaacatcgaaccggtgttctttgcttatcccgacaatgcggtgctcgatgccattatccgcaagtatacggctcaaaagccggtatacgattttattgctcccggtgacggattcggacacactttctgggtgatcgacaacagcgaagacattgctgtcatcaccaaggagtttgctgccatgccggcgctttatatcgccgacgggcatcatcgttcggctgccgctgccctggtaggggccgaaaaggcaaagcagaatcctaatcatcgcggagacgaagaatacaactatttcatggccgtatgtttccccgccaaccagttgactattatcgattacaaccgggtggtgaaagatctcaatggcttgacgcctgccgaatttctgaccgcccttggaaagaattttgagatcgaagagaaaggtaaagagatttataaacccaatgcgttgcataactttgcgctctatctggatggcaaatggtatagcctgacagccaaaccgggtacttatgacgataatgatcctataggtgtattggatgtgaccatctcttccaacctgattctggacgaaattctgggaatcaaggatctgcgttcggatcgccggattgactttgtagggggaatccgcggcttgggcgaattgagcagacgggttgacagcggcgaaatgaaagtggctttggccctttatcctgtttcaatgaagcaattgatggatattgccgatacaggaaacattatgcctccgaagactacctggttcgaacctaaactgcgttcggggctggtgatacacgagctcgaataa

SEQ ID NO: 2182 - DNA, 636 bp, B.fragilis
aatatgagccaattattttctaaaaagaataaagaagtattcgctactccactgggattgaataacccggtaaccgtgcaggtgctcggtatctgttcggcactggctgtaacggccaaactggaaccggctatcgtgatgggtctttcggtaactgtgattacggctttctcaaacgtcgttatctctttgctgcgtaagacgattcctaaccgtatccgtatcatcgtacagttggtggtagtagccgcattggtaactatagtaagtgaggtgctgaaagcgtttgcatacgatgtaagcgtacagctttcggtatacgtaggtctgatcattacaaactgtatcctgatgggacgcctcgaagcgtttgccatggcaaacggtccgtgggagtcattcctcgacggtgtaggtaatggtctgggatatgccaagatcctgatcatcgtggctttcttccgcgagttgctcggatcgggcacattgctcaacttccgtattatccctgagtcattctataagatgggttacatcaacaatggtttgatgttgatgccgccgatggcactgatcatctgtgcatgtatcatctggtatcagcgcagccgctgcaaagaactccaggaaaagtaa

SEQ ID NO: 2183 - DNA, 495 bp, B.fragilis
tttgtggcgaattcgttttgtgttccggactattcaaatatgtacgtttttccgtatctttgccgccgaagtaattattatcaggaaacagatatgggacgaaaagaagaatacaaattgcagaacgaacaattcatgcagacattacgcaccgaagcggatgtacacgaattgccatgcggcatattatataaggttttggaggaaggtaccggcgcagccacgccccgttccaacagtgtggtgtcggttcattacaagggcactcttatcaatggacgtgaatttgataattcctggaagcggaactgtcccgaagcttttcgtctgaacgaggttatcgaaggatggcagattgctctgcaaaagatgcgggtgggagatcactggatcgtctacatcccttataatatgggctatggcacacgtaccagtggcccgattccggctttttcaactttgattttcgaggtacaattactgggtatagcttga

SEQ ID NO: 2184 - DNA, 1290 bp, B.fragilis
agtaaaaagaataaaacaatgacgtctttaatattagcaagtatcggagtcttccttgtggtgatcatcctgcttgtcattatactgctcgttgcgaagagctatctttctccttcgggcgaggttacgattacgatgaatggagagcaacaactgaaaacatctcagggtggtactctgctgggtacgttgtctgccaacaatgtgttcctttcatcggcttgtggtggtaagggttcatgcggacagtgccgttgccaggtgctcgaaggcggtggcgagattttgcctaccgaaaccggtttcttctctcgtaaagaacaggccgatcactggcgcctcggatgccaggtgaaggtgaaacaggatatgtctatcaagatcgacgagtctatcctgggtgtgaaagagtgggagtgcgaggtgatctcgaacaagaacgtggctacgtttatcaaagagtttatcgtggctctgcctccgggcgaacacatggactttgtgccgggttcgtatgcccagatcaagattcctaccttctcgatggattatgataaggacatcgataagagcctgatcggtgacgaatatcttccggcatgggagaaattcggtctgctcggcctgaagtgccgcaacgacgaaccgaccatccgtgcttattctatggccaactatccggctgagggtgaccgcatcatgctgactgtacgtatcgctactcctcctttcaaaccgaaagatcagggaccgggctttatggatgtgatgccgggtatcgcttcttcttacatctttacgctgaagccgggtgacaaggtgaccatgagtggaccttacggtgacttccacccgattctggattcgaagaacgaaatgatgtggatcggtggtggtgcaggtatggctccgttgcgtgcccagattatgcacttgaccaagacgctgcatatcactgaccgtacgatgaactacttctacggtgcccgtgcactgaacgaggtgttctatctggaagacttcctgcagattgagaaagacttcccgaacttcaagttccacctggcactcgaccgtccggaccctgctgcagacgcagccggtgtgaagtatacggcaggtttcgtacacaacgtgatttacgaaacttatctgaagaaccatgaagctccggaagacatcgaatactacatgtgtggtcccggcccgatgagtaaagctgtcgagaagatgctcgacgatctcggtgttccgtctaagaacttgatgttcgataacttcggtggataa

SEQ ID NO: 2185 - DNA, 456 bp, B.fragilis
aaaaagatagatagaatggcatttgaagcaacaaaaagagagtggagcgagttgtacgtctttttccgtctgctggcggatggaaaagtatcgcttggaactccgcaggcaaagaaagaagatgaaaagtaccggcccattgcaatgatccagcgtgaagagcatgatggcacccggcgttactatattgaagaagaggtcatccggatggaaggtgagaaggtggagaaaagtattccccgtgaggactttgcaacagtggcggacctgattctggacgcgattaaaaattcttcggcggatgaagttacgtcacccgacggggtggaggagttcctggacgaggcaggtatctttgatctggaagcccggacggaggaccgtaccgacttctcgattgctttctggcatcctgaggctccgttggcgggttgtcttcgccacgggccaggggag

SEQ ID NO: 2186 - DNA, 1416 bp, B.fragilis
tccttcggagatcatcataaaagaaactgctttcgggttgtccggaagcagtttttttttatctttgtgtcattattcaaaaatgtggaaaaaacaatgaatggtttgaaggatatactcgaaaggttgaaaatagaacaactcaatccgatgcaggaagcgtctgttgaggcatttgataaaggtggcgaagatttgatattactttcgcccacaggttcgggcaagaccctggcctttctgttgccgctggtcggcagtctgaaggccgacgtgaaaggagtgcaggccgtggtgctggtgccatcacgtgagttggcattgcagatagagcaagtgttcaaggcgatggggacggaattcaaggcgatgagttgctatggcggacgtccggcgatggaagagcaccgtacgatgaaaggaatgcagccggcggttatcatcggtacgcccggccgtatgaatgaccatctctccaagcagaacttcgatgcaagcacagtgagtctgttggtgatcgatgaatttgataaatgcctggagtttggttttcaggaagagatggcaacggttatcggacagttgcccgacttgaaacggcgttttctgacttcggcaacagatgcggaagagattccgcaatttacaggactgaaccgtacgataaagcttgatttcctgacaaacgatgtggaggaatcacgtttgcggttgatgaaggtggtttcgcctgctaaagataagatagaaaccctctataagctgctttgcacactgggaagcagttcgagcattgttttctgtaaccacagggatgcggtggaccgtgtgagtgccttactaacggaaaaaggagtttccaatgaacgctttcatggaggtatggagcaaccggatcgggaacgggcactgtataagttccgtaatggcagctgtccggtgctggtgtctacggacctggctgcccgcggacttgatatcccggaggtggagcatatcatccattatcatttgccggtgaacgaagaagcctttacccaccgcaatggccgtactgcccgttgggatgcgacgggtacttcttatctgatactgaatccggaggaacatgtgccggattatataccttcggagcttgagatcttcgacttgccggagaatacaccccgtccggctaaacctcagtgggtgactatttatataggtaaagggaagaaggacaaattgagcaagatcgacatagccggtttcctttataaaaaaggaaatctggcacgtgaggatgtcggagcaatcgacgtgaaagatcattatgcctttgttgccgtgcggcgccccaagatgaagcaattgctgactctgatccgtggcgagaagatcaaagggatgaaaacggtgatcgaggaggcggattaa

SEQ ID NO: 2187 - DNA, 552 bp, B.fragilis
  unsure (421),(422),(491),(508),(510): Identity of nucleotide sequences at the above locations are unknown.
tatgggctatggcacacgtaccagtggcccgattccggctttttcaactttgattttcgaggtacaattactgggtatagcttgaaccatcaaaaaaagattccggatatcatgacagaagatacctataagaccatcactgaagtctcggagggaacatataccgagaaacgaagcaaatttattgccatcgctctcccggttcgtaccttggaagagattaaagtgcatctggaggcgtaccagaagaaatactatgatgcccgccacgtctgctatgcctatatgctgggacacgagcggaagaattttcgtgccaacgataacggagagccgtcgggtactgccggcaaaccgattctgggacagatcaactcgaccgaattgacggatatactgattatgtgggttcgttattcgnnagggatcaagttgggcactagtggactgattgtggcctatagggccgccgcgcgaggcccatcgctgcntgcaccatgggagagananctgtggacgaggaagtacccgtacttttcgagtatcctttaa

SEQ ID NO: 2188 - DNA, 645 bp, B.fragilis
gaaagtaaaagaaaaattatggaacaattattaagtttattcgtccgctccatctttgtggacaacatgatattcgccttcttcctgggtatgtgttcatatctggctgtgtcgaagaatgtgaaaactgctgtaggactgggtatcgccgtaactttcgtattggtggttacgttgccggtcaactacttgcttcaaactaaggtgctggctgccaatgcgatcattgaaggtgttgacctcagcttcctgagttttattctctttattggccgtatggccggattcggccaattggtagaaatggtggtggaacgcttcagcccttcgctctacgcttcactgggtatcttccttccgctgatcgccgttaactgtgccatcatgggtgcttcactgttcatgcagcagagaatcacgatggatccgtcgaacccgcaggctattaccggcgtgggcagtgctgtagtatacgcactcggttccggtattggctggttgctggctatcgtcggtctggccgctatccgcgaaaagatggcttactctgatgttcccgctccgctgaaaggtctgggcattacgtttatcacagtaggactgatggctatggcctttatgtgtttctctggattgaaattataa

SEQ ID NO: 2189 - DNA, 255 bp, B.fragilis
  unsure (1),(2): Identity of nucleotide sequences at the above locations are unknown.
nnattgcgcggtcccttccagccccgtggtgaagacggtgctgagatcgcgggtgctgctttccagaatgaattctctggcaagaaggtattgaaagacggacaggttgcactggctgtagagaaaaacggtaaggtgacagaccctgcttatcaggttgacggtatttcgggtggtacaatcacttcgaaaggtgtggacgccatgatcaaagcatgtctgagccagtacgataaatttttaactaataattaa

SEQ ID NO: 2190 - DNA, 1098 bp, B.fragilis
cgaaattgtataaccaaaaacactcatcaaatgaaaaagcataatttcagtgcaggcccttccattctccctcgcgaagtaatagaagaaacagcgaaagccattctcgatttcaacggttcaggtctttctgtgttggaagtcagccatcgtggcaaggattttcaggcagttatggatgaagccgttgctttgtttaaggaaatacttaacatccccgaagggtattcggtacttttcctgggcggtggtgccagtatgcagttctgcatggtgccttacaacttccttgagaagaaggcagcttacctgaacaccggtgtttgggctaaaaaagcgatgaaagaggcgaaaggctttggcgaagtggttgaggtagcttcttcggctgatgcgaactatacgtttatccctaaagactttaccatacctgctgatgctgattatttccatgtgaccaccaacaatacgatttatggtacggaattgaagggagatcttgattcaccggttccgatggtagccgacatgtcttctgatatcttctcccgtccggtggacgtttcgaagtatatttgtatctacggcggtgctcagaagaatctggctccctccggcgttacattcgtcatagtaaaagacgatgcggtaggcaaggtgtcacgttacatcccgagcatgctgaattataagacccatatcgacggcggttccatgttcaacacacctcccgtattgcctatctattccgccatgcagactttgcgctggatcaaggctcagggtggcgtcaaagagatggatcgtcgggctaccgagaaggcagacatgctgtatgccgagatagaccgcaacaagatgtttgtagggacagctgctaaggaggaccgttcgcgcatgaatatctgctttgtgatggcaccggaatataaggatctggaagccgatttcctgaagttcgctacggataaaggaatgtccggcatcaaagggcaccgctcggtgggtggcttccgtgcatcttgctacaatgcaatgccgaaagagagcgtacaggcattgattgactgcatgcaggaatttgagaaacttcattaa

SEQ ID NO: 2191 - DNA, 984 bp, B.fragilis
atgacggcatttggtgtctgcggtatcctctgtggtgaattctcccaaaatagaataagagaaatgaaaatacttgttgcaaccgaaaagccatttgccaagattgcggtggatggcatcaagaaagaaatagaaggagccggatttgaattggctctgcttgagaaatatacagataaagcccaactgcttgacgcagtgaaagatgcgaatgccattattatccgtagtgacatcatcgacgccgaggtgctcgatgcagcgaaagaattgaaaatagtagttcgtgccggtgccggatacgataatgtagacctgaatgcagctactgcacacggtgtatgtgtgatgaatactccgggacagaactcgaatgctgtagccgagttggtgtttggcctgcttgtttatgctgtccgtaacttctataacggaacatcgggtacggagttgatgggaaagaaactgggtatccacgcatacggtaatgtaggacgcaatgtggcgcgtattgccaaggggttcggtatggaactctatgcttatgacgctttctgcccgaaagatgtgatagagaaagatggggtgaaagccgtagactctgccgaagagctttataagacctgtaacatcgtctcactgcacattcccgctacagccgaaacgaaaaattccatcaatcatgatctgctggccaatatgccgaaaggggctatcctggttaatacggcccgcaaagaagtgatcaatgaagacgaattgatccagttgatggaggaacggccggactttaaatacatcacagacatcatgcctgcggccaatacgaagttcgccgaactctttgccggacgttatttctcgactccgaagaagatgggagcacagacggccgaggcgaatatcaatgccggtattgcagctgcacggcagattgtgggtttcctgaaagagggttgtgaaaagtttagagtgaataagtaa

SEQ ID NO: 2192 - DNA, 333 bp, B.fragilis
attgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 2193 - DNA, 261 bp, B.fragilis
atagtaactttatgtgttttaacctttaaacttttgtatcaaatggataaaaatgaaatcggcttgaatgccggaaaagtttggcaattgttgagtaacaatgacaaatggagttatggtaacttgaaaaagaaatccggactgaaggacaaggatttgggggcagctctgggttggttggccagagaagataagattgagtttgaacaggaagaggaagaactctatgtttacctctgtgtaaatgtttatattgggtag

SEQ ID NO: 2194 - DNA, 186 bp, B.fragilis
atttatgaacccttttctcccggcaagctggcaaataaagaatgggacggacgatcggatggagaaatatgcagaaagctggaggaaaaaaaaggagatattgcaggacacaacaggaatgcccttcccggtagtcggcgaacttatcctgacacgttcctatccgttcctagccaaaacacttga

SEQ ID NO: 2195 - DNA, 811 bp, B.fragilis
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaac

SEQ ID NO: 2196 - DNA, 528 bp, B.fragilis
ttctatttctatgtgttctcctttggggggacatcggttgttgatgcccagactaagggaatcgttgtcgatggtgtgaagggccggtctttatccgatgtgaatatttacttgcagaaagattccgttgaaatcggatcgacagaccgaaatggagaatttatgtttagccgtgatcagataacgataagtgataccattgtcttttcgcatgtcggttactttccgttgaagtgtacattatccgaattacagcatcttggatataaagtggttctacatgagcatccccaattgctgcatgaggtagtggttagtggagagcgtccaccattcttcctggaatggacttcactgtctcctttacccaaacctttatactctttcggaggatttctgcatgcaggaaaaatttatgtggttgccggtgacgaaacactggtccgaatggttactgataaacacaggcggtcgacttcacttctttcatttacgatgactgcttgtatgcgatgggaggagctataa

SEQ ID NO: 2197 - DNA, 348 bp, B.fragilis
tcagttaaatatgcgatggttaaagtaatattgtttccgagccttctattttgttttattattgatgcgcactcttattttaacactatttaccgtaatcaatatattaataagagggggaatgaaaagaaaacagagcggcccaatacccttgatccgttaaggattaatctgacttacgtcaatggcaattacatctcgatgaggagctacatatatcccttgacagttacacccacccactatgtaaagcgtattcctccagtagaaaagtcctgcattttccacatccaaagcagccagttcgtatatgcgcattgtatctgtttcaatatggtagacctgtaa

SEQ ID NO: 2198 - DNA, 252 bp, B.fragilis; identical to SEQ ID NO: 860

SEQ ID NO: 2199 - DNA, 342 bp, B.fragilis
ataaagttaaattatagtgttgcggaattaaggtttattaaaacttttccgggatattattatttgcagtatacatacaaggagcaagtcctgggtgaaatatggagtcggaaaacgaatcaaatcgtatcgagaagtatcttgacccgtcccaatcaatttacaacgctccgtggaatccggtttcgttttccttcgggtactgtcatcagattattaccagattatataagtggaaataaaattgctttctttattcctgcggatgaagctatgggtgaaattcccgggataaagataagggaggatgataatccgatattgatggtgatggagttgtag

SEQ ID NO: 2200 - DNA, 486 bp, B.fragilis
agaaaagtcgatagaagagataggagaggtgctgaaactttcgccgggaaatgtgaaggtaaagttgcatcgtacccgcaaaaagatttatgtattgatgaacggaaaggagtgatgatggaaacaaataagaagcatacggaaaatgcgttgaaacaggccctccaaaggaggcagcccggcagattgccgtccaattttaattatcggatgatggagcagatccgtctggaagcggaaaaacaacagaagcggaaggagagggtcatgctgtgcggcatgattgcgggtatattgctattgttgggagtgggagtatatacgcttgttttcaaattggaattcaatttcaaggagtacttgtccggtatggatttttctcatgctgattcttccctgttggctttctatagctatattgcaacgttggtcctgttgttgctcggattggattactggcttcgtaagaagaagtttcattcctga

SEQ ID NO: 2201 - DNA, 597 bp, B.fragilis
acctataaaagaacagacaaaatgaagattgtggcgtttaatggaagccctcgtaagggtggcaacacagagcttttaattaaagaagtttttaaaccgatacaggaagccggtatagagaccgaattagtacagttgggtgggaaactattgcgcggttgtgcctcatgttatacctgtttcaagacaaaggacgggaaatgtgcgattaagaccgatccaatgaatgagttcatccaaaaggcccaggaagcagacggtattattctggcttcgcctacttattacggcagtgtgagtgccgaaatgaaggcatttatggatcggttgggactgaccacgatcggtcagggacgtacactgacacgtaaggtgggggcggctgtaattagtgtccgtaggggcggtgctgtaacagtgtatgatgaactgaaccgttttatgctcggaagcggaatgattgttcccggatctacctactggaatttcggtattggtgaaatgccgggagaggtttttgatgacgcagaagggttgagaaacatgaaagacctgggagtgcagttggcatggcttctgaaggcgatacataattaa

SEQ ID NO: 2202 - DNA, 1020 bp, B.fragilis
cacactatgagaagttttgcctctgataataattcgggtgtgcatcctgccattatggaagccctgacacgggctaaccgggatcatgccttgggctatggcgacgatttgtggacagaagaagctgtccggaaaattaaagaaacgtttgtagccgattgtgagccactgtttgttttcaatggaacaggcagcaatgtcattgccctgcaattgatgactcgtccttacaactctatcctttgtgccgaaactgcgcacatttatgtggatgaatgtggctctccggtgaagatgaccggttgtcagatccgtcctatcgccactcccgacggaaaactgactccgcaactgatcacaccctatctgcatggctttgccgaccagcatcattcccagccgggggccatttatctttcggaatgtacggaactgggtactatttatacacccgacgaattgaaagccatcacttcgttggcccatcaatacggtatgtgggtacatatggacggtgcgcgcatcgccaatgcttgtgcttcgctggggctttcattgcgagcgctgactgtggattgtggtatcgatgtgcttagtttcggtggaaccaagaacgggctgatgatgggagagtgtgtgatcgtattcgatgattcgttgaagtcggaagcgcgtttcatacgcaagcaatcggctcagttggcatccaaaatgcgttatctatcctgtcagttcactgcctatctgacagacgaactgtggctgaaaaacgcaacccatgccaatgctatggcaaagcgtcttgccgatgccctggaacaggttcccggcgtacgtttcactcagaaggtggaaagcaaccagttgttcctgactatgccccgtgccgaaacagatcgcatgctgcaaacttatttcttctatttctggaatgaggaagccgacgaaatacgtctggtcacttcatttgatacaacggaagaagatatcgatacgtttatccgtatactgaaaaattag

SEQ ID NO: 2203 - DNA, 2211 bp, B.fragilis
acaacgtttggtccttccagccccgtggtgaagacaagcagctacatcacagcacagacagtgattgaaaatccccctttcgaaacacgtcagggaagtatacacaccatctcgaaaatagaactctcgccaacagaaacccgactgacgatacggactgtgttccgcccgcaatggtggaccagtctggacagcctgacttacatttacgctcccgaaagcaaaaagcaactgtatcccctgcgcatagaaggacgtaaatttggcgaacaggtgacgactcccgcctccggtatcatagaggacgattgtgtcatcacctatcctcccttgcccgaaggcactacccggatagactggatggacgacaacctgaattcggaaaccaatacttacggcatcttgctggtgaaacctcaggaaaccaaagaacaggcctccctccgcaagattcacggcaactggcagcaagccgatgcccaaaacggatgggacatcggaatttatgattcactagccattatggacaaccgtttctggaaatatgatctttgccggaaacagggaaaaaaattcaaactgaacttaaaagacgaaacaggcgaacagtgcctgcttgaaataacacaggaaaaagacggcaacctatgtatcggaaaaaacgggggaaaagccaataagtatatccgtgccgggcgtccacaaagaaattatgcggcaacaacagcagccacagccccacaaacagccttcttccggaaagacacggttcacatacgcggattcctggatggctacagtcccaaactgggattcactaccgtactgatttatacggacaatcacataactaatgaaggcactcccgccgtagtcaccatccatccggacggacgctttgaatcggacttcgtcgtcaattatcccggagtacatcacctctctatgggcaacaactggatgacgttctatatcaggccgggcgagacactgatgctttatatcaattgggaagaccatctggactatctacgccagaggagactgaaacctatgttgacagaaactctgtacatgggaccttcaagcagcataaatcaggaactgatgccttgtgaaccgctgttctcaaaagactatcacatcatacagaatgcatgcaaaacgctgacaccctctgaattcaaaacacagcaggaaccgatgtacaagttgtggatgcatcgggtcgactcgctggagcaatcgaaaacactacaacccgaagcgatgcaaatgctgaagaacgatgtgatgataaattacggcgcctggctcttggagtttatcctgatgagagacatggatgcccgtaaagatacgaccaacacgatattgaaaataaaggaaaccccggactattatgacttcctgaaagcaatgccgttgaatgatgtccgcagcatcggttgcaacaacttctccacctttatcaaccgcattgaatttatgaacccttttctcccggcaagctggcaaataaagaatgggacggacgatcggatggagaaatatgcagaaagctggaggaaaaaaaaggagatattgcaggacacaacaggaatgcccttcccggtagtcggcgaacttatcctgacacgttcctatccgttcctagccaaaacacttgagaacgagaagaaggcttttgccctgctggacacactgaagggatatctgcacgacccattcctggtagcagaagccgaacgtatgtaccgtcaggtttatcccgtacaggggaacaagccacaagaacttccggcaggaaaaggtacggacattatccgtaaactgacagcaccttatctgggaaaatttgtaattatcgacttttgggcaacgtcttgcggtccttgccgtgccagcatcgaacaacatgctgatttgagaaaagactaccgcaacagtcccgatatcaagtttatctttgtcaccagtaatcaggactcacctgaaaaagcttacgaaaactatgtggagaagcatctgaaagaggaaaccatcttccgccttccacaaagcgactataactatctgagggaactattccatttcaatggcattccccgttacgtattgttggatcgggacggcaaattgctggacgagaacttcccgatgtataatatcgaactgttcctgaaagaatctaagataaggaaggaataa

SEQ ID NO: 2204 - DNA, 561 bp, B.fragilis
ccggatatcatggtacagaacgacgaaacacaatatatagcacggatactggatggagatacagaatgtttttctgcatttctcgatcgttacagccgtccgctttatgtgctgattgtacaaatagtcggttgttccgaagatgcggaagagttggtccaggatgtattcctgaaagctttccggtgtctgggtagttatagaggggagtgccgtttctctacctggctttatcggattgcttataccacggccgtatctgccacacgcaagaaaaagcaggagttcctttatatagaagagaacacgatcaacaacgtgcccgatgaaaaagctgacgatatactttatcctactgatgatgaagagcggacagcgaggttgattcaggctatcgatttactgaatgtcgaggaaaaagccttgattacacttttctattatgaagaaaagtcgatagaagagataggagaggtgctgaaactttcgccgggaaatgtgaaggtaaagttgcatcgtacccgcaaaaagatttatgtattgatgaacggaaaggagtga

SEQ ID NO: 2205 - DNA, 441 bp, B.fragilis
aaacatacgatcatgatggattttattacagcccctttaattgtaggcatcattactttaggtatttacaaattgttcgaactctttgcgtgcagacgcgaacgcatcacgcttattgaaaagttaggagagaaaatgtctcaaaccgatcttgagctaaacggaaaaatctgtctgcccgactttaatcgtccccaactatcattcggagccctgaaaggcggttgcttattgctgggagtaggcttagggctactggtcggatttatcttgagctatgtcagtttttctccctacgatctcgacagactcgacagagggtatacccgcgagatggttggggtcatctacggttcgtgtacccttcttttcggaggagcaggattagtggcctctttcctgatagaacagaactttgcagcgaaaaagaaagagaaataa

SEQ ID NO: 2206 - DNA, 1806 bp, B.fragilis
atatacaactttttatcacaactacctgttattgcaacatcaaatcacctaaacttaacgataaatatggcaaagaaggtagcagaacagcttgtcgatacgctgattgaggcaggcgtcagaagaatttatgcagtgacaggcgacagcctgaacgaagtaaacgaggccgtgaggcaaaatgaggtaatgaagtggattcatgtccgccacgaagaaaccggtgcgtatgccgcaggtgcagaagcgcaactgaccggactaccgggatgttgtgcgggtagcagtggtccggggcatgtccacttaattaacggactttacgatgcgcatcgctcgggagcacctgtgatagccatcgcttccactattccgacaggagagttcggaaccgaatatttccaggaaaccaataccgtcaagctattcaacgattgtagcttttacaatgaagtggctactactcccgagcagtttccccgtatgctgcaatcggccctccagacggcaaccacccggaaaggagtagccgtagtcggacttcccggcgacctggcaaagaaaccggcagtcaaggtagagtcctcggaacagatttatccgcttgcctcgtctgtctgtccggcagaagaagacctgatacggctggcagggatgctcaatcattacgaacgtatcactttgttttgcggcataggctgcaaaggggcacatgaagaaatcatccggatgtctgaaaccttaaatgctcctgtagcatacacttttaaaggaaaaatggaagtacaatatgacaatccctatgaagtagggatgaccggcctgctgggcatgccctcgggctattacagcatgcatgaagcggaagtacttgtcatgttgggcaccgatttcccttactctgcttttctacccgacgatatcaaaatcgttcaggtagacattaagcccgaaagactgggacgacgcgccaaagtggatctcgggctttgcggagatgtacgttctacactccgtgccctactgcctatgttgcaacaaaagaagaatgactctttcttacggaaacaactgaaacgttatgaaggggttaagaaggacctggcggcatatacggaagacaaaggcaaaatggaccagatccatccggaatatgtaatgtccgaaattaataatatttcctccgacgacgccatctatacggtagatacgggcatgacgtgtgtatggggtgcccgctatctgcaggcaaccggaaaacgtcacatgctgggatccttcaatcatggttctatggcaaacgcattgccacaggccatcggagcggcattggcttgtccggacaggcaagtgatcgcactttgtggtgacggaggactgtccatgacattgggtgacctggaaacagtagtgcaatataaacttcccataaaaatcatcgtattcaataaccgttcgctaggtatggtaaaactggaaatggaagtagacggattgccggactggcagaccgatatgctaaatccgaatttcgcacaagtagccgaagcaatggggatgacagggttcaacgtatcagatccggaagaagtattaaatacattatgtaacgctttcgagctggaaggtccagtattaataaatgtcatgactgatccgaatgctttggctatgcctccgaaaatcgaattggggcagatggtaggctttgcccagtctatgtataaactgctgatcaatggtcggtcacaagaagttatcgatacgattaattcgaatttcaaacatatcagagaggtattttaa

SEQ ID NO: 2207 - DNA, 270 bp, B.fragilis
ttgtgtgacttgaaagacggggtttcctatcccgggctggcttctgatggcagctatatttatatttttgagaatcgcaacttacaggtctaccatattgaaacagatacaatgcgcatatacgaactggctgctttggatgtggaaaatgcaggacttttctactggaggaatacgctttacatagtgggtgggtgtaactgtcaagggatatatgtagctcctcatcgagatgtaattgccattgacgtaagtcagattaatccttaa

SEQ ID NO: 2208 - DNA, 273 bp, B.fragilis
acacaggcggtcgacttcacttctttcatttacgatgactgcttgtatgcgatgggaggagctataagggaaaaagcttattctaataaaaaacacacgcttgatttgaaacgaggtgtctggtatgaattggaaggtactcttcctgccgggcggtgcggcagaatgaatggcatcctggtgggagataaggtgtatttctggggtggttatcatacagcacctatgtggacagcagcgagctacgatttgcggacgggagaatggcggtga

SEQ ID NO: 2209 - DNA, 213 bp, B.fragilis
tccagtacgtccggagtcacttgctgtgaagcgtcgctccatgcacagtccgggttgcaatggctttctacaatcaatccgtcaaagttcaggtccatagcctgctggcagagaggagctaccagttcgcgctttccgccgatgtggctcgggtcgcagaagataggcagttcgggtatgcggcggcgcaattcgataggaatgtgccattga

SEQ ID NO: 2210 - DNA, 1296 bp, B.fragilis; identical to SEQ ID NO: 845

SEQ ID NO: 2211 - DNA, 789 bp, B.fragilis
caaatcattcatattatgcgaattctaattttgggagccggcaagatgggctccttctttactgacatactaagtttccagcacgagacggccgtgttcgacgtcaacccgcatcagcttcggtttgtatacaacacctaccgcttcaccactctggaggagatcaaggagttcgaaccggaactggtgatcaatgctgccacggtgaaatacacgctggacgctttccgcaaaattctgccggttttgcccaaagactgtatcctgagtgatatcgcttcggtaaaaaccggattgaagaagttctacgaagaaagcggattccgttatgtctccactcacccgatgtttggccctacttttgccagcctgagcaatctgagcagcgaaagcgccatcatcatcagtgagagtgatcatttggggaaagtattctttaaagacttatacaatagcctgaacctgaacatcttcgaatatactttcgacgagcatgatgaaacagtggcttactccctgtccatcccgtttgtttcgacatttgtttttgcagctgtcatgaagcaccaggaagctccgggaaccacattcaaaaagcacatggccattgccaaagggctgctgagcgaagatgactacttattgcaggaaatcctgttcaatccgcgcacaccgtcacaagtggagaatatccgcacagagctgaaacaactgcttgagatcatcaccaacaaagatgcggagggaatgaaaaagtacctgacgaagatacgagagaaaattaaatga

SEQ ID NO: 2212 - DNA, 1191 bp, B.fragilis
gcgaatatgcagaaggaaaatcaaacgtataaggtagcgccggccgacagactggccggtgtaagcgaatactacttttcgaagaaactgaaagaagtggcacggatgaacgcagaaggtaaagatgtaatcagcctgggaatcggaagcccggacatgcctccttcggaacagaccatcgaaacgctatgtaataatgcccacgatccgaacggacacggttatcaaccgtatgtgggtataccggaacttcgcaagggttttgccgactggtataaacgctggtatggagtggaactgaatccggcaacagaaattcagccgctgatcggatcaaaagaaggcatcttgcacgtgacactcgcttttgtcaatccgggagaacaggtactggtgcccaatccgggatatcccacctacacttcgttaagcaaaatactgggtgccgaggtggtgaactataacctgaaagaggaagacggatggatgccggacttcgatgaactggaaaagatggatctgagccgcgtgaaactgatgtggaccaactatccgaacatgcctaccggtgccaacgctactccggaactgtacaaacgcctggtggagtttgcccgccgcaagaacatcgtgattgtgaacgacaatccgtacagctttatcctgaacgataagccgatcagtatcctgagtgtgccgggtgccaaagaatgctgtatagaattcaactccatgagtaaaagtcacaatatgccgggatggcgtatcggcatgctggcttcgaacgcagagttcgtacaatggattctgaaagtgaaaagcaacatcgacagcggaatgttccgtgccatgcaactggcagctgccaaagcacttgaagcggattcgacctggtacgaaggcaacaatgtaaactatcggaaccgtcgtcacctggccggcgagattatgaaaacgctgggatgcacgtacgacgaaaagcaggtgggcatgtttctctggggaaaaatccccgcaagttgcgccgatgtagaagaactgacagagaaagtgctgcaggaagcacgcgtcttcatcactccgggatttattttcggaagcaacggagcaagatacatccgcatctccctctgctgcaaagacgccaagctggcagaagcactggaaagaatcaaattaataatgaaataa

SEQ ID NO: 2213 - DNA, 252 bp, B.fragilis; identical to SEQ ID NO: 860

SEQ ID NO: 2214 - DNA, 921 bp, B.fragilis
ttaaataataaaatgaaacattatcaacgtttggaaggaatggttgccgccacttttactcctatggatgcgcggggagatatcaatctttctgttatagacaaatacgccgacctgatggctgaatcaggaatggcaggtgtatttgtttgtggaaccacaggagaatctcattcactgactacgggtgagcgtaaagctattctcgctcagtggataaagtctgcccggaaacgcttcaaggtgattgcgcatgtgggtagtaactgccaattggaagctatggagctggctcggcatgcacaagaggtggaagctgatgcttttgccgctatggctccctgtttttttaaaccctcttcggtaaaggatctggtggacttttttactccaattgctcaaagtgctcccgatcttcctttctattattataatatgccgtctatgacgggagtatctctttcggttccctcttttcttatagagggaaagaaaacgatgcctaatctggttggaacaaaattcacacacaataacctgatggagatgggtgaatgtttggaactcaataatggagaattcgaggtgctgcatggatacgatgaaattctgattgccggattggctttaggagccgttgccggtgttggtagtacctacaattatttacctgctgtatatcagaatctttttgatgcgttcaagaaaggtgatatctgtactgctcgccggatgcagcagaagtcgattgaaatagtaaaaataataattaaatacggaggaggtgtacgtggaggaaaagcaataatgaatttaataggtgttgattgcggccggtgtcgtctgcccgtcacaccatttggcgatgatgaatattcttcgctcaaaagagatcttgaaaaaataggtttcttgaattaa

SEQ ID NO: 2215 - DNA, 498 bp, B.fragilis
ataaagttaaattatagtgttgcggaattaaaggaatcttataaatttatgaagaaactgggtttacttttgttcttgtttgtttgtgctgcggttgtccgggctcaaagcaatatcgtgaaaagtctggaacgtaatgtaccggggcaagggaaagtaactattcatcaggattcccgcatcgaagctttgctgggaactgcccgcaccggcacaggagagcagactgttataaagtcgtccggttatcgggtgcaggcttatgccggtaataatacccgccaggccaagaatgaagcccatcaggtaggtacccgtgtcaaggagtactttcccgaactttcggtttatacttctttcaatcctccccggtggttgtgtagagtcggtgattttcgcagcatcgaagaagctgatgccatgatgcgtaagctgaaagcaaccggtgtgtttaaagaagtctctattgttaaagatcaaattaatattcctctgtaa

SEQ ID NO: 2216 - DNA, 3309 bp, B.fragilis
aagcatacaaagatgagaaaaattactcgaattaagtgtctcattgttgttttattgacatttattgggacattagcacccgttcatgctcaacaaagtggcaattttgagattagtggtgttgttaaggacacatccggagaaccggtcataggtgctacagttattgtaaagaacacacaaataggtacaactaccgatgtcgatggaaaatttaaattgaaggttccacataaatctttgttacaaatctcctttattggaatgaaaaccaaggatctgaaagtaaccaataatacattttatgaaattactttggaagatgaatcggttctacttgacgaggtcgtagccatcggttatggaactcaatctaaggcaaccgttacttcaggagttgtatctgtgaagaaagcggagttaatgtcttctgtctctgcatctcctttgaacaatctacagggaaaggttgctggactggatattcgacagactaccggacagcccggtgcacagccggtagtgctgatccgtggcgggtcaaccgatccggctaacgactctcctctttttgtcattgatggggttgtccgtagcaacatgaatggactcaatcaggaagatattgagtctatggaagtactgaaagatgccgcttccgctgcaatttatggtgctaaggccgccaatggtatcattcttattactaccaagcaaggctcttcaaaagatggtaaagccactatttccgcttcctaccgtttgggagttgagcagattcggcagcattatccgttttccggtgcacgcgactatctgtatgcttcccgtttagccggttcccgtggaatcaatgacgccaatgtcagcggacgcctggaaggcggcgcatatccttattcaacaggtaatatcaattataaaaatggagccttggaaggatatggctattctcgtttcactaccgaatatttagatgatttgatttccaatatgggacagtcttatgtcgatgatttgctgaacagacaaggatatgaaacgatgaccgatccttattcgggaaaacagttgatatttaaagacaatcactatcaaaaagatgtattgtttcagactgcattgacacacaactacgatctgagtgcttccggcggaaatgacaaaggtaattattatgtgagtttggggtatattaattccgaaggtattgttctgggtacgggatacgatcgtttcagccttactgccaatggaaattacaatcttcgcagtaatttaaaattaaccgtcggattgaaacattccacaatttcgaataaagcgactgatccggagaactcgggcacaagcacaatggaccgttcttctcgctatcctacgaccttccgtctgtattatgacgatggaactcccggtattggtgaagccggaggctcaccccggaatagactgcacgaattatattatcaggatatttcggacaaagtttatcgaaacacgattcagttaggattggattgggagattctgaaaggattgcattttaagccgtcagcctcctattatatgcaggaaaatatctatcgtttttttgagaagtataacgagtttaataaaggtcgtaagacactcgagaaacacgaccagtataagcaaatcatggcagacgcggtgtttacctatgataaagtattcagtgataaacacactcttaatgcaatgataggtatgaattatacccaggacgatacttataaattgaaaggaacaggctcggaagcccctacggattatgtacctacgttggcgcctaccaagcccgatttacagcgtaccacttcctctttggataaagaagtactggtaggtttctttgcccgtgtcaattatgactataagcgccgctatttgctgacggtttcagcacgctatgacggagcctcccaatttgccgaagatcataaattcgcattgtttccggccgtatccggaggatggaatatgcattatgaagactggtttcccaaaaccgttgtcagccggatgaaattgcgggcgagttggggacagaccggaaataataagttgtcgtattctaatacccaaggcgaatatgcttcatatatttatgccggaaatccgggggtactgaatagtgtacttgccaataacagtttggtatgggaaacaacctctaatgtggattatggttttgatgccggtttctttgataatcgtcttgaactgtcggtaaccggatataataaattgacttccgatcgtttgtatgacaaagctcttccggcacagacaggttttagttctataaaggccaatttggggactgtacagaacgaaggttttgagttatcgctgacagcacatcctctttcaacaacttcccccgtgagttgggatgttacgggtactttcagtatgaacaggacgtatatgaaaaagcttccttataatgggagagacaaaaatcgggtacagggcggacttgtatgggatgctaaatcgggtacttatgttgagaccggcggcctagccgaaggcgagaggataggcggacgttggggatataagtatctgggggtatacgatacagatgaagaagctgcaaaagctccggtcgacaccaaggtctccggttctaagatgaataagaaaaaggttgccggagatgctatctgggccgaccttgacaataatggagttatcgatgataaggatattacttttattggctgggccaatccggataagaagggagccttgattaataatttgtcttacaagaatttttctcttcgtttggttgtcgattttgctttaggacattccattgccaatatatggagatgccgtgccaatgcctatgcacgcaatgccattataccgactactgacgttacgaatgcaaacatctggtggcagacgggtgatgctgcaacagccaagtatccgcgttacgatgttgcttcggactgggataacggatatcgcaatcacatgcgtacaatagcttatgccggaatgaattcaaatggaaatgccgacaatacggcttattattcaaagggagattatttgtgcttccgtgaggtttcgttaggttatgaactgccgcgttccatatgttctaaaatgaaggtgaaaggggtgtctttgaatgccggtgtgacaaatatcggatacattacagcctttgacggattaaatcctgaacagtacgatggacaagagaccggtgaatactttctcccgattcaatttaactttggtgtaagactaactttttaa

SEQ ID NO: 2217 - DNA, 2052 bp, B.fragilis
ttatccaagaaatatcacgtacatttgcatccgcaaggagataaaacaatgatagatcaggcaaccatagaccgtatactcgatgccgcacaaatcgtagaagtggtttcggacttcgtcacgctgcgcaaacgcggtgtgaactacgtgggactttgccctttccataacgagaaaactccctcgttcagcgtgtctccctccaagggactttgcaagtgtttcagttgcggcaagggcggcaacgcggtgcacttcatcatggaacacgaacagatgtcctatcccgaggcactccgctacctggccaagaagtataacatagaaatcaaggaacgggagctgaccaatgaagagaaagaggtgcaaagcaaccgcgaaagtatgttcattgtcaacaacttcgcccgcgactactttcagaatatcctgaaaaaccatgtagacggacgcagcatcggactggcttatttccgccaacggggtttccgtgacgatattattgataagttccagttgggtttcagcaccgaggggcgcgatgcactggcacaggaggcattgcgcaaagggttcaaacaagagttcctggtaaagaccggactctgttatgaaacggacgaccataagttgcgcgaccgcttttggggacgtgtcatgtttcccgttcacacgctttcgggcaaagtggttgccttcggcggacgtgtgctcagcacggagaacaagaaacttgccaagtacgtcaactctcccgaatcggaaatctatcataaaagcaacgaactatacggcatctactttgccaagcaggccatcgtaaagcaggaccgctgcttccttgtggaaggatatacggacgttatatcaatgcaccagtcgggagtagagaatgtggtggcctcgtccggtacttctcttacaccggggcagatccggttgatccaccgtttcaccaacaacatcacggtgctttatgacggtgacatggcgggcatcaaagcttctatccgggggatcgacatgctgctcgaagagggaatgaatatcaaagtatgcctcttacccgacggagacgacccggactcttttgcacggaagcacaacgctacggagtttcagaacttcatacaggaacacgagacggactttatacgcttcaaggcacaactgctgatggaggatgccggcaaggacccgatgaaacgtgccgagctgatcaatgacatcgtgcgcagcattgcggtgattcccgaagccatcgtccgggatgtgtacatcaaggagtgcgggcagttgttgcggatagaagataagttactggtatccgaagtggccaagcgcagggaacttcaggccgagaaggggaataaacccatagcctccaataatgccccgacgccgcaaccgggcgaaatgcctcctcctttccctcccgaagaaatggaggcagacacctaccaatcgttcatcccgcaggaaggtaaagagggacaagagttttataaatacgagcgcctgattattcagatgattgtgcgctatggagagaaggtgatgtgtaacttaacggatgaagaaggcaacgaagtcccggtcaccgttgtcgagtatgtcatcaatgacctgaaggaggacgaactggctttccataatcccctccaccgcggtatcctctcggaggcctccgaacatatccacgaccaggagttcgcttccgaacgcttcttcgtggcgcaccccgatccgaaaatcagtacgatagccaccgaactggcgagtgaccggtatcaactgagcaagtatcactccaaaacacagaagttggtgacggatgaggaacggctgtacgagatggtcccgatgctgatgattaacttcaagaacgccattgtcgcagaagagctgaagcacatcatgtatgccctgcaagatccttcgattgcgaatgacaacgcccagtgcgacgctgtcatgcaacggtacaaggagatgaaggagatacagaatctgatggccaaacgactgggcgaccgggtggtgctgcgctga

SEQ ID NO: 2218 - DNA, 1605 bp, B.fragilis
aatataacagatatgaaattcgttaccttatcattgttagccactgcgttgactgttggcggaaatgccgccgagcaggcacgttcctccaagcagcccaatatcttatttattctggctgatgactttggctggagagatctggcatgtacgggcagccgttattatgaatcgcccaatatcgatggaatcgcccgtaatggcgtgaggtttacccaaggatatgcagcctgtcaggtgtccagtccttcccgtgccagcattatgacaggcaagtttaccgcccgccacggaataaccaattggatcggtgaaggaagtggagaagagtggcgcaagatgggaagacattccaagcttcttccggcccaatacgtatggcaattgcccaaagaagatattactctgcccgaagcattgaaagcccacggttataaaacgtttatggccggcaaatggcatttgggaggtgagggttcttatcccgaagatcatggtttcgatatcaatataggcgggcatgaagcgggaggtccttatcccggcggctattttgctccctatggcaatccgaaaatgaaagaaggaccggatggtgagaatttatccatgcgtctggcacacgagacagcgtcgtttatcgaaacccatacccgccggaataaaaagcagcctttctttgcttttctctctttctatgctgtgcatgcgccgattgagaccactgaagccaagtggaggcatttccggaataaagcggattcgatggggatcgctccgatggggtttgaagtagaccgtacattgcctgtacgtttgcagcaggataatcccatatatgccggactgatacagcagatggacgatgccgtgggagtggtgcttgccaaactgcatgagttgggtttggatgaaaatacgattatcgtgttcaccagtgataatggcggagtgtcttcgggcgatgcatacgctacctctaactaccctcttcgcggcggaaaagggcggcagtgggaaggtggaatacgcgtaccgttatttatcgattttccgggtaatactttaaagggagattcgtgcgtggtgcctgtcaccggtgccgatttgtatcctacttttctcgatatggcaggcatcccattaatgcccggccaacatcaggacggtgtaagcctgcttcctctgttacagggcaagagcatccccgagcgtgctttatactggcattatcctcattatggcaatcagggtggcgaaccttcttccatcatacggcaaggcgactggaagctgattcattattacgaagacggcagggatgaactttataatctgcggatagacgaaaccgagtcggaaccgctgaatgtgcaatatcccgaaaaggtggagttcttgagtaagaagctgtctgtatggctgactgaggtaggggccagatatcctgaacccgatcctcaatacaatccggcagcggaggctctctataagaaaaagactcgcgaaagaatgatgagaaccttggaagctacccgcaagaagcagttaggcaaagatttcaagcctaatgcagactggtgggggagcgaaacgaaagattaa

SEQ ID NO: 2219 - DNA, 1068 bp, B.fragilis
atcgatatggaactcgaatcaatcttattgccgggtgtggaagataaacgcccgatggtaatagccggtccttgcagcgccgaaacagaagagcaagtaatgtcaacagctacccaactggcagccaaaggagtaaaaatcttccgtgcgggaatctggaaaccgcgcaccaaaccgggaggtttcgaaggaatcggtgtggacggactggcctggctgaaagaggtgaaaaaagaaaccggcatgtacgtatctaccgaggtagccaccgccaaacatgtgtacgaatgcctgaaagccggtatcgacgtactctgggtaggagcacgtaccactgccaatccttttgccgtacaggaaatagccgatgcactgaagggagtagacattcctgtactggttaaaaacccggtaaacccggacctggaattatggatcggtgctttggaacgcatcaacaacgccggactgaaacgtctgggagccatccaccgcggattcagcagctacgacaagaagttataccgtaacttgcctcaatggcacattcctatcgaattgcgccgccgcatacccgaactgcctatcttctgcgacccgagccacatcggcggaaagcgcgaactggtagctcctctctgccagcaggctatggacctgaactttgacggattgattgtagaaagccattgcaacccggactgtgcatggagcgacgcttcacagcaagtgactccggacgtactggactatatcctcaacctgcttgtcatccgtaaagaaacgcagacaacggagaatctgaacgtattgcgcaagcagattgacgaatgtgatgacaacatcatacaggaattggcaaaacgtatgcgcgtagcacgcgaaatcggtacttacaaaaaggaacacgatatcacagtgcttcagaccggacgttataacgagattcttgaaaaacgaggtgctcagggcgaacagtgcggcatgagtgcagagtttgtgaaagtgatcttcgaagccatccacgaagaatcggttcgtcaacagatggagattatcaataaatag

SEQ ID NO: 2220 - DNA, 903 bp, B.fragilis
tatgaatcccgctccgacatggacgcgggatttttttataccatatactcaataggaatgaaaagaatagcaattcaaggaacactgggctcgtatcacgatatagccgcacacaagtacttcgaaggagaagagatagaattaatctgttgcgccaactttgaagatgtgtttgctgccatccggaaagatagtcagaccatcgggatgctggccattgaaaacacgattgcaggaagcctgctgcacaacaacgaattgttgcgccaaagcggcacacaaattatcggcgaatacaaattacgcatttcgcacagcttcgtttgcctgcccgaagaggactggaatgacattaccgaggtgaactctcacccgattgccctgatgcaatgccgggagttcctgaaccaacacccgcgtatcaaagtggtagaagccgaagatacggctttgagtgccgaaatcatcaaacgggaaaacttgaaagggcacgccgccatctgttcccgtgccgctgccgaacgctacggaatgaaggtactgcaggaaggcatcgaaaccaacaaacacaatttcacccgttttctggtagtggcagatccgtggcaggtggacgagatacgaaagcaaaacaccgttctcaacaaagcaaacatcgttttcactctcccccactccgaaggaagtctctcacaggttctgtctattctatctttttataatatcaacttaacaaaaatacaatcgctccctatcatcggacgggaatgggaataccagttttacgtagatgtagctttcaacgattacctgagatataaacaatcgattacagcaatcactccattgacgaaagaacttaaaatattaggcgaatatgcagaaggaaaatcaaacgtataa

SEQ ID NO: 2221 - DNA, 1566 bp, B.fragilis
ttagtttctggtaaagtgattgtttggagaggagcgttcgtcaagcgctcctcttttgaatggtcttataaaaaaaatggaaacatgaaaagactgattttaccaattgcatgtggcatttgcactgttacctctgatgcacagaccgacaaacaaccgcatcccaatgtgatcttcatttatgcagacgatttgggatataaggatttgagttgtaccggaagccgtttctatgaaactcctcatatcgacaagctggcaagagaaggagtttggtttactcaatcctatgccgcatgtccggtttcgtcgccgtcccgggctgctctgttgaccggtaaataccctgcccggatcaacctgaccgactatattcccggagaccgggcgtacgggcctcataagaatcagcggttggcttctttgccgttcaatctccatctgtcgaaagacgaaataacgatggccgaggccttcaggcagaacggatattctacctttatggcaggcaagtggcatctggccgagtctgccgaatactatcctgagcagaatgggtttgatattaatatcggaggaaataatacggggcatccctccaaaggatatttttcgccttatggtaatccacaactgaaagacggtcccgaaggagagtatctgacggatcgcctgactgatgaagtgatccgttatatctcggagcctaaggaaaagccgttctttgtctatctgtcctattatacggttcatctgcccttacaggcaaaagcggaaaagatagccaaataccggagaaggctgagccgggcggttcctgcggattcatcttttgtgaaaaaaggagagacgtatcataaacttgtgcaggacattccggcttatgccgcgatggtcgagagcctggacgaaaacataggacgcctgttagacaccctgcatcggtcgggactcgatgaacgcaccattgttgtgtttacgtccgataatgggggaatggccaccagcaatactactcgtaatatcccgacctccaatctgcctttgcgtgccggaaaaggatatttgtacgaaggaggcatcaaagtgcctgccatcatccggtggagtggacacctgaaaggaagacaggtttcggatactccgatcatcggtacggattattatccgactttgctcgatctttgcggattgcgtctactgcccggacaacacgtggacggagtttccatgaaacccgtcttacagggcggacggctgtccagaccttccttattctggcattatcctcattatagcggtggactgggtggtcggccttctgcggctatacgtgagggggattataagcttattgagttttttgaagaccatcacgtcgagttgtacaatgtgattcaggacgaatccgaagagaaagacctgtcacaaatataccctgagatagcagatggactaaggaagaaactatatttgtggtataaggaggtcggtgcccgaatgcctgttgataatccccactatgtttctcctgtgaaggattccgactcttttgaaaataaataa

SEQ ID NO: 2222 - DNA, 192 bp, B.fragilis
  unsure (169): Identity of nucleotide sequences at the above locations are unknown.
tttaactttatttataagttcctggaccaacaaaaagttgcccaggatttgccatgtcagaaatttcacttaatcttagtgttgcaaaaagaaaacaagcaaaactctaatatgacatggccaaaaatacaaattaaatctgagaaactcacaaccttttggagaattnttttcattcatggaagaaattga

SEQ ID NO: 2223 - DNA, 942 bp, B.fragilis
gaccgacttatgaaaatagaaaaagaaatattatatcgatattttaatggagacgctactccggaagaagagcataaaatccggcaatatcttgaagcttcggatgaaaactggaaagagtatttgcgtgagcgaaagtttttcgataccattatattgaaagaacaggttgtgtctgaggagaaacagatgaagcgcaggcagctgattcggaagataagtcttgaatgcctgaaggtggccgccgttttgttgattgcttttggaacggcatttttctggaacaatcagtccgagaagcccgcaactaaaagtgtggtaaatactttgaagggacaaatggccaatataaccttgcccgacggaagccgggtgtggcttaactcgaatacgagaattgagtattcgcagcattttgatgataaaagggaagtgcagattgacggagaggcttatttcgaagtcgtacggaataccggaagaccttttattgtttatactccggatgacgaacaggtagaggtactgggtactaaattttatgtagaagcatactcaggtacaaagaagtttgagactgcactgatagaaggcagtgttcgtgtcagggcagctaactcccagttcatattgcaaccctcttataaggcagtgctgaaaggaggcaagatgagtgtagagaagatcactgattttgatatttatcgttggcgtgagggactgatctgctttaaaaacagacatttttctgaaatactggaagagctcaaaaagtattatggagtccatatccggtttgacgcagctaaaataaataacccggtgctgactgttaagttccgcttgtctgacggcattgaatatgcgttgcgggttttgcagaaagatgtgaaatttaaatatgtgcggaatgatgaagaaaacacattcgttataaaataa

SEQ ID NO: 2224 - DNA, 300 bp, B.fragilis
atagttattattctgtataatatcaaaactccgagtttatcatctctggcggatcaggttcataaactcttcacgggtcttagcctgattaaaagctcctgtaaagtcggaagtagtagttacggaattctgtttttccactccgcgcatctgcatacacatatgcttggcttccaccacgaccattacgcccagcggattcaacgtttcctgaatacactctttaatttgcagcgtcatccgttcctgcacttgcagccgatgagagaaaatatcgaccacacgggctattttacttaa

SEQ ID NO: 2225 - DNA, 588 bp, B.fragilis
caaaattctatgtcagctactatcaatgatttagcttcatttaataagttctttaccgagaatcaacatcggtttatccgatttgcatggacttacacccgtgacgaagttgtggcggaagatattgttatggagtctctgatggcttattgggagaatcgggatcatatgactccggaaatcaatccggctgcctatgtacttactgtcgtaaaaaataaatgtctcaattatctgcgccatttacagttggttaatgacgtttctgaccgtgtcgcctcacattctgagtgggagttgtccaatcgtattgccacactggatgcctgtgaacccaatgcattgtttgccagtgaagtgcaggatattatcgatcgtgttatttcccgtttatctgctactaccgcccgaatttttcttttaagccgttacgacaacaagtcccataaagaaattgctgaaattatgggaatgaccgtgaagggagtcgagtttcatatctctaaggctaccaaagagttgcgtgttgctttaaaagattatcttgtcctttttcctttcttatgtgactttctgtcccgaaattaa

SEQ ID NO: 2226 - DNA, 3387 bp, B.fragilis
agcaaagatatgaaaaatactcgttgcacggatttttgtgtacctaaaaattcgtctatcaaacaattattaaaaactatgagagtcactatattcttacttttcttttgtgtgttcagcacaatcgcaggtactgtcaattctcaaaatgccagggtatcgatacataaaaccaatgtccctttggaagaaatacttaatgagatcgaacatcagacagattatttatttatgtattcgaataacattgatgtgaaagaacgtacttctatccgtgtttcggagaaaccggtctcggaagttttaaagaagttgcttggaaacaagattgcttatgagatggaaggcatgcacatcattctatcagataagagagagaatcaaactgcaattgcccagcaggcgaataagatccaggtgaaaggtaatgttacagatatggccggtgaacctgtcattggcgccagtatattggagaagggaactaccaatggtatcgtaaccgacttcaacggtgatttctccctgaatgtaaatcccggtgccgtgctggtggtttcgtatatcggttactctgcacaagaagtaaaagtcatccccgggaaggtgttgaaaataaagataaaagaagatgcggagttgttggatgaagttgttgtagtgggttatggaactcagaagaaagtgaatctgacaggtgctgtggagactgtcgatgcggatgtcatcgagaaccgtccgatacgcagcgcgaccgatgccctgcaaggcaccgtatccggattgacggtaacttcgggtacaggcaagcccggagagtttgcctcttttaagatacgaggcaacacttctgtgaacagtgccggcgcattggtgatcattgatggaatgccgggagatatcaatacggtaaacccacaggatattgaaacaatctcggttttgaaggatgccgcttctgccgctatctatggtgcaagggctgcggaaggagtcgtgcttgtcactactaagaaaggaacttcggagaaagtgaaagtagagtataccggaaacttctctttcaatactcctacacgtctgcccgaaagcaatacaggactggatcatgcattattatccaatgtcgcgtttaccaatgccggactggccattcctttttctcaaaaggcaatcgatgccattaaagatccgaatacgattgccatccccaacggtaaggagtggacatacacttcggatatggactggattgacctgatgatggaccatagtttccagcaaactcataatttaaccatttcgaaagcttctgatcgtttgaaataccttttctctatcggttggctcgatcagaacggaatgttctctgagtatgggccggacaattatgaccggattaatctccgttccaatatcagtgtcgagttgatcaaggacaaactgtcactggacagtcgcatcagctattcacgtggagtgaatctttatcatgctgccgagggttcctggtcgattccttatattacctttatacaagcgggtcccaatatgcctgtttatgatcccaacggaaattattcgcggcatcgtatgcaattgaatccgatacaggctctgaaggaaggtggcgaagggcgtactcgcaatcaacgtatcgagggagtatttactttagagtataaaccggtgaaaggtctttctctccgggccgtaggaggcgccaatattttggatggacagaagaaagaatggcgcagagcttacggaaaatatggagtggatggtttgatttcaacagcttttggccagaaaagcccgaactcggttacgcagaacaactcccatcgacaatatctgaccggacagttgattgccgaatacaaaggggtatttggaaaacatgatatcaatgtcctcggcggatggtcggccgaagaaaacctgtatgaagatcttcagggaaagcgtaccaatattgtcggcaatgaactgcctgcactgaatctgggagataccgacggatggtcgaacgccgctgatgaaaatgaatgggcgttgctctccggatttatgcgtgcaagctatgcttttgctgccaaatatctggtagaagtgaatttccgtgcggatgcttcttcccgtttctcatataaaaacaggtggggagtgttcccttcggcatctgtcggatggagaatcacagaagagaagtttatgcaaaatcagcacatctttgataatctgaaattgcgtgcttcgtggggacaattgggtaaccagaatggattggggctatacgaccacattgccagctataacatcaatggatattatccttttaagtcggaattgggacaatgggcggttatctcgaaattgccttcagagtccagaacctgggaaactgtagaggtgaaaaatattgctgtcgacatggcattcctcagaaaccgtttgactgtaacgggtgaatattttattaagaagaacaaagatatgttggtcagcatcgagatacccagtataataggtatcgatgtgcccacaggaaactacggagaacttaaagtaaaaggctgggaagttacggtcggatggcaggataagattaaggatttctcttacggagcccgttttaatttgtcggatcagaaagataagctggtggattatggtgtagaatacaatggttttgtggccggtgtcaatcagaaagtgcaggggtattccttggggtctatctttggataccgtacggacgggtattttacttctgaagaagaggtgaagaattcggctgccttcaataaggccattacaggtgtgggagatattaaatacatcgataaagacggcgacggaaagatttcggctcccaatgatctggaatatctgggaactacgactccccgttatacattcgggttgaatctgactgccgcatggaaaggattcgatctgggagtgttattgcagggggtaggcaaaagaaatttttatctgtcgagcgaagtgatgaacccgtactacgctacctggaataacttctcgtataaaatgcataatgactattggactccggagaatcccaatgccgcattcccccgctattacgccggtgccaatcataattaccagatatcggatcattggctgcagaatgccgcttatgttcgtttgaagaatctgcaattgggctatacgataagtccgaagcttactaagtcatgggggattcagcgtttgagagtctactttagcggtgataatctttgtgagtatagtaaactgaacgataatttcgatccggaactgtctgatattaacggatatgtatatcctattatgagaaacttttcttttggaatcaatgtgacactttaa

SEQ ID NO: 2227 - DNA, 1482 bp, B.fragilis
ctttttaaaatgattttcactatgaaagcaacaaaaatattgatctgtattctctgctgcacatggatttgcagttgtagcttgttggaggttgatccggtttctaccatcacttcacagtcgttctggaaaactccgggagatgccaaagcttatcttacgggcatttacaataaggtgcgtgacctgaataatacttcttattacggtgaagaccggggagatgcttttaaagccggtgagattggccctacgagtgtggcatgggcccatactttgcttgagagcaatgctccttcttatcgttcggcttataatatcattcatcacgccaatcttcttttcaataaaattgaaagtctgaagtttactaatgagactgagaagaatcgtataaaagctgagtgtcactttctaagagcatatacttattttcttatagtacgtatttggggagatgctcccatcattactgatcctgtgctttcggacaacgttgagcttaaaccccgttctcccaaagaagacgtcatgaagttgatccttgaagatatagaacaggctgtcctgttatttccggaggatggatatatcaataagaatttagcttcaaagccggctgcctatgctctgaaagccgatgttttaatgtggaaagcaaaggtcctgaatggtggaaatgcggatctggaagaagcgatcaaggcaatcgaccaggtaggcgggagtggagtgtctttgctaccggattatgcaaaggtatttgccaatgataataaaaagaataatgagatcattttctctttttattttgaacgctatgaaactggaaatctttctattgcaaccaacactacatcgagaaccgataatttatcgatggctgtcaacttggccgatgcggcaacttcacccaatcagagccgccatgtctatgccccaagtgacaaggccagagagttgtatcttaagtatccgggcgataggcgctataaagtcgccatgattgatttggtggataaagatggtaacctgattttaacccagacaaacaaattcagggggaaggcctattccgacgatcgttattttgacgatgacttgatagctcatcgttggggagatcttcttctgttgcgtgctgaggccaatgctgcactcaataagatatctgagtctcttgtcgatctgaatgaggttcgtgaccgggcgggcctggagccctatgatggtccgaaagataagattgctgtagagaaagaaatctgtgacgaacgtttaagagagctttttatagagcaaaaacgatggtttgatttggtgcgtttccattgtggcgggaccattgacatttataaggaggtgcccaatttgaatgacaaacccggttatccgttgtatttcccaatcaattataatgatatggtcttaaatgacaaactggtgcagacagatgggtacgaaagtaatgtagagagatag

SEQ ID NO: 2228 - DNA, 600 bp, B.fragilis
tattcctctgtaatcatgttagaaaaagaagaaatcatttctccagctttggaagatttaaagaatcactatcgcagtataattactttgttgggcgaagatgctgaacgggaaggattattaaaaactcccgaacgtgtagctaaagccatgttgaccttgaccaaaggctaccacatggacccgcatgaagttcttcgttctgccaagtttcaggaagaatacagtcagatggtgattgtgaaggatatagatttcttctcactttgcgaacaccacatgttgcctttctatggcaaagctcatgtagcttatatacctaacggatatatcaccggattaagtaaaatagcccgtgtggtcgatattttctctcatcggctgcaagtgcaggaacggatgacgctgcaaattaaagagtgtattcaggaaacgttgaatccgctgggcgtaatggtcgtggtggaagccaagcatatgtgtatgcagatgcgcggagtggaaaaacagaattccgtaactactacttccgactttacaggagcttttaatcaggctaagacccgtgaagagtttatgaacctgatccgccagagatga

SEQ ID NO: 2229 - DNA, 861 bp, B.fragilis
tatataggcttgtctttgttaatgtttgctaaatgggacgtttcagttcttaaaatgctagtttttctcctaaaaacttcttttatttgtcagacaaataagattaatcttattttaactaaactgaattgttatactatggatacattaaaactacatggtcaggcgataactttggtcgatcaggtcgaagataacctacttacttattttagaaccaaagatctgcgggcaggagatgccattcccaatgagatggaactggctgctgctttgggtgtggcacgtagtgtgctgagggaggccctcagccgattgaaaatggtagggatgatcgagacacgtaccaggcggggaatgattctgaccgaaccttctatccttggaggcatgaagcgggttgtcgatcctcgcattctgagtgagcattccctgtttgatcttttaggtttcaggattgctttggaattgggaatttgcagtgatcttttccagaatataactccggaagatattgttgaactgaaggagattgtccggttgggaatcgcttttgagaacaatgaatatgcccctatcagtgaatttacttttcatgctaaactttatgagataaccggtaatgccactatccgtgaatttcaggagatcatccatcccgtgatggtttttgtgaaagacaaattcaaagagttgctcgaacctattaatatagagataaaagagcggggagaattggtaactcacgctgaccttctcggctttttggaaaaacatgatgaggccggttatagaaaggcgcttgagaaacattttgccgtatacaagatttttatgaaacgtagaatcgttaacgaataa

SEQ ID NO: 2230 - DNA, 1629 bp, B.fragilis
cactttaattcttggagtaagatgaaaaatatatatctttttttgttaagcgtagtaattctttgcagctgtaacgatttcttggatcgtgaacctaaaacaaatttgtctcccggcagcttctggaagtcggaagaagatttaagattggcagcgaacgtgttttaccagaatatgaaccgttcttatacgctggataatcagagtgccgacggttttgccaatgtaggaaacctggtaagttccggaacacacgctccaggcaatactgatgggatatggaccacagcctataaacagatacgacatgctaataattttctggagaattatgagaaagctgaggtgagtgaggccacaaagaaccgttatgcaggtgaagcccgttttttcagggcatatttctatttcaatctggtgaagcggtttggagatgttccatacgtattgcgtacactcgatatggactcggaagagctgatgggaccgcgtgtacccaaagagcaagtgattgcaggcatcatagaagacctggagtttgccgaaacacatattccactgaaaagtaagttgcctacagatgtaggacgtttgactaaaggagccgctcaagccatgcttgcccgtgtggcgctttatatcggtacctggaataagtttcatggtagcggagagtataagagctatcttcaaatagctaaagaagccagcaagcgactgattgactctaaagaatattcgctgtacgccgattaccgtaatctgtttttgcttccgggcgaagattcgaatgaacatattctgtcatttcgttattctgccgaagccgatacgtacaatccccgtatccgtgctacaatagccgacttgtctcatagtccgacgaaggtattggctgatgcttttctttgcaaagacggacttcctcttgagaagtcggcctaccgggtggaatatcttcctgcaggaaaagagttcgagaatcgtgatcctcgcatggcattgactatctggaaacccggcgatccttttttaggcaaaccgtttgtgcctaatctcacgagccagacacgtaccggatatatgtttaagaagtatggcgacgaggagtcttactctaacatgaagtcgcggattgatgagattctgattcgttatgcagaagtattgctgacctttgccgaagccagtttcgaactggacgaccggatttccgatgaagacttgaacctctctgtcaatgcactccgtaatcgtttcgagggagatcctaaccggctgccggatctgaccaatgcttttgtagtagaacacgggttaagcatgcgtgatgagattcgccgtgagcgcagagtggagcttgccgccgaatcgttccgttatgacgatatcattcgttggaaaacggcagaaacggagttgcctgccgctatcttgggtgccaagttcgatccggaactctatccgtccacagttcccggtaaagatgtcattctggataagaacggtttcatattggtacagaatgccgaaagccgtacgtttgatagttcgaaagattatcttttccctttgccgctgcgcgaggtttcgctgaatccgaatttgaagcagaatcctaattggtaa

SEQ ID NO: 2231 - DNA, 402 bp, B.fragilis
actatttgtccctttaaagtttttcttttaactttgtccttgtataaaatcttggatatgagtatagaaagctttaatctgcttcttttagtaatgggcctgatggctttggtcgtattcatagccctttattttgtcagggcgggatatggcatgtttcgcagccgatcctggggaatctcggcgaataataagatagcctggattctgatggaagctcctgtttttctggttatgggatggtgtggtgggcattccgaccgacgttttttacctgtcgaactcactttctttctttttttccaactacattacttcccaaagggcttttgtttttcctttcctgatgaaaggaaagagcaagatgccggtactcattcttttgatgggagtgatctttaa

SEQ ID NO: 2232 - DNA, 606 bp, B.fragilis
aatacagtaactacaatggcaaaaggaaatagaacagttcctgagattaattcaagttcaacagcggatattgctttcttattgcttatcttcttcttgattacgacatctatggatactgaccgtggtctggcaagacagttgcccccacctcctgaaaaggatcaggttgataatgacgtagttgttaaggaccgtaacgttttgcagatttttctgaactttcagaatcagctgatgtgcggtggcgaaattgttgatgtgaagcaattgagagaaaaagccaaagagttcattgccaatccatataacgatgaaaaattaccggaaaaacacgctaaagatgtgcctttctttggtaatgtcatggttacggagaatcatgtaatctctttgcagagtgaccgtggatcttcttatcaggcctattttgatgttcagaatgagctggttgctgcttataacgagttaagagatgaattggctcaggaaaagtggcagaagaattatgctgatttaaatgaagatcagcagaaggctattcgtgatatttttcctcagaagatatctgaggctgaacctaaaggagtaaaaaagaataattaa

SEQ ID NO: 2233 - DNA, 552 bp, B.fragilis
tccgcacccgcacatcgctggaaaagttgcggtataatcccccatcggactatgagtagaatcagcattatcgccgccgtagacagccggatggctatcggctttcaaaataaacttttattctggctgcccaatgacctgaaacgtttcaaagcgttgaccacaggaaacacaatcatcatgggacgcaaaacgttcgaatcactcccgaaaggggcattacccaatcgccggaatgtggtcctttcttccaatccggcagccgaatgtccgggagcagaagtattcacttcgctggaagccgctttggaaagctgtcaagccgaagaaaaagtatacatcatcggaggggcaagcgtctatcgccaggccatatccctggccgacgagctgtgcctgaccgaagtaaatgatacagcgccggaagccgatgccttcttcccggctgtagacacaactatatggcacgaaaaaagcagagaagttcatcctgccgatgaaaaacatctctgctcgtatgcttttgtagattacgtacgggagatcgattaa

SEQ ID NO: 2234 - DNA, 1218 bp, B.fragilis
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgcaagtggatcatga

SEQ ID NO: 2235 - DNA, 876 bp, B.fragilis
aataaatcggcaatagttagtacctttgtaaaaacaataaattcacacgatatgaagctgatattaaccctattcacctgtcttttcgtgacaggatgtgcatacgcacaaaatttctcggactacttcacgaacaaaaccctacgcatcgattatctatttacggggaatgcggacaagcagtcgatctgtcttgacgaactttcggaactgcccgtatgggcaggcaggcgccatcatctgccggaattgcctttggaaggaaacggacagattgtgatgcgcgatgtggcaagtggaaaagtaatttatacgacttcgttttcttcgctcttccaggaatggctcgagacagatgaagccaaagaggtcaccaaaggatttgagaatacttatctcctcccctatcccataaagccggccgaggtagaaatcacattacgcaataacaaacgcgaagtcagtgccaacctgaagcacgtcgttaagcccgacgacattctgatacacaaaaaagggctcacacacatcactccgcacaagtatctgctgaaaagtggaaatgaagaacaatgtatcgatgtagccatcctggcagaagggtataccacaagtgaaatggaaactttctataaagatgccgccatcgcatgcgaagccctgttctcacacgaaccgtttcagtcgatgaagaatcgcttcaacatggtggttgtggccagtctttcggcagacagtggggtcagcgctcccaaacagggagcatggaagcactcggccttccggttcccacttcgatactttctattccgaccgctatctgactaccagccgggtaaaagcaataaacgacgcattggcaggcatcccttatga

SEQ ID NO: 2236 - DNA, 267 bp, B.fragilis
tctatgtcggcgggacttgtttcccgtgagaaaatagatgaagtgctgaacgaagggttcgaagccgtgcagatggcacgtgctttactcaacgaaccggggtttgtcaatcggatgcgtcgggaagagaaagcacgctgtaattgcggtcatagtaattattgcattgggaggatgtacacgatcgaaatggcttgccatcggcatctgacagaagaacttcctctttgcctgaaaaaagaaatagaacagttggagaataaatga

SEQ ID NO: 2237 - DNA, 399 bp, B.fragilis
tcccggtcggcacgttccagtgctttaatcagcatatacgtctttttattgcatagaatgtctccaccgatgtttttaccaaacacagcaggatcaccatatacatccagcaaatcatcctgcaattggaaggctactccgatctgcatgccaaaatcatacagattttcggcatcctcaggagaagctccacctaaaatagctccgattttcaaactggcagccaacaaaaccgccgttttcaaacggatcatttccagatactcctcttcctttacatcctcacgggactcaaaattcatatccatttgctgcccctcacaaatttcaagtgctgtcaggctgaacaaatccatcacttctttgaggtgttccgatgaactggcagccatatactga

SEQ ID NO: 2238 - DNA, 816 bp, B.fragilis
cccaagaagtataccattcgtatgaaacaatatttagacctgctcgaccgagtgttgacggagggaatagaaaaaggtgaccgcaccggaacgggaaccatcagtgtcttcggacaccagatgcgtttcaacctggacgagggattcccttgcctgactaccaagaaacttcatctgaaatcaatcatttacgaactactgtggttcctcaaaggagacacgaatgtgaaatatctgcaggaccacggcgtacgcatctggaacgaatgggcggacggaacaggagatctgggacatgtatatggataccagtggcgttcgtggccaacctacgacggaggatttatcgaccagatcagcgaagctgtagatgccatcaagcacaatcccgattcacgccgcatcattgtcagtgcatggaatgtaggagacctggatcacatgaacctccctccttgccacgcattcttccagttttacgtagcaaacggacggctgagcctgcaactctatcaacgcagcgccgatatcttcctgggggtacctttcaatatagcatcttatgcattgctgctgcagatgatggcgcaagtcaccggtctgcaggcaggagactttatccacacactgggcgacgcacatatctacctgaaccacctggaacaggtgaaactccagctcagccgggaaccgcgcccactaccacaaatgaagatcaatccggacgtgaaaaacatcttcgacttccaattcgaggactttgaattagtaaattatgatccgcacccgcacatcgctggaaaagttgcggtataa

SEQ ID NO: 2239 - DNA, 573 bp, B.fragilis
gcaatgggccaggagaatatgttaatttatcttcaggttgtatatcattcaaaagattccactattcgtatttttgataatggcagttataagcatattatttataataagcaggggaaatttctccgggagatcagtttggccgattccgagtttaattacttattgcacatgcagagcgatacttatttctttcgtggcagtttcagtaaaggcaaatcagaaattattgtgacggatacgacgctgcgggtgaagtttcccattttgccttttgattcgacggccgattatattacacggggagccattatgttgaataccactggagaagagtgcgcccctgacatttgtttgtttaatcacatttatagcgatagtgtttttctcctgactcctgatggattgaaacttgactttattctgcgtaagggcaaatatgcgccgtctttggaagatgtaaagcaattcatgaaatggaatcaatatgatccattcattaaaggattgtttatcctaaaatccgcaactatcatccaatacacgattaagggtagatttatgagtcgttag

SEQ ID NO: 2240 - DNA, 252 bp, B.fragilis; identical to SEQ ID NO: 860

SEQ ID NO: 2241 - DNA, 1581 bp, B.fragilis
tggaagctcctgtttttctggttatgggatggtgtggtgggcattccgaccgacgttttttacctgtcgaactcactttctttctttttttccaactacattacttcccaaagggcttttgtttttcctttcctgatgaaaggaaagagcaagatgccggtactcattcttttgatgggagtgatctttaatattctcaacggactgatgcagggagaatggatattctatcttgctccctcggactattatacacccggatggttgctgactccttgcttttggataggaactcttttattttttgccggaatggggatcaactggcattcggattcagtcatccgtcatctgcgtgctcccggagatacccgtcattaccttcctcaaagaggcatgtatcggtatgtgacctctgccaattatttgggtgaaattgtagagtgggtaggttgggctattctcacttggtctttgtccggatgtattttcgcctggtggactgttgccaatcttgttccgagagcagatgctatctggcatcgctatcgggaagagtttgggacgcagcgtcggattgaagaaacgaatttttcctttcttatattaaaatacacagtacttatgaacacacattctgcttctaagcttttcacgccggttaccatcggaccgctcactttgcgtaaccgtaccatccgttcggcggcttttgaaggcatgtgtccgggaaatgctccttcccccatgttactcgattaccatcgttctgtggccgccggaggcgtgggaatgactaccattgcctatgcttcggtaacacgcagcggactgtcgtttccacggcaattgtggcttcgtccggaaattattcccggtttgcgtgaagtgactgccgctattcatgccgaaggtgccgccgccagcatacagatagggcattgcggcaatatgtctcataagagtatttgcggagttaccccaatttctgcttcgtcaggtttcaatataaattcgcctacttgggtgcgggggatgaaacgcgaagagttgccggagatggcaaaagcttacgggcgtgctgtctgcctggctcgcgaagccggttttgatgccgtccaggtacatgcgggacacggctatctgatcagtcagtttctgtcgccttataccaatcaccggaaagatgaatacggaggatcgttggagaataggatgcgtttcatgacgatggtgatgaacgaggtgatgaaggcggccggtaaggatctggcagtatttgtgaagatgaatatgcgtgatggctttcggggcggaatggaaatagaagagacgctcgaggtagccaggcggctcgaatctttgggggctcatgcgttggttttgagcggaggatttgtcagtaaagcccctatgtacgtcatgcgtggggccatgcctatcaagaccctgacacattatatggattgttggtggttgaagttcggcgtcaaattggcggggaggatgatgataccgactgttcctttcaaagaagcctattttctggaagatgtctctgaagtttccttcggaaattaa

SEQ ID NO: 2242 - DNA, 846 bp, B.fragilis
ttaatcttaaaaattagacacacaatgaaaaagttatttgcaattgttgctgtgatgggagtcttaacatttggctcaactcaactcgttcaggctcaggatgctgctgctaccgaacaagctgctcctgcagcagacaaaccggttgctgatgctgtagctgaggctgctgaagcttctgctcctcttgctggcgctgaagaaggtggtatccacaaagaaattaaagtaaaattcatcgaaggtactgcatctttcatgagtttggttgctatcgcattggttattggtttggctttctgtattgaacgtatcatttacttgagcttggctgaaatcaacactaagaaatttatgtcttctatcgaagcagctctggaaaaaggtgatgttgaagctgcaaaagacatcgctcgtaacacaagaggtcctgttgcttctatctactatcagggtttgatgagaatcgaccagggtatcgatgttgttgaaaaatcagtagtatcttatggtggtgttcaggccggttaccttgaaaaaggatgttcttggatcacactgtttatcgcaatggctccgtcattaggattcttgggtactgtagtaggtatggttatggcgttcgataagattcagcagcagggtgatatctctccgacagttgttgccggtggtatgaaggttgccttgattactactatcttcggtttggttgtagctttgatccttcaggtattctataactacatccttgctaaaatcgaagctcttacaagcgaaatggaagattcttctatctctttgcttgacatggtaatcaaatataacttgaaatacaaaaaataa

SEQ ID NO: 2243 - DNA, 468 bp, B.fragilis
ttaatgggaaaatttaataaaacaggtaagcgcgggatgcctacgctgaatacttcttcactgcctgacttgatctttacattgttgttcttctttatgattgtaacaacaatgcgtgaagtttcattgaaggttgagtttaagattccgcaaggtactgagttggaaaagcttgaaaagaaatctttggttacgtttatctacgtaggtaaaccgacagcagaatttcgtaaaaaactggggtctgaaagccgtatccagttgaatgatgcttatgctgaagttgacgagattcaggcttacgtgactaacgagcgctcaagtatgaaagaggaagaccaaccctttatgactgtgtctttgaaaattgaccaggatactaagatgggtatcgttaccgatattaaacaggctcttcgtcaagcttatgcactgaaaattaactattctgcgagagctcgcgaataa

SEQ ID NO: 2244 - DNA, 720 bp, B.fragilis
aaaccagaagaacaccaatttttatatactaattttatggaagtaaaaaaatcgcccaaagcagacctcgaaggtaagaaaacccagtggctgctgatcggttacgtggtggtgctcgcctttatattcgttgcgttcgaatggacggagcgtgatataaagatcgatacaagccaggcggtagcccagattgagtttgaagaggaaatgattcctattacacaacaggaagaaaaaccggccccacctcctgtcgaggttcccaaacaggctgaaatcctgaagattgttgatgacgaggctgatgtacaagaaacagccattgcttcaacagaggataccggacagaaagtggaagtaaaatatgtaccggttgaggtaaaagaagaagaaccctcggaacaagagatttttgaagtagtagaaaatgcacctgaattcccgggtggtatgcctgcttgtctccagttcctgtacaagaatatcaaatatccgccgatcgctcaggaaaacggtactcagggacaggttgtcctccagttcgttgttgaacgtgacggtagcataggtgatattaaagttgtaaagagcgttgacccctaccttgataaagaagctcttcgtgtggttaagaccatgcctaagtggaagccgggtatgcagagaggtaaaccggttcgttgtcggtttacattacctgtacgattcagactgcaataa

SEQ ID NO: 2245 - DNA, 873 bp, B.fragilis
atgatggaacgtaaacttgctgttattaccggtgccgacggcgggatgggaacggagattacccgtgccgtggcttgtgcggggtatgatgtaattatggcctgctattcatcgtcaaaagctgaaaccaaatgccgggagttggtgaaagaaacgggaaatgaaaagatagaggtatggcagatcgaccttgcttcactgtcttcggtgagggcttttgccgaccggatgttacggcaaaagactcctgtcgctttgttgatgaataacgccgggaccatggaaaccggattgcacattacggaagatggtttagagcggacggtcagtgtaaattatgtaggtccttatcttttgacgcggcttttgcttcccttgatgggagagggaacccgcattgtcaatatggtgtcttgtacctatgcaatcggtaaactggatttcccggatttttttcttcgggggagaaagggaagtttctggcgtattcctatctatagcaataccaagcttgctttgttgctttttaccattgaactggctgaacgtcttcgggcacgcgggattactgtcaatgcggccgatccgggcattgtgtctaccaatatcatacggatggaccagtggttcgatccgctgacagacatttttttccgtccttttatacgtactcccctccagggagcagctactgcaatcggattattgctcgatgcggaagtggagggacggacggcaacgtttaatttgaataatcattgtcgtcttctaccggaaaaatatacccgtcctgaccgaagggcacagctatgggaagagacggaacggattttgtcggaaaagggcttcttgccgataaatgataaacggtga

SEQ ID NO: 2246 - DNA, 210 bp, B.fragilis
ctgaaaacgcttgtggttcgcattttttttgtaatttgcacccgatttgaagaaagcgccaattggagagatgctcgagtggttgaagaggcacgcctggaaagcgtgtatacgccaaaagtgtatcgcgggttcgaatcccgctctctccgcaggaagtataaacaagagacgataagtaaatacaataataataatttaattaattaa

SEQ ID NO: 2247 - DNA, 477 bp, B.fragilis
tctgagatgagtaagttaacatataaagtatcgtattacgtactgtacgcgatgtttgctcttatcgtgatcgtattgggtttgttctacttcggtggacaaatggaaactccaattgtatacgacatggataatcccgcaaacacagatgccttgctgtacttgatgtatggtctgtttggcattgctgtagttgcaactgtggttgctgctatcttccagttcggttctgctttgaaagataatcctaaaggtgctatcagatcattgctcggacttattcttctggttcttgtattggtcgtagcatggtctatgggtagtggtgaaacactgaccattcaaggatatgagggaactgataatgttcctttctggttaaaactgactgatatgttcctttatagtatctacttcttaatgttggtaacagttcttgctatcatcggaagtagtatcaaaaagaaattatcataa

SEQ ID NO: 2248 - DNA, 735 bp, B.fragilis
tgtaccgcgagatgtaatatcgagatgccctatagacgtttgccaaatacagatcaagccaggatacgggcgctgaaaacagcggtcgtgaagggcgatatgtgtgatgtctatgatttgcctgtttcactcaagacattgggagaagcccgtatatttctgtctaaatttgaaacggcgcattcttattatgtacactgttacggagagcaaagcaggaacagtaagaaacaccaggcgaatgtaaaaacggcccggctttatatttctcacttcatacaagtcttgaatttggctgtgattcgtatggaaatcaaagaatctcataaggctttgtatggcttgcccgtagataatttcagtgtacccgatttaagtagtgaagcgtctctggccgagtggggacaaaaaattatagaaggggagcggaaacgcacctctcaaggcggtattccgatttataaccccacgattgctaaagtgaaagtgcattatgatatattcatggaaggatatgaaaaacagaaaagccttcagtctctcaccaatcgtagtttagagcaacttgcatccatgcgtgtgcaagccgaccggttgattctggatatctggaatcaggtggaagccaaattccaggatgtatcgcccaatgagaaacgcttggaaaaatgtcgtgattatggtctgatttattattatcggaccggagaaaaacagaataaggagattctttaa

SEQ ID NO: 2249 - DNA, 1044 bp, B.fragilis
tataagaagagaggctgccgtccaagcagcctcttttcattcaatctctctttttataatttatttattatgtatacagcatttcagcttctcgataagatcaattctcacatttcagatatccggtttacacgtactccggcaggtttgtatgaccctattaaatatgttctttccatgggaggaaaacgtattcggccggttcttatgctaatggcatacaacctctacaaggaggatgtgtcctctatttatgaccctgctacggctattgaagtttatcataactatactcttttgcatgacgatttgatggatcgggctgatatgcgccgcggcaagacaactgtccataaagtatggaatgacaatactgcgattttgtcaggagacgctatgctggtgctggcctatcagtatatggctgccagttcatcggaacacctcaaagaagtgatggatttgttcagcctgacagcacttgaaatttgtgaggggcagcaaatggatatgaattttgagtcccgtgaggatgtaaaggaagaggagtatctggaaatgatccgtttgaaaacggcggttttgttggctgccagtttgaaaatcggagctattttaggtggagcttctcctgaggatgccgaaaatctgtatgattttggcatgcagatcggagtagccttccaattgcaggatgatttgctggatgtatatggtgatcctgctgtgtttggtaaaaacatcggtggagacattctatgcaataaaaagacgtatatgctgattaaagcactggaacgtgccgaccgggatcagttggagggattaaatcattggttgagtacaacttcattctgtcccgaagaaaaaatcagtgctgtgaccgaattgtacactcagattggcatcaaggctgtttgcgaaaacaagatgcgtgagtattacactcgtgcgatgacaagcctgggcgccgtgtctgtcattgaggataagaagagtgagctgaaaaagttgatgaagcatttaatgtaccgcgagatgtaa

SEQ ID NO: 2250 - DNA, 1374 bp, B.fragilis
aaaatagacggacgttcggacccgcgtgagacgaataaagaatatttgatttataaactctccgaggcaatgaaggattgtacccggattgataacgaattgtttccaaaatttgacgttaaacgggggcttcgcaatgaagacggtacaggtgtattggtcggattgactaagattggtaatgtcgtaggatacgaacgaatccccggaggtggtctgaagccgatcccgggaaagttattttaccgtggatatgacctagaagatttagcccacgccattttaaaagaaaaacgtttcggatttgaagaggtggcctacctgctgttatccggcagtttgcccgataaggaagaactggcttcgtttcgcgagctgatcaatgataatatgcctttggagcagaagaccaagatgaatatcatcgaacttgaaggaaacaatattatgaatattctggcgcgcagcgtactcgagatgtatcgtttcgatcctaatccggatgatacttcacgtgacaacctgatgcgtcagagcatcgatctgatctcgaaattcccgaccattattgcttatgcttttaacatgttgcgtcatgccaccttcgggcgttcgttacacattcgtcatccgcaggagaatctgtcgattgccgaaaactttctctatatgctgaaacgcgattataccgagctggatgcgcgtacactcgaccttttgttggtgcttcaggcagagcacggaggaggtaacaactctacgtttactgtccgggtaacttcgtctaccggtacagatacatactcggccattgccgcaggcatcgggtcgctgaaaggcccgcttcacggaggagccaatattcaggtagccgatatgttccatcatttacaggaaaatattcaggactggaccaatgtagacgaaatcgatacttactttacccgtatgttgaataaggaggtttacaataagaccggattgatatatggcatcgggcatgccgtatataccatttccgatccgcgagctgtgttgctgaaggaacttgcacgtgacttggcacacgagaaaggtcgtgaacgggagtttgcttttcttgaacttttggaagaacgtgctatcgctactttcggtaagattaagaataatgggaaaacagtatccagcaacgttgatttttattccggttttgtttatgagatgattggcctgccgcaggaaatctatacccccttgtttgccatggcgcgtatcgtgggttggtgtgcccatcgcaacgaagagttgaattttgaaggtaaacgtatcattcgtccggcttataaaaatgtgttggaagaagaacaatatgtaccgttaaagaaacggtaa

SEQ ID NO: 2251 - DNA, 483 bp, B.fragilis
tttaaaatgggacatcatcaattagatactttagacgagcagattctgaagttgattgccgacaacgcccgcattccgttcctggaagtggcaagagcgtgcaatgtttcgggtgcggctattcatcaacgcatacagaagttgactaatctgggtatattgaaaggttcggagtatgtcatcgacccggagaagatcgggtacgagacatgtgcttatattgggatttatctgaaagatcctgagtcgttcgattctgtaaccaaggctttggaagcaataccggaagtggtggaatgtcatttcactaccgggaaatatgatatgtttatcaagatatacgcaaggaacaatcaccatcttttgagtgtgattcatgataaactccagccgttgggattggctcgcaccgagacgctgatttcattccatgaagccatcaagcggcagatgccgattatggtagatacggacgaggattaa

SEQ ID NO: 2252 - DNA, 954 bp, B.fragilis
ggtgtagccatcctaaagaaagggtgtagccatccggtcagtatggctacaccctttcttaatcatacatttgtaatcattatggtaaaagtagaaatagatgaaggttccggtttttgctttggagtggtcacagctatccacaaagccgaagaggaactcgcaaaaggggtaacactctattgcctgggagacattgtacacaacagccgtgaagtggaacgcctgaaagagatggggctgattaccatcaatcatgaagagttcaaacaactccataacgccaaagtgcttttgcgtgcccatggcgaaccacccgaaacctatatcattgccaaagaaaataatatcgaaatcatcgatgccacgtgtccggtggtactccgcctgcaaaaacgaatcaaacaagagtatatgcaggaggacctcgacgaaaaacaaatcgtaatttacggaaagaacggacatgcggaagtcttaggtctggtagggcagacaaccggcaaagctattgtgatagaaaagctcgacgaggctcgccggctggatttcagcaaaagcatacgcctgtactcgcagacaaccaaatcactggatgaattctgggaaatcgtggaatatatcaaggagcacatctctcccgacgtaacttttgagtactacgataccatttgccgccaagtggccaaccgtatgcccaacctacgaaagtttgccgcatcacacgatttgatcttcttcgtcagtggtaaaaaaagttcaaatggcaaaatgttattcgaagaatgcaaaaaagtcaacccgaattcacatttgatagacagtgccgacgaaattgacgactctttactacccggtgtcaattctatcggtgtatgcggggctacatcgactcctaaatggctgatggaagaaatctctgaagctataaaggcacagattaaaagacaatga

SEQ ID NO: 2253 - DNA, 837 bp, B.fragilis
tatataaaaattggtgttcttctggtttttaagctgttattgcttttgtggcacaaatataacgcagatattttaaaaatacagtatatttggcgaaaaaatttagataatacgttaaaaaagggagtaaacctgctgcataacataatgaaaaagataacaattgcaattgatggcttttcctcgtgcgggaaaagcaccatggctaaagatttagccaaagaaataggatacatctacatcgacagtggagcgatgtatcgtgccgttacattatatagtatagaaaatggcatctttcacggtgatacaatcgatacggatgaattaaaacgacgtatcggcgacatccacatctctttccggatcgatccggagacaggacgccccaacacttacttaaatggagtgaatgtagagaacaaaatccgcacaatggaggtttcttctaaagtaagcccgatcagtgcactcggttttgtccgggaagcgatggtggctcagcaacaggaaatgggaaaagccaagggtattgttatggatggtcgtgacatcgggacgaccgtattcccggatgcagaattaaaaatattcgtaaccgcctccgccgaaattcgtgcccaacgccgctatgacgaactgaaagccaagggtcaggaaaccggcttcgaagagatactggaaaatgtgaagcaacgtgaccacatcgatcagacacgtgaagtcagcccattgaagaaagccgacgatgctttgctattagacaacagccatctcaccatcgccgagcaaaaagagtggctgatggcagaatatcagaaagcgataaaagcataa

SEQ ID NO: 2254 - DNA, 996 bp, B.fragilis
aaaaacatgattgttatgggaacagttaagtgtgttggtattttaacttccggtggtgatgcaccgggaatgaacgctgctattcgtgcagtaacgcgtgcagcaatctacaacggactgcaagtaaaaggtatatatagaggatacagaggcttggtgacaggagagatcaaggagtttaagagccagaatgtaagtaacatcattcaactgggaggaacgatcctgaagacagcacgttgcaaagagtttacaactcccgaaggacgtaaaatggcatacgacaatatggtgaaagaaggaatcgatgcccttgtagtgatcggtggcgacggttcgctgaccggagcacgcatctttgcacaagagtatgacattccatgcatcggacttccgggaaccatcgacaatgacctttacggcaccgacacgaccatcggatacgatacggcgctgaacactattttggatgctgtcgacaaaatccgtgacacagccacttctcacgaacgtctgttcttcgttgaagtgatgggacgtgatgccggtttcctggcattgaacggtgcgattgcttccggagcagaagctgccatcatccccgaattcagtacagaagtcgaccaattggaagaatttataaagagcggtttccgtaaatcaaagaacagcagtatcgtactggtagccgaaagcgaactcaccggaggagctatgcattatgccgaacgcgtgaaaaacgaataccctcaatacgacgtccgtgtcaccattttagggcacttgcagcgcgggggtagtccgacggcacacgaccgtattttggccagccgtctaggcgcagccgctatcgacgctattatggaagatcaacgaaatgtcatgattggcattgaacacgacgagattgtatacgttccgttcagtaaagccatcaagaatgataaacctgtcaagagagatctcgtcaatgtattgagagaactgtctatttga

SEQ ID NO: 2255 - DNA, 780 bp, B.fragilis
aatatgcttgtcgattcacattcccatctttttctggaagagtttgcagaagatttacctttcgttatggaacgtgcccgtgctgccggtgtgacgcatatctttatgcctaacatagatagtacgacgattgaacccatgctgtcggtttgtgatacctatcgggacttttgctttccgatgatcggattgcaccctacctccgtgaacgagtcctatgaaaaagagcttgaaatcgttgccgcaaatctggaaacttccggccggttcgttgctgtgggcgagattggaattgatctttactgggataaaacctggctgaaagaacagttgattgcttttgaaaaacaagtgcaatgggcccttcattatcaattgcccatagtgattcattgccgcgaagctttcgattatatatataaggtattgcaaccttataaaaatagtggactgaccggaatctttcatagttttacgggaactcccggtgaagctgcccggatgatggagtttccgggatttaagatcggtataaacggtgtggtgactttcaaaaagtcaacgttgccggagacattgaagtctgttccgttggaacgtatcgtattggaaaccgattcgccttacctcactccggttcctaatcgtggaaagagaaatgagagtgcgaatgtgaaagatacattaataaaagttgccgaaatatataacgaagatccggaaaaagttgcggaattgaccgctgttagcgcattaaaagtgtttggaatgctcaaataa

SEQ ID NO: 2256 - DNA, 186 bp, B.fragilis
agctatgtatttataggaactatattattcgtagagccatgtatttatagaatcatctcattcgtaggctttattcagagttgtgtatacaatatctgtatggattcagaggaagagcggtttactgttcttggtgcgattggattacgcaggggaggattattgccaggtggtggattgaaatga

SEQ ID NO: 2257 - DNA, 642 bp, B.fragilis
agaatcgcttcaacatggtggttgtggccagtctttcggcagacagtggggtcagcgctcccaaacagggagcatggaagcactcggccttccggttcccacttcgatactttctattccgaccgctatctgactaccagccgggtaaaagcaataaacgacgcattggcaggcatcccttatgaacatatcattatcttagccaatacggaacaatacggtgggggcggcatctacaatgctttcacactgaccaccgcacaccatcccaatttccgtccggtagtggtacatgagttcggtcatagttttggtggcttggccgacgaatatttttatgatgaagacgtcatgaacggactctatcctctcaacattgaaccatgggagcagaacattaccacccgcatcaactttgcctctaaatgggaagatatgctcaccaaagctactcctgttccgactccggtagcaaataaggccaaatatcccataggcgtatacgaaggaggaggctactcagccaaaggtatttatcgcccggcattcgactgccgcatgcgtaccaacgaatatcctaccttctgtccggtttgccaaagagctatccaacggatcatagagttttacacaggtaaataa

SEQ ID NO: 2258 - DNA, 1053 bp, B.fragilis
ataagattatcattgaaactctcttcctccattatgtcagattctattaaaacctttaaaaccggctatatcctgcttcccgtcctgatagggctgtcggtggtggggtggttgttctactgggagttcaatccggaacttttcagtggcattcgtttctcttggcgtctggtaggcggattgctacttgccgtactttttatgtttggacgagacggtgggctgatgtggcgtttccgctttattactgaccgggaattaacttggcgtcaggcattccgggtaaatatgctttgtgaatttacatcggcagtgactccttctgccgtgggagggagtagcctgatcgtgttatttttgaataaagaaggcattaatgccggacgcagtacagctttgactatctcctgcctgtttctggatgagctatttcttgtattggcctgtccgtttgctttacttctattttcattcgatgatctgtttggtaatgtggcgattctatcttcgggaatagaggtactgttttttctggtctatggagtcgttacgatttggactttcctgttatatcttgcattgttccgccgtccggaatgggtaaaacgtttgttgctcactattttccgcttgccactgcttcgccgttggcacaaggccatcgaaacacttacggacaatctggtattaagttccagagagatgagtcagaagtcttttaccttttggttgaaagcttttgggattacttgcttggcttggacttcacgttatctggtagtcaatgctttgctgatagcctttactacttcgggtagccaactgttggcttttgtgcgtcagctgattctatgggtagtgatgactatcagccctactcccggtggaagcggagtaagcgaatatatgtttcgtgaatattatgccgatttttttgatgtggcaggtatggctttggtcgttgctttcgtatggcggattattacttattatatgtatttgctgataggtgctatcattattcccggttgggtgaagaagttgagagattaa

SEQ ID NO: 2259 - DNA, 459 bp, B.fragilis
  unsure (374),(432): Identity of nucleotide sequences at the above locations are unknown.
agaaaagaatcgtacctttgcgaccgttcaatctttttaagtatagagtttatgaagagaagacttatccaattcgttacgacttattttctttttgtcctcatattcgtcctccagaaaccaattttcatgggttactaccataccttatataataaggtgtcatggactgattatttctctgtaatgggacacgggcttccgttagatttttcacttgccggatatctgactgccattcccggactattgctgatcgcatcggtctggatacagccggcggttattcgccagatacgccggggatatttcatgataatcgccattctgctttcctgcatctttatcggtgacctggactgtatgaatactgnggattccgcttggatgccactccgctgttctacctcttctcctcgcccaaagatgctntggccagtgtcagcatttgggtcgtga

SEQ ID NO: 2260 - DNA, 189 bp, B.fragilis
gcaagacgatccccgtacaacaggcaagagtctgtatacatctgcatgtttgacgtcctctacatcggacaagaaacaatggcgggggatcaacaaactctaaaaccggacactactcttgtccgatcttgtacagattgttcatttccgaacagttctttctcgaatcattacactaatttacaatga

SEQ ID NO: 2261 - DNA, 2118 bp, B.fragilis
caatcaatcccgactgggacggtatacatgacgatgatgaaacaatcataccttaactccggttatttaacacaactaattatgaaaaagagaatacaaatcctgataattgtcatattatatgctttgatgtttgtccctctttccgcccaaactccacataccatcagcggtatcgttaaagacagggcatcagttcccatttcgggagtcaatatccgagtagaagggcagaaatggaaagcctccaccggaaaagaaggtaagtttacattggaaattcctcaaaactccaccatcaccttttcctctgttggttatgagccggtcaccatccattccggtgagaagaaatggatagaaatcactctcaaagaatctcaaagcctgttgcccgaaataacagttacttccacattaaaaaacagcatgaaatttgttttcgctccgtccgacctggagctgatcaaagacatgctctaccttaaaacgagatataaaatcccctccaaacgctttcaaagtgattcccgggtcatcattcaacccattctgtcaaacaatagccggggaactcaaaaaaacttctctcccattgtgtacgatggcaagaattatgatattttactccggcgaggaaacgtctgcggcgaccgggctgaaaaagaatattattcacgctttgcacaggtcatagaccctgactccatttgtaaccagacgttgacttatgcggactcgtgtacggtggacgacatcaacgacctatatacaaccgaagtacgcatcaaaataagcactttctgccaggatgaatatcgggatacgattcgcatcaccaacggcattatctacccgatgcggttctttaactataatctgagtgcaatggacttggacaacagctacatccccaagcagactccgctcaacttcaatgaaaaaggagaaatgcatcttcgttttcgccctgaagacgcgaacatctatgaaaatgaaggaaaaaacgccgaagaactcagaaaaatgaaaaaggcattggacgacatagacaaagatcgaacaaagacactgaccacctttcagatcataggatacacttcgccggaaggaacatatgaatataacctaaagctggccaaaaaaagaatgaaaaatgcagaaggaaaagtattcgagaacatttccgaagaaaccatccgaaaagccaaagtagataacgatgccgtagtagagtcatggacaacggtttgtgaactcatggaaaaggacagcattcaagaagtatcacagctcaaagaactgatcaaacgtgcccgcggaaaccataatgaaatatcctggggagccagacgaatgaagatttacccgctcatccgggaccgttatctgccccgactccgaagagtagaatatttctatgaatattccgaactacgtacgctcaataaagacgaaatcgacgctctttataaaaaagatccccaaaaactgacagccagcgagttttggagttatatcatgagtcagaaagatgctacggacgaaaaacgggaagcactttacagagaggctctctcgatacatcccgatttaatgatcgcagccaacaacctggcatcgctcttaataaaacaaaatcgtgccgataccactctcctgaaaccttttatcacacaagatgctccctcagccatacttgtcaaccaaactgtagcctatctgcaaaagcgcgacttcaaaagggcgaatcattttgcagaactcctgcctgacaataaagatactgaaatagtgaaagcacttgctgccgccatggacgggaaatatcaggaagcctacccaatattcgagaaacaagggggaatcaatcaagcaatcttattgctgagtatgaagcaaaactcaaaagcctgggaagtcctgaaaaaggtagaagacacctctccggacaccgaatatgtgaaagcgattgccgcaaacaggctgaataacgtcaatgaagccgtcattcacctacgaaatgccatcactcaaaaaccatctttaaaggaaatagcacaaaaagatggagatgtgttagatttactggatttattagatttagataagaaataa

SEQ ID NO: 2262 - DNA, 1137 bp, B.fragilis
tcaatgaaaccacatacactttttctgactttaggaatcctattgctcggattctccgcatgcgagccactcaatgaaactcccgagacgcccgctttcagtctcaacctgacatctcctgacggagagccctccaccgataacgacaatgcggtattgcaaaaactggtataccatctttttattttccgttccaatactgccaatccttcccccgataatgacggctccaattacactttttggaggcataccggagatctcaccctaaagcaaatccgggaatacactttatccatccccagtgaatctacagatcggtcttatctgctgctagttcacgccacccctaaagaaaagccggaatctgagatcataagcaaagaaggaatgactttcagtgagtcagaaatcagcatgataaaagaaaacgataacaactatgtcccgctttcaaaagataactattacgccattcaacaactcactcccgaggatatagcgcaagggaaaacgtctatcgaattcaaattaaagcgggctgtgggagaattggtatttgacgtaatgaaatgcgatgaaaaaagccacaacccgattgacattgacacagaatgttcttcaactttagacagagtgtttcggatcgatatagaaatcaatggcgtgatccccaaagtttcattaaccaacgaaaccaagaatcccgaacggatcaacatctgtttttctaaagaaatagttctcaaaagcgactatacccctgattttgcaaacaacacagaagtcatagagccacttactaatgctccattagatacgaatgaaaaagccgtaaaaggtgcgacacgcatctgcggcccctatctcttctctaaaatgacattagatcatccggacgaagaagcaacggatccggaagaaggtatcaagaccatactcaacttttcgtactacgataccactcctcttccgaacgggagctatagcacgaaaaaacttattctttctcttaccgacaagccattgacgattgtaaaagaccattatacagtgaccaatatacgtttgcggaacaaccgtatcatagatctttccgtttcgggtgacttcggaatagattggaaatgggattga

SEQ ID NO: 2263 - DNA, 210 bp, B.fragilis
attcttgccgctatctttgtcatacccaaattaaaagagtatccccctatgagtagagaagaattacagcaaaaaagtcgtttcgccatgataggaacattgatgaccattgtcagtctggtgtttttgttttatgtaggcagttcgttggtcaatactactaagaaatataaagagctggccattgagatagcttgtataaacaagtag

SEQ ID NO: 2264 - DNA, 405 bp, B.fragilis
aagggggaagctgacagcttctcccttttttcgtacttattcttttcatcggcccggaaagccggtgtacgtggggaaaagtcaggtttggggcggatgaaagtctggctttccaacccaaacagaaggttgcttcgacccggacagacgccatcttccgataaagatgaagctttgttctgctatattacaatatatgttacgggaatatctcctattgtaattggcagctcctctattcggttaataaaacataaaaatgctattgacaaaattcagctggggtttccgtttttgctatacgaactgacggatcagggcaacaaaatcttttccgtactttttctttttatattcaccaatcccgttgatgttaccgaaggcttcgactgtcgtgggacgtga

SEQ ID NO: 2265 - DNA, 522 bp, B.fragilis
aactattttctggttttatcgactaatggattaaaagagacaaaaaacatggaaatagaaaaagattttatagacctactgactgaacacaaagcgctgatatataaagtctgttttatgtatgcctccaatcaggaagatttgaacgatctttatcaggaagtagtagtcaacttatggtgttcttatcctaaattcaggtatgaaagtaaattgtctacctggatatatcgcgtagctttaaatacttgtatctcggatttacggaaaaagaaaatactggattatgtaccattgagcgtggatatcggagtgtatgatgactgtttgcgcaatgattctttaaaagagatgtatcagttgatatgtcaactcgaccgatatgaacggatgcttgtcctgctatggctggatgaaaatagttatgacgaaatagcatccattaccggaagtaaccgaaatacagtagctgtcaagttgcatcggatcaaagataaattaaaaaagatgtcgaaccaatag

SEQ ID NO: 2266 - DNA, 1698 bp, B.fragilis
atttgcagccaaccactaaaaaaatgttttatgacaagagtcccctttacacaaaactatcgctggcacttgcctctcctccttctcgttttctgctgttctttcttcattaacaatggagctatctttgcagatatcatggagtcgagaaatatcatcactgcacgtgagatggtatacgatcataattggctggtgccaaccatgaacggagaattaagattggaaaagcctcctctccccacctggattgctgccataaccgaaatgatttcgccagacaacctccctttacaacgcgccatggccggatttgccgctgtcatgttagtactctttttttataaattcgccaccaagctaaccgacaaccgaacctatgccctggtatcttcgctcgtcttatgtacttcgtataacattattctgatgggacgtacggctacctgggatatctattgccatgcgttcatgataggagccatttattatctttatcttgctttaaggcagaatacatgcaagtggacttattttatcggtgcaggtatttttatgggattatcttttctcggcaagggtcccgtatctttctatgccctgcttctcccgttcgtatgtgcctacatcttatattaccgcaaagagactcaaatgaaaggaaagtggattgcactcgctgtcatgattctcatcggcatcgtactcagcacttggtggtatgcctatatttatatctatcatcaagagatggcttcctacgtgtttcacaaagagtcttcttcctggagtaatcacaacgtacgttcctggtattattactggcaattctttttggagacgggtgtatggtcactgctgacactgaccactcttttagtacccttctggaagaagcgagtagaatcatccaaagaatatttgttctgtctgagctggatgttactgatccttttctttctgtccctgcttccggaaaagaaaacacgctatctactcccgatattgttgcccgcagccctgacaatgggacatctatttgtatattggattcggcaggcaaaacaaaaaatgccacaacttaaggatagggtactctaccgcatcaatgcttacttgattgtagtagccgcattggccctacctatagcgctttatctattcatgtaccgggaaggacggatgggaacgggaatgttcgtatggttggtcgtattgttcctgacagtagcagtatggctattccgatctgctttcaaacttcagcccttttccttcctgatgggaatcgtggcgttatttgctgttgccgaactatttgtgatgccttatataggaagttttgtgagcaactcggatcccaaaagtatcagtgctacccgagagaatccggaactacaacctttaccgttttaccacagtaaagacgaagtgttgcgcatcgaactggtatacgaagcacataaaaagatcggggacatggatttaaccaataaagaagagatcataaaagcgctgccgttcgtccttatctcacaaaagccggcggaactgctgattccggattctatccgaaaggacctgaacctccgttttattgattgttatgataacaaccgctgggcaaaaggacataaaagatatgacagcgtatttatcagcaatgtgacaattgtagaaccgataaaggaacaatag

SEQ ID NO: 2267 - DNA, 258 bp, B.fragilis
cacagtgttaaagcttgttctttggatgtgaataaaaagttctttaaatgcaaaagacttgttatttgcgcacaagaacctgacaatccgcaaaaggcgttaacaatgttaattgaaaaaaggtataaggatgaagataccggttcagacggcgtaaactcatttccgaaacttgagctatcttattcagccggtgtctgtcttttcttattaaagcaagcaaaaaggacaattatcaacttgaaaataaagaaataa

SEQ ID NO: 2268 - DNA, 1656 bp, B.fragilis
ttaaatagtaaaatcgttatggcaaaagaaatattattcaatatcgaagctcgcgatcaattgaaaaaaggtgttgatgctttggctaatgcagtaaaagtaacactaggcccgaaaggacgtaatgtgattattgaaaagaaattcggtgctcctcacattactaaagatggtgtgactgtagcaaaagaaattgaactgacagatgcttaccagaataccggtgcacagttggtgaaagaagtggcttctaaaacaggtgatgatgccggtgacggtacaactactgcaactgttttggctcaggctattattgctgagggtctgaagaatgtaactgccggtgcaagccctatggatattaaacgtggtatcgataaggcggttgccaaagtggttgattctattaaacaccaggcagagaaagtgggtgacaactatgacaagattgagcaggttgctactgtttctgctaacaatgatccggttatcggtaaactgattgccgatgctatgcgtaaggtttctaaagacggtgtgattactatcgaagaagctaaaggtactgacactacaatcggtgtggtggaaggtatgcagttcgatcgtggttatctgtcagcttactttgtgactaacacagagaaaatggagtgtgagatggagaaaccgtatatcctgatttacgataagaaaatttctaatctgaaagacttcttgcctatccttgaaccggccgttcagtctggtcgtcctctgttggttattgcagaagatgtagacagtgaagcgttgactacactggtagtgaaccgtctgcgttctcagttgaagatctgtgcagtgaaagctccgggattcggtgaccgtagaaaagagatgttggaagacattgccgtattgacaggtggtgtagtgatcagtgaagagaaaggtctgaaactggaacaggctactatcgaaatgttgggtactgctgacaaagtgactgtttctaaagacaacactacaattgtaaacggtgccggtgctaaagaaaacatcaaagaacgttgcgatcagattaaagctcagattgctgctactaaatcagactacgatcgtgaaaaattgcaggaacgtctggctaaattatcaggtggtgtagctgttctgtatgtaggtgctgcttcagaagtagaaatgaaagagaaaaaagaccgtgtggacgatgctcttcgtgctactcgtgctgctatcgaagaaggtattgtagccggtggtggtgtagcttacattcgtgctattgaatcacttgacggattgaagggtgagaatgatgacgagactaccggtattgctatcatcaagcgtgcgattgaagaaccgcttcgccagattgttgccaatgcaggtaaagaaggtgcagttgttgttcagaaggtgagtgaaggtaaaggtgactttggttacaatgcccgtaccgatgtttacgaaaatatgcatgctgcaggtgtggtagatcctgctaaagtaacacgtgttgctttggaaaatgccgcttctatcgcaggtatgttcctgactactgaatgtgtgattgtagaaaagaaagaagataaacccgaaatgccgatgggcgctcccggaatgggaggaatgggtggaatgatgtaa

SEQ ID NO: 2269 - DNA, 1017 bp, B.fragilis
acggtcgcaaaggtacgattcttttctttatctttgcgcattaactgtggtaaaacagagagatatatggcaaaaatcgcaaagaaacttaccgaactgataggccatactccattgatggagttgtccggttatagtcgtaaatacggccttcaagagaatatagttgctaaactggagtcgtttaaccctgccggaagcgtaaaggaccgcgtggcactttcgatgattgaggatgccgaagagagaggagtgctgcaacccggtgccactatcatcgagcctaccagtggcaataccggtgtgggactggcgatggtggccactatcaaagggtatcgccttatactgaccatgcccgaaaccatgagcctggaacgccgtaatctgttgaaggcattaggagcccagattgttttgactaacggacagaagggaatggccggttccattgccaaggcagaggaactgaaaaagtcgattcctggttcggtcattctgcaacagtttgagaatcctgcgaataccgaagtccatgctcggtctaccggtgaagaaatctggcaggatacggacggagaagtggctgtattcgtggcgggagtaggaaccggaggtactgtttgcggggtggcccgtgcattaaaaaaacataatccgaatgtatatatagtagctgtagagcccgcatcctctccggtactcgaaggcgggaaagcagcttcacaccgtatacaggggatcggagcgaatttcgtgcccggcatttatgatgcttcggttgtggacgaagtcatgcctgtgcccgatgatgaagcgattcgtggcggacgagaattggcctcgacagaaggattgttggtgggaatttcttccggagcagctgtttatgcagcccgtcaactggccggacgtccggaatttaaaggaaaaatgattgtgactctgttgccggataccggcgaacgctatcttaccaccgagctattcgcatttgacgcttatccgttggactga

SEQ ID NO: 2270 - DNA, 192 bp, B.fragilis
gtacgaaaaaagggagaagctgtcagcttcccccttttactgtattttaatctgaatatagtttatgattacgcagacaaagatacgacaatcaataacaaaagtcaagttttaggactcttatttttccggattatttgcattgttgcatctgttcgtgaacatcggcaggaggcactcccagcgaaatag

SEQ ID NO: 2271 - DNA, 546 bp, B.fragilis
agtatgaaaaagagagcattcttcctgcttttgttattgctgattccgttgacttccatactttcccaagagatagcattaaaaacaaatgtcctctcctgggcaaccacgaccataaacctgggagcagaattcaaaatatcaccccgactgacagccggggcagatatcatgtataaaggatggagttttttatccgataaccgcaaaatgggcggattcttagttcaacccgaagctaagtattggttttgcatccctttctataagcactttatgggccttcatgcccactatggacaatataacggtggattcagtaaatatcgttatcagggagacttgtacggtatcggtttatcttatggttaccaatggatatggaaaagacgatggaacattgaagtatctgcgggaataggatatgcatctatgaactacgataaatatgaacgtcccaaatgcggactattccttgggaaagaccattccaactattttggattaaccaaactcggagtcagcctgatctatatactcaaatag

SEQ ID NO: 2272 - DNA, 813 bp, B.fragilis
ctgacgacccttcgaacccgtcgtgaagaccgcttcctgcgtccgaacctgactcattctatggatttgtattatggcgcctgggcggttctggaccccacccgcaatatggtggacgcatttgaatgtacggatggaaagccatggggagaatctcctttgacggtacgtcctgacgaaagtattttatatggtaatgacgatgccctgaagaaagcggaacgtgctaaaatgtttatgaacagagaccgtcgtctgtacgagtctgtcaaccattctatgatggccaattttgtcgatgacgggtttaaagacgaagaggttcaggtgaacgaatcaaataataaaggacctaccggtttcagcgctctcaaatatgtccaacctacggatgtgacacccggatacagtactgtttcggatgcagatatcgttgtactgcgttacgctcatgtattgttgatgatagccgaagccgaaaacgaagcacacggagctaccacaacagccttgaatgctattaatgaagtaaggacacgttcgggacaaccggccatcgaagccggtatctcacaagacgatcttcgtgaacgtatccggaacgaatggcgtattgaaacttgttttgaagggctgcgttacttccagttaaaacgatggaagttgatggataaacgggtgaacggggtagaagatcctgcttatccgggatacatcaaggtgtataaacctgcatttgaatttttcccgattccacagtccgaaatagataaagcgggcggtgtattgaaacaggacccggcgtatgaatga

SEQ ID NO: 2273 - DNA, 699 bp, B.fragilis
ataagaaagaatatggtaataggatttcaatggattatttttattggcattgctctcgttagctggctggtgcagatgaatctgcagaacaagttcaaaaaatactccaagataccgacaggaaatggaatgacaggacgcgacgtagctattaaaatgttacaagataacggaatatacgatgttcaggtgactcatactcccggacagttgaccgatcattataatcctgccaataagacagtgaacctgagtgaaggagtatatgacagtaacagtatcatggccgctgccgtggctgctcacgagtgtggacatgcggtgcagcatgcgcgggcttatgcacccttgacactgcgcagcaagctggtaccggtcgtttcgttcgcttctcagtggatgacatggttgttgcttgctggtattttgctgttagagtctttccctcagttgttgtttgccggcattatcttgtttgctatgactacgttattcagttttatcacccttccggtggagatcgatgcaagtaagcgtgcattggtatggctgagtgcttcaggtataacgaattcatataatcatagacaggcagaagatgcccttcgttcagccgcttatacttatgtagttgctgcccttggttcgttggctacactgatttactacattatgatatttatgggacgtagagagtga

SEQ ID NO: 2274 - DNA, 2055 bp, B.fragilis
agtatgaagaaacatttaatttcaatggctgcaaccgtaatcttgttgactgcttgcggcggcgccaaaaaaacaaacactgctgaggcagataattttaaatatacagtggaacaatttgcagacttacagatattacgctatcgcgtacccggatttgagaatttaactctcaaacaaaaagagctggtatactatctgactcaagctgcgctcgaaggaagagatatcctgttcgatcagaacggaaaatacaatcttaccatccggaggatgcttgagacgatctatacggattatacgggtgacagaaacagcccggactttgtgaatctgaccacctatctgaagcgtgtgtggttctcgaacggtattcatcaccattatggctcggagaagtttgttccgggctttacaccggagtttctgaagcaggcattgcttagtgttgacgcttcgaagctccctttggctcaagggcagacggtagaacaactttttgaagaactgtctcccgtgatcttcgatccgaaggtaatgccgaaacgtgtgaatcaggccgatggtgaagacttggtgctgacttcggccagcaattactatgacggggtgactcagcaggaggctgaggctttttataatgcgttgaagaatcctaaagacgaaactcctgtctcttacgggctgaacagccgtttggtgaaagaagacggaaaaataatagagaaggtctggaaagtagggggactctatactcaggctatcgagaagattgtgtattggctgaagaaagctgaaggagtggccgaagacgatgctcagaaagcggctatcggcaagttgattgaatattatgagaccggtgatctgaagacgtttgacgaatatgccattctttgggtgaaggatctgaattcccgtgttgacttcacaaacggatttaccgaaagttatggtgatccgcttggcatgaaagccagttgggagtcgattgtgaattttaaagatctggaggccacccgtcggacagaactgataagcagtaatgctcaatggttcgaagatcactcacctgtggacaaacagtttaaaaaggaaaaggtgaaaggagtaactgccaaagtaatcactgccgctatcttgggaggagatttatatccctcgactgccattggcatcaacttgcccaattctaactggattcgcagtcatcacggttccaagtcggtgactatcgggaatattaccgatgcttataataaggcggcccacggaaacgggttcaacgaggagtttgtgtacagtgacacagaaaagcagctgattgataaatatgccgatctgacgggtgaactgcataccgacctgcacgaatgcctgggacacggttccggaaagttgcttccgggagtcgatccggatgcattgaaagcctatggctctacaatagaagaggcacgtgccgatctgttcggtctttattatgtagctgatcccaaactgctggagttgggactggtgccgagtgaagatgcttataaggccgaatattatacttatctgatgaatggactcatgacccagttggtgcgtatcgagccgggcaacagtgttgaagaggcgcatatgcgtaatcgtcagcttattgcccgttgggtatttgagaaaggaaaggctgataaagtggtggaaatggtacagaaagatggaaagacttatgtcgtagtaaacgattatcagaagcttcgtcatctgttcggcgaactgctggccgagatacaacgtatcaagtctaccggagactttgacgcagcccgctcattggtggagaactatgccgtgaaagtagacccggaacttcattccgaagtattgactcgttataaaaaattgaacctggcaccttataagggatttgtgaatccgagatacgatgcggtcattgacgagcagggaaatatagtagatgtacaagtaacctatgatgaaggctatgccgagcagatgctgcgttatagcagggactattcgccgctgccttctataaatgattaa

SEQ ID NO: 2275 - DNA, 885 bp, B.fragilis
aaggaaattgaggaatccgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 2276 - DNA, 678 bp, B.fragilis
ccccaaaatgatatgactaacgacatgatccagttactggtcaacacagaccagaatctactgctatacctcaacggatttcacaatgcctttggtgattatttcatgagtactttcaccggaaaatggatttgggtaccgatgtatgccagtatcctgtatgttctgctaaagaacttcaattggaaaataacactatgctgcctgactgccatcgcactcaccatcctctttgccgatcaagtttgtgccagcctgatacgccctgccgtagaacgcctgcgaccgtccaatccggcaaatcccatctccgacctcgtccacattgtaaacaactaccggggcggacgttacggctttccatcctgccatgcctccaattctttcggactggcattctttctggtcttcctgttccgcaaacgatggctgagccttttcattcttttatgggccacgctgaattgctatacgcgcatttacctgggagtgcattatccgggcgacctcatagtaggtgccatcataggatgctgcggagcagcattcatgtgttatttactgaagaaaacagcaagaggcgcttcttttggaaaagtgaaacatacggaaatcacgatctacgtagggctacttacaacaataggaattgtggtttacgcttcaatcatggcataa

SEQ ID NO: 2277 - DNA, 696 bp, B.fragilis
agatatcgtgaagggaggtacactggtgtacaaaatgaaataaccaattataaactcaaaactacaatggacaaaaagttactgatgatggcgctgttgataacaacaggacttgccacacatgcacaggagaagctgacccgctatcaggtgaggaacgccattacggtgcgtactccgatcatgaacgatagcatcaacccgaaaggagaaaaacacacagccaaagcattgctacaaacaccggtagtactcgaccttgccaatgcaccgactcaaatgacagctgccgatacagccggtctggtcaccttcgcgaaagctgataaagacaatctgctttacctgatcaaaacccaactgcgtgccgaacgctttatgaaaggtaaactgaaagtgacctctccggtcagatgggagcttttcattaatggtgaatcgaagatggtaaaggatgcttcggaagacagcatctctaaagcagcaaccaaagaggtcgctttacgcctcgaacccgaaatggattatgaaatagccatcaaactgctttcgactccggacgacaaaaccgtaccttcactgaaatgcgaactggtaaaagatgacaaattcaaagaagtggcatgcagcaccgatcctgaacagaaacatcgtttctcactcgataacaccaatttacgggaaacggggccataa

SEQ ID NO: 2278 - DNA, 501 bp, B.fragilis
aacggcgccgatatggaaactcaaaatgtgaaagatacggtacggcagatattcacagaatatctaaatgcgaacggacatcgcaagactcctgaacgttatgcgatactggacaccatatactccattgacgggcatttcgatatcgatatgctgtattcacagatgatgaatcaggagaatttcagggtgagcagagctacgctttataacaccatcatcttacttatcaatgcccggctggttatcaaacatcagttcggtacttcctcccaatacgaaaaatcatataatcgcgagacgcatcatcaccagatatgtacacaatgcggcaaggtcaccgagtttcagaacgaggctttgcagaacgcgattgaaaacaccaaattaagtaaattccaactttcgcattactccttatatatatatggtatatgtagtaaatgcgacagggcaaataagagaaaaagagtaaataacaacaataaaaaagaaaaatga

SEQ ID NO: 2279 - DNA, 1827 bp, B.fragilis
aagatgaacgaaaaatatcaaatgatacagaccctcaaaacttatttcggttatgatagcttccgtcctttgcaggaagagatcatccacaacctgataagtaaaaaagactcactggtattgatgcctacggggggaggcaaatcaatctgctatcagcttccggctctgcttatggaaggcacagccattgttatttcgccccttatttcactgatgaaggatcaggtagaaactctacgtgccaacggaataccggcaggtgcactaaacagcagcaatgacgaaaccgaaaatgccaacttacgcagagcctgcatctcaggacaacttaagctcctctacatctcgcccgagaaattactgtctgaagccgactatctgctgagagacatgactctctcactgtttgcagtggacgaggcccactgtatttcacaatgggggcatgacttccgcccggaatatgcccggatgggattcttacgcaaccagttccccaatgtgcctatgatcgccctgactgctacggcagataaaattaccagggaggatatcgtccgccagttgcaattgagacaaccgcaaatatttatttcatcgttcgaccgccccaacctgagcctgtctgtaaaaagaggctatcaacccaaggagaaaagtaaagcgatcatagatttcattacccgtcacaggggggaaagcggaatcgtctactgcatgagccgtagtaagaccgaaacagtggcacagatgctgcaaaagcacggcatccgttgcggtgtgtatcatgccggattgtccgcccggcaacgcgacgagacacaggacgacttcatcaacgaccggatagaggtggtatgtgccactatcgctttcggaatgggtatcgacaaatcaaatgtgcgctgggtgatacattataacctacctaaaagcatcgaaagcttttatcaggaaatcggccgtgccggacgcgacggcatggcaagcgacactatcctgttctactcattgggtgacttgattctactgacaaagtttgcaacggagagtaaccaacagaatatcaatctggaaaaattaaaccggatgcaacaatatgccgaatccgacatctgccggcggcgtatcctcttaagttatttcggcgaaacgactacggaagattgtggcaactgtgatgtatgccgaaatccacccgagcggttcgacggcaccatcatcgtccagaaagccttaagtgccattgcccgcaccaaccagcaggtaagcatcactctcctgatagacattctgaggggaaacccaacgactgaaatcacagaaaaagcatatacagaattgaaaacgttcggagccggaagagacatccccgcacgtgactggcaggattatctgttgcaaatgctgcaaatgggttacttcgagatagcctacaacgaaaacaatcacctgaaaataacagggagcggcagtgacgttcttttcggccgtgaaagggcaatgctggttgtcatccgcagagaagagcctgcaactgccaaaagaagaaaaaagagtgcagccacccccacacaagcatgggcagaagaaagcagaagcaaagaagaagacctgttcgaagcattgcgcgcattacgcaaacagttggccgatcaggaggcactcccggcttacatcgtattgtcggataaagtattgcatctgctctgtctgtcacgtcccacgacagtcgaagccttcggtaacatcaacgggattggtgaatataaaaagaaaaagtacggaaaagattttgttgccctgatccgtcagttcgtatag

SEQ ID NO: 2280 - DNA, 585 bp, B.fragilis
aggaacatggaactggatgaattaaaacaaaaatggacagaactgtccgagcaggtagaaaaaaatgaattgcttaaccgtcagataattattgatatgatacagtcaaagaaagaaacccacctgcagcaacaattgcgtgtggaaaagatggctttcggtgtcttaggtatctttctgggaatagtgtgttacactttttggagaaatgtagctccaggttggatttcatggtatttgctgggaatggtgatatggcttttgctcatgcagactcttatgtttcggattatatataccttaaagacagtaactgaacatgtagagcaacaatataaaaggttacaatcttataaggtattgatgaatctgacctatattttttcgtatgtgataatcactcccgttataatcgcttttttctatatatggcacaatcctctttttagaacagtattgtgcgtgatgatactggccggctttttaggggattattttatttatcataagaccggtgaccggttaaaagggtttagagatgctgtccgtgcgttgcaggatttaaagtcgggaaagcaggaatag

SEQ ID NO: 2281 - DNA, 1188 bp, B.fragilis
agtgataaactgtacatcaggtataaccgaaagttgggttccggtagattgagaagtatgaaaattagaacagccttttttatattttgcatttctttattgttgggggcctgtagtcaagttgctacagagtctcgggtgcaatcgatttcttttgaagtcggttcttctatgatagctgatacgtttttcttagatagcttatttctttttatgcccgaaacaaatgaagaagctttaataaataacattgatagagtctatgaatctaacggacgatattttattctggataagcggatgaagcagggtgctttgtatactcttttcgggaaacatttatttacgatacatgctgtggggaatgggaagggagagtatgttgacctgttcgatatcgctattgatgaagcagaaaataaattgttgcttttaacctatccttcgcaaattctttactatgatttggagggtacatacctgtcttcttatccattagacgatatgtatcaatcttttgccgtggataaaggatttatctatttgcggaatgatacttatgctaatggagtggtatcagattattctctgatagtgattaataaggaaacgggtaaacaaacttctttattagaacctttatacgaaacagcaccgttttgttcttctggtaattaccaaattacgaatactgcctcagtgctatttacccgtaagtttgacaatcatatatatcggataacgggagaatcgattgaaccactttatatggtagattggaaagataaggcttttccggagagtgataagcagcgtcagttccaatgtaatgatttgaatcagttctgttatcaaggaaaatatgtatatactatgactgatttatgtgatactccttcctatttgttgtttagaaccaaccaacctggcatgtgtttgctttcaaaagccactagtacagtgaacaattatcaggtaattatcaatacggattatcagttgcctttgcccaattatatgtcggtagagggaaaacaaagtcggattttctttatttattcatctgaagtactatgcgagcaaaagaaattgtctgctgaagaagatattaatgaaaaaatgtccagtttgctagggcagataaaggagggagacaatccggttatttttacatatcatgtgaagtaa

SEQ ID NO: 2282 - DNA, 1875 bp, B.fragilis
ccccgttattgggataaccattcgctgaaacgttcgcgcacttattgtgaactgaccgaactgaaaacaggaaaagtgctgctcactaatctaagagatggtatgcgatggatgccgaaaagtaataaactgtattatacagtagtggctccggaaggaaatgacgttatcactctcgatcctgtcacactgaaagaagaagttcttttgcgaggtatccccgagcagggattcagttggtcgcccaacgaggacttcctgatatactatccccgtgaagaaggtgtaaaagatgaaggtccgttgaaacgtattgtcagcccggcagaccgtatccccaatacacgcggacgcagcttcctggccagatatgacatcgccagcggaacatcagaacggctcacttacggtaatcacagcacttatatgcaggacatttcaccggatggtaaatatctgctttacagcagttcaaaggagaatatcacgcaacgtcctttctctttgagctctttgttccaggtaaatcttgaaacattggccgtcgacacactgttcttcgaagaccgattcctcggaggagccagctactcaccggacggtaagcaattgctattgacggcaagcccggaagcttttgacggtatcggtaagaattgcggcaaccaccctatcgccaatgacttcgactctcaggcatttatcatggatctggctacccgtaaaatcgatccgatcaccaaagaattcaatccgtctgtcaacttcctgcaatggaacaagggtgacggttgcatctacttcagcaccaatgatgaagattgccggaatatctatcgctattcacccaaagatcgtaagtttgaaaagctgaacctggagactgatgtcaccagtgcatttgccatgtcagaaaacaatccgtcgttggctgcttatatcggacagggatgctacaatgcaggagttgcttatgtatacgacctgaaaaagaaaacctctcgactgatagccgacccgatgaaaccgactctggagaaaattgaactgggcgaaatgaaaccctggaacttcacagcttcagacggaacagagatcaaaggtatgatgtgtttgccgccttcattcgacccgaacaagaaatatcctctgattgtgtactattacggaggaacgactcccacagaacggggtatcagtaatccatactgcgcacagttgtttgcttcacgcgactacgtggtatatgttatccagccgagcggaacaatcggattcggacaggagttttcagcacgccatgtcaatgcctggggcaaacgtactgcggacgacatcattgaaggtaccaaacagttctgtaaagaacacccgttcgtgaatgataaaaaaatcggttgtctcggtgcatcttacggtggattcatgacacaatacctccagactcagacggatattttcgccgccgcagtttcacatgccggtatcagcaatgtgaccagttattggggtgaaggctattggggatacggttataatgccatagccgccgcagacagttacccctggaacaatccggaactgttcaccaaacaaggttcgctcttcaacgccgataagatcaacactccactcttactgctgcacggcaccgtagataccaacgtacctatcggtgaaagcatccagctattcaatgctctgaaaatattgggtaaaacagtagagttcatcactgtagatggagaaaaccactttattgccgactatccgaaacgcgtgcaatggcataacagtattatggcatggtttgcccgctggttgcaggatagtcctcagtggtgggaagatatgtatccggaacgtcatttataa

SEQ ID NO: 2283 - DNA, 831 bp, B.fragilis
aaaaactgctggatgggcgatgtcaccttgacaattgtcgcagaaaaattccagcaacccgccactgatgaaggaaaactggaagagaacttgtctaccagaatcaacagtatacgttattatctctataaagacaacgtgcttatccattccggaatcatcgataacgttaccgacctgaatacagatgcttacaaactgacctttcctaaattagcatttggagattattgtctggcacttgctaccaatgtttcagaagaagagttgcctgatacgactactcctgaagctctcaacctaaactatccgggaattgaacagaccaaagactacttcacgtcttgttatgatttcaccgtcgattgcgaatgcggttaccaggatttcgtaattctacgacgtacacagggcgtcactcaattccagctgaaacagttacccgaaaacattaccggaattggaatagagatacacaaagtagcagcaacctgtcaaatcgatactctatacaaaggtgaaacgatagccgaataccacactacagttgcagaagtcactaacgccgaagaagttgccgacttcagcataggtactttcccgacgtccggaccggaaaatgccagtattaccttaaaattatatgccgatgatcattccggctcccctatctatcaaaaaacactgaacaacatatccattctacgcaatcaactgacccgtattagtacagactttaatcacagtatcctcggcaactcgggattctccatagcaatcaatcccgactgggacggtatacatgacgatgatgaaacaatcataccttaa

SEQ ID NO: 2284 - DNA, 822 bp, B.fragilis
atgccgaatcggttttcacgtaccctcgaatcggtttacgatgattatgccgcagctaccatggccgggttaatgggtaaaaaagaagatgcggaatacttcgggaaacgttcggaattctacaagaacctattcgataaagaaacacagtttatgcgcccgcgttatgccgacggacgttggaagactcctttcaaccccagtgatctggcacatgcagaaagccgtgggggcgattatacagaaggaaatgcctggcaatatacctggcatgtccagcacgatgtaccgggattgatcgaactgtttggcggtaaagaagttttcctcaacaaactggattcattgtttactatcgaactgaaaggaagcggactggccgacgtaaccggactgatcggtcaatatgctcacggtaacgaaccaagtcatcacgtcactttcttgtacgcactggccggaaagccggaacgcactcaggagctgatccgtgaaatcttcgatacccaatacaaaaacaaacctgacgggctctgcggcaatgacgactgcggacagatgtcggcttggtatatgttcaatgccatgggattctatccggtcgatccggtgagcggacattatgtgttcggtgctccgcagatgcctaaaattgttctccatctgccggatggtaaaacgtttacggtcattgccgaaaatttatcgaaagaacataaatatatcgacagtatcacactgaatggtgaaccctatactaaaaactacatttcacatgaagatatcgtgaagggaggtacactggtgtacaaaatgaaataa

SEQ ID NO: 2285 - DNA, 1038 bp, B.fragilis
aaaaagaagctgctttcggaaacggaagcagcttttttgttggctactgcggatattgcgtggaacgctttgtcgagattatataattgtgtacattcgtatatccaaagcaaaacaaacttatatatgaagacacatcttatattcttatggttcatcacttttggggtgatggcttgtacttctcagccggggattaataccggtgagaacaaagtagaaggagatactataccggtattggattttgcttcggcaatccataaacaagttcctgatacgtttatgtggaatagtgtggccagaaagattacctatataccattggcctcttcccatctgatggatggccatcctgtaatcgaatatctcgatgatgatatgtgcattattatggaagggaaaagccaatggataaattgtgtcgattataaaggtaatttcttaagtactttccggcatgtaggcaatgggccaggagaatatgttaatttatcttcagttgtatatcattcaaaagattccactattcgtatttttgataatggcagttataagcatattatttataataagcaggggaaatttctccgggagatcagtttggccgattccgagtttaattacttattgcacatgcagagcgatacttatttctttcgtggcagtttcagtaaaggcaaatcagaaattattgtgacggatacgacgctgcgggtgaagtttcccattttgccttttgattcgacggccgattatattacacggggagccattatgttgaataccactggagaagagtgcgcccctgacatttgtttgtttaatcacatttatagcgatagtgtttttctcctgactcctgatggattgaaacttgactttattctgcgtaagggcaaatatgcgccgtctttggaagatgtaaagcaattcatgaaatggaatcaatatgatccattcattaaaggattgtttatcctaaaatccgcaactatcatccaatacacgattaagggtagatttatgagtcgttag

SEQ ID NO: 2286 - DNA, 1170 bp, B.fragilis
aaatccattagaatttttctgccaaaccctatgacaatgaaacgctacatccgacaaatacttttgggaacacttttgctggggagtgcctgtaccaatcaccaggaagttatcgaagaagatacttctgtcagtgtcgtgtttaaaacccggcaactaccttctaccaaaggagaaaatgacgacgaaatttctgttcttatatttagaaaagagaaagaccaatttaccaaagtagaaagtatccaagagagtccatggcttttcgaacaagaacaattgcagaagaatatcttattgccaacagggatctatcgatttctgttggcaaaaggattctcaaactccccgggaaactctgggaaaatatcatttgtgacagacaataatccgggaaacttagtttccacttcgtatgatcggaactattattttcaatatcctacccgaaccttaaacggacaaacggaactcaatcactgtacaaccgctctattcactgacaaaaatgaagaatcggcacaaaatagtcagacagaatatgacttatcccaaacgaacaggacactgattgcccgaaaaatcagccatttacagggacaattgtgtttcatcattcaaagagctaaaaaagaaaacggacaatacacattaatagattcacccgaaaacagcttcgataatgcattgaaaaaaatcagtgccataaatctcacaatagaaggcagcagccaatgttgctatttaagtgaaaccggactgatatttaaaagcccaatgtcatatcactgtttggtacagctccagaatggggactattcttttaaaagatttgatgcagaccagttcgtatccttgttcagcccgattatagagaaaacagattatcaaagatatgagggagccgcttattgtgaaggtccgttgctattccccgctcctcttgatcagacaatccgtgtaaccattgacatcgattacacaggaacgttgaaaaacaaaacctttacgctagaaaacatccccttggagcgcaacaagatgtatctgttcactctttggcttctaaatgaagatgttgacatttccatctctcccgacgccgatttggacttggaagaactcaaattcaataatcaaatcaccgggaatgacggattctggaactaa

SEQ ID NO: 2287 - DNA, 1521 bp, B.fragilis
ttcatatctagatattcattcctaattaaagatacggtttcaggtcagaatcatttgcatagccatatattcattaaaattattctcttacctattaagtatgagaaaagtcttttttccagtctttatattacattatctcacattgcctctgtaagaggtaagagcgtagcatacctaatcaacaaattattttctaattattttccagaagctctgcaagctcagcatagctattttaaactcatacccacttcctcggaaggaggagatcgcccacgacccgatcattcactaaagaaacaacaaatacttaacattatgaaatcatttaaaatcatgctcatcacggtattatccgtaatgactctgagttgtagcgagaaaacgacgacagaaattcctgaaacagaattgaaaaacattagttgtagcacccaattagtcactcattcatctgctcaaaccagaggagcggcaccaacaaccttgaatgaaaacgatttcgtgctttatgcattcaaaaaaaacggtgaaggtaactttagttatgaagaagccaaacatgaaacaagtgtcattgatggcggagtttggaaatacaatgcagctttcccggtaggcacctacaaattcatcgcattttataacctggacgagaagaaccaagccgctctcaacacgaccataacaggtatcagtaaccaaacttgggaaaacatattgaagagtattgttattacccattttccttccgccaccgatcaataccatgaagatatgaatgaaatattctgtggcaaaacaaaagatgcaatcgatatctccagtggagtgggcggagatgacaatgaaataaaaatcaaattaactctggaacgcattgtatcacgcatcgacattaagtttatcaaagtggcatcggatgacgaccatatagaagtaccttatgctaccggcaatattttcggtggaacaggtactacttcgttgacttcgttaatcttcacatcgtccaacgtacctcttaaatataatcttaatggagaaaatccggattatgttacaggagttcaatgccaagtcacttacgctgctccatcatttcaatacggagaagccaatgcagatgcagtcaaggcacttgattaccagccattccccaaaaatgccgatgccattaacaacaatatggaaactaatattaaaaaaggcatagccaagggtggagcttacttcatgggatcgtatttacttccatttccctcatcatcgcaaacactgaatgccaacattcaactcaacaaggctaatcaagaacgaaccatcaaagttcccggtttcactgttacctcaaattatgtttctataattactgtcaggctgaagtcttcgactgatgccggagacaataacaacggtaatgacgacgaacacttatttaatcctaaatctacttttatcgtagaaatagaaaagacctatgatggcattcacaatacgaatgtagacgtcgaataa

SEQ ID NO: 2288 - DNA, 1128 bp, B.fragilis
cttcggaatagattggaaatgggattgaaaaacaacaataagaatatgatgaaaaacaaattactatctatttggataggatgtgggagtgtattatgttcatatacctcttgtagcaaggaaatggaattcatcgacagccccaatgaacaggtgaccattcaactaaccactaccatcgacggccaagggttttcaactgacaatgaaatcatacctatgaaaacccgaagcacccgatcaacagactactacgtaacggcaatatatgacagccggttggtaattattaaagagacagggcaatctgcctggagcatagaaaaaatagaggataatgttattcctcagggatatatcaaatcctccgatgcatgtaagtataccatgcagacaacacttcgtccgggaaactacaaattcatgctactcgttaacggtccgaaaaacgaagcattgcacctatatcaaaatttttcggaagaggatgtaccatggctaacggatactgagaaagactattccggatatgaaatctttttcgctacatcgggcatcgtcaccattaagaaaacagataggttagaagagtccggacagtatcacccgcttcccaccccattggttcttaagcggtattcttctctaatcagactgtgtgcaacaggagacggtttttggggaagccttgaaagagcaacagatatctcttatagtataaaagaacaaagtataaatggaataaatctattaggacagatcgtaagtaaagacaccgagctgtctttcggaactttaacggcaagcatcagaaagaattttgaatgtcaactcggagataagaaactttttttcagttattttggagatgaagacgaagccaagcaattgcaaaacatattaactccttctgacggtaaagatattactgtaaccattttccaaaaagaaaagcaaacacctcctatcgaaacaacaacccaagcgaaacccaatcaagtgacaacccttatccttgataagacagaatcagttttagactggaatcaacctcctattataggcacacctatcgattgggatcctgataatattccatggggacatttagaactcaattttttataa

SEQ ID NO: 2289 - DNA, 894 bp, B.fragilis
ctgatttgcggaatgaacaaggaaatcttgaagagactgttggccaagcccggtgaggaacatagcgtttcggagtttgatgctcgctataccggtgatttgaccaaatcggaggccgaggcattgctggctgaaaacataggaaaactttcctctttgcaggataagttgtatgcgcaggaccgttatgctgtcctcgttatttttcaggcaatggatgctgccggaaaggacgggacgatcaagcatgtgatgtccggcatcaatccgcaaggttgtcaggtatattcttttaaacagccatcggctgaagaactcgatcatgattatctttggcgcatcaacagatgcctgccggagagaggacgcatcggtatattcaatcgctcacattatgaagatgtattggttgcaaaagtgcatcctgaaattgttttatccgctaagttaccgggtattatgggaccgggagatattactccgaaattttggaaaaagcgttatcgtcagattaatgattacgaacgctacctgacggagaatggtacagtcattattaaattcttcttgaatgtttcgaaagaagagcagaagaggcgctttctgtcaaggctggaagatgaggctaagaattggaaattttccgtatccgacctgaaagagcgcagctattgggacgactatatgaaggcttattcggatatgttgacccatacttcgacggaagaagcaccttggtatgtgattcctgccgataataagtggttcatgcgttatgcagtaggacagattttatgtgaccgcatgaatgaacttgatttacattatccggaaatgcctgttgaggcgcggcatcagattgaggatttcaaaagagcattgttgaatgaataa

SEQ ID NO: 2290 - DNA, 210 bp, B.fragilis
tctctttttatatatatctttgtaaatgccgatggtggagatcgggtatatagtaaaaattcaaataccaatcaatatggtccttatcttataaccctgagaggacaaaacgtttttgcatatcgcgtggtaacagaaacatcctgttttggagttagagtgataaactgtacatcaggtataaccgaaagttgggttccggtagattga

SEQ ID NO: 2291 - DNA, 282 bp, B.fragilis
aaagtaactatgaacattaaaccattagcagacagagtgctgatactccctgcacctgcagaagaaaaaacaattggtggtatcattattcctgatacagcaaaagaaaaacctttgaagggtgaagttgtggcagttggtcacggtacgaaagacgaagaaatggtattaaaggcaggcgatactgttctttatggaaagtatgctggaacggaacttgaagtagaaggtaaaaaatacctcattatgcgtcagagcgatgttctcgctgttttgggttaa

SEQ ID NO: 2292 - DNA, 1269 bp, B.fragilis
ataaaattaatatcaaacaaaaagcatatgaaaacaatcactttgatcattactctgttatgtctcagcctatcgggcatagcacaaaacaacgcaaaaaaagaatttgaaaagaagtatggtgcacttgttaaggaaataatgaacgtacgcgagcaaaaggattacaagaaagccgaaaagctaaattgggaaatactgaaactatatgacgcactgcctcaaacacttcaggaaagagcccggcagatagcaggtttgacttactatgatctcgcctgttatcagtcgcttcaaggaaaaaaaaaggcagctttgaacaacctcgaaaaagcatttgccaacggatggagcaactacaaccatgccaaaagcgacagcgacctcgacaacctgcgaaaagagaaaagatatctggaggtattgagcaaaatgcgtctggacagcgactatttatatatccttcaacaagccaacggatacaacagaaccgaaactaaaccggtatgccataatgaatcgttaaccgatacccttcctcgtttcacctacatgaatcctaatgatagtaacctggtatacctccggaaacatttcaacctggatagtatcgccggaagcggagacgagatctctaaaatcaaaaaccttctctactgggttcacaacatagttccgcatgatggcaattcacgcaatccggaagaacagaacaccatagccatggtggagctttgccagaaagagaaacggggagtaaattgccggatgatggcacagatgctgaacgagtgttatctagcgatggggttcaaatcacgttacattacctgcatgcctaaagtaatgattaacgactgccacgtcatcaatgcagtctactccaataccctcgacaaatggttatggatggatcctacattcaatgcttatgtgacggacgaaaaaggaaatctgctgggcatcggggaagttcgcgaacgtctccgcaagaacgaacctatcgtactaaacgaagatgccaactggaataacaagaataaacagaccaaagagtattatctggattactatatggctaaaaacctgtattatgtgacctgtcccctacggagcgaatacaacgcagaaaccaattatccgggtaagaaatggtcaatgcatatatcattagtccccgaaggatacagcactaatggaaagtccggcgccactccatacgactcacataatgacttatatttctggcaatcaccttatcaggaataa

SEQ ID NO: 2293 - DNA, 903 bp, B.fragilis
tattttataatattcgcttttaatatactatttatgaatcgaaaaactatcatgattccctttcgagaaagagaaggggtgaggaggaagttcctctttcttcttttttcctgcctcttgtctgtttccctttctgcccagacctatcaggaactttctgaaaaggctgtggagtgtgtcggaaaagacagtctagtacaagctgaagacctcctgaaacaagctttgaaactggagccgaagaacgcccataatgctctgctgttctccaatcttggcttggtacaacgcaagttgggacgttataatgatgctgtcgagtcgtatacttatgcactcaacattgctccgcttgccgtacctattttgttgaatcgtgctgccatttatctggaacagggtatgcaggacaaggcttatgtggactattgccaggtgatggatgtagataagaagaatacggaggcgctgttgatgagggcgtatatttatatgttgcgacgggattataaaggtgcccgtttggattatcagcgtttgctcgaaatcgatccgaagaactataacggacgtctcggattggcgactctggaacagaaagaaaacaagttccgtgaagctctggatatcctgaaccaattactggtggagtttcccgaagatgcggttttgtatgtggctcgtgccgatgtggagtgggatatgaaacatgatgatcttgcattggtcgatctggacgaggccattcgcttggcgcccgactcgatcgatgcctatctgttgcggggtgacatttatctcgatcagaaaaagaaatcgctggcaaaagcggacttcgaaaaagctatttcgctgggagtgcctcctgccgatgttcacgaacagatgcaacaatgcaaataa

SEQ ID NO: 2294 - DNA, 1161 bp, B.fragilis
tggaatacaatgataggtctttttaatgattgtttccctccgatcatggatggggtatcacttactacacagaactatgcctactggctgcataggaaggcggggaatgtttgtgtggtgactcctaagtcacctgatgcgagagatgcggaagaatatccggtttaccgctattcatctgttcccattcctatgagaaagccttacagactgggttttccgcgcatcgattggccttttcacgagcgtatcagccggctttcattcgagctggtacatgcccattgtcccttttcttcgggagcactggccatgcagattgccaaagaacagcatgttccgattgtagctacgtttcactccaagtaccgggcggattttgagagggccattccttcccgtctgttggtgaactatctgataaaaaaggtgattcgtttttacgaagctgcggatgaagtgtggattccccaggcagctgtcgaagagacgttgcgggagtatgggtataagggcaggatagaagtggtggataacggaaatgattttgcaggtacgccttttctccaatctgtccggcaggaggctcggaggactttaggtatccgttccggggagtttatgtttctttttgtcggtcaacatatttgggagaaaaatctcggttttttgctcgattcgcttgtccgtttgtctgatataccttttcggatgtactttgtcggttcaggctatgcaagccatgaattgaaacaaaaggttgtggaactgggattggcttccaaagtgtcttttgtaggtagtattgtggaacgcgagatcttgaaacgctattatgttgctgccgatctgtttctgtttccttctttgtacgataacgctccgctggtgatacgtgaagcggctgcattgggcactccttcggtattgatcagggattctaccgcttcggaaataatctccgattcggtaaatggttttctgagtcccaatagcacagaggcttattccaatcgcatacgtgaaatattatgcagtactgctataataaaacaggtgggagaggaggcatcacgaactattgcccggtcatgggaagacgtggccggtgaagtgtacgatcgttataaccggttgataaagcgaaacggaaataaataa

SEQ ID NO: 2295 - DNA, 1281 bp, B.fragilis
aaaagaaaaatgaaagtagatgttctattaggattacaatggggcgacgaaggtaaaggaaaagttgtcgacgtcttaactccgaaatacgatgtggttgcacgtttccagggtggcccgaatgccggtcatacacttgaattcgaaggacagaaatatgtgcttcgttccattccttcaggtatcttccagggggacaaggtaaatatcatcggtaacggtgttgtgctcgatccggctttgttcaaagctgaggcagaagcgctggaggcatcgggacataacctcaaggagagactgcatatttcgaagaaagcgcacctcattttgcctacacaccgtattttggatgcggcttatgaagctgccaaaggcgatgctaaggtaggaactaccggaaaaggtatcggtccgacttatacggataaagtgagccgtaatggcgttcgtgtaggtgatatcctgcataactttgaacagaaatatgctgcggcaaaagctcgccacgaacagatcctgaaaggtttgaactatgaatatgatttgacagaacttgaaaaagcctggttcgaaggaatcgaatacctgaaacaattccagttggtggatagtgaacatgaaataaacggtttgctcgataacggcaaatccattctttgcgaaggtgctcagggtactatgctggatattgattttggctcttatccgttcgtaacttcttcgaacacagtttgtgcaggtgcatgcacaggtttgggggttgctccgaataagatcggtgatgtatatggtatctttaaagcttattgcacacgtgtaggttcggggccgttcccgacagagttgttcgataagacaggggatcagatttgtacacttggccacgagtttggttcggtaaccggacgtaaacgccgctgcggatgggtggatctggttgcactgaagtattctattatggttaacggtgtcactaagctgatcatgatgaagagcgacgtactcgatacgttcgaaacgatcaaagcttgtgttgcttacaagatgaatggtgaagagatcgattacttcccttacgacataaccgatgaggtagagccgatctatgtggaacttccgggatggcagactgatatgacaaaaatgcagagtgaagatgaattccctgaagaattcaatgcttatctttcattccttgaagaacagttgggcgtacagatcaagattgtgtcggtaggtcctgaccgcgaacaaactatcattagatatacagaagaataa

SEQ ID NO: 2296 - DNA, 1374 bp, B.fragilis
aatgaggcctttcttcctccctctctttccggagaggcccgaagtgaggcctttttatttataatacttatgaagaaacattttattacgtttttgctattagtgggaatgacagcttccctgacagcacagcaaaagtatcaaccgacagaggctaacctgaaagcccggagtgaatttcaggacaataagtttggaatcttccttcattggggactctatgccatgctcgctaccggagagtggacgatgacaaacaataacttgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagctgacagagttgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtattggaacttgctaaagttccaacggatgtagactacgtggtagaacttacaattgactaa

SEQ ID NO: 2297 - DNA, 207 bp, B.fragilis
aaagaaaggatcagaaatggatacaaacgagttaaaacaaagacagcatttcattctaatcaggacgttactggttgttacggctcttgctctgtaggtctatattgctttttctatggcctattcatccagaagatttcaagaaagtacttcaattatcgaatgggtaaacgattagaaaaagaagatgtgaggataattaactga

SEQ ID NO: 2298 - DNA, 1515 bp, B.fragilis
  unsure (58): Identity of nucleotide sequences at the above locations are unknown.
ggattccgcttggatgccactccgctgttctacctcttctcctcgcccaaagatgctntggccagtgtcagcatttgggtcgtgatggcaggactggccgcaatggctgtctatgcggctttactttacctgatattctaccgggtactgatttatcaaaaacaaccggtaaaaataccttttcaccggttgagtgtatccggagtattgctacttgccaccgccctcctgttcatcccgatacggggaggtttcacggtgtcgaccatgaacctgagcaaagcctacttcagcagtaatcagcggttgaaccatgcggctatcaatccttgtttcagcctgatggagtcattgtcacgccaggacaatttcgacaagcaatatcgattcatgccagccgaagaggcagacaaactctttgccgaactcaaagaccagccggttgcccccactgacagcatcccacaactcttcacgaccgaacacccgaacgtgatattaatcatacttgaaagcttttcgtccaaactgatggaaaccctcggaggagagtccaatgtggcaatcaacatggatcagttcggacgtgaaggggtattgttcactcatttctttgccaacagcttccgcaccgaccgtggactggcagccatcatcagtggttatccggcacaaccgactaccagtattatgaagtatccaaagaaaacgcaacacttgccttcgatccccggcagcctgaagaaagcaggatacgacctgcaatactattacggaggtgacgccgattttaccaacatgcgctcttacctgatccaggcaggaatagacaacatcgtttcggataaagatttcccgctttccgaacgtctcagcaaatggggagcgcatgaccatgtggtgttcaaccgtctgctggacgacttgaaacagcatacaccccaaaaaccctttatgaagatattgcagacttcaagcagtcatgaaccgttcgaagtcccgttccgacgattggaaaatcccagactaaacgcttttgcctatgcagacagttgtgctggcgactttgtacgtcagttcaaagagactcccttatggaaaaatacggtaatcgtattggttcccgatcatctgggagcctatccgcaggacatagacaacctgaccgtagaccgctatcggattccgctgattttcataggaggtgccgtaaaagagcccagacagataggtacttacggctcgcagattgacattgccgccacactgttgggacaactcggattaccgcacgaagagtttatctttagtaaaaacatgcttaatccgaactcacctcacttcggattcttcacctttccaaatgctttcggaatgatgacaccggagaatgaggtcgtattcaactgcgaatcgaactccatcgtctcagatgaaggaacacataaaggagagaatttacccaaagccaaagcatacctgcaaaagttgtatgacgacttggctaaacgataa

SEQ ID NO: 2299 - DNA, 666 bp, B.fragilis
cttatggacgtaaaagaacaactgaaagatataaaaacacaactccgcctctctatgaacggagtcgtgtctcaaagcatgcgtgaaaaggggctggactataaactgaactttggtgttgaattgccccgtatcaaaagcattgctgccgcttacgagaagagtcatgatctggcacaagccttgtggaaagagaatatccgtgaatgtaagattctggcaggcttattacagccgatagatactttctttcccgagatagccgatatttgggtagaggatattcggaatatcgagatagctgaactgacatgtatgaatctgtttcagaatttgccttatgctccggcgaaaactttccaatggattgcggatgaggcggaatatacacaagtgtgtggctatcttaccatagcccggttgctgatgaaaaagggagatatggcccagcgtcctgccggtgagttactcgatcaggcgatttgtgccgtacagtcagggagttatcatgttcgcaatgcggcaatgcttgccatccgtaagtatatgcagcatagtgaggaacatgcttttcaagtttgccgtctggtagaaggcatggagaactctgaaaaagaggcggaacagatgctgtatgcgatggtgaaagacgagataaacgattga

SEQ ID NO: 2300 - DNA, 1425 bp, B.fragilis
tttatcaaggtcattgctatgaagttcaaatcaacctttatgactgcatgtctggggatcggtctttgcacctcctgcactcccgaaactccgacagcaccccaagactacactcagtacgtaaacacctttatcggagcagccgacaacggtcacaccttcccgggtgcttgcctgcctttcgggctgatccaggcaagtccggaaaccaacgccatcggatggcaatattgctccggatacaattatcaggattcgctgatctggggattctcacagactcacctcaacggcaccggttgcatggatctgggtgatctactggtaatgcctgtcaccggacagagagttcgggacgactataaaagcggattttctaaaaagacagaaagcgctactccgggctactataccgtagaactcgataaatataaggtaaaagcagaactgaccgctacggatcatgtagccctgcatcgttacacttatcagaatgccgactcggcttcattgctacttgacttgcaacacggattggtatggaatccccaacaatacaaatcgcatgtcaaagcctgtgaaatcaactgggaagatgctcaaacactgaccggacacgtacgtagcagtgtatgggtaaaccaagatttgtattttgtcatgaaattcaataaaccggtgaccgactccatctatctgccgatggaagagacggaaaaaggaaaacgcctgatcatgagcttcgacatgaaaccggacgaacagttgctgatgaaagtcgctatctccacagtcggtgtagacggtgcccataagaatatggagaaagaattggctgactgggacttcgacgggacaagacaaaaagcaaaagacagctggaacagttacctgagccgcatcgaggtaacaggtactccggatgaattggagaatttctataccagtttctaccatgcactgatacaacctaataatattgctgacgtggacggaagataccgcaatgccaaagattcgatagtaaaatcctcatcaggcgtttattactctactttttcaatttgggatacctaccgagccgcccatcctttctatactctggccgtacccgaacgagtagacggctttatcaattcgatgatcgaacaaaatcaggcacaaggctatttacccgtctggaccttatggggtaaagaaacgaatacgatgatcggtaaccactcggtttcggttattgccgaagcctacaaaaaaggcttccgtggctttgatgccgagaaagcattcgatgccatcaaacagacactgaccgtttcacatccgaaatcggactgggaaacttatatgaaatacggctactacccgacagacaaagtagatgccgaatcggttttcacgtaccctcgaatcggtttacgatga

SEQ ID NO: 2301 - DNA, 2142 bp, B.fragilis
aatatgatattcgaaacatatttcaaacatgtgtacctgtatgttgcatgcctgtatgccacatccggcacgggactatacgcacaaacgctgcaccaacatgcgggaacacagagagatactgttcctgtcacatttccggtacaacatctggaagaagtcgtcatcaccgcagggcgtccgggaataacggcaggagccgtaagtaaccggatctcttcctccgaaatccatcgtgtggcaggcagttcgcttgccacattgctggaacggatcagtggtgtcagttctctcagcacaggaacaacagtatccaaacccgtcattcatggaatgcatggtaaccgcatcctgatcatcaataacggtgcgcgccagacggggcaacaatgggcgacagaccatgcccccgaagtagatataaacgaaagcggtaatattctggtcataaaaggcgcggacggagtaaggtacggttcggatgctttgggaggtattatcgtgatggaacagccccctttggctttcgggcaggaacaccccaaaggcagaatcgccacattctacggaagtaacgggcatcgctatgcggcaaccggaagcctggaaggcacactacctttcctcagaaacatcgcctggcgtatgcaagggacctattcaaattcgggagaccgctctacggcacattatttgctcaacaataccggaaccagaggattacacttctctgcatctgcgggatatgacagcgggcgattacggatcgaaggaatatacagccacttcggcgaacagacgggagtgatgttcggtgcacagatgggaagtgaggacctgcttgccgaacgtatccgcttgggacgtccggtatatacagacccttttacacggcatatctcttacccataccaaaaagttgtccacagaactgccatcggaaaagtcagatacaatgcaggtgcggcaggtgtcttttactggcaaacttcctggcagaaagacgaccgccgggagaatcgcatccgccggatgaatcattcggatataccggccgtcgcattgctgctgagttctatccaaaatactttccgttggaaactggattatgggccatggcagaccgaaatcgggggacaaatgatattcaccgacaatcacagcaaagcagggacgggaatcgtccccgtcattcccaactacacagaaatgcaggcaggcgcgtacggcatacagaaataccggtatgaaagaaccgccgtagaagctggaattcgcctggataggcaagagacacgtgccggcggatatgactggaccggaaactattatgggggaaacagaaaattctgtaatttcacgtatggcctgggcgggcactaccgactttcaaaatactgggagcttacatccaacttcgcactgacatggagagccccgcatgtgcacgagctgtacagcaacggaaatgaattaggatcaggcatgtttgtccggggagacgcctccatgaatgccgaacgaagccacaaatggataacctcggtcagctaccgggacaaagtgttccatatccgtctggacagctatctgcaatggataaaggggtatatttatgatgaaccgctaaaagagaacatcactgtcatttcaggcacttatccggtattccggtaccggcagacacccgcctttttcagaggagcggattttgacttccgctttatgcctgccgcctcctgggagtatcatctgatcgcctcctttatccgggcaaacgaacaaggaaccgggaattacctcccttatattccttctttccacctcagtcatgaactggcatggacgcaccaaacaaagtcacacatcctgtttcgcctgactgcccgccacaaatttgtagcgaaacaaaaccgttttaatccggcaaccgaccttattccatatacccctcccgcctatcatcttttcggagcggaagccagtatggagtgtcccgtaaaatacggaaacaaactaacactgactgtgacagcagacaacctcctcaacagggaatataaggaatataccaaccgctcacgctactatgcgcatgatatgggacgtgacatacgttgcacactgaactggaacttctga

SEQ ID NO: 2302 - DNA, 1416 bp, B.fragilis
tcaattatttcatataactttgcaactcaattcaataaaacagttagaacaatggcagcaaaaccaggtatacctaaaggaacacgtgatttttcgcccgtagagatggcgaagcgtaactacatattcaataccattcgtgacgtttatcatctgtatggtttccagcagatagaaactccttccatggagatgctttctaccctgatggggaaatatggtgaagaaggtgacaaactactttttaagattcagaattccggtgattatttttcaggcattactgacgaagagctgttgagtcgcaatgcggctaagctggcaagtaaattctgtgaaaaaggtttgcgttatgacctcacagtgcctttcgcccgttatgtagtgatgcaccgtgacgaaattactttccctttcaaacgttatcagattcagcccgtatggcgtgccgaccgtcctcagaaaggacgttaccgtgagttttaccaatgtgatgctgatgtcgtaggcagtgattcattgctgaacgaagttgaattgatgcagattgttgatacggtgtttacccgtttcggtatccgcgtttgtattaaaatcaataaccgtaagattctgaccggcattgccgaaatcataggagaggcagataaaatagtagatattacagtagcaatcgataaactggataaaatcggtttggacaatgtcaataaagagctggccgagaagggtatcagtgaagaggctattgccaaactgcaacctatcattcttctgagtggaaccaatgctgagaagttggctacactgaagactgtactttccgatagcgaaacaggtttgaagggagtggaagagagtgagtttattttgaatacccttcaaacgatgggactgaaaaacgaaatagagcttgacttgacattggcacgtggattgaattactatacaggtgctatttttgaggtgaaggcgcttgatgtgcagattggcagtatcaccggtggaggtcgttacgataacctgactggtgtattcggtatggcaggagtatcgggcgtaggtatttcgtttggtgccgaccgtattttcgatgtgctcaaccagttggaactgtatccgaaggaggccgttaatggcactcagcttctgtttattaacttcggtgagaaagaagctgctttttctatgggtattctgtctaaggcccgcgcagtcggtattcgtgccgagatattccccgacgctgcgaaaatgaagaaacagatgagttatgcaaatgttaagaacattcctttcgttgctatcgtaggtgagaatgaaatgaatgagggaaaagctatgctgaaaaacatggaaagcggtgaacagcaattggttactgctgaagaactgattggcgctttaacaaaataa

SEQ ID NO: 2303 - DNA, 1080 bp, B.fragilis
actggaacttctgactatgatttttattcattgtataatatcaacaaaccaattgaaagaaaaatgaaaacaattacatctaaaaccatcttaatgctcctgacgggggcctttcttgtcttattgtttaatagttgcaccaaagatccggtgattcccgaagacgaaacaaaaaacaagttgcatgaagacccggccaaagtaacggtccgactggtagaatgccacctccatgccgactggaacgagatacagaccaacggtggtccgcatcagaatcccgaatctcctgcccgacatataaaaagaatacaggacattacctatgaactgaaggccggacaaggctggacactggcagaaggtagccagaagaagttctatgtacagaaaaacggggaatataaaaatcaaggacgctttacgcctgctcccgtctatctgatgtttatctattactacaatgccaaaggcgaactgatgaataaccagtttgtggaaaacgggcaagagaacatacaccagcacttcttcacgccggaaaatataaagccaaccttcgacggacagatagaagctgacgacaacgatccacagaagctgatagactatctttatgtagacactaccccctgggataagacctatcacagcggagaggccgaaatcacgggacgggacaatccggtagggttaaaaggaattatccgtttcttgaaagaccgcaaagagttcgatctaaaagtccggctgtatcacggttacgaatccaaaaaaaatccgcagaccggtactttcgatcctttctacaaaccttccggggtattgatacaacggggaacatgggatattaacctgaatctgccggtcgttgtattttggagtcgggaagaatttatcgatatagatgaagaagcaaacttagagaaagtgggcgaagacagtctcgacgagggcagcaaccgtaccgtacactccatcatggaaactttcaacctgacttggaaagaagctctggaagaattcataacctatacctataaggccggagatgccgaaggaggagctatctggctgtaa

SEQ ID NO: 2304 - DNA, 477 bp, B.fragilis
ccagttaattcaatgagtgatttagaaaacaaaacccaggaagaaactcctaaaaaacgcccttacaatttaagggagaaaaaagaaaagaaagctgcttaccggtctttgatcagacccgaattggcagatgaattgtacgacagaatcctgaacatcattgttgtacagaagaagtacagagacccggactattcagctaaggatttggctaaggaactgaaaaccaatacccgttatctttcagctgtagttaattctcgctttggtatgaactattcttgcctgctgaacgagtacagagtaaaagatgctttgcacttgttgacggataaaagatatgccgacaagaatgtagaggaaatcagtgcgatggttggtttcgctaaccgtcagtctttttacgctgcattttataaaaacgtaggtgaaacacccaacggatatcgtaaaaaacacgcagaaaaaaagaaataa

SEQ ID NO: 2305 - DNA, 912 bp, B.fragilis
  unsure (151),(197): Identity of nucleotide sequences at the above locations are unknown.
tcggttaatccggcttatgaagaaagggccaacaatgttcggcccgttcgctcaaaccgcgacaaccgcacgaatcaacaatggttggagaaggcgctgaaaaaagcttcacaagcggacgtgattgttgccgcattgggtgaatcgtcgnagatgagcggtgaaagcagtagccgcaccaacttcaatctgcggantgtacagcacactctgctggaggctttgctgaaaacaggaaagcccgtagttctcgtactgtttacgggacgtccgctggtactcaattgggaacaggagcatgtccctgccatcctgaacgtatggttcgggggttcggaagccggtccagctatcggagacgtattgttcggtgcagtcaacccgggcggaaaactgaccatgactttcccgaaaagtgtaggacagatcccactttattatgcacacaagaataccggacgaccgctgaaagaaggcaaatggttcgagaaattccgcagtaactatcttgacgtggacaatgatgctctctatccgttcggatacggactgtcgtatacgaccttccgattcagtgacatcacattgaaccgttcgtccatcggaatggacaatgaactggtagcctccgtcaccgtaactaataccggagaccgtgccggcagtgaagtggtgcaactctacatccgtgacttggtgggcagtgtcacccgtccggtcaaggaactgaaaggatttgaaaagatctatctgcaaccgaatgaatcaagaaccgtccgctttacaatagctccggaaatgttgaagttttacaatgccgacttgaagtttgtagctgagccgggcgatttcgacgtgatgataggcccggatagccggaatgtgaaaacagcacggtttacattgcgttga

SEQ ID NO: 2306 - DNA, 201 bp, B.fragilis
tcttttgtttatagcatattaagagaaaatcatctctgtggaactctgtgtgactctgtggtgaatcttattcttttctattcccttgtgtatccggttcaacgcaatgtaaaccgtgctgttttcacattccggctatccgggcctatcatcacgtcgaaatcgcccggctcagctacaaacttcaagtcggcattgtaa

SEQ ID NO: 2307 - DNA, 309 bp, B.fragilis
ttggagccgtttggtttattgtttggaaaaaagggattggatactcgtataaaaaataaactcgatattcgtataaagatgaagaaagtaaaaaagtcaacctgggttactgtcgccttgctgatctatgtatctgcgacagcggcttatctgctgcctcgcaatcatgaggtgagcgacacagagaaatatctcaccctggctgcttcgtatgtcattgttctggttctctggctggtgctgagaaaaaaagaacagatgcagcagcgccgccgggaggaagaacatatgaataacctgaaaaagtag

SEQ ID NO: 2308 - DNA, 2124 bp, B.fragilis
aaagtatatttaatatttatattgttaactttaatttttagatgcatgaagcaagttaatcttagagtctgtcgtatgattctgcccctattgtttgggctattcttgtcattgagcgcttatgcacaacaagtctctgtcaaggggcatgtgaaagattcaacgggtgaacccgtaatcggcgcgaatgtggttgtgaaggataattcttctatcggtacgattaccgatctgaacggaaactttgttctgagtgttcctcaaaattcaactcttgtaatttctttcatcggttataagccggttgaaatgaaagccgctcccagcgtgacggtaactctccatgaagatgcggtgatgcttcaggaagcggtggtgattggttatggtaccgtgaagaaaaatgacgtaaccggttcggtgatggcaatcgatgcggataggatggtaaaaggtatggctacctcggcttccgaccttttggtgggtaaggctgccggtgtcagtgtgattaccgatggtggagccccgggggccggagctacgatccgtgtgcgtggaggttcatccatgtcggccagcaacgatccgttgatcgttattgacggagtgcctgtcgataacaccgagatcaagggtatgggcaacccgctctctactgttcatcccaatgacatcgagacgtttacgattctgaaagatgcctctgctactgctatctacggttcgcgtgcttccaatggtgtcattatcattaccactaagaaagggcaatcgggacgcgtgaaggtagactacagtggtacgttctctatcagtacgaaatcgaatacggttgatgtgatgaaggcggaagattttcgtaattttgtaatcgagaagtttggcgaaaacagccttcaggccaatgcgctgggtaaaacctctaccgactggcaagatgaaatcttccgtacggctttcagtaccgatcataatgtaagtgtatccggagcagttccgcatatgccttatcgtgtgtccgtggcgtatacaaacgaaaacggtatcctgaagacttcgaatatgcaacgtctgacaggtgccatcaacttgaaccccaactttttcgacaagaagctcaacatccagctcaatgtgaagggggtatacaataagaaccgttttgccgaccgtgcagctatcggtctggctacccagtatgatcccacacagcctgtctatatggaaggcaatccttatggaaacggatactttatgtatatgaagcaggagggagacaaggcttctccgattgatatcggcctggccaatccggttgccatgcttgaagagaaagatgatacatcgactgtttaccgcagcatcggcaatgcgcagatcgattataaattccacttcctgcctgaacttcgcgctaacctgaacttaggttatgatgtatcgaaaagtaaaggtgacgtgattatagccgataattcacctttgacttactgtacgggtaatttcaaaaacggctttggtgaaaacagccattatactcagctgaaacgcaacactttgcttgatttctacctcaactatgccaatacgttcggagttaattacattgatgtcatggcaggttactcctggcagcatttctataattcgactaccaactcctatccttactcggctgcctatgcagagaagacgggagaagaattttataaaaaaggagatgactatgcgagcgaaagctatctggtttctttcttcggacgtctcaactatactttgttgaaccgttatctggtgacatttaccctgcgtaacgacggttcctcacgtttcagtccggacaatcgttggggcctgttcccatcggtagcactggcatggaagctgaacgaagagtcattcctgaagaatgtgaacgctatttcggatctgaaattacgtttgggatatggtgtgaccggacagcagaatctgggcaatggagactatccttatatggcccgatacatgtattccaaggcaggtgccaactattattttggtgataccgaatactcactgattgctccgcaaccttatgaccagaaccttgaaggggaaaaaaccacacctggaacctag

SEQ ID NO: 2309 - DNA, 4008 bp, B.fragilis
aggattccagcttgtatgaaaaaaattctttttcttctgctcttattgcctcttatggtctctgcacaaacttacaaatatatcggtgtagaggatgggttaagcaaccggagggtatattacatccaaaaagataaaaagggttatatgtggtttctgacccacgaaggtgtggacagatatgatggcaaagagttcaaacgatataaattaatggatgacggtgaagaactcaattcactgcttaacttgaattggctatatctggaccacgagagcactttgtgggaaataggaaagaaaggaaaagtgtttcgttacgacccgttacgagatcagttcacgctggtctacaaactaccagaagagaaaatcaaggaccgccccgctcccatcagttacagcttcatcgatcggaataacaacatctggctgtgtaacgaggagactctctatttatataatacccatacactacagaccctccagatcaagaacgaaatcggagaagacatcactgatatcgaacagatagacgatactcacttctttatcggtacggaacaaggtatccatcatgcggagttgaagaatcaagggctacatttgcttccttgcgacaaactggataatcttccgatacaaatcaatgaactttatttccaccgtccctcacgtaaactattcatcgggacgtttgaacgcggtatttatgtctatgacatgaataccaaacaaagcactcagccccatatgagcctgaccgacgtcagcatcacgcggataaagccgttgaataataaagaactgcttgtcgctacagacggtgctggagtgtataagataaacataaactcttatctgactactccttatatcgttgccgattacaaccagtacaatgaaatgaacggtaacaacatctctgacttttacgtagacgatgaacaacgtatctggctcgccaattatccaatcggtatcacggtacgcaataaccgccattcaagctataactggataaaacattctatcggtaacaaacaatcacttattaacgaccaggtaaattctattattgaggacagtgaaagagatttgtggtatgccaccaataacggaatcagttattacaattccgaaaccggagtatggcattcgttcatgagttcttttgaaaagaatggaggcaacaagaatcacatattcgttacactatgcgaggtagagccgggaattatctgggctgccggatatagttcgggcatctatcaaataaacaaacggaccttatctgtcgagtatatcactccatcttcactgtatggagtcaacatccggccggataagtacatccgttcgatcataaaaacagccgatggagacatctggtcgggaggttactacaacctgaaacgcattgattttcataaaaagactcttcgcctataccccaagctgaactcgataacttccatcatggaaaaagacagtaagcagatgtggataggtacggccacaggactatacttattagagaaagaatccggtaagtaccaacgtatcgaacttcctgtagaatcaatgtatatttattctctgtaccaagcacggaacgggcttctttacatcggaacaagtggttccggattattgatatacgacccggaaaagagaactttcacccactaccacagagacaactgcgcgctgatttccaataacatatataccattctttcggataccgacgatgacattatcatgagtaccgaaaatgggctcagcagttattatccggcagaaaaattgttccataactggaccaaagatcaaggactaatggccagccatttcaatgccggctcaggtacattgcgtaaaaacggtaactttatattcggcagctcagacggtgccatcgagtttaacaaggaaatgaagatacccaggaagtacagttctaaaatggtactcagtgatctgacaattttttatcaaacggtctatcccggtgacgaaaactccccgttaagtacggatatcgatgataccaaagaactggaactcagttacagccaaaatatcttttcgctgaaagtgtcctccatcaactacgattatccgtcgaatattctatattcatggaagttggaaggattttacgaccagtggagccgtcccggaaatgaaaacatcatccgtttcaccaatctgagtccgggagagtatacccttcatatccgtgcagtctctaacgaagataaacgtatcgtactcgaagaacgtaccatgaaaatcagtattgcccaacccatttggctcagtttctgggccatgctggtctatgcaatcgtactggcagtaattgccatcattactctccgcatcattattttgagaaaacaaagaaaagtatcggacgagaaaatccatttcttcatcaacacggcgcatgacatccgtactccgctgacattgatcaaggcaccgctcgaagagatacgcgaacgggaagcgttgacaaaagatggcatcagcaacatgaatacggcactgcgaaacgtaaatgccctactgcgtctgaccaccaacctgatcaactttgaacgggcagacgtatattcgtcagaactttatatttcggaatatgaactgaatacctatctgacggagactttcaacgcattccgtccatacgcaagcgtgaagcatattaacttcacctacgaaagcaatttccgttacctgaatgtatggattgacaaagagaagatggattcaatcctgaaaaatatcatctcgaatgccttgaaatatacaccggagaacggtagcgtacatatttatgcttcggagaccaatgacagttggaatgtagaggtaaacgatacaggtatcggaatacctgccaatgagcagaagaagttatttaaaatacatttccggggaagcaatgcgatcaactctaaagtaaccggaagtggtatcggactcatgcttgtatggaaactggttcatctgcacaaaggtaaaatcaatctgagcagcgtggaacatcagggatcgtctatcaaagtaagttttccgaaggacagtaagcactttcataaagcacacctggcaacccgtacccgtgaactcagcacagagcaagtgccacacgtgtctccggccgagatttatgaaaaggcgaaaaagcaacacgaccagaacctgcaacgcctgttgattgttgaggacaatgatgaactgcggaattatctgactcatacattatcggataattacaccattcagacatgttccaacggtaaggaagcactgacgatcgtaaaagagtacatgcccgaactgattatttcggatatcatgatgccggaaatgcggggagacgagttgtgcgccgccattaaaaacgatatcgaaacctcgcacatccccatcatcctgcttacagcactgaatgacgaaaagaatatcctggaagggctgaaaataggagcagacgaatatatcgtgaaaccattcaacattggtatcttgaaagcaactattgctaacttgctgacaaaccgtgcattattgaaaagcaagtatgccaatcttgaagtcagcgaggaagaggaggtatctccaaactgtgctacagatctcgattggaaattcatcgctacggtcaagaagagtgttgaagagaatatagacaatccggcattcaatgtagatgtactctgcaatctgttgaacatgagccgcacaagtttctataataaactgaaagcactgactgatcaggcccctgctgactatatcagattaatccgcctgaaacgggcggcggcattattaaagaccggtcagcactctgtcaccgaaatatccgaactgacgggattcaacgatgtcaaatacttccgggaagtgtttaagaaacatttcaaagtgagccccagcaaatattgtaaagagggcggaaaagaggatgtagaggaacaacaagaataa

SEQ ID NO: 2310 - DNA, 543 bp, B.fragilis
atgaatatttatcttgaagcattcggcatctttttcaagattggtgccttcactatcggaggcggctatgctatggtgcctctgatcgaaaacgaaatcgtaaccaaacggaactggatttccaaggatgactttatcgatctgcttgccatagcccaatccgccccaggcattcttgccgtaaacatttcgatctttataggatacaagctacgcggcatacggggaagccttgtcaccgctcttggaacggtacttccgtcattcgtcatcatattggccattgctatgttttttcataacttcaaagacaaccccattgtagaacgaatcttcaaagggatacgtcctgctgtagtcgcactgattgcagcacccactttcagcatggcaaagtctgccaaagtcaatcgatataccctctggattccggttgtctccgccctgctcatttggttattgggcttctctcccatctggattattatcgcggcaggtgtaggtggcttctgctggggaaaatggaaacagtcacatccctaa

SEQ ID NO: 2311 - DNA, 1380 bp, B.fragilis
aatcgtgcgtaccaacttagtggtacggggaacgacgaaataaatctacttaataaatacaccatgaaagtaaagcctgacttaagtttttggaagctgtggaatatcagcttcggttttttcggcgtgcagatagcctatgcccttcaaagcgccaacatcagccgtatattcgccacgctgggcgccgacccgcacagcctgagctatttttggatactccctccgctggcgggaatcattgtacaaccgatcatcggagctgccagcgacaagacatggacccgtttcggacgacgcatcccctacctttttgcaggttcgctgctggcggtatgggtgatgtgcctactgcctaatgcgggaagtttcggtatggcagtcggcacggccatgatcttcggactggtagcgttgatgtttctcgatacttctatcaatatggcgatgcagcctttcaagatgctggtgggtgacatggtgaacgagaaacagaaagggctggcctactccattcagagtttcctgtgcaatgtgggtagcctgataggctatcttttcccattcatcttcacatttatcgggatcagcaacacggcggacaagggcacggtgcccgactcggtgatttactcgttctacatcggcgccgccatcctgattctatgcgtcatctataccacggtaaaagtgaaagagatgcctcccaaagagtttgaagagttccatggtatcacggcggacgaaaagaaggaaaaagccgactttatctccctgctgaagcatgctcccaaagtgttttggacggtagggctggtacagtttttctgctgggccgctttcatgtacatgtggacctacaccaacggtgccattgccgccacggtgtggggcactacggacgtccaaagcgccggctatcaggaagcgggcaactgggtaggcgtgctgttcgccgtgcaggccatcggatcagtcatctgggctgtgatattgccgttgttcaaggcacgcaaacaggcctatgccttgagcctcgtactgggtggcatcggtttcatatccaccctgttcttccacaacgaatatctgctgttcatctcttatctgctgatcggctgtgcctgggccgccatgcttgccatgccgttcactatcctgaccaattcggtttcgggcaaaaacatgggggcttacctgggactgttcaacggaaccatctgtgtaccgcaaatcgccgccgcccttgtcggaggaggattgctccacctcgtcggggggcatcaggtgaacatgctggtgctggcaggcgtactgctgattgcaggcgccgcttgtgtatatttcatcaaagagacgatggcgcatcacgaagcgtaa

SEQ ID NO: 2312 - DNA, 3885 bp, B.fragilis
gctatcagacagactatttcctgttttcacataggtatttgtttgatttgtttttcagcctacccggtcattccccccttgacccgtggtaggctgaagtttttttatagtatttccttctcaccaccaacgaatttgcttatctttgcacgcaaagaaaacaaaatcgtatatacacacatgattctttttttcagaaccccttccaagagcgtgattgccgtagagagcaaccacgaacttaacgcgaacgacaacaacaaactctgctggctttttggtgaagccatgccggaaagtgaagaaaacctgcaaggctgcttcgtcgggccacgacgtgagatgattactccatggagtaccaacgcagtagaaataacccagaacatgggactcgacggcatcagccgcatcgaggaatatttccccgtaaaagatgaaaatgcagaccatgatcccatgctgcaacgcatgtacaaaggtcttaaccaaaatgtattcactaccaaccgccagccggaagctattatttatatcgacgatctggaagcctacaatgaaaaagaaggccttgccctgtcaaaagaagaaatggactacctgaaaaaggtagaatctgatttaggacgtcgcctgactgattctgaagtatttggattcgcacaaattaactcggagcattgccgtcacaaaatctttggcggaacgtttatcattgatggcgtagaacaggagtcttctctctttcagatgatcaaaaagacgacccaggagaaccccaataagattatctcggcctataaagataatgtggcttttgccgaaggtccggtagtcgaacaattcgctccggcagatcactctaagcccgacttcttccggataaaggacatcaagagtgttatttcactaaaagcggaaactcacaacttccctactaccgtagaacctttcaacggcgcatctaccggtaccggtggtgaaatccgcgaccgtatgggaggaggtaaaggttcatggcccattgccggaactgctgtttacatgacttcttacccgcgcaccgaagaaggacgcgaatgggaagacatcttgccggtacgcaaatggttgtatcagactccggaacagatcctgatcaaggcatccaacggagcaagtgacttcggcaacaagtttggccaaccgctgatctgtggttcggtattaacttttgaacatacagaaaacaacgaaacttatgcctacgacaaagtgatcatgcttgccggtggtgtaggttacggcacacaacgcgactgtttaaaaggacagccggaagccggcaacaaagtagtggtcatcggtggcgacaattaccgcatcggattgggcggtggttctgtttcatcggttgatacaggtcgctacagcagcggaatcgagctgaatgccgtacaacgtgccaatgcagaaatgcagaaacgtgccaacaacgtggttcgtgctctttgcgaagaggatgaaaatccggtggtatcgattcatgaccacggttcggccggacacgtcaactgcctgtctgagttggtagaagaatgtggcggcctgatcgatatgagcaaattgcctatcggcgacaaaacgctgtcggctaaagaaattatagcaaacgaaagtcaggagcgcatgggactccttattaaagaggaagccattgaacacgtacgccaaattgccgaacgtgaacgcgctccgatgtatgtagtaggcgaaacaaccggcgaccatcgttttgcgttccagcaagcggacggtgtgcgtccgttcgatttggctgtggaccagatgttcggttcttctcccaagacctacatgatagataaaaccgtagaacgtcactatacaatgccggaatatgaaacatctaaacttcacgaatacctgactcaggtgttgcaattggaagcagtagcttgtaaagactggctgaccaataaagtagaccgttccgttaccggtaaagtagcccgtcagcaatgtcagggcgagattcaattgccattgagcgattgtggagtagtagcattggattatcgcggcgaaaaaggtatcgctacttctatcggacatgcccctcaggctgcattggccgatccggcggcaggttctattctttctgtatccgaagcactgaccaacttggtatgggctccgctggccgaaggtctggacagtgtatcactctccgccaactggatgtggccatgccgctcacaggaaggagaagacgcacgcctctacacagctgtaaaagccttaagtgacttctgctgtgcacttcagatcaatgtacctaccggaaaggactctttgtccatgacccagaaatatccgaacggagaaaaagttgtttctcccggaacagttatcgtatcagcaggcggtgaagtctcggacgtaaagaaagtggtctctccggtactcgtcaacgatgcaaaaaccacactttaccatatcgacttcagtttcgacaacctcaaactgggcggttcggctttcgcacagtcattgggtaaagtcggtagcgaagtaccttgtgtacaggatgccgaatacttccgtgatgcttttctggcagtacaagagttggtaaataaaggactgatccttgccggacacgacatctcagctggtggtctgatcacgactctgctcgaaatgtgctttgccaacgtagaaggcggtctggaaatcagccttgataaaatgaaagagacagatatcgtgaagattctgttcgccgaaaatccgggtatcgttattcagatcagcgacaagcataaggacgaagtgaagaaaatccttgaagatgcaggtgtcggtttcattaaattgggtaaaccgacagacgaacgccatatcttggtaaacaaagagggtgctacttatcagttcggcattgactatatgcgtgatgtatggtattcttcttcttacctgctcgaccgtaaacagtcaatgaacggatgtgctaagaagcgttttgagaactacaagatgcaaccgctcgaatttgcgttcatgccgggattcaaaggaaaactttcacagtatggcatcactcccgaacgtcgcacaccgagcggtatacgtgccgccatcatccgcgagaaaggaaccaacggtgagcgcgaaatggcttactcactctatttggcaggtttcgatgtaaaagacgtgaccatgaccgaccttatcagcggacgtgagacactggaagatgtaaatatgattgtttattgcggcggtttctccaactcggacgtgttgggttctgccaaaggatgggccggaggattcctgttcaacccgaaagcaaaagaggctcttgataaattctatgcccgcgaagacaccctgtcattaggtatctgtaacggttgtcagttgatgatggaactgggattggtaaatccggaacacgagaagaaaggaaagatgttgcacaacgaatcacataagttcgaatcgactttcgtcggtgtcaccatcccgactaaccgtagtgtcatgttcggttcactgagtggcagcaaactgggtatttgggtagcgcacggagaaggaaaattctctctgccatacgatgaagaccaatacaacgtagttgctaaatactcttatgacgaatacccaggcaatccgaacggatcggattattcaatagccgctctggccagtgcagacggacgccatctggccatgatgcctcacctggaacgtgctatcttcccgtggcaaaatgcctgttatcctgccgaccgtgtacacaacgaccaggtaactccttggatcgaagccttcgttaatgcacgtaagtgggtagaagaaaagaaaaaataa

SEQ ID NO: 2313 - DNA, 3066 bp, B.fragilis
tctgtggtgcactcaaaaccatatacaatcatgaatttagccaaatattcattagacaataccaaagtaatctacttctttctggctgtattgctgatcggaggagtcttctctttcggcaaactgggaaagaaggaagacgctccttttgtcatcaaatcggccgtcatcatgacgcgctatcccggtgccgagcctgccgaagtggaacggctgatcaccgaacccatctcccgcgagatacaaagcatgagcggagtatacaaaatcaagtccgaatccatgtatggcatttccaaaatcacattcgaactgctcccttcgctacccgcctcttccatccctcagaaatgggatgaactgcgacgcaaggtacttaacatacagccacagttacccagcggctcttcggtaccgacggtttcggacgacttcggcgatgtgttcggtatttattacggactgacggccgacgacggattcagttatgaagagatgagaaattgggccgaacgcatcaagacacaggtagtcactgccgacggagtaatgaaagtagcactcttcggcacacagaccgaagtggtaaacatctccatctccgtgaacaagctggcgggtatgggcatcgatcccaaacaactggccggcctgttgcaatcgcaaaaccagattatcaacaccggagagattacagccggcgagcaacagctacgcgtggtggccaacggcatgtacaccacagtggacgacatccggaaccaggtcatcaccacccgggccggacaggtaaaactgggagacatcgctgtgatagagaaaggatacatggacccgccgggcaccatcatgcgtgtcaacggtaaacgcgccatcggtatcggtgtatcgaccgacccgcaacgagacgtggtactgacgggagaaatggtagacaagaagctagccgaactcctccccctgatgcccgtaggactgaatctggagagtctttatctcgaaaacgtcatagccaaagaggccaataacggatttatcatcaacctgatagaatccatactgatcgttattgtcatcatcatgctggtgatgggaatgcgcgccggagtattgatcggcacttcgctggttttctccatcggaggcacactgcttatcatgtcattcatgggggtaggactcaaccgaacgtcacttgcgggatttatcattgccatgggtatgctggtggacaatgccatcgtggtgacggacaacgcccaaatagccatcgcccgcggtgtggaccgccggaaagcattgattgacggagccaccggcccgcaatggggactgctgggcgccacattcattgccatctgttcgttcctgccgctctatctggcaccttcgtcggtagccgagatcgtgaagccgctctttgtcgtactggccatttcgctggggttaagttgggtactggcactgacgcagaccaccgtattcggaaacttcatcctcaaatccaaagcaaagaatgccggcaaagatccgtatgacaaaccgttctatcacaagttcgaaaaaatactgagcgttttgattcggcggaaaatcgtgacgctggggtcgatgatcgtactctttgtcgtctctctggtagtaatgggaatgatgccgcaaaacttcttcccgtctctggacaagccttacttccgtgccgacgtgttctatccggacggatatggagtaaacgatgtggcccgggaaatgaaaaaagtagaagctcacttgctgaaactgccggaagtgaagaaagtatcgatcaccttcggaagcactccgttgcgttactatctggcatcgacctcagttggtccgaaaccgaattttgccaacgtactggtagaactgaacgacagcaagtataccaaggaatatgaagagaagttcgatgtatacatgaaggccaacttcccgaatgccatcacccgtaccagcctgttcaagctgtcaccggctgtggacgcggccatcgaaatcggcttcatcggtcccaatgtggatacgttggtagcactgaccaaccaggcgttggaaatcatgcaccggaatcccgaccttattaatatacgtaactcctggggaaacaaaattcctatctggaaaccaatttacagtccggagcgggcacagccgttgggagtatcccgtcagggcatggcacaaagcatccagatcgggacgaacggtatgacattgggtgaattccgccagggagaccaggtactgcctatcttattgaaaggcaatagcgtggcagattccttccgcattaacgacctgcgcacactgcccgtattcggcaatggtcccgagaccaccagtctggaacaggtggtgtcggaattcgatttccgatatcgcttctcaaacgtgaaagactataaccggcagttggtgatgatggcgcaatgtgacccgcgacggggagtgaacgccatcgcagctttcaaccagatatggtctcaggtacagaaggaaatcaagattccggaaggctacaccttgaaatactttggtgaacaggagagtcaggtggaatcgaacgaagctttggcaaagaatctgccgctgaccttcttcctgatgtttaccaccctgctgctgttgttcaagacgtatcgcaagccgacagtcatcctgctgatgcttccgttgatattcatcggcatcgtattgggattgctgctgctgggcaaatcgttcgacttcttcgccattctcggcttgttgggactgatcggtatgaatatcaaaaacgccattgtactggtagaccagatcgacatcgaaaatcaatcgggactcgatccgcgcaaagcggtgatcaaagcaacgatcagccgtatcgtgccggtagccatggcttcgggtacaacaatcctgggtatgcttccgttgctgttcgacgccatgttcggcggaatggcggctactatcatgggcggactgctcgtagcttcggcactgaccctgttcgtgcttccggtagcctattgcgccattcacaggattaagggataa

SEQ ID NO: 2314 - DNA, 1314 bp, B.fragilis
ctaattctaaacatgaaaagaatgaaagctatgcattggatgatgtacaccctactgggaatcacgcttcttttaaccgcgtgtgttgacgatgacaaagacctctcacagcccaaagaaccggagaaaacaacagatctgatcattccggatgatgcggactggactactacacgaagtgtcaatctctcgatccactctcctgtggcaactcgggtagcgatttataccgacgcagcatgtactgacgaaagtttgctggcagaaacacccgtatccgatacctctaaaagtatcgaactggatgtagcgaaagcaaaccgggcattatatgtacagtatcctgccggcaaagggaaagaagtgataagcgttccgatcaacagagcttctacacgtgcggaactgtcgattaaactgccggaaaacgtgagtggcttcgatacaaacggaggagaaggcgcatatagctaccaatggtatcccgtcaaagggggagaagctactcttatgatggaagataattggccggaaacaggagattatgactttaacgacttcgttatcggatatcgcacacaagcaaccttcttcgacggacacggtggaagcaagaaagattacgaacaagacggacttgaaatcaagatcactttccgtgcgatgggcgggtatctgccctaccgtttaggactgcaactggataaaacacatgcccgatacattgatgacgtgattgaaatagaaggaaacgacctggttaaaatggagcttcagaatcccggagaagatgcgcccgccatctttatctttacaggaacagaacaattaagaaagcggaacaatggcggaacattctataataccgaacctgaccacgcaatagcgaacaacgatctggtgaccatcaaatacagattaaagataaattgcttcaaaaatttagaaaagactcaggcactgtgggcagcagccacatcagaaaatcagaacttcttcctgcaaaaagagaaaaacggaggacgcgaaatccacttgagaggctacgaaccgacagcttattacagcaattcatacgccggcgaggcaggcggcaatatgcgtaccgatattaaatattgcagtactgacaactttgtgtggggtataaaaattcctgtcgccatcccgcatcccatcgagaagatagacatcatgcaggtctacagcaagttcaggagttggatcaccgaaccgaaccattcggatccaagcagtccggacttcaatgaaaactggttcaaatattatgatacatcgaaagtaataggataa

SEQ ID NO: 2315 - DNA, 498 bp, B.fragilis
aaaagtagaaacgttatgaagaaattaatgtggatcgtatgtctgcttgtcgtttcagtgacggtacaggcacagtttgagaaaggaaagtggattgtgaatccctcggtgacgggacttggactttcgtacagtaagtctgagaaaacccagttcgggttgcaggcgcaaggcggtgctttcctggtggataatgtggcactgatgctcacggccggagccaattggagcaaaccggaagataagtacacactgggtgtgggtggaagatattatttcgacaaatgcggcatttatctcggagccggattgaagatgaatcgctataactggaaagtaggagacacgaccgactttgccttcggtgcggaggctggctatgcgtttttcctgacacggactgttaccatcgaaccggctgtctattatgatttgagtttcaaagacagtgatttgtcgaagttcggactgaaagtaggcttcggattctacttctga

SEQ ID NO: 2316 - DNA, 1065 bp, B.fragilis
tcaatgggaaatatgaaaaaaaactatggatgtatcctcgcagccctcattctactgacggcttgcggacaaaagaaagaagacagtgtgacaacagtacgccccgtaaagacggccagggtagagtcccggtcggaaatcagaaaagacttctcgggcattgtagaggctgtggactatgtgaaactggccttccgcgtgagcggacagatcattaacctgccggtcgtagaaggccaaagggtcaaaaaaggacaactgattgccgctatcgacccgcgtgatctggctttgcaatacgcggcagacaaatcggcttacgaaaccgccgccgcacaagtggagcgtaacaaacgattgctggcacggcaagccatctcggtacaagaatatgaaatcagcgtatcgaccttccaacaaaaaaagtcggcctacgaactttcaagcaataatatgcgggacaccagactgacggctccttttgacggctcgatcgagaagcggttagtagaaaattaccaacgcgtgaactcgggagaaggcattgtacagctggtgaacaccaaaaaactacgcatcaaattcactatccccgacgcttacctttacctgctccgctccaaagaccaacgtttccgcgtagaattcgacacctaccgcgggcacatcttcaacgccaaactggaggagtatctcgacatatcgacagacggtaccggtatcccggtgaccatcacgattgacgatccggctttcgaccatgccctgtacgaagtaaaaccgggctttacgtgcagcatccgcttctctgccgatgtaggtccgttcctggaagaaagcatgacggtggtgccgctgagcgcgatattcggtgaaagcgaaggtaacaaaacctacgtatgggtattgaacggaaaccaagtgaaccgtcgtgaagtaaccgtttactctcctatgggagatgcacaggctttcatttcaaaaggattgaaagcaggcgagactgtggtgacagccggtgtgacacaactggtagaaggtgaaacggtaaaggaactgaaataa

SEQ ID NO: 2317 - DNA, 2322 bp, B.fragilis
aaagccatgaaacaattcctcaaggtagacgaatggaacatcatagaagagggttttcaccccgataacatgcgcgcttcggaaagcatattcagcctcggaaacggccggttcggacagcggggaaattttgaagaaacctatagcagtgacagcctgcaaggctcatacgtggcaggcatcaccttcctggaccgaacccgggtgggatggtggaaaaacggatatccccgtttcttctcgcgcgtccccaacgcaccggactggagcggcatttacctgagactgatcgatgaggagctagacctggtccattgggatgtagaagcatacagacgacgactcgacatgcgcgagggaatctcttaccgcgactttcgggtgacctcacccaaaggccacacactggaagtacacgtagagcatatcaacagcctggcaaaccaaaatctttgtctgataaagtacagtgtgacgtcggtgaactacgaaggtaaaatctccctggtacccttcctgaacggtgacgtaaagcacgagaactctaatttcgacgaaaaaatgtggaacatcctgcgggccgaagccactaacgagtacgcctacctctgggtgcaaaccaagcatgaagattcacaaatctgcctgggcatgacttaccggttttataaaaacagcaaacctacccatatcagtcccatcaaaatagaaaaggagaaattgacaggattcagcgccggtgccgatgtgaaaccaggtgaccgggtgactctggaaaaatatgttgccatcctctcctctctgcaatgcgaccgtcaggagttggtggagtatgcggtggacgaagcgcaagccgccaaagagcagggttgggaagcactggtcggcgcgcacaaacagcaatgggaagaaatctgggaagaaagtgatgtgatgatcgagggagacccggcagcgcaacagggcatccgtttcaacatcttccagctgaaccaaagctaccggggagacgacgcgcgcctgaacatcagccccaaaggatttaccggtgagaagtatggcggaaatacacaatggaacaccgaactgtgctgcgtgccctacttcctgttatcgaccccgagagaaatatcacggaaacttttgctataccgttacaaccaactgcccaaagccatcgaaaacgcacgcaaactgggattcggcggtggagccgccctctatccgatggtgactatccatggagaagagtgccacaacgaatgggaaatcacattcgaagagatacaccgcaacaacatcatcgtgtatgccatcatgcaattttcgagggtaacaggcaacaaagaatatatcgcctactacggtctggaagtgatgatcgccatcagccgtttctggagccagcgagtctctttctcggaagcccgacagaagtatgtgctgctcggggtaaccggacccaatgaatacgagaacaatgtaaataacaactggtacaccaactactcttgcgtgcaatgcctgcaaagcaccatcgaatgcctggagatggtggcgcatgaatatccggaagagtacaaccggatacgtcgctcaaccgagttccggcatgccgaagagacggcgcgatggaaggagatcatcgagaaaatgtatctgcccgaagacaaagaacggggtatttttgtgcaagacgatggctatccggacaaagtgctgggtacggtagacgatattcccgtcaacgaacggccgatcaaccaacactggtcgtgggaccggattctgcgctcgtgctacatcaagcaaagcgatgtgctgttgggacttttcctctattatgaacatttcgaccgggaaaccatccgtcgcaacttccggttttacgaaccccgaaccgtacacgaatcttctctttcgcctttcgtgcatgccattctggctgcatggataggagatacggaagaagcttaccgcctcttcctgcattccacacgcctggatctggacgactacaacaacgaggtgcaccaaggcctgcacgtcaccagtatggctggaagttggcaaatcattgtacgcggattcgccggaatgaaaatactggacggacaactcgacttcactcccatcattcccgaagcatgggacagctatactttcaaagtaaatttccgcaactgcaccttacagatgaaagtcggaaaacaagagataaaaatctctcttttagagggatatgaattgaacatacgcatctccgaagttgtttataacctgaaaaagggtaaagatttgattgtaccgaaacaaaattaa

SEQ ID NO: 2318 - DNA, 294 bp, B.fragilis
cagataaaactctgcgctctttttatctttcgtgctattttatggtacgaatggtgggagatgattctggatcagcgacaggtaaggggcgatttattttgtcatgaaggtattcttttatcccttgccgacagaggttgcgttggtttgaaatcaggtagcctttggtttaaaagagagggtactttgattttaaaccaataccccctctcttttaaactcaaaagtcattcgcgctatagctgcttctggagcactttttgtctttccgcagtatacttttacgcttcgtga

SEQ ID NO: 2319 - DNA, 243 bp, B.fragilis
ggatgtgactgtttccattttccccagcagaagccacctacacctgccgcgataataatccagatgggagagaagcccaataaccaaatgagcagggcggagacaaccggaatccagagggtatatcgattgactttggcagactttgccatgctgaaagtgggtgctgcaatcagtgcgactacagcaggacgtatccctttgaagattcgttctacaatggggttgtctttgaagttatga

SEQ ID NO: 2320 - DNA, 1026 bp, B.fragilis
aaaccaatatgtaccatgagtaaaccgcaaatcaccatcaaagacattgcccgcgaactgggggtatcgccctccaccgtatcgagagcactgaaggataatccggacatcagccaggagacaagggatgctatacataagtacgcgcgcgaacataattataagcccaacgtactggcactgaacctgcgcaccagccgttcgaacaccatcggggtcatcatcccccagttagttcaccacttcttttcgtgtgtgctgagcggcattgagagaacggcggcggaagcgggctacaacatcctggtggcgcaaagcaacgaggagtacgagcgggaggtaaaaatcgttcactccttcctcgccgcacgggtttgcggagtcatcacttcgctcgccaaagacacatcccgatatgaccattaccaggaattgctggacaacaatattcctatcgttttctacgatcgcatctgtaccggtatcaacaccgaacgggtggtggtagacgattacgctggctcgtttgccgccgtggagtatatgatacagacgggctgcaagcgcatcttcttttatagcgccgctccccacctcgaaatatcgaaaaaccggcggaacggttatatggacgcgatgaaaaagtatcggattccggtggaccaaagcatgataaagttatgtgacagccgcgaaaaagcgattgccatcactcccgccctgctcgaaaggccggatcatccggacggcttcttcgccatcaatgacgaaacagcttcgggcatcctctactcgtgcaaactgaccggacggaaagtgcccgacgaagtgtctatctgcggattcaccgacggcgccatcgcccaaagcacagatccgaagctgaccacggtggagcaacatggcgaagaggtgggcaaaagcaccatcaggctactgatagacaaactggaagggaacgatgaaggaaaaagcggtaataaaatcgtgcgtaccaacttagtggtacggggaacgacgaaataa

SEQ ID NO: 2321 - DNA, 840 bp, B.fragilis
aaaccaattatgaacctgagaaaactgattcttcttttagctctctttcttgcaacaggagtgggggcacaaatacaacaacaaagcccttatccgaaaagagaatttcgcggagcgtggatacaggctgttaatgggcagttccgtggtattcctactgagaagttaaaacaaacacttatcgatcagctcaactctttgcagggggcaggcatcaatgcgatcatattccaggtgcgtccggaggcagatgctttatatgcttcacaattggaaccgtggagccgtttcctaaccggagtgcaggggcaggcgccttcgccctactgggatccgatgcagttcatgatcgacgagtgccataaacggggaatggagttccatgcgtggatcaatccttatcgggtgaagacatcactgaagagtgagctgtcggccaatcacctgtataatatccatccggaatggtttgtcacttacaataatcaactcttttttgatccggcattgcccgaaagtcgtcgtcatatttgcatggtggtggcggacattgtttcgcgttacgatgtagacgctattcatatggatgattatttctatccttatccggcaaaaggcatggactttccggatgacgcaagctttgcccgttacggcggagggttcaccaatcgtgccgactggcgccggagcaatgttaatatattgattcagaagatacacgagactattcgtggcttgaagccttgggtgaagttcggtattagtccgtttggtatctaccgtaacggaaaagaacgatccgctcggaagcaagaccaacggcctgcagaattatga

SEQ ID NO: 2322 - DNA, 2814 bp, B.fragilis
ctcactatctttgcagtccaagtaacgaaaatgcttatgactgatagtaaatacatctctataaaaggggccagagtcaacaatctgaagaatattgacgtaaacattccccgcaacaaactggtggtgatcaccggtctttccggttccggaaaatcatcgctcgctttcgacaccctctatgccgagggacagcgtcgctacgtggaaagtctcagtagctatgcccgccagtttctgggccgaatgagcaaacccgaatgtgactttatcaaaggcattccgcccgccattgccatcgaacagaaagtgaacagccgtaacccgcgttccaccgtaggtacctcgaccgaaatttacgaatacctgcgcctgctttatgcacgtgtgggcaaaacctacagtcccgtcagcggagaggaagtgaagaagcactccatcgaagacattgtaaactgcatgctctcttatccggaagggacccgctataccgtgctgacacagatttacctgcatgacggacgcacgctcgaacaacagttggagatcgaccggaagcaaggtttcaaccgtcttgaagtaaacggcgagatggtgcgtatcgacgaatatgctgccggcaaagaggacgtggtatacctgctcgtcgaccgaatgacggcagcaaaatccaaggatgccatcagtcgcctgaccgactctgccgaaacagccatgtacgaaggcgacggcatgtgtatgcttcgcttttatcagccggacggaacgacccggttgcatactttcagtaccaaattcgaagccgacggtatgacgttcgaagaaccgaacgaccagatgttctcgttcaactccccgatcggtgcctgtcccgtatgtgaaggattcggtaaagtgatcggcatcgacgagcacttggtggtgcctaaccgttctttgtccgtctacgacggagccattgtctgttggcggggcgaaaagatgggagaatggcgcgaagagctgatccacaatgccgaaaaattcaacttcccgatctttactccttactacgagctaaccgacgaacagcgccgggtgttgtgggaaggaaaccaatacttccatggcatcaacgacttcttcaagatgctcgaggagaatcagtataagattcaataccgtgtgatgctggcacgctatcgcggaaagacgctttgcccgaaatgccacggcacccgtctgaaacccgaagcgggatacgtccgcgtgggtggaaagaacatttccgaactggtagacctgcctatcaccgaattgcaaaaattcttcgactcgctcacgctgaacgaacacgaccaggccgtagcccgtcgtatcctgacggaaatcaacagccgcatccggttcttgattgatgtgggtctgggctatctcaccctgaaccgcctcagcaattcgttgtcgggcggagaaagccagcgcatcaacctggccacttcgttgggaagcagcttggtgggcagcctttacatcctcgacgaaccgagtatcggactccacagccgggataccgaccgattggttcatgtgctccgccaactccagcagttgggtaacacggtcgtggtggtagagcacgacgaagaaatcatccgtgccgcagactacatcatcgacatcggtccgaatgccggacgactgggcggacaggtagtatacgagggtgacatgaaagatttaaagaaaggcagcaacagttatacggtgaagtacctgctgggcgaagagaccattcccgtgccggaacaccgtcgtccatggaacaactatatcgaaataaaaggtgcccgtgaaaataacctgaaaggtgtggacgcccgcttcccacttaatgtgatgacggtagtgacgggtgttagcggttcgggaaagagcacactggtacgcgacattttttaccgcgcgctgaaacgcgaactggacgaatgcagcgagcgtcctggagaatttgtgtccatcgaaggcgacctgcgcaatctgcgcaatgtggagtttgtcgatcaaaatcccatcggcaagtcttcccgctccaatccggtgacctacatcaaagcatacgacgaaatccgcaagctctgggctgaccagccgctcgccaaacaaatgggatataccgcaggacatttcagcttcaacaacgagggtgggcgttgcgaagagtgtaaaggtgacggaaccatcacagtggaaatgcaattcatggccgacctggtgctggagtgtgaatcatgccacggaaaacgtttcaaggccgatacactcgaagtgaaattccaggataaaaatatctatgacgtactggaaatgacagtcaaccaagctattgaattctttacggaacatggacagaagaaggttgtgaagaaactgatccccttgcaggatgtcggtttgggatatatcaaactggggcaatcttcatctaccctgtcaggaggagagaaccagcgcgtgaaactggcttactatctgagtcaggagaaagcagacccgacgctgtttatcttcgacgaacctactacgggattgcactttcacgatatacgcaagttgctcgatgcattcgatgcactgatccgacgcggacactccatcgtaatcatcgagcacaacatggatgtcataaaatgtgccgattacgtgatagacctcggaccggaaggcggagataagggcggcaatattgtggcaaccggaacgccggaagaggtggctgcctgtgcggcaagttatacgggacaattcctgcaggagaaactgaaccacttgtaa

SEQ ID NO: 2323 - DNA, 771 bp, B.fragilis
gagcgcggcatctcttccagccccgtggtgaagaccccgattatgtttgtcagtatcgcctgtggagccatctccggatttcatgctacgcaaagtcccctgatggcacgttgcatgacttctgagcgtcatggacgtcctgtcttttacggtgccatgattaccgagggcattgtggcgctgatctgggctgccgccgcgacttatttttatcgtgaacacggtatggaagagaacaatgcctctgtcattgtagacgctataacgaaagattggctcggtgcggtaggtggggtgcttgccattctgggagtgattgcggcgcctattacatcgggcgacaccgcgtttcgttcggcacgtctgatcgtagccgattttctgaaactggaacaaaaaagcatgcgtcgccgtttgtatatttgtgtgccgatgttcattgtcgccatcgggctgttgctttacagtttgcgtgataaagacgggttcgacatgatctggcgctattttgcctgggccaaccagaccttatcggtctttactctctgggccatcacagtctacttggcgcgtgcccgcaagtggtatggtttgacattggttcccgctctgtttatgacagctgtctgttccacttatatctgcatcgcccccgaaggattaggattgtcacattgggtttcgtatgtgacaggagggctttgtacactgattggagccgtttggtttattgtttggaaaaaagggattggatactcgtataaaaaataa

SEQ ID NO: 2324 - DNA, 555 bp, B.fragilis
aacattatgatttacctgcaactcttttatacattcttcaaaatcggattatttggcttcggaggcggatatgccatgctctcgatgattcagggagaagtggtgacacgctatgattgggtaagtactcaagagttcaccgatattgtagctatcagccagtccactcccggtcccatcggtatcaacgccgctacctatgttggctttacggctacaggcagtatctggggatctgtcatcgccacctttgcggtagtgttgccgtcatttatcctgatgttgaccatcagtaagttcttcctgaaatatcagaaacatcctgccgtagaggctgtgttctgcggactccgccctgcagtggtaggattattggcatcggctgctctggtcttgatgaatgtggaaaacttcggttcgcccacagacgatacttatacttttgtcatcagcatcattattttcctggtagcctttataggaacaaaaaaatatcacgctaacccgattctgatgattatcgcctgcggaatagccggactgatcttatactag

SEQ ID NO: 2325 - DNA, 1281 bp, B.fragilis
aagtatatgatgaagaataaacttatacttctatttgcattgggactctgtgcgcaagtgcaggcacaagtcccgcatctgagccgtgagacataccgtgaacgtgtggaagcctatagccaggtgctgaaacagcaacatctgaaatcgatggcaagcacggacgcacggaaaatagcctttacgggatttctgcccaaagtggacatctctgccgaaggaacactgaacctgaaagagatggattcatgggacggaccggccggacaatatcgtaatcacacgtaccaaggcatattcgtcgtgtcgcagccactctataccggaggtgccctgcaggcccagaaccgcatagccaaagccgacgaaaaactcgaccagctgagcgaagaactgacacgtgaccaaatccactaccagagcgatgccttctattggaatgcttcttcggcccgtgccatgctcaatgcttcggcccaatatcaggagatcgttgaaaaacaatatgaaatcatccaggatcgcttcaaagacggtgctatcagccgcacagacctgttgatgatttcgacacgccgcaaagaggccgaacttcaatacatcaatgcacgccagaactatacgctggctttgcaaaagcttaatatcctgatgggagaagagcctaacgcacctgtagacagcctttgcgccatcggtgtcgtatgcccgcctgtcaccttgcttccattggatgatgtgctgcaacgccgggccgatttcgccagcacagaagtcaacatacagaagagcgaagcccaacgaaaagcagccctgagccaatacaatccgcaagtaagcatgtacgtcaccggcggatgggcaacagcctctcccaatatgggatatgacgtgaagtttactcccattgtgggaatgagcgtaaatatccccgtattgcgctggggagcaagattcaagaccaaccggcagcagaaggcttacacaggtatccaaaaactacagcaaagttacgtagtagaccagatcaaccaggaactggcagccgcactgaccaagctcaaagagacggaagagcaggtaaagacagctgaggaaaacaaagaactggctgaggaaaacctggacctgatcaccttctcttataatgaaggaaaggcaagtatggtcgatgtactgtcggcgcagctttcgtggacacaggcacacaccagcctgatcaacgcttatctggcggaaaaaatggcagtagcggaataccgcaaggtcatcagcgaataa

SEQ ID NO: 2326 - DNA, 270 bp, B.fragilis
attactttggtattgtctaatgaatatttggctaaattcatgattgtatatggttttgagtgcaccacagattacacggattttcacagattaatgatttatattattgataataagattaaaaaatctgtgttaatccgtgtaatctgtggtgaaattaattattgcgttgaacgggcactcttatttcagttcctttaccgtttcaccttctaccagttgtgtcacaccggctgtcaccacagtctcgcctgctttcaatccttttga

SEQ ID NO: 2327 - DNA, 765 bp, B.fragilis
agttcggtattagtccgtttggtatctaccgtaacggaaaagaacgatccgctcggaagcaagaccaacggcctgcagaattatgacgatctgtatgcagatgtattgctttgggcgcgcaatggttgggtcgattataatattccgcagatatactggcagatagggcatcctgccgccgattatgaaaccctggtgaaatggtgggcaaagaatacggagaaccgtcctttgttcattggccagtctgtgatgaatacgattcaaaatgccgatccgaagaatccttccatgaatcagctgcctcgcaagatggctttggaaagagcttatcagaccatcggtggtagttgtcagtggccggcgagcgctgtggtagagaatgccggaaaatatcgggatgcacttgtgcaggagtatcataagtatcctgctttggttcccgttttcgactttatggatgataaagcaccgggtaaagtccgtaaagtgaaaaaagtatggacggaagatggttacatgttgttctggactgctccgaaagctaaagatgagatggatcgtgctgtgcaatacgttgtttatcgttttgatgataaagaaaaagtgaacattgacgatgcttcgcatattgttgccgttacccgtaacaatttctataagctcccttacaaggatgggaaaaacaaataccgttatgttgtgacagcacttgaccgtctgcacaatgaatcgaaatcggtaagtaagaaagtgaaactgtaa

SEQ ID NO: 2328 - DNA, 1221 bp, B.fragilis
ccgcatcgggcaattggcgtgagagagggtacgagttatataatatttactatgaaaatacatatcttatttggaatgatcgggttcattctgctgtccggttgtaaccgggcagcagaaaagaaccctcgtttttatgatgccggcgtttctagggaactagccgggcaccgtaaggcccagattaagaatctgaagtatgaacttagtttcaatatcccgcgacagaaagaggctgccattgagggcgatattaccttgcgctttgatttggcttcccgacaggaagtcctgatagactttcgggaagagcgtgagaagatcaaagaggttatagccaacggagtgccggtggacaaggtgcgttttgagaatgagcacatcattctgcctgcttcgtcgacagtggaaggagcgaatggaatacggattcgtttcaccgccggcaatcagtcactgaaccggaacgacgaatacctctacacattgctggttcccgaccgtgcccgtaccgtattcccctgttttgagcagcccaatttgaaggcggagttcactttacagcttgaacttcccgcagactggaaagctgtttctaatacatacatccggagtgagacggtaaccgacgatcgtaagaccgtctgttttgcaccgaccgaacctcttagtacgtacctgttctcgtttgtagccggaaagttggagcgtcgggagtatacccgggacggacgtaccatcgctgcttattaccgggagaccgatcctaagaaagtagctcagttggatattgtcttcgggcaggtgatggcatcgctccattggcttgaagagtataccggcattgcatatccgtttgccaagtacgattttattgttctgcccggttttcagtttggcgggatggaacatacaggggctaccttatataatgataacgggattatcctgagtgaacaccctacgccggacgaggagttgaatcgggctgagctgattgcccatgaaacgtcgcacatgtgggttggcgattcgggtaccatggattggtttgacgacggatggactaaagaagtttttgccaactatattgcagcccggattgtcgaacccctgtttccggagatcaatcacacccagaataagctcaagacctttacggcagctatcactttccgaggatcgtactatggggacgaatgccatccgtcaaccgcttga

SEQ ID NO: 2329 - DNA, 1569 bp, B.fragilis
ttgcccatgaaacgtcgcacatgtgggttggcgattcgggtaccatggattggtttgacgacggatggactaaagaagtttttgccaactatattgcagcccggattgtcgaacccctgtttccggagatcaatcacacccagaataagctcaagacctttacggcagctatcactttccgaggatcgtactatggggacgaatgccatccgtcaaccgcttgataacttgcgtaatgccggattgatctatgggcagatcatctataacaaggctcccgtgatgatggaaaaactggtcgacaagatgggcgaagccaatttccggagtggtatacaggagtacctgaagacctactcgtacggtaatgccacctgggacgacctgatccgtattctggacagtaagacgaccgaggacctggccgccttcagtgatgtatgggtgaaccggaaagggatgcccacgttaactttccggacagacgggcaagaactggaaattcgccagcacgatccctacaaccggggattgctctggccgcaacgttttgccgtcactctttgcggagagcgcgattcggtgatccgggtgaatatgacagataccctgttccggatgcaacttccgtttgtgccttcgcgcgtattgcccaataccgatggcagaggctatggggtatttgtgcccgacgagcctgctctgcattggctggcggcacattggtgggagatagaagatgatacggcccgccaatcgctgctgatggtgctctatgaaaattatctggccaaacacatctcggcggacgactgggtcaacagcctgataacagggcttccggccgagaagaacgctttggtggcttctacagccagtggttatctggcgaatgtcatgtgggagatagctccggcaaaccgggcagaagtagaagcccgcatttatacgatgacacagaatcatccgttgccttcgtgccggatacaattgatgcgccttttcatgcagaatgccatttccgaaccgatggtgaagaagctctacattttgtggcaacagcagtccgacaaacatctgaaccgacaggattatacaactttagcctacgaactggctattcgcatgcctttggagagcgaacagatactccgcacacagcgggcacgtattgacgatccggatcgtttgcggcagttcgactttatctcacgggcagccgtatccgatactgcgcggctcgatactctgttcaacagcctgctggcggcagaaaaccgccggatagagccttggacgactgctgtcattcgatacctgaaccatccgttgcgtgaggatcagtcggtgaagtacattcgtccgggactggaggtgctggaagaggtacaacgcaccggagatattttctttcccaaaaattgggcggcagctttgctgggcaatcatctcagttcatcggcttacgaagaagtggtacgcttcctgaacgagcgtcccgattattcaccgcttttgaagaacaagatactgcaggcagcctatccgttgtaccgggcaaacaattaa

SEQ ID NO: 2330 - DNA, 1248 bp, B.fragilis
agtagaatgaaagaatttgtaatatccgaagccaaagtcgaaacagctgttctggtgggtctcattacgcagacgcaagatgaacgcaagactaacgagtatctcgacgaactggcatttctggctgagacagccggggcggaagtagtgaaaaggtttacgcagaagttgccgacggctaactcagtgacttatgtagggaaaggaaaactggaagaaataaaagaatatataaggatagaggctgaagaagaccgggaagtgggaatggtcatttttgatgacgaactttcagccaagcagatacgtaacatcgaagcggaactgaaggtgaagatactggaccgtacttcgctgattctcgatatatttgccatgcgtgcccagactgccaacgctaaaactcaggtggagctggcccagtataaatatatgttgccccgtctgcaacgcctttggactcaccttgagcgtcagggtggtggttccggaagtggtaaaggcggttcggtaggacttcgcggtccgggtgagacccagttggagatggaccgccgtatcatcctgaaccgtatgtcactgcttaaagaacgccttgctgaaatagataaacagaagtctactcagcgcaagaaccgcgggcgtatgatccgtgtagccttggtgggttacaccaacgttggcaaatcgaccatgatgaacctgttggccaagagtgaagtctttgcggagaacaagctgtttgccacactcgatacgacggtgcgcaaggtgattatcgataatctgcctttcttgctctccgataccgtcgggtttatccgtaagttacctactgacttggtagattcctttaagtcgaccctcgatgaagtacgtgaggccgacttgttggttcatgtagtagatatttcgcatcccggatttgaagaacagattgaggtggtgaacaaaacgctggccgatatcggaggaggcgggaaaccgatgattttaatattcaataagatagatgcctatacttatgtagaaaaggcgctggacgaccttacccccaaaacaaaggaaaacttgacactcgaagaactgatgaaaacgtggatggccaagatggaggacaattgcctgttcatctccgcccgtgagaaaatcaatatagacgaactgaagagtgtggtttatcagcgagtgaaagaattgcacgtacagaagtatccctataatgactttctttatcagacctactaa

SEQ ID NO: 2331 - DNA, 1413 bp, B.fragilis
cagataaaagaaactacaatgaaaaagataattttattttcgacattatgtgcttctctctttttaggtagttgcagcagcagcttcctcgatcaggagcctccattatatgtaaacgagaacgatattttcacaagtcctacccgaatcgaggcaactctgaacggcttgtatgctgcaatcaagaacacggggactaagtccttgatgggaggtaagtcctatctggtgtttgacaacaggggagatgatgttattaatatctcgaacaacctggtgactttgttcaatacctacaacatgaatgtaggcattacggatgccgagaatgccgacacttggacatacgcttatctggccattaataaagtaaatactttccttcagtctcttgaaggtgccagggaagttgccggtgagaattatgaccgctatgtgcaggaagctaagtttgtcagggctttggcatactactatttgaataatttgtatccgactccgtattctgtgaatcccgatgcaaaatctgttccgttgcgtcttactgccgaagccggaactgaaaacaacaatatgccccgctctacggtaaagcagatttatgaacacattctgtctgacttggagaacatttcggcattagataccgaagtgaatacttatacaggggtcacacatgctactcaggctgctgccaacatgcttaagatgagagtttatatggcaatgaacgaatgggacaaagccattacagccggagaattggtgaccggatatagtttgccggaagacgtaacattgatttataaggctccgtacttcagtcaggagagcatcttctctttgccaatggcagacactaatatcccgaacactcagcagtcattggcagaatattattatgatggcaagattatgctgatcgatacaaagagcgggattatgtcaaaacctgattattcgttggctaccgataagcgtatcatagcctttaagggagagaaagacttgttgatgaagtttacggatgcaaaaactaaattacagtgggtacccatcttccgttatgccgaaacattgctggatcttgccgagtgttatgcaaacaaagccgggggcgaagctacggccaaaagcctgttgaaacaagtcagaggccgctcggtggatgcggctaccgatccgttgaacatcgataatctgtcgggtgatgcactgaaagaggcaatttacaatgagaagcgccttgagttcattggtgagggtattcgtggtatcgacattatgagacgtggtgaacacttcattaaagtgggcgagaatgagacgatcaatgtcggtccgtccgatgaaaaatatacttggcccatacctcaggttgagttgttgctcaataaagatattaataaataa

SEQ ID NO: 2332 - DNA, 1407 bp, B.fragilis
tttgtagtttgtaacaagaggagtatgggaaagacttaccgtagactgactgaagatgaagtgcttcacttgaagagccagtcgtgtctggccgatgactggaataaggttgcagtagccgaagagttcacaaccgaatttgtacatcacacccgtttctcgggtgaggtgaaactgggagtgttccattcggattttatcctgccgggtggaatcaaaaaacattccggtctgagacatgtcaccctgcataatgtgactgttggtgataattgctgtattgagaacatccaaaactacattgccaactatgagataggaaacaatactttcattgagaatgtagatatcatcctggtggacggcttgactcagtttggcaacggagtagaaactgccgtactgaacgagacgggaggtcgtgaagtgctgatcaacgacaaactctctgcccatcaagcctatatcctggctctttaccggcatcgtccggaactgatcagccggatgaaagagattacagactattattccaataaacacgcttccgcggtgggaaccatcggcaaccatgtgatgattctcaataccggttctatcaagaatgtgcgtatcggggatttctgccggatctgcgggacgtgccgtctgtacaatgggagcatcaacagtaacgagtctgccccggtgcatatcggacacggcgttatttgcgatgattttataatttcctccggttcccatgtcgacgacggggccatgctgacccgttgttttgtgggacaagcctgtcagttggggcacaattattccgcttccgactcgctgttctttagcaactgccaaggagagaacggtgaagcatgtgctatttttgccgggccgtacaccgtcacccatcataaatcgaccttactgatagccggtatgttctcgtttatgaatgccggttcgggatcgaatcagagcaatcacatgtataaactgggaccgattcatcaaggaacgttggaaaggggagctaagactacttccgattcatacatcttatggccggcccgtgtaggcgctttttcgctggtgatggggcgtcatgtgaaccatgccgatacatcgaacctgcctttctcctacctgattgagcaacagaataccacgtatctggtgccgggagtcaacctgcgtagtgtgggtacaatccgtgatgcccaaaagtggccgaaacgtgacaaacgtacagacccgaaccgtctggattatatcaactataaccttctcagtccgtataccattcagaagatgtttaagggacgctctatcctgaaagagttgaagagggtgtcgggcgagacttcggaaatctactcttatcagagtgccaaaaataaaaaactcctcgttgaatag

SEQ ID NO: 2333 - DNA, 684 bp, B.fragilis
agagggtgtcgggcgagacttcggaaatctactcttatcagagtgccaaaaataaaaaactcctcgttgaatagcggcatacgctattacgagatagctatccataagtttcttggcaactccatcatcaagcgtcttgaagggatcaactttaaagataatgaagagatacgccggcgtctgaagccggatacggaaatcggggtaggcgaatgggtagatattgccggtttgattgctcccaaaagtgaagtggagaagctgatagacggcattgaaagcggtgagattaaccgtctgaagagtatgaatgcctgttttgccgctatgcacgataattactatacttacgaatggacatgggcttaccataagatacaggaattttatggcttgaatcccgaaaccattacagcaaaagatatcatcgccatcgttcgcgcctggcgtgaagcggtggtaggacttgaccgcatggtatacgatgatgcgcgcaaagagttctcactttcgtctatgacgggctttggtgccgacggttcacgtgacgaaatgaagctcgacttcggtcaggttcgcggcgattttgagagtaatccgtttgttaccgccgtgctgaagcatattgatgataagaccgctttgggagaagaactgattaaccgcatcgggcaattggcgtga

SEQ ID NO: 2334 - DNA, 2949 bp, B.fragilis
tataattgtagttctgcaaagactttgcagatttcgtacatcggaatgcagactgctgaggtagcaattgcaccggtaatcaaagtgatattaaaaacagactcaaaagcacttgacgaggttgtggtagttgcttacggaacacaaagtgctcgtacggtgaccgcatctgtatctactgtaagagcggatgctttgaaagatgtgccaagtgtaagttttgatcagatgcttcagggacgtgcgtcaggtgttagtatcaccactccgtcagcaggtgtagggcaggccccgattgtgcgggtacgtggtgtgaactcgattacttccggtacttctcctctgtatgttgtcgatggagttcctatcgaatcaggcaatctctcttatttggctaatgccaacgcactggctgatattaatccggccgatattgtatctatggatgtattgaaggatgcggcggcagctgcgttgtatggttcgcgtgctgcgaatggagttatcttgattaccactaagcaagggcaaagtggtaaagtcaaagtaagctatgatggttttgtcggtttctcaaatgcaaccgatttctatgaaatgatgaatgcacaggaatatgtcgacttcaagaatttggccgtaaagaaccgttatgggacagatgaattgtcactgactaccggctatgtttctccttatggtaacaaagcgtttaacatgatgaaagatgccaatggtaactatgtagatactgactggaaagatgctgccttccaaaacggattgtcacagagtcactctgttgctgtaagtggcggatcggataaagtgcggtattatctatccggtaactatacaacgcaagaaggtattgtgaaaggtgataaatatgaccgtttgggagtaaaggctaatattaacgtgcaggcaaccgactggttgaaggttggaatgaataccaacgtgacaaccggaacgacatcttacgtagatgctgcccgtagaggttccaactttgcggtaggaggatttccgcgtctggcattgatcaatgcgcctaacttgccgatgtataatgaagatggtactccctactatctggctcaaggtttgggttatggagggaatacggtattcagtacattctctaatccggctgccattttgtctttgggcaatggattgagttctgacgtaacccgtttcatcggagtattttatgccgaagcaactccgttgaaggggctgtcattgaagactcagtacggtgtggactatgcacgtattgaggaacagcgtttctggtctccgctgcatggtgatggagtaaatagcaaaggtctggcaaatgcctataataccaagaacaacagatggacttggactaatacggcaacttataatttctctttaggacagaataactttaatttgctggccggtacggaagcgtctgaaagaaataactctcgttggaccgcacagcgtaaagatttacaagatgataaatttgttgtattccaaggtccttttggttcggcaactgccggtggtagcttgtccaacaataccatggtctcttatttcggacgtatcaactatgattatgcttctaaatacattgtatctcttaactaccgtcgcgatggttattccgctttgagtgagaagaatcgttggggtaatttcggaggtgtttccgctgcatggcgcgtatccgaggaagggttcttcaaacccttgcgtaatgtagtcgacgacttgaagataaagggaagctatggtgtggttggtaacactgatatttacgattatgcttcgaaatcattctattcaagctacaactatggtataaacggtacttatggcctggctcagattgccgatccgaacctgaaatgggaatcttcggaaaaatatagtattggtttcaatgcacgattgctggatagaatcagtgtggactttgactactattatacgaagtcttccgatttgattctggatgtacctcaatcaccgtccaaaggtattccgggcaatatcattactaccaatgccggaaagatgaagaatagcggtattgaactgaccgtctcggccgatgtgataagaaacagtcagtttacatgggaaaccagctttaacattacgactaacaagaacaaggtgatctcgctggctgacggtgtagagaatattctgaaaggggataatggcggtttagagattacgaatatcactgtaccgggaaaatctatcggacgtctgtatctctacccaactgccggagtagatcccaagtcggggcgtagggtatttattactccagaaggtgacagaaccttactgatgttcgaaaaagggggatggttctatgaagatggaatagaatatgccggtgaatttgaacctgttgattgtggaaatacacttcctacctggtacggtggctggaccaataacttcaagtataaaggtttcgacctttctctgtttttccaattctcgggaggtaataagatttataacggaaccaaagccagtgtgagcgatatgcgttactggaacaactctaaagatgtatataagaagtactggactccggaacgcacacatgcagagtatcctatgccgatatacggtgataattactctaatggttcggcattgcctatcagcgacttagtggaaagaggagattatttacgtttgaagaatgtgtcactgggctatacattcaatacaaagaactggtcgaaagctgtgggaatctctgcacttcgtctttacgtccaggctcagaacctgttcgtgattacaggttatagcggtatggatccggagacactaaccaacgtagagagtgcgactttgtcaggtggtacggataagaatacgttacctcaggcacgtacgtatacaatcggtgtgaatctgacattctaa

SEQ ID NO: 2335 - DNA, 1299 bp, B.fragilis
cattacgtaataaaattaagagatatggcaacacctccgtttaagtatcaacctatgttcgaacatggggaagataaaaccgagtattatctgcttaccaaagactatgtgtcagtaagcgagttcgaaggaacacctgtgctgaaagtacagaaagaaggtctgacagcgatggctaatactgctttccgcgacgtatctttcatgcttcgccgtgcgcacaacgagcaggtagcgaagattctgagcgacccggaagcaagtgaaaacgacaaatacgtggcattgactttcctgcgcaacgctgaagtggctgccaaaggtatacttcctttctgccaggataccggtacggctatcatccacggtgaaaaaggacagcaggtatggacaggctattgcgatgaagaagctttgtcattgggtgtttacaagacatatacggaagaaaacctgcgttattcacagaatgctccgctcaacatgtacgacgaggtgaacacgaagtgcaatctgccggcccagatcgatatcgaggctacggaaggcatggagtacaaattcctgtgtgtgaccaagggtggtggttctgccaataagacttatctgtatcaggagacaaaagcgattctgaatccgggcactctggttccgttcctggttgagaagatgaagacactaggtacagcggcttgtcctccttatcatattgcattcgttatcggcggtacttcggctgaaaagaatctgctgactgtgaaactggcttctacccactattacgacgagttgccgactaccggtaatgagtatggtcgtgctttccgcgacgtagaactggagaaagaggtacttgccgaagcccaaaagatcggtttgggagcacagtttggcggtaaatatctggcacacgatgtacgtatcatccgtctgccccgtcacggagcttcttgtccggtgggcttgggtgtatcttgttctgccgaccgtaacatcaaatgtaagatcaataaagacggtatctggattgaaaaactcgattctaatccgggcagtctgattcccgcaaaactgcgtagtgcaggtgaaggcgatgtagtgaagatcgacctgaaccagccgatggcggatatcctgaaggaactgactaaatatccggtagctacacgtctgtcactcaacgggacgatcatcgtaggccgtgatatcgctcacgctaaactgaaagaaacgtttgaacgggggaaaatctggcccaaatatcaaagaccatccgattattatgccgttcggcgtctt

SEQ ID NO: 2336 - DNA, 536 bp, B.fragilis
  unsure (1),(2),(3),(4),(5),(6),(7),(8),(9),(10),(11),(12),(13),(14),(15),(16),(17),(18),(19),(20),(21),(22),(23),(24),(25),(26),(27),(28),(29),(30),(31),(32),(33),(34),(35),(36),(37),(38),(39),(40),(41),(42),(43),(44),(45),(46),(47),(48),(49),(50),(51),(52),(53),(54),(55),(56),(57),(58),(59),(60),(61),(62),(63),(64),(65),(66),(67),(68),(69),(70),(71),(72),(73),(74),(75),(76),(77),(78),(79),(80),(81),(82),(83),(84),(85),(86),(87),(88),(89),(90),(91),(92),(93),(94),(95),(96),(97),(98),(99),(100),(101),(102),(103),(104),(105),(106),(107),(108),(109),(110),(111),(112),(113),(114),(115),(116),(117),(118),(119),(120),(121),(122),(123),(124),(125),(126),(127),(128),(129),(130),(131),(132),(133),(134),(135),(136),(137),(138),(139),(140),(141),(142),(143),(144),(145),(146),(147),(148),(149),(150),(151),(152),(153),(154),(155),(156),(157),(158),(159),(160),(161),(162),(163),(164),(165),(166),(167),(168),(169),(170),(171),(172),(173),(174),(175),(176),(177),(178),(179),(180),(181),(182),(183),(184),(185),(186),(187),(188),(189),(190),(191),(192),(193),(194),(195),(196),(197),(198),(199),(200),(201),(202),(203),(204),(205),(206),(207),(208),(209),(210),(211),(212),(213),(214),(215),(216),(217),(218),(219),(220),(221),(222),(223),(224),(225),(226),(227),(228),(229),(230),(231),(232),(233),(234),(235),(236),(237),(238),(239),(240),(241),(242),(243),(244),(245),(246),(247),(248),(249),(250),(251),(252),(253),(254),(255),(256),(257),(258),(259),(260),(261),(262),(263),(264),(265),(266),(267),(268),(269),(270),(271),(272),(273),(274),(275),(276),(277),(278),(279),(280),(281),(282),(283),(284),(285),(286),(287),(288),(289),(290),(291),(292),(293),(294),(295),(296),(297),(298),(299),(300),(301),(302),(303),(304),(305),(306),(307),(308),(309),(310),(311),(312),(313),(314),(315),(316),(317),(318),(319),(320),(321),(322),(323),(324),(325),(326),(327),(328),(329),(330),(331),(332),(333),(334),(335),(336),(337),(338),(339),(340),(341),(342),(343),(344),(345),(346),(347),(348),(349),(350),(351),(352),(353),(354),(355),(356),(357),(358),(359),(360),(361),(362),(363),(364),(365),(366),(367),(368),(369),(370),(371),(372),(373),(374),(375),(376),(377),(378),(379),(380),(381),(382),(383),(384),(385),(386),(387),(388),(389),(390),(391),(392),(393),(394),(395),(396),(397),(398),(399),(400),(401),(402),(403),(404),(405),(406),(407),(408),(409),(410),(411),(412),(413),(414),(415),(416),(417),(418),(419),(420),(421),(422),(423),(424),(425),(426),(427),(428),(429),(430),(431),(432),(433),(434),(435),(436),(437),(438),(439),(440),(441),(442),(443),(444),(445),(446),(447),(448),(449),(450),(451),(452),(453),(454),(455),(456),(457),(458),(459),(460),(461),(462),(463),(464),(465),(466),(467),(468),(469),(470),(471),(472),(473),(474),(475),(476),(477),(478),(479),(480),(481),(482),(483),(484),(485),(486),(487),(488),(489),(490),(491),(492),(493),(494),(495),(496),(497),(498),(499),(500),(501),(502),(503),(504),(505),(506),(507),(508),(509),(510),(511),(512),(513),(514),(515),(516): Identity of nucleotide sequences at the above locations are unknown.
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctacatgcaaaatgtaa

SEQ ID NO: 2337 - DNA, 540 bp, B.fragilis
  unsure (1),(2),(3),(4),(5),(6),(7),(8),(9),(10),(11),(12),(13),(14),(15),(16),(17),(18),(19),(20),(21),(22),(23),(24),(25),(26),(27),(28),(29),(30),(31),(32),(33),(34),(35),(36),(37),(38),(39),(40),(41),(42),(43),(44),(45),(46),(47),(48),(49),(50),(51),(52),(53),(54),(55),(56),(57),(58),(59),(60),(61),(62),(63),(64),(65),(66),(67),(68),(69),(70),(71),(72),(73),(74),(75),(76),(77),(78),(79),(80),(81),(82),(83),(84),(85),(86),(87),(88),(89),(90),(91),(92),(93),(94),(95),(96),(97),(98),(99),(100),(101),(102),(103),(104),(105),(106),(107),(108),(109),(110),(111),(112),(113),(114),(115),(116),(117),(118),(119),(120),(121),(122),(123),(124),(125),(126),(127),(128),(129),(130),(131),(132),(133),(134),(135),(136),(137),(138),(139),(140),(141),(142),(143),(144),(145),(146),(147),(148),(149),(150),(151),(152),(153),(154),(155),(156),(157),(158),(159),(160),(161),(162),(163),(164),(165),(166),(167),(168),(169),(170),(171),(172),(173),(174),(175),(176),(177),(178),(179),(180),(181),(182),(183),(184),(185),(186),(187),(188),(189),(190),(191),(192),(193),(194),(195),(196),(197),(198),(199),(200),(201),(202),(203),(204),(205),(206),(207),(208),(209),(210),(211),(212),(213),(214),(215),(216),(217),(218),(219),(220),(221),(222),(223),(224),(225),(226),(227),(228),(229),(230),(231),(232),(233),(234),(235),(236),(237),(238),(239),(240),(241),(242),(243),(244),(245),(246),(247),(248),(249),(250),(251),(252),(253),(254),(255),(256),(257),(258),(259),(260),(261),(262),(263),(264),(265),(266),(267),(268),(269),(270),(271),(272),(273),(274),(275),(276),(277),(278),(279),(280),(281),(282),(283),(284),(285),(286),(287),(288),(289),(290),(291),(292),(293),(294),(295),(296),(297),(298),(299),(300),(301),(302),(303),(304),(305),(306),(307),(308),(309),(310),(311),(312),(313),(314),(315),(316),(317),(318),(319),(320),(321),(322),(323),(324),(325),(326),(327),(328),(329),(330),(331),(332),(333),(334),(335),(336),(337),(338),(339),(340),(341),(342),(343),(344),(345),(346),(347),(348),(349),(350),(351),(352),(353),(354),(355),(356),(357),(358),(359),(360),(361),(362),(363),(364),(365),(366),(367),(368),(369),(370),(371),(372),(373),(374),(375),(376),(377),(378),(379),(380),(381),(382),(383),(384),(385),(386),(387),(388),(389),(390),(391),(392),(393),(394),(395),(396),(397),(398),(399),(400),(401),(402),(403),(404),(405),(406),(407),(408),(409),(410),(411),(412),(413),(414),(415),(416),(417),(418),(419),(420),(421),(422),(423),(424),(425),(426),(427),(428),(429),(430),(431),(432),(433),(434),(435),(436),(437),(438),(439),(440),(441),(442),(443),(444),(445),(446),(447),(448),(449),(450),(451),(452),(453),(454),(455),(456),(457),(458),(459),(460),(461),(462),(463),(464),(465),(466),(467),(468),(469),(470),(471),(472),(473),(474),(475),(476),(477),(478),(479),(480),(481),(482),(483),(484),(485),(486),(487),(488),(489),(490),(491),(492),(493),(494),(495),(496),(497),(498),(499),(500),(501),(502),(503),(504),(505),(506),(507),(508),(509),(510),(511),(512),(513),(514),(515),(516): Identity of nucleotide sequences at the above locations are unknown.
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctacatgcaaaatgtaaatga

SEQ ID NO: 2338 - DNA, 567 bp, B.fragilis
  unsure (1),(2),(3),(4),(5),(6),(7),(8),(9),(10),(11),(12),(13),(14),(15),(16),(17),(18),(19),(20),(21),(22),(23),(24),(25),(26),(27),(28),(29),(30),(31),(32),(33),(34),(35),(36),(37),(38),(39),(40),(41),(42),(43),(44),(45),(46),(47),(48),(49),(50),(51),(52),(53),(54),(55),(56),(57),(58),(59),(60),(61),(62),(63),(64),(65),(66),(67),(68),(69),(70),(71),(72),(73),(74),(75),(76),(77),(78),(79),(80),(81),(82),(83),(84),(85),(86),(87),(88),(89),(90),(91),(92),(93),(94),(95),(96),(97),(98),(99),(100),(101),(102),(103),(104),(105),(106),(107),(108),(109),(110),(111),(112),(113),(114),(115),(116),(117),(118),(119),(120),(121),(122),(123),(124),(125),(126),(127),(128),(129),(130),(131),(132),(133),(134),(135),(136),(137),(138),(139),(140),(141),(142),(143),(144),(145),(146),(147),(148),(149),(150),(151),(152),(153),(154),(155),(156),(157),(158),(159),(160),(161),(162),(163),(164),(165),(166),(167),(168),(169),(170),(171),(172),(173),(174),(175),(176),(177),(178),(179),(180),(181),(182),(183),(184),(185),(186),(187),(188),(189),(190),(191),(192),(193),(194),(195),(196),(197),(198),(199),(200),(201),(202),(203),(204),(205),(206),(207),(208),(209),(210),(211),(212),(213),(214),(215),(216),(217),(218),(219),(220),(221),(222),(223),(224),(225),(226),(227),(228),(229),(230),(231),(232),(233),(234),(235),(236),(237),(238),(239),(240),(241),(242),(243),(244),(245),(246),(247),(248),(249),(250),(251),(252),(253),(254),(255),(256),(257),(258),(259),(260),(261),(262),(263),(264),(265),(266),(267),(268),(269),(270),(271),(272),(273),(274),(275),(276),(277),(278),(279),(280),(281),(282),(283),(284),(285),(286),(287),(288),(289),(290),(291),(292),(293),(294),(295),(296),(297),(298),(299),(300),(301),(302),(303),(304),(305),(306),(307),(308),(309),(310),(311),(312),(313),(314),(315),(316),(317),(318),(319),(320),(321),(322),(323),(324),(325),(326),(327),(328),(329),(330),(331),(332),(333),(334),(335),(336),(337),(338),(339),(340),(341),(342),(343),(344),(345),(346),(347),(348),(349),(350),(351),(352),(353),(354),(355),(356),(357),(358),(359),(360),(361),(362),(363),(364),(365),(366),(367),(368),(369),(370),(371),(372),(373),(374),(375),(376),(377),(378),(379),(380),(381),(382),(383),(384),(385),(386),(387),(388),(389),(390),(391),(392),(393),(394),(395),(396),(397),(398),(399),(400),(401),(402),(403),(404),(405),(406),(407),(408),(409),(410),(411),(412),(413),(414),(415),(416),(417),(418),(419),(420),(421),(422),(423),(424),(425),(426),(427),(428),(429),(430),(431),(432),(433),(434),(435),(436),(437),(438),(439),(440),(441),(442),(443),(444),(445),(446),(447),(448),(449),(450),(451),(452),(453),(454),(455),(456),(457),(458),(459),(460),(461),(462),(463),(464),(465),(466),(467),(468),(469),(470),(471),(472),(473),(474),(475),(476),(477),(478),(479),(480),(481),(482),(483),(484),(485),(486),(487),(488),(489),(490),(491),(492),(493),(494),(495),(496),(497),(498),(499),(500),(501),(502),(503),(504),(505),(506),(507),(508),(509),(510),(511),(512),(513),(514),(515): Identity of nucleotide sequences at the above locations are unknown.
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctacatgcaaaatgtaaatgatttaattggctgtttattaaatacataa

SEQ ID NO: 2339 - DNA, 312 bp, B.fragilis
  unsure (241),(256),(257),(258),(259),(260),(261),(262),(263),(265),(266),(267),(268),(279),(292),(293),(296),(297),(298),(301),(302),(304): Identity of nucleotide sequences at the above locations are unknown.
agcaataacatggacaatcggacagagcagtattcacttcgggaactgttagaaagcatcacagaaaatattaaaaccaagcgcctggctgacgtttttcgcttcatttcattccatcccggtgagatgtatggaccacatcagcatttacgtatcgaaataaattatgtgaaaaagggaagctgcattctccatccggatcatgagagtatcagtcttcaccacggggctggaaggatcngcggagcgttcgtannnnnnnngnnnngtaccaacggnggctcagatattnntannnaanncngggctccc

SEQ ID NO: 2340 - DNA, 294 bp, B.fragilis
tccggaaaatcaaaagatatggatcaactgaaaaccatcaaagagcttatcaatcaaggagatatagaaaatgcgcttcaagcacttgaagaatttctccagactgaacccgtcggtaaagacgaagcttactatctgatgggaaatgcttaccgcaagttaggagactggcaaaaagccctcaataattatcaatccgccattgaactcaatcccgacagcccggctctccaggcacgcaaaatggtgatggatatattgaacttctacaataaagatatgtataatcaataa

SEQ ID NO: 2341 - DNA, 846 bp, B.fragilis
gaaacaaggtcgttaaagcgtaataaaatggaacataaatacttatttgtcgctgttgatgcagccctgaaggcgggggaggagatattgtctatttataccgatccggcttcggacttcgaaatagagcggaaagcggatcactctcctttgactattgctgaccggaaagcacacgtaacaattgccaccattctggacgaaactccttttcccgtactgagcgaagaggggaaacatttagagtataatacccgtcgcaattgggatgtgatgtggattgtcgatccattggatggtacgaaagagtttatcaagcgaaacggtgagtttacggtaaatattgcgttagtgaaagccggagttcccattatcggagtgatttatttaccggtcaaaaaagaactttactttgccggtcaggaaatcggtgcctacaagctgtcgggcattacgactttagaagacgatgcaacactcgataagctggtagctgcttccgtacggttgccgcaagacctgcagcgggaccgatttgtagtagtggcttcccgttcacacctgactccggagaccgaagcgtacattgatgcggtgaagcaaaaacacaaacatgtcgagttgatttccagcggcagttctattaaaatatgtttggttgccgaaggtaaagcggatgtttatccccgttttgctcctacgatggagtgggatactgctgccgggcatgccattgcgcgtgctgcgggaatggaaatttatcaggcggataaaaaagatgttcctttgcagtataataaagaagatttgctgaatccctggtttattgttgagaagagaaggtaa

SEQ ID NO: 2342 - DNA, 480 bp, B.fragilis
cttttttctcctcaaggaggcggttcatctccgttatcttcaccacagcaatcaggctctttgcctaaacctgaagaagtcattaaggatgcaactgtaaaaaaggctttggaagaagcctggagtgatatgcttaagcgttccacagaggtccaaagacaagaagttggtttctggatttattatgatccggtgaaaaagcaatattacataggtaagaaacgatatggtatggcagtgaagaatgacggaaaagcaagaggaaatataagccttggagacaaatctccttctataaatggtgtgcctgccacagcaaaagtggttgcttcttttcatacacacactccaatgactgaaataaaaggtaagaaaagaaaggcaggtccatctaaagaagataaagaaaatgccgataaaaataaaatacctattgatatattagttttccgttgcattttagaaattgtaatttattaa

SEQ ID NO: 2343 - DNA, 1569 bp, B.fragilis
ttgtttgcgtttatgacatttgaaattgcatttgtgctgttatccttattagggatggtaattgctttgatcttggacaaaatgcgtcccggcatgatacttttctctgtagtggtgttgtttctctgtgcgggtattttgactccgaaggaaatgctcgaaggattcagtaataaagggatgataaccgtggccctgctttttttggtcagtgaaggtatcaggcagtcgggagcgttggggcaggttgtcaagaagttgcttcctcagaaacggacgacggtcttccgggcacaattacgcttattgcctgcggtcgcttttatttccgcttttctgaacaatactccggtagttgtcatttttgccccgattattaaacgatgggcacggacagtccatttacctgccactaaatttctaattcctctttcgtacgtaactatattgggaggtatctgcactttgatcggtacatctaccaacctagttgtgcatggaatgatattggaatccggtcatgaaggatttaccatgttcgaattgggcaaagtgggtctctttattgcaatagccggtattatttatctgtttgctttttctaagaaactgcttccggatgcacgccccgatacagctgtgcccgatgaagaagtagaagaaggcgataagcttcaccgcgtggaggcagtacttggtgcccgtttcccgggtatcaacaaaactttgggagagtttaattttaaacgtcactatggtgccgaagttaaagaaataaagaaacgtaacggacagcggttcatcaacaaccttgaagaagtgatcttgcgtgaaggagatacgttggtggtaatggcggatgacacgttcatacccacttggggagaatcttccgtgtttgtgctgttggctaacggaaatgataatgaaccgataccgggaaaaggaaaacgttggtttgcattgattctgctgatcctgatgattgccggtgctactatcggtgagcttccggtagtgaaagaaatgtttccggacatgaagttggatatgttcttctttgtttctgtcactaccattatcatggcttggactaaaatttttccggcacgtaaatacactaaatatatttcctgggatatattgattacgatcgcttgtgcttttgctatcagtaaagcaatggtaaattcgggtgtggccgataaggttgcaggatttataatcggcatgagccatgactatggcccacatgtattactggcagttttatttattatcaccaatttgtttacggagctgataacaaacaatgccgctgctgcattggcttttccgttggctctgtcgctttcggtccagttgggtgtcgaccctacaccgttctttgtggtcatttgtatggctgcatctgccagtttttctacaccgatcggttatcagacaaatttaatagtacagggtatcggcaactataagtttatggattttgtcaggatcggattgccattaaatcttataacattcctgatttccatatttctgatccctttaatctggccgttttag

SEQ ID NO: 2344 - DNA, 501 bp, B.fragilis
gaagaccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 2345 - DNA, 819 bp, B.fragilis
agaatgtatacagtaaatttaaaacgaatcttcatagtatcgctatttatagctataccctttatgctttcggctcaattgacctacggtactacaggattgctgcatgctccctcggcagaaatgcagaaggacaaaacagtcatgctgggtgcaaactttatgaataaggagataactcctccaacgtggtactaccacacgtacaattactacctgaatgtaaccattttaccttggatggaagtagcatatacctgtactttatttaaggcggaagctcttggattaaaaccttatggttactcaggctttacgaatcaggaccggtatttttctctcagattacgggcactgaaagaagggcaattctggaaatacatgcccgctgttgtagtaggcacttccgatccttttacctcgtccggcaatggagttgtggctccgacggaaggtaacggatacttcagtcgtttctacatcgcagccaccaggcatgtccaattaggaagagagacagtgggagtacacctctcctatctttataacaaaaggatagagtacaaactgaatgggatcgcggcaggtatcagttataacccgtctttccatccgcaattgagattaattgccgaatatgattcgaaagattttgcattaggtgccacctatttgcttttcaaccatttgcatgcacaagtggaactccaaagaatgaaatatttcacaggtggattgactttccagttccgcttgtccggaaaagatggaatgaaaaagcagaaacgaaacaaagagttaaaacaaaaaatgaaataa

SEQ ID NO: 2346 - DNA, 1176 bp, B.fragilis
ctttttaataccaaaacgatcatggatatagaacacgtaagaagtcgcttcatcaaacattttgatggaactacaggatttgtatatgcctctccgggccgtatcaacctaattggtgagcacaccgactacaatggcggatttgttttcccgggagctatcgataaaggtatgatcgccgaaatcaagcctaacggcacagataaagtaaacgcttactctatcgacctgaaagattatgtaactttcggattgaacgaagaagatgctccacgcgccagctgggcaagatatatattcggtgtgtgccgcgaaatgatcaaacgtggcgttgacgtgaaaggattcaataccgctttctccggagatgtgccattgggtgccggaatgtcttcatcggctgctttggaaagtacttatgcctttgcgctgaatgacctgtttggtgaaaacaaaatagacaaattcgaattagctaaaatcggtcaggctacagaacacaactattgcggtgtgaactgtggtattatggaccagttcgcttctgtattcggtaaagaaggtagcctgattcgtttggattgccgctctttggaataccagtacttcccgttcaaaccggaaggttatcgtctggtattgctggattcggtcgttaaacatgaattggcttcatcggcatacaacaaacgtcgtcagagctgcgaggctgctgtggctgccatccagaaaaaacatccacatgtagaattcctgcgtgactgtacaatggatatgctggcagaggcaaaagctgatatcagtgaagaagattacatgcgtgccgaatacgtaatcgaagaaattcagcgtgtactcgatgtatgtgatgccctggaaagaggagattacgaaacggtaggtcagaaaatgtacgaaactcatcatggcatgagcaaactttacgaagtaagctgcgaagaactcgacttcctgaacgactgcgctaaagagtgtggcgtaaccggttcacgcgttatgggcggcggcttcggcggttgtactatcaacctggtgaaagacgaattgtatgacaacttcatcgagaaagctaaagaatcattcaaagctaaattcggcagaagcccgaaagtgtatgatgtagttatcagtgacggttcaagaagactggtataa

SEQ ID NO: 2347 - DNA, 1131 bp, B.fragilis
aaacaaaaaacaatgaaaagtaaattagtaatattatctttattgttggccggtgctactgcagctactgctcagactaaagagacgttctacagcgaaagcttcaaggacaatatctttgtgagtgtaggtgttggcgctcagggttgtgtaaacccggacaactttgattatggctttggtaaagccataactccgctgatcaatgtgtcagttggtaaactgttcaatccggtttggggtatccgtggtcaggtagccggtgcatggactactttgtattctaactatggacagcctgccgatacttatattaagagcaagaataaacattacttcactatgcgtgcagacggtatgtttaacttgtccaatgctattggcggttacaacccggatcgtttgttcaccgtttctgtttttgctggtcccggtttgacatttgccaaagcttatggcgatcaggataaagtaaatgcgttgattaacggttctgttggtttggctggacagttcaatatcaacaaatacttggatatcaacattgaagcaagaggagaagtttctccgtctccgtttggtaatatcagctctgcccataccgacggtgctgtttctctgactgccggtgtgacttacactttcggtggcaagagatttgtttcttgtggctctcaggtagatcagaacgctatcaacgaagagttgaatcgttacagaagcgagttggctaaagctcagtctgacctggctgatgctaagaacgcactggctaacgtgaaacctgtaaccaaagaagtggtgaaggaaatcgaagtagccggacctcgcgctatcttcttccagattggtaaatctaagatcgatgactatggtatggttaacatccagctggctgccaagatcttgaaggctaatccggataagaaatacaaggtggcaggttatgcagataaggctaccggtagcgctaagtggaaccagaaactgtctgaagctcgtgcacaggctgtttatgatgcacttatcaaagaaggtgtaagtaaggatcagcttgaactcgtcggcttcggtggtactgccaatatgtttggcaagaacttcctgaaccgcgttgtgattctggaataa

SEQ ID NO: 2348 - DNA, 843 bp, B.fragilis
actaacttggccgccatgaaatctaactggaaacctaagtatctgaaatacgttgtattgggactgatatcagccctcgttgtcacctgctggccccgcaaagaaaagccccaaggacatccgcgggattatgccgagatcaaagaaagcggcattcttcatgctgcaacagaatacaactccatcagcttctatgtggatggagatacggtttcgggattccattacgaactgatagaggcgtttgcgcgcgacaaaggtttacaggtacaggtctctccggtgatgagcttcaatcaacggctggaagggctggccgacggaacgtatgatgtagtggcttatggcataccggctacgagtgaactgaaagactcgctgctcctcacctcccccatcattttaagcaaacaagtcctggtgcaacgcaaagtcggagaaaacgattcacttgccatcagaagccaactcgacctggcaggcaaaacattgaatgtcgtcaaaggatctccctccatcctgcgtatccgcaacctgagcaatgaaataggcgatacgatctatgttaacgaaatagagaaatatggttccgagcaactgatcgcaatggttgctcacggagacatcgattatgccgtatgtgacgagggcatcgcccggatggctgtggactcgctaccccagctcgatatcaataccgccatcagtttcacgcaattctattcatggggagtcagcaagcaatctcccgccctactcgacagcctgaatacatggctatccgacttccgaaaaaaaggagaataccagtccgtttatcgcaaatattacgggaaacaataa

SEQ ID NO: 2349 - DNA, 273 bp, B.fragilis
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctgctcgtatcatcctacccttcgtacatgcagctctga

SEQ ID NO: 2350 - DNA, 195 bp, B.fragilis
aaaaatctttttggtaatttcgggagtgacggatgttgtctcccggtaaagaaggtatcctgtgaaggatgccttcttttttgtttcaccacttgggtagatacactttttattgataacattaaaacaggttctcaaaatattatgtatctttgcggcatgacaaatactcttagatcggatttggttttgtaa

SEQ ID NO: 2351 - DNA, 1095 bp, B.fragilis
atttttaattttattgagatgaaaatgaaaagtaaatttttcggtaatggcgctaagttagcgttagccgttttggcagtttgcggtacactgtttacaagctgctatgagaaagcagaagttgatcaagcaacaaaaccagctgaagcaaagtattatattgctggtacgattactgatgcgactacaggccaggaattgactactgctaaagttacattgggtgataaatctgtcactagctcttttaacgagcaagttaattacaaggcagaaggttatgctttagtcgtttcagcagacggatactatcctgttaaaagacaagtttatctgaatcaggtaagtgatggtcagacaagtgttgctactgttaatgttgcattggtttcagttgaagccgcagttattcctccggtagttcctccgacagatcctgagactgacatcaatgaaggagaagcaactaaggttgcggacaaggcggtagaagtagctaaaccttctgaatcaactgtaaccgatatgcttgctggtactacagctacacccgaagagaaaaaagcattggatgagactcttgaaatggcaggaggaatgaaagttggtgaaactactcctgaagttcttgctgatggttctattcttgctattactccggtgaaatttacgaatcctattcaggatgctccggctatggttccttatttctataatgaaggttgtgaactaacaggtgatgtaaaagaagttgctgctcctgtaacaagagctgatggtgctgttgcagctgatattcagaaagcattcttatcaaacgctgctaaggctctgaacatgaatgcagggtttgttcagaagatcggttatactcggattagtgtattgaatggttatagcatcttgggttatacaattaaaggacaattggtttctaagaaactgacattcttgatctctggcaaatattatgaaggtatcgtttcttatcagaagagcgtaatgatctatcctaactattacagccacgattctcatgattctcatgattctcacggtttcaacccgaatgccggtggtggatctaacgactaa

SEQ ID NO: 2352 - DNA, 1569 bp, B.fragilis
atttttaattttattgagatgaaaatgaaaagtaaacttttcggtaatggcgctaagttagcgctaaccctgttggcaatgtgcggtatgttcgcaagttgctacgaaaaagacgagattgatgttcccaaagtgaccgaccctacagctacgacgtaccaagtagcaggtattgttacagatgctgaaagcaatgctgtaatggacggtgtcacagtaaccaatgtcacaaactcaaagtcaatgactaccgcagcagacggtaagtatgttctggaagctaaagtgggagaaaccaacgtagtaacttttgcaaagagcggttataaaacagtgacaagctcggtattcgttactaaacaggaaaacggttctatcgtagcctataccatcgacgctaaaatggaaaaaggcaaagaaacaaaaccgacaaaagatgtagaatatcaaattgaaggttctgtatttgatgcggaaagcggtgagcctgtagctatcaaaaccgcaactatgccaggcatattgacagcaaccattcagaatggtaacgaattcactatgtccaatgtaggtctgggtcagcacactatatatatcactgctgacggatacaaaccggctactgccgacgttgtgatcagtgaagtagccgggccggaaggtgaaggtattttcattgcaaaaacttcggtaactgttgctatgcagaaaaaagaagtagaggttgcccctaaatactatttggcaggaaatatctacaatcaggatggtggcatggttactaaggctgaagtaacactgaacatgtcaggatacgaagtaacaactactgcttccaacggtttctacaaattcgagattcctgccgacaaagtaaaaggtctgactaaagcaactgtaacaatccgtcataacagctataagatttatgtatatactgcatttatagcaccggtagacaatggccaagtatctaacaccacagtcaatgtaactctgatactgaaaccggatacagaaaaaccgaatgatgacgataatgtatttatcggtggcaatgtagagattgaagttccaacagagaatgctgttgaagccgcaccggaaaaagcagaaggtgaaaaagttccaagtaaatctgctgtagaagaatcaattaacaaggttttggaagctgctggatcggacatcaagattactccggcacaagcagaacaggtggttaacactatggaaaaatatgtagccaacggtactttgacagaaatcgataaggtagcagttcttccgatcgagaaagaaacgaccttcaaactggaatctaaagtaattgatactaataatgataaagaagaaaccgttattgacgaaatcgttcttcgggctaacactataatcatttttacaagtggcgtagcaagcaccctgaacatcagccgtactgacgaagttaaagaaggtgctttctgtcgtgaatacgacggtactccaaccggaactagttttcgtaactccgatggaagtgaaatttactcctgctgttgtcgtagctcaaggagaaactcctga

SEQ ID NO: 2353 - DNA, 192 bp, B.fragilis
tcaaataactacagtacgatgaatcccgataaaataagaaacgtattgaacatactgtttatgatattggctctggcagctattatcacctacttcgttgcgaaggacgactttaaggtgtttatctacgtatgcggcgcggcaatttttgtcaagctgatggagttttttatacggttcaccaacagataa

SEQ ID NO: 2354 - DNA, 396 bp, B.fragilis
ctaaatgaacaagatcaaaacagagctatcatgtttacagacgataaaagcattgaaaatatccagcagctgtttgctgagttcaagaagttccttgtactccagaaagaatataccaaactggaattaacggaaaagttaactatactcttatccacgttaataatgattttagtgctcactatcttaggtatggtagccctgttttatctgctttttgccctggcttatattcttgagccgttagtaggcggtttgatggtaagtttcggcatcatagcaggcatcaatgttttattgattgccatcatttattttttccgcaggcaacttatcatttcgccgatggtaaatttccttgcaaacctatttctcaacgactccaataaaaaatga

SEQ ID NO: 2355 - DNA, 312 bp, B.fragilis
atttccttgcaaacctatttctcaacgactccaataaaaaatgaagcaatgaacaacagcacacctactccaaagaaaattacgctggaagacattgctcagcgtaaacaagaagtgttgcaggaaatctgtgaccagaaacaagccatggcggataccacccgccgaattttcgccccccttgcacctgccgcctccggtggtaatgcgttaatgcgctctttcagtaccggtatggccatttttgacggtgtcatgctgggtatgaaaatgatccgtaaagttcgcggactcttccgaaaaagatattaa

SEQ ID NO: 2356 - DNA, 252 bp, B.fragilis; identical to SEQ ID NO: 860

SEQ ID NO: 2357 - DNA, 918 bp, B.fragilis
aaaaaaactaaacattataagaatatgaaacacatttatttattactgtttatgctgatcccgatgacgggaatggctcaagaaggcatttcgcaagacacgactctttacgtcaacggacgcaaaatcctgattaaagaaaacgaagggaaaataaaggtaaaactttacgaacagtcttcgcacggcgatacgatagagaacgatcagatttttgagggaatctatacggacggacaaactaccgaacgccgcacggcattcactgtccccttcgtcaaaagaaagaaccattatcggttcgacccgcatattgccggattctatatgggatacacacggctctctgacggcatcaacttcaatactccggacggactgaatataaacgccaacaagtcctgggaaatcggtttcaatctgtttcaaggctccctgacactctcacgtgatcgccaatggggcataacaaccggtttaggctggggataccgctctttccgcctgggcaacaactatgccttcagacaaatagatggagtcaccggcattgttccgggtgttcccgacgaggaagtgtataccaaaagccggttacgctatttctacttccgcattccggtagccctggaatggcaaaaaagattcagccacagcaatgctcacggtcctctattcttttcagccggacttgaagcggaaatccgtcatggagccaagtcgaaagcaaaggtcaacggacataaaaagaatctggacagcggcctgaatgtccacccggtaggcattaacctcctagcacaagcaggttacggtgacatcggagtgtatttgcgctactctacctacagcctcttcgaacacaaaaaaggtcccgaactttatccctactctttcggtctgtgctggtattggtaa

SEQ ID NO: 2358 - DNA, 1383 bp, B.fragilis
aaaataaataaggaaataactaacctcatttttataactaacaactttttaaaaaccatgacacaacaaaaaaagaattatgtgttgcctattgcaatgatgtttgcgctttttgcaatgatttcattcgtaacaggacttactaacccgctcggacttattgtaaaagagcaattccaggctgccaactggatgacgcagctgggtaatgcagccaacttcatagcttatgcctttatgggactcccggcaggtatgatgctcaaaagaatcggttacaaaaagacagcccttactgccgtagcagtaggatttatcggagtcggcattcaggtgctttcgggacagatggactaccagcccggtgaactgactgtattttggatctatctgacaggtgcttttgtttcaggtttctctatgtgtatgttgaatgcagtagtaaacccattgctgaatacacttgcaggtggcggtaagaaaggtaatcaattaattcagttcggtggttctctgaactctatttcagctacaatcgttccggtattgggtggttacctgatcggtactatcagccaggacacacgtatcagtgacgctaatccggcattgttcattgctatgggtatctttgctgtcgtattcatcgtgttggctatcatggacatccccgaacctcacaaagaaagcgccagtgatcataaagtaaaagacactcacagcccgctttcattccgtcacttcgttttgggaacagttgccattttcgtatacgtaggtgtggaagtaggtattcctaactttatcaacctgttcctgactacttcacctgatgcagccggtgccaaaggtttcggtatggatacagctatggcaggttcaatcgtaggtacttactggttcctgatgatgatcggtcgtctgtgcggtggcgctttgggagctaaattctcaagtaaaactcagttgacagtcgtttcttcactggctttgatcttcttgctgatcggtatgtttgcccccagcgcaacaacagtagctatgcctgtatttaaaggaggtgccagcatcggtttcggtatggaaacagtacctgtaggaatcatgttcttcgcactttgcggactctgtacatctatcatgtggggtggtatcttcaaccttgcagtagaaggactgggtaaatatacggcaatggcttccggtatcttcatggtaatggtttgcggtggtggtatcctgccgttgattcagggtgcagtagccgacgtgaccagcagctacattgcaagttactgggtaatcttcgctgccgtagcatacatgctgtactatgcacttgtaggttgcaagaatgtaaataaggatattcctgttgaataa

SEQ ID NO: 2359 - DNA, 252 bp, B.fragilis
ccggattccaatatcattccatgcacaactaggttggtagatgtaccgatcaaagtgcagatacctcccaatatagttacgtacgaaagaggaattagaaatttagtggcaggtaaatggactgtccgtgcccatcgtttaataatcggggcaaaaatgacaactaccggagtattgttcagaaaagcggaaataaaagcgaccgcaggcaataagcgtaattgtgcccggaagaccgtcgtccgtttctga

SEQ ID NO: 2360 - DNA, 840 bp, B.fragilis
tctgcatgcaatgctgaaagtattactatgcttttcgtgtatgcgaaatatattaagataatgagtaacgaaaataaaacaattcacgatttcgaacttaatttaatctgcgattttttttccaatatggaacgacagggtcccggaagtcctgaggtaacattgaaagcattgagttttatagataatctcactgaaaaatcccttatcgccgatatcggctgtggaaccggaggtcagaccatggtattggccggtcatgtgacggggcaggttacaggactcgattttctttccggctttattgatattttcaatcgtaatgcaagacagtcgggcttgcaaaacagggtgacaggcattgtcggttccatggatgatcttcctttccgaaatgaagagttagacctgatttggtcggaaggggctatctataatattggttttgaacggggattgaatgaatggcgtaagtatttgaagaaaggagggtatcttgcagtttctgaatgttcatggtttacggacgaacgtccggcggaaatcaatgacttctggatggatgcatatcccgaaatcgatacgattcctaatcaagtagccaaaattcacaaggcaggctatcttcctgtcgctacatttattctgcctgaaaattgttggacagatcattactttacccccaaagttgcagctcagaagatttttttaactaaatatgccggaaataaaattgctgaggaatttagtatgcttcaatccattgaagaagaactgtaccataagtataaagagtattatggctatacattttttattgcaaaaaagatagggctgtaa

SEQ ID NO: 2361 - DNA, 1191 bp, B.fragilis
actttcctaaatcgccgaacagatttacaaagaataatttgggagaacgaaagaatttccctttatttgcaagaaattttaataataccagacatgattaacacattcccaactgaaggaaatctgtcagggctcagccggaaagattttcaaaaggatataaacgataagaaaaccgatttgtttatcctcaaaaacaagaaaggaatggaagttgccgtaacaaactacggatgcgccattctatctatcatggttccggataaagacggaaaatatgccaatgtcgtactcagctatggtacactggatgcactgatgcacggaccggaacctttcttaagtaccactatcggacgttatggcaatcgcatcgccaaaggtaaattcaccctgtatggcgaagaacatagtctcacgatcaacaacggtcccaactcacttcatggtggccccaccggatttcacgccagagtatgggatgccgagcaacttgaagaaggggtgatccgattcaactatacttccgctgacggagaagagggcttccccggtaatctggaagttgaaatgacttatcgccttgaagaagaagagaatgctattgtcatcgaataccgtgccactacagacaaagcaacagtcgtaaacctgaccaatcacggtttcttcaacctggcaggaacagccaatcctactccgactgtagaaaataacatcgtcacaatcaacgcagatttttatactccgatcgatgaagtatccatcccgacaggagaaatagccaaagtggaaggaactccgatggatttccgtaccccacatactgttggcgaacgaattaatgacaaattccagcaacttatatacggtgccggctatgaccattgctatgtattgaacaaggcagaaacaggttctctcgacctggcagctacctgcaaagagcccaacagcggacgcaccatggaggtatataccacagaagccggcgtacaattatacacaggcaactggctgggcggcttcgaaggaacaaacggagctactttccccgcacgaagcgctatctgcttcgaagctcaatgcttccccgacacaccgaataaagcacacttcccgtcggctactttactgccgggcgatgaataccagcaggtaaccatctataaattcggagttgaaaaataa

SEQ ID NO: 2362 - DNA, 522 bp, B.fragilis
atggaactaaaacaattcaaaatagccgttcttccactccgcgacaaactgcttagttatgcgcggaagttgacagatgaccactcggatgccgaagatgccgtgcaggaagtgatgctgaagttatggaaacttcgtccgaaactggacgaataccatagcattgaggcccttgccatgactatgacccatcatacctgcatggatatcctcagagggaaacatcccgacaacctatcgctcgacagcgtacaggctgccagtccggtcgccacccccgaacgcttgcttgaagagaaagacgaattcagcctgatgcgacatatcatcagtacacttccacctctgcaacagaccatcctccggatgaaagatgtagaagagtacgaaaccgaagaaatcgccgagataacaggatgcagctccgaagccatccgcagcaatttatccagggcacggaaaaaagtaagagacatttacctgcaaaccatacaacaaagaaaaaggagaaacgaagcatga

SEQ ID NO: 2363 - DNA, 630 bp, B.fragilis
cgactcataaatctacccttaatcgtgtattggatgatagttgcggattttaggatagagaaattattaaagtgtcacctaataaataacaacattatgaaaaaattattattattatctgtattatcaatttttatgattgcctgccaccaaccagatactccaccatattcatacagtatgaatatagatatgcaaatcatctcttctttggagactacctatcctcttgataacttagaaacagttattattaactctagattagaactcgcttcgtcaagttatcgaataaagaccttgatcagttctaatgacttacaagagagttggcttgaacgtccaatcgttatgctgggaagagaaggacatagatatttgtctttaccaataacttttaatgaagagaaagatagatataatgtgaaaattgaattttattgtccagaaatttttaaagacgataaataccacacaataaatatcgtttattcgattgttaaagggaagtatttatataatttagaatcttttacattagattcatatgcaggagaaatagagaatcagggagagaataatgctcctattattgtattctctatcaacacagccgaaaaaaaagagtaa

SEQ ID NO: 2364 - DNA, 1443 bp, B.fragilis
tataagataaatagggaaatccctattattgtttggggaaaatctatccggcagcgtgaataccttgcttatctttgtaacgtgaataaaaagattaagaaaccaataaaccacggaaatatgaaaaagattgtgttattatcgctgtttgccctgtgcctcccactacttgtgatggcgcaaagcaataatgacgacctttatttcgtaccttctaaggaaaaaaagcaggaagccaaaaagactcctgtgaagaaggaaccggaaaaaaaagttgtcaccacgaacatttatacgtctccgggtactacggtagtagttcaggaccgtaaaggaaacaaacgcgatatgcgtgatgtggatgagtataaccgccgttacgatgtcaaagataacgagttcgcaatggaggacgatacattatacgtaaaagaaaaagctgtctccgatccggatggtgaatgggtgaacgggttcaatggctcacaggatgactacgagtacgctgaacgcatcattcgtttccgtaatccccgttttgcggtaagcattagcagcccgctttactgggacattgtttatggaaccaattcctgggattggaatgtttatacagacggtttctatgcttatgcattcccgacatttaccaaccgcttatggtgggattggcgttacaactcttatggttccggatggggctggggatggggctggtcttcaccttattatgcttggggtggctattatcccggttattggggtggctattggggtggttactggggcggctggtatggcggcggctactggggacaccatcatcactatcatcccggatggggtggcggaggacattattgggcgagtcataatacttataccaaccgccgttcttatggtccttctcgtgttagcacctcttccagagtaaacgcctcttctatacggcgtacagattcttatactcgttcaggtaataatatctctccttcgcgtggtggtgatagccgtatgaattatggctcacgtagagtaataagtgttcgagatacagaacgtcctgatgcaacaacccgcacggatgcttcttcatcaagaagatctacttatactcgtccaagtagtacacgtagtagctctagttataatagtaacgttcatccgaatcgttctacaaactctggaacatattcaagaagtactagtaggtcttcttctacttatactcgtggaagttcgacaacaacaccttctcgttcttattcaaatgaaggtacccgtcgttcttatggctcttcttcatcttctcgaagctattcctcaggtagttctactcgctctagtagtagttattcttccggtagcagaagtagtggtagcagttctcgttcgacaagtggtggaggtagctacagcagaagtagcggtggtcgaagataa

SEQ ID NO: 2365 - DNA, 201 bp, B.fragilis
aattattcaaaaccatcaataataactaatcataatccctaccacaatgaagaaaagtattattctgttattcatcagtttacttttatccccgctatgcataaaggcacatcaacccgaattctccactgccggatttttccggctggcagactccggacgagacgtctattccatgaatcctgcatggcgtttttataa

SEQ ID NO: 2366 - DNA, 231 bp, B.fragilis
attatggcaaaaatcaaaggagcaatcgtagtcgacacagagcgttgcaaagggtgcaacctgtgtgtggtagcttgtccgctcaacgtaatatccctcgccaaagaggtgaatgtgaaagggtataattatgcccagcagattcttgaagatacctgtaacggatgcagttcatgcgcaaccgtatgtccggacggatgtatctctgtttataaagtaaaagtagaataa

SEQ ID NO: 2367 - DNA, 450 bp, B.fragilis
cacattaaaaaggacatgaagaaaattggaatttgttgcgaccacgccggtttcgaattgaaagaatacgtaaggggctggctggaagcaaaaggttgggaatacaaagacttcggaacttactcgacagacagctgtgactatcccgattttgcccatccattggcactggctgttgaagccagcgaatgctatccgggaattgccatctgtggtagcggtaatggtatcagcatgacattaaacaaacatcagggtattcgtgccgcactctgctggacagcagaaatcgcacacatggcacgcctgcacaacgatgccaacgtattggttatgcccggccgttatatcagcacggaagaggcggatatgattatgacggaatttttctcgacagagtttgaaggcggacgccaccagaaacgcattgataaaattcctgtaaagtga

SEQ ID NO: 2368 - DNA, 501 bp, B.fragilis
attatgaaaaaattagtagtattagggatgggcgtatgcgttgccttggcatttgcttcatgtaaatccagcgaaagcgcttataaaaaggcatacgagaaagctaaacaacaggaattggctgagcctcaggtagaagctcccgtagaagttactccggtagttgctgctccggtagaaactaaaaaggctgttgataatgctgcaggcgttcgtcaggaaaaggtaacagttgtttcaggtgctgatggattgaaagattatagcgtagtatgcggtagcttcggtttgaaagcaaatgcagaaggtctgaaagattttctggacaaagaaggttataatgcaaccattgcttttaatgctgagacagctatgtatcgtgtgattgtaaatacatttgccgatagggcttctgctgcgcaggcacgtgatgctttcaaggctaaatatcctagtagaaaagacttccagggcgcctggttgttatatagaatctattaa

SEQ ID NO: 2369 - DNA, 1587 bp, B.fragilis
gatatgaaaaagataataatagtttctgcattagttcttttatggactgcaggagcaaatgctcaaactgcatatgatgctgcaaaattggttagcaaagatttaaatggaacagctcgttttgttggtatgggaggtgcaatgggagcattaggaggagatatatctactatggggacaaatccggctggcataggtatttatcgaagtaatgatgttatgacttcttttagtttttctacttatgggacggaaagtaaatatggtggaaagacatttgataataataataatcgatggtcttatgataacattggaattgtctttgcttctaaaataggtaatcacactccattacgttatgtgaattttgggtttaattatcatcgtgcaaaatctttctataaaaatatgtttatggagggcgctttgaattattcgcaaatcgattatatgactggacaagctaatgggatgttggccaatggcgtgagtcttaaggaactgtcagataataaattgaatccttatagtgataatggcgttggctggttaggtgctttaggctgggatgggcttttgttcgattttaagaatggtgagtatattggtgtcttgccacaaactccatattctacttttcgttcaagagaaaaagggggaattgatcagtatgattttaatatagcctttaatattagtgacagagtttatctgggactgacaattggagcttatgatgtagactatactaaatcatattactattcagaagactatggtgataaacagaactataatataggaagtatgaatcgcattagtggttccggttttgactttaagatgggagctattattcgtccgtttgaagattctccttttcggatcggtcttgcagtacatacacctactttttacagattgacgtatacaacaagtgcttatttggaatctaatatctggatgcataataatgatacaggaaaagatgaacttcttaatagttattttgacacttataaggagttgaaagatatgaatcaaaatcgggaatttcgtttaaaaactccctggaaatataatgtcagccttggatatactgttggacaaaatttagccatcggtgctgaatatgaatatgaagattattcttctgtgaagtttcgttatccagaaggtgataagatggaatttgagacgaatgcagcaaagatggttatgaagggagttaatacatttcgcattggtgccgaatataaagtaatccctcaatttgcttttcgtttaggatacaattatagttcatctatatttaagaatggtgctataaagtacttaccatataattctgttaatacagacactgattttgctaattctaaatcacttagcaattatactttaggtattggatatcgtgggactatgatttatgcagatctagcctataaattctcttcttataaagaagacttctatcctttctataatgagtttaatgatagaggcattgtaactcctaatgtaactaagataactaatacccgtagccaagtattatttactttaggtatgcgtttttaa

SEQ ID NO: 2370 - DNA, 1128 bp, B.fragilis
aataacatgaaaagtaaaatagcaatattgtctttactgttgacaggcgcagccgtctcagcctcagcgcagacaaaagagcattattatagcgaaaaagctaaagataatatctttatcagcgtgggtgtaggagcacagggatgtgtcaaccccgacaactttgattatggctttggacatgccataactccactgatacacgcatcagtcggtaaactgttcaaccctatttgggggatccgtggccaggtagccggatgttggagtacattatactccgaatatggaatgccggaaggcgaatacaagaagatgaagaataaaaaatacttcactctacgtgccgacggattgttcaacttgtcaaacgctatcggaggctataatcccgatcgcttgttcactgtatccgtatttgcaggtccgggacttacgtttgccaaggcctatggcaatcaagataaactgaatgcgttgattaatggttctgtcggtttgatgggacaattcaacatcaacaaatatttggatatcaatgtagaagcaagaggtgaagtctctccttctgtcttcggacattatagttctgctcgtaccgacggcgctgtttctctgacagcaggtgtgacttacacattcggtggcaagagattcgtttcttgcggtgcgcaggtagaccaaaacgctatcaacgaagagctgaatcgttacagaagtgaactgtcaaaagcgcaatcggacttagccgatgccaaaaacgcactggctaacgtaaaacctgtaacgaaagaagtggtgaaagaaatcgaagtagccggtcctcgcgcagtcttcttccagattggtaaatctaagatcgacgactatggtatggttaacatccaactggccgctaagatcttgaaagccaacccggataagaaatacaaaatagccggttatgcagataaggctacaggtagtgccaagtggaaccagaaactgtctgaggcccgtgctcaagccgtttatgacgctcttatcaaagaaggcgtaagcaaagatcaactggaactcgtcggttttggtggaacagccaacatgtttggcaagaacttcctgaaccgtgttgtaattttagaataa

SEQ ID NO: 2371 - DNA, 777 bp, B.fragilis
gaagaaatgaaaggtaaaatcgtttttataacgggagcaagcagtggcattggtgaaggatgtgcgcgtaagtttgcttcgcaaggttcggatttgattctgaatgcccgtaacgtggcaaaacttgaagagttgaaagtagaactggaagctaaatacggagtacgtatctgcctgttgccgtttgatgtacgtgatcggaatgcagcgaccatggcactggcttctttaccggaagagtggaaacgtattgatgtattggtgaacaatgccggtcttgtgattggtgtggataaagaatttgagggaaacctggacgaatgggatattgtgattgatactaatataaaagccttgttggctatgacgcgtatagtggttcccggaatggtggaacgcggacacgggcatatcattaatatcggttcgatagctggtgatgcggcttatcccggcggaagcgtatattgcgccactaaagccgctgtcaaagcactttcggacggtttgcgtattgatttggtagatactccgcttcgtgtgacaaacataaaaccgggaatggtggaaactaattttacggttgtccgttatcgtggagataaggatgctgccgatgctttttataagggtattcgtccgttgactggagacgacatagctgaaacagtttattatgctgcctctgctcccgaacatatacagatagcagaagtgctggtgatgcccacttatcaggcaaccggtacgatttcttataagaaaaaagactgctga

SEQ ID NO: 2372 - DNA, 882 bp, B.fragilis
aagaactcgaagccgagtccatccatattatccgcgaagtggcggcgggagttgagaatccggtcatgctgtatagcatcgggaaggattctttcgttatggtacggccttgccgaaaaaagcttttatccgggcaaagtaccggttcctttgatgcatatcgattcaaagtggaaatttaaggaaatgattcagttccgtgacgaatatgccaaaaagtatggctggaatctgattgtggaaagcaatatggaagcttttcatgcaggggtagggccttttacgcatggcagtaaggtgcatacggacttgatgaaaacacaggctttgttgcgtgcgttggataaatataaatttgatgctgccttcggaggtgctcgccgcgatgaagagaaatcgcgtgctaaagagcgtatattctctttccgtgataagttccatcaatgggatcccaaaaaccagcgtcccgaattgtgggatatctacaatgcccgtgtacataagggtgaaagtatacgtgtattcccgttgagtaactggaccgaactggatatctggcagtacattcgtttggagaatattccgattgtaccgttgtattatgccaaagagcgtcctgtggtgcagatggacggtaacttgattatggctgatgatgaacgtctgccggaaaaataccgtgatcagatcgaaatgaaaatggtacgtttccgtacattgggatgttggccgttgaccggtgctgtcgaaagcgaggccgacaccattgagaagattgttgaagagatgatgactaccactaagagcgaacgtacgacccgtgttatcgacttcgaccaggaaggtagcatggaacagaagaaacgcgaaggatatttttaa

SEQ ID NO: 2373 - DNA, 228 bp, B.fragilis
aatattgggaaagatctgataatgaacgatgaacgatcaaccataaacgatagagatcgtcttacctcacactacattccacctgtcaggacactacttattgttgatcgttcatcatttttttatcttttccatgtcacgttttccttccttctccgtcttgcttatgtaaatggaactaaaacaattcaaaatagccgttcttccactccgcgacaaactgcttag

SEQ ID NO: 2374 - DNA, 240 bp, B.fragilis
aatatagatgaagaaataatcataaaaatgaaagaagaatataagttaagccacttgaaagaactcgaagccgagtccatccatattatccgcgaagtggcggcgggagttgagaatccggtcatgctgtatagcatcgggaaggattctttcgttatggtacggccttgccgaaaaaagcttttatccgggcaaagtaccggttcctttgatgcatatcgattcaaagtggaaatttaa

SEQ ID NO: 2375 - DNA, 255 bp, B.fragilis
attaagttcgaaatcgtgaattgttttattttcgttactcattatcttaatatatttcgcatacacgaaaagcatagtaatactttcagcattgcatgcagattaaacttgaattataataataaagaattgctcccgaaaagagttttccgagagaagacgaaaggacaatctgttgcaaaaaaacagattgtttacaaaaccaaatccgatctaagagtatttgtcatgccgcaaagatacataatattttga

SEQ ID NO: 2376 - DNA, 1476 bp, B.fragilis
catggaacagaagaaacgcgaaggatatttttaaacattacaactatggcagataaattagatataaaagcatttctggataaggacgaacagaaggatttgcttcgtctgttgacagcaggttcggtagatgacggaaagtctacattgatcggacgtttgctgttcgatagcaaaaaattgtatgaggaccagcttgatgcattggagcgtgacagcaagcggttgggcaatgccggcgaacacattgattatgccttgttgctggatggcttgaaagcagagcgtgaacagggcattacgattgatgtggcttatcgctacttttctaccaataaccgtaaatttatcattgctgatactccggggcacgaacagtatacccgtaatatgataaccggcggttcgaccgccaatctggctattattctggtagatgcccgtatgggagtaattactcagacaagacgtcatacatttctggtatctctgttgggaatcaagcatgtagtgttggctgtcaacaagatggacctggtagatttttcggaagagcgtttcaatgagattgtagcagagtataagaagtttgtagctcccttggggattcccgatgtgacttgtattccactgtccgcactcgatggagacaatgtggtggataagtcggaaagaactccgtggtatgaaggactttccttgctcgattttctggaaacagtccatatcgacagcgataataattttagtgatttccgctttccggtacagtatgtacttcgtccgaacctcgacttcaggggattctgtggtaaggtggcatccggcatcatacgcaagggagacaaagtaatggctttgccttccggtaaagtatctcatgtgaagagtatcgttacttttgatggtgagctggattatgcttttcccccacagtcggtcacactgacacttgaagacgagatagatgtctcaagaggggaaatgttggttcatccggataatttgcctgttgtggaccgtaattttgaagcaatgttggtgtggatggatgaagaaccgatggatatcaacaaatcgttctttattaagcagacaacgaatgtcagccgcacgcgtatcgacagcataaaatataaagtggatgtcaatacgatggaacattcgtctgttccctttttgtctttgaacgaaatagcacgtgtggtgtttactacagctaaagaactgttctttgatccgtaccggaagaataaatcgtgcggttcgtttatcctgatcgatccgataaccaataataccagtgctgtgggaatgattatcgatcgtgtggaaaagaaagacatgaatattgccgatgattttccggttttgaatctgcctgaattgggcatagctcctgaacattatgaagctattgagaaggcggtaaaatcattaagtgaacaaggtttcgaagtcagaatagagaagtaa

SEQ ID NO: 2377 - DNA, 249 bp, B.fragilis
tatgttaaagacgatctttttggtgccgttttttcgttacccgaagtgacagtaatcggtagacgtcctacatcttctgaaaacccgtttaaatggccttttggggatatgccttctgaatctccgaaagcccttcccggacttgatgacttttttctcctcaaggaggcggttcatctccgttatcttcaccacagcaatcaggctctttgcctaaacctgaagaagtcattaaggatgcaactgtaa

SEQ ID NO: 2378 - DNA, 438 bp, B.fragilis
tcgtatttttgcaatccaaatatgagtagaatagtagcaatagattacggacggaaacgtacaggtatagctgtgagtgatacgatgcagatcatcgctaacggtttgacaactgtgcctacacacgagcttctggatttcattactaattatgtgaaacaggaatcggtggaacgtattattataggtctgcccaagcagatgaataatgaggtctctgagaatatgaagaatatagagccttttgtgcgttcgctaaaaaaacgtttgcccgatatgcctgtggagtatgtagatgaacgtttcacttctgtcctcgcacatcgcacgatgcttgaagccggactgaagaaaaaagacaggcaaaacaaggcattggttgatgagattagtgcaactattattttgcaatcttatttggaaactaagcgtttgtaa

SEQ ID NO: 2379 - DNA, 1071 bp, B.fragilis
tgcgccatctgctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 2380 - DNA, 558 bp, B.fragilis
tttctctgccggaagaaacaatctatcgttcatattgtttatatttgcaaaaaacgtataacaatattaacgatagattttttatatcacatgaccaaagaagaactaatgaggaaagccatcgaactttccagagaaaatgtagcaaacggaggaggccccttcggagctgtcattgcaaaaaatggagaaatagtggccacaggcgtcaatcgcgtaacagcctcatgcgaccccactgcccatgcagaagtaagcgctatccgcgcggctgcctcaaaactgggaacttttaacctgagcggttacgagatttacacctcttgcgaaccctgtcccatgtgcctgggtgctatctattgggcccgattagacaagatgtactatggcaataacaagacagatgccaaaaacatcggattcgacgactcgtttatctacgatgaattggaactgaaaccggagaaccgcaagctgccatccgaagtattactccacgacgaagcaatcaaagcttttgaggagtggatggaaaaagaagataagatagaatactga

SEQ ID NO: 2381 - DNA, 651 bp, B.fragilis
agagaaagacgaattcagcctgatgcgacatatcatcagtacacttccacctctgcaacagaccatcctccggatgaaagatgtagaagagtacgaaaccgaagaaatcgccgagataacaggatgcagctccgaagccatccgcagcaatttatccagggcacggaaaaaagtaagagacatttacctgcaaaccatacaacaaagaaaaaggagaaacgaagcatgaatatagaagaattattgaacaagtattttgaaggggaaaccacctgcgaagaagaacgtgagctccgccgttttttcacccggggcatcgtaccggaacatctgcagatgtaccgcccgatgtttgctttcctcaacgaagagaaccggcagagcaagactgccgtccccgaagttccgaaaacttctgtccctttacgccgccgtctactttacatattcagcggaatggctgccggaatattgcttatattgggtattgccggtctcaaccgacatttcaacacctcaaccgctaattatgtaatcattgacgggaaatgctataccgatgccaagctggtacgcgaacaagccatgatcgcgtttcgtgatgtcagtatcagcgaagaggaagtattcgctacgctgttctccgaataa

SEQ ID NO: 2382 - DNA, 1980 bp, B.fragilis
gtatctttgcggctaattatgagacgaatcctacttacatatatactccttgttgtaggtttgctgaccgcacaggcacagttcaaccctacacaacaagttgatccccgtaccggcagagatgccaacggcaaccagatagacccggccatgcgggttcaggaagatagtacagacgttgagatacagggacttcctccgacactttatatgtggcacgtcagcgaaaacctggggacgattcaaagaatcccggctgataccgcaacccacatgtttcagaacaccaacttggtagaaggtctgacaggacattataattatctgggcaatttaggttctccccgtctgtcccgcctcttctttgaacgtcgggacgcggaaccgaccatctttatggaacctttttcaagcttcttcatacgtcccgacgaattcaacttcaccaacagtaacgtgcccttcaccaatcttacctactataaagccggtaataagatcaatggagaagaacggtttaagtcttacttttctgttaatgtgaataaacggctggcatttggtttcaacttcgattacctgtacggacggggatattataacaaccagaatacctcttactttaatgccgcacttttcggaagttacataggcgaccgctatgaagccactttactgtacagcaacaattatctgaagatgaacgagaatggcggtatcaccgacgaccgttacatcacccgtccggaagagatggcggagggaaaaaaggaatacgaatcgcagaatatccctaccctgttgagcaaaagcgccaatcgtaacaaagacttttacatattcctcacccaacgctataaactgggattcacgcgtgaagtggagaaagccaaagatgacacaaccaacactcaaaagacagagttcgttccggtcaccagtttcatccacacgatgaaagtggaacgcagccgccaccagtttacttcggaggacgaactgtacaaaatttatccggaggcttatatccaacccggaaacaaattggtgaatgactctaccagttatatcggagtcaaaaacacattgggaatcgcactgctcgagggtttcaataaatatgccaaagccgggctgacagctttcatctcgcataagttaagcaattaccggcttatggaccgggactctgtaagcgtggataaatacagcgaacatgaagtctttgtcggaggtgaactggccaaacgccagggaaaaacactccactaccgcgccatgggtgaagtgggaatcctggataaagcgatcgggcaattccgtgtcaacgccaacctcgacctgaacttccgcttatggaaagacacggtcagctttattgcccgcggatccatcagtaacactcttcccgcattctatatgcgtcattatcactccaagtacttctattgggacaatgacaatatggaaaaagaattccgtacccgactggaaggtgagctgaacatagaacattggcaaaccaacctgaaagccggagtggaaaacatcaagaactatacgtatttcaatcaaaaagcattgccccaacagaatggaggtaatatccaagtgctttccgccactctgtcacaaaacttccgcctgggcattcttcatctggacaatgaagtgacctggcaaaagtcgagcaacaacaccgtgttacccctgcccgaactttcactataccataacctctatatccagacaacactggctaagaaagtgcttcacgtacaattgggagccgacgtacgctatttcaccaaatattatgctccggcatatactcccgccatccagcagttccacttgcaaccggaagacgaccaggtaaagattggcggttatccgatcatcaatgtatatgccaacctgcaattgaaacgtacgcgccttttcgcgatgatgtaccacgtcaatcaggggaatgggtaa

SEQ ID NO: 2383 - DNA, 1110 bp, B.fragilis
agtaaaagtagaataaaagaaaagaatatggcagaagaagttgtattaatgaaaggaaacgaagccatcgcccatgcggccatccgctgtggtgccgacggatacttcggatatcctattactccgcaatcggaggtgttggaaactcttgccgaactgagaccttgggaaactaccggcatggtagtcctccaggcggaaagtgaagtggcagctatcaatatggtttatggtggtgccggaagcggcaaaatggtgatgacctcatcatcaagtcccggtgtcagcctgaaacaggaaggtatttcttatctggcaggtgccgagcttccatgtctgatcgtaaacgtgatgcgcggcggccccggtttgggtactatccaaccaagccaggccgactatttccagactgtaaaaggtggaggacacggtgactataaactcatcgcattggctccggcttctgttcaggaaatggcagactttgtcggactcgctttcgaacttgcgttcaaataccgtaatccggccatcatccttgcagacggtgttatcggacaaatgatggagaaagtggttcttcctcccgcaaaagcccgccgtacggatgcggaagtcatagcacaatgtccatgggcttctaccggaaagacaaaagaccgtaagcccaacatcatcacttcgttggaactgcgtccggaagagatggagaaaaacaacctccgcttccaggcaaagtacagagtaattgaagaaaacgaagtacgttttgaagaaattgactgcgaagatgcagaatatctgattgtagctttcggttcaatggcacgtatcggccagaaagcaatggaactggcccgtgaagaggggattaaagtcggtatgcttcgccccatcactctatggccgttcccgacgaaagcgattgccgagtatgccaataaggtaaaaggtatgctggtaaccgagctgaatgccggacagatggtagaagacgttcgtttagcagtgaacggaagagtgaaagttgaacatttcggccgcctgggaggaattgttcccgatccggacgaaatagtaactgcattgaaagaacaattaatcaaataa

SEQ ID NO: 2384 - DNA, 999 bp, B.fragilis
ttacccgaaagaaagccatgccgtattatcgttttgaataacaatgtgccgcaaatatctctttattatcagccatctttcaaagatagtacagtaaatattagcagacaagactgggaagttagttataatctgggaaatagctggaacaaagtaaaaaggaataaaaaagcaaatagctctttgtataaagtagatatcacaatatatccggaattatcactaaaaaacttggtaatcacacagatttatcaagtgcttttcaatttatcacccgccatagaagtctctttctggaaagggatgaaattcacggctcaaatggtgattccggtatataatgacggatatgccagcagatacgataaactacatccgggtttccttgaactatcgcaaacagtccgtctgccctataatttttgggcaacattggctatcggtagctttaataatagccgatatggcatcgacttcaacctgatccaccactttaaagatgaacgtttcagtatagaaggccgcatcgggtataccggtacaggatattgggaaggttttactatgcattatggaacaaagatgcgggctacatggtcattgggaggaagcttttattggccacgctataatgtagaattaaatgcaagagttgaacaatatctattaaaggagaaagcagttagagtagaagcaatccggcattttcgctatgcttccattggattctatgcaatgaaagccaaagacgtgaaagccaatggaggattccgtttccaaatagctttacccccttaccgatataaacgcaaaggatatattcctcggatcactccttccaataatatgggaatgtcttataatgcgggaaatgaacaatattactataagacttatcgctcagcacctgacgataacataatgaagaacaatagttttaatccatattttaccttaattccgcaacactataatttaactttatttataagttcctga

SEQ ID NO: 2385 - DNA, 462 bp, B.fragilis
aagaaacgaagtatgaataaagtcattcgcaccacatggattatcctgctacttactgtcgcctccggcatggcaagagcacaacagggactacaaatagcttccgtattccagaaatacggtaaacaaaaaggagtgactatggtagagctgtccaacgaaatgctggaaacctaccagatgactctctataaaagccttgtctttaaagacgttgaagaagcactgcccaccattctcaactgtctggatgctgacaaaaagaaggcaaagaaagtgaaggaagtggtggcaggcggacaaatccagtccggctattatcaattgccccagctaaaagaagatgtcaaccggttcatcctgttcaaaaccggtaaaaaaggctcggctaccctgatttacatcgagggcgagttggatgcagacgatctggtaaccatgttatttatgaaaaaaaactaa

SEQ ID NO: 2386 - DNA, 993 bp, B.fragilis
aaagatatgagcaataagattataaaatggggattcattggttgcggagaggtgaccaaatacaaaagcggacctgcttttcagaaagtagaaggctccaaagtagtggcagtcatgagccgtgacggtaaaaaagccaaagcctatgctaaagagcggaacataccgaagtggtatgacgacgcacaagagttaatagacgatccggaagtaaatgccgtatacatagccactccgccctcttcgcacgccacttatgccatcatgtccatgaaagccggaaaaccggtttatatcgaaaagccaatggcacagacttacgaagagtgtgcccgcatcaaccgcatctcacaagagacgggagtcccttgttttgtagcctactaccggcgttacctgccttactttatgaaagtgaaggaactggtggacaaaggtacgatcggcaatgtaatcaacgtacagatccgttttgcacagccccctcgcgatctggactataacagagagaatctgccctggcgtgtacaggccgatattgccggaggaggatacttctatgacctcgcaccacaccagatcgaccttctgcaggagatgttcggctgcatactcgaagccagtggctataaaagcaaccgtggcggactctatccggcagaagatacactgagcgcatgtttccagttcgacaacggattggtagggagcggttcgtggtgctttgtagcccatgattcggcccgcgaagaccgtatcgaaattatcggcgataaaggcatgatctgcttctccgtatttacctatgacccgattgccctccatactgaaagaggacgtgaagaaataatggtagaaaaccctgaacacgtacagcagcccttgattcaggccgtagtagaccatcttcttggaaaatccacctgttcgtgtgatggcgaaagtgccacaacgactaactgggtgatggataaaatattgggaaagatctga

SEQ ID NO: 2387 - DNA, 1131 bp, B.fragilis
ttgttttggagtatgaaaaaacttggacttttactaatgctattcacatttgccgcttgtactaatgatgatttttctgtattacaggaaaatgaagaaattaccttacccactgctgtaactagggcctctggagataaactatatgatttattaggttatggatatgatgtgacaggattatactttacttctgcttctgctaaaagtaaaataattgatatagttgcactgagaaaggattatgaggaaagggtcgatattggcgctgtaccttccaattatgctagaatgacttcgggtactacggcacaagactatactcgtaatgtaacttctaaagtaaaactcggaggagcattatctttattctcgggttctttgagtagttcttttagtagcactcaacattatacatcgaaatactctatagctgattatacgtcttttattaggagacgtagactttttcttactgcttcgactgagttactatctaaatatttgacaaaaatgtttgttgatgatttatctaaacaatctccgtcttttattattcaacattatgggacacatgtattaactgatattactttgggaggaagaataacagttctatatagaagttctattaatacatcaaagaaaacagcaaccgtagaagctggatgtgcatcgggtataaaaaatatgtttaatttgagtgttgatgggcattatgatcaaactttggttaaggataattcggagcaggaaattgtttatagaacagagggaggagatccgagtagagctttaatagggcaacttaattatgattctaaaaatccatccgtaattgatatatcatcatggcaacagagttgtgatgataataatatgactttagttgatgcagaacctggaagtcttattccaatttatgatttggtatctgatatgggtaagaaagagcagttgaaacttgcggtggaaaattatttgaaggagcatagttatgtagacattgatgattctagtaaaggaggagctgtacgtaataattcccgggggcataataccagttcgtatggtaattcaactcgagttattggggctaatggaaatagaagtacttataggagaccataa

SEQ ID NO: 2388 - DNA, 978 bp, B.fragilis
aaaaaaggaggaaagatgattcagaagacatatcgcctgtgggtggcaagtctgctaactttgtgttcagcttctgctgcagcgcagcagaaagtagagatactcccttttgggaatatggatcaatgggtgacgcgggaaataaaagagtcgggcattattggcggaaataccaaaaaagtatatgcgattggccctaccgaaaccattgtgggtgcgaagccttatacaaataaaggtggttcaccctggggaacttctaacgtaatggcacgtgtgtcgggtattaccaaaaccaatacttcggtatttcccgaaaccagaggagacggtttctgtgctcgtctggatactcgtatggagagtgtaaaagtacttggtattgtagatatcaccgtacttgctgccggatctatgtttttgggaacggttcatgaaccgattaagagtaccaagaatccgaataagatgttgcagatgggaataccgttcactgagcgtccgtcggctattcagttcgactataaagtgaaaatgtccgatcgtgaaaaccgtatacgtgcaacgggattcagtaagataacggatgtgccgggtaaggattttccggctgttattttattgctacagaaacgttgggaagatgccaaaggcaatgtgtacgctaaacgtatcgggacaatggtgaactattactatcattcgactgattggaaaaatggttcaaaatacgatatcatgtatggtgatatcacgaaagatccggcgtataaagcacacatgatgcgacttcaggcctctgaatattttacggtaaacagtaagggcgaaagtgtgccgattcatgaagtggcgtggggggaagctgatgatgtgccgacgcatatgatacttcagtttacatccagtcatggtggtgcttatatcggttcaccgggaaattcgctctacattgacaatgtaaaactgatctattaa

SEQ ID NO: 2389 - DNA, 1236 bp, B.fragilis
gacaagaggggttacacctctcccaccccaatacaagaacagtcaatccccattttacttcaaggaaaagatttattaggttgtgctcaaacaggtaccggtaaaacagctgctttttctatccctatcttgcaaaaattgtataaaaccgaccatcgtaaaggtatcaaggcacttgtgctgacgccaacccgggaacttgcaattcagataggtgaaagtttcgaagcatacggacggtataccggtctgaaacatgccgtaatctttggaggagtaggacagaaaccacagactgacgctctacggagcggtattcagatactggttgccactcccggcagattattggatttgatatcacagggatttatctccctgaattcacttgatttttttgtattggacgaagcagaccgtatgctggacatgggatttatccatgacatcaaacgcatcctgaaactgctaccggcccgaagacaaactttgtttttttcggcgaccatgccaccggaaatagaaacgttggcaaattcgatgttgactaaaccggagaaagtggaagtgaccccggcctcttcgactgtggacatcatctcacagcaggtctatttcgtcgagaaaaaagaaaaaaaggacttgctgatccatctgttgaaagatacatcaatcgagtcggtacttatctttacgcgtacaaaatacggagccgacaaattggcacgtgtactgactaaagccggtatcggagctgaagcgatacatggtaacaaaactcaaaatgcacgccagcgtgctttgaccaattttaagaaccatacccttcgcgccttgatagcaaccgacattgctgcacgcggcatcgatgtagaccaattatcacacgtaatcaattacgagttgcccaatgttccggaaacttacgtgcaccgcatcggtcgtaccggacgtgccggacatgaaggagtggccatctctttctgcgaatcagaagaactgccctacttaaaagatatccaaaagttgatagggaaaaacatcccggtggtaaaagaccacccgtttgtcacgaccgaaggtatcaaggcccaggaagaaaagcaggaagaaatcaaggttaaagccaaagccaacaaaacataccgcgggagccgggctaatggcgacttctggagacggaaaaagcaaaaaacaaatcaaccgtcttccaccaaacaggaaaaaaggaaatag

SEQ ID NO: 2390 - DNA, 999 bp, B.fragilis
tctaagtttataacaagaaaaacaaaaatgtatccgttaaaattcgaacccattctgaagcagacgctttgggggggcgacaaaattatcccgttcaagcatttgaatgatgatttgaagggagttggggaaagctgggaaatatccggcgtagagaacaacgaatctgtcgtagctaacggcccggataaaggccttacactgaccgatatggtgaaaaaataccgtgaggaactggtaggcgaagcaaactatgcccgttttggcaatgagtttcctttgctgataaagttcattgatgcgaagcaagacttgtctatacaggtgcatcccactgatgaactggctaaaaaacgccacaactcaaaaggtaaaactgaaatgtggtatgtagtgggtgctgacgaaggagccaaactgcgttcgggattttctgaacagattacaccgaaagaatataaagaccgcgtgcataataatacaattacagatgttcttcaggaatatgaaattcatccgggagatgttttcttcctgcctgcagggcgtattcacagtattggtgccggggcatttattgccgaaattcagcagacgtcggatatcacttaccgtatttatgattttaatcgtaaagacgccaatggaaaaacacgtgaattgcataccagccaggcacttgatgcgatcaattatgaagtgctcgatgactatcgtaccaaatatgaacctttgaaagatgaaccggttgagttggtggcatgtccttatttcacgacttcggtttatgatatgagtgaacagatcagctgtgattattcggagctggattcattcgtaatctttatttgtatagaaggctcttgcctgatgacagataatgaaggcaacgaagtgcgactgggtgcaggagaaactgttttgcttcctgccactactcaggaattgaccattgtgcctcaagaagggaatgtgaagttattggaaacatacgtgtaa

SEQ ID NO: 2391 - DNA, 558 bp, B.fragilis
gttaatattattaagatgaaagaagaaataattatagcaggattcggtggacagggtgtactgtctatgggaaagattttagcctattccggactgatggagggcaaagaagtgacctggatgccggcttatggtcctgagcaacgtggcggaacagccaacgttacagtcattgtaagtgacgacaagatctcttcaccgatcttgagcaaatatgatacagctatcattctgaatcagccttcactggaaaagttcgaaagccgtgtgaaacccggaggtatcctgatctacgacggatacggcattatcaacccgcctacccgcaaggatatcaaggtgtaccgcatcgatgcaatggatgcggccaatgaaatgaacaatgctaaagcattcaacatgatcgtgctgggaggattgctgaaacttcgccccattgtcactttagaaaatgtagtgaaaggtttgaagaaaactttgcccgaacgccaccatcacctgatcccgatgaacgaagaggccatcaaaaaagggatggaactgatcagagaagcttaa

SEQ ID NO: 2392 - DNA, 558 bp, B.fragilis
gatatgattttacctatttatgtatatggtcaaccggttctcagacaggtagcggaagatataactgtggactatccgaatctgaaggaactgattgaaaatatgtttgaaacgatggatcatgctgacggggtaggacttgccgctcctcagatcggtttgcctattcgtgtcgttgttattaatctggatgtgctttctgaggattatcccgaatataaagattttcgcaaggcttatataaatgcccatattgatgtggtagagggtgaggaagtatctatggaggaaggttgtctcagtttgccgggtattcacgagtctgtgaagagaggcagcaagatacacgtaagatatatggatgagaattttgtagaacataatgaggtggtagaaggatttctggcacgggttatgcaacacgagtttgaccatttggatggaaaaatgttcatagaccatatctctcctctgcgtaagcaaatgataaaaggaaaattgaacacgatgctgaaaggtaaagcacgcagttcttataaaatgaagcaggtgaagtga

SEQ ID NO: 2393 - DNA, 939 bp, B.fragilis
tcaatagatatgaacgatagtaaacttatgaatcgtgcggctgataatatccgcatattagctgcgtcgatggtggaaaaagccaattcgggacaccccggaggcgccatgggcggtgctgattttgtgaacgtactcttctctgagtttttggtatacgatccgcaaaacccacgctgggaaggtcgcgaccgctttttcctcgacccgggacacatgtcaccgatgctttattccgtattggctttcaccggaaaatatacattggacgaattaaagcaattccgtcagtggggcagccctactccgggacaccctgaagtgaatgtagaccgtggcgttgaaaatacttccggcccgctgggacagggacacacttatgcagtaggcgcagccattgcagccaaattcctgaaagcccgctttggcgaagtaatgaaccagactatttacgcatatatatccgatggaggtatccaggaagaaatctctcagggtgccggccgcattgccggtacactcggactggacaacctgatcatgttctacgattcaaacgacgtacagctttctaccaacacagaagatgtaacaacggaaaacgtagccatgaaatatgaagcatgggactggaaagtaatcacaatcaacggtaacgatcctgacgagatacgcaaagctctgactgaagccaaagctgaaaagaaccgtccgaccctgatcatcggtaaaacgaccatgggtaaaggagcacgccgggccgatggaagcagctatgaagccgactgcgcgacacacggcgcaccattgggcggagacgcatatgtaaatacaatcaagaacctgggtggaaatccggagaatccattcaccattttccccgaagtagccgaactgtatgccaaacgccgcggaagaactgaagaagattgttgctga

SEQ ID NO: 2394 - DNA, 1131 bp, B.fragilis
ccgaactgtatgccaaacgccgcggaagaactgaagaagattgttgctgacaaatatgcagcaaaagcagagtgggcaaaagcaaaccctgaaaaggcagctaaactggccgaattcttctctggaaaagctccgaaagtaaactgggatgccattgaacagaaagccggcggcgcaacccgtgcaggatctgcaaccgtattaggagcattggccactcaggtagaaaatatgatcgtttcatcagccgacctgtctaactcagacaagacagacggattcctgaaaaagacgcacgcattcaaaaaaggagatttcagcggcgctttccttcaagcaggagtttcagagttaagtatggcttgtatttgtatcggtatgtctctgcacggaggtatcattgctgcatgcggcacattctttgtgttctcagactacatgaaaccggccctgcgtatggctgccctgatggagcaaccggtaaaattcatctggactcatgatgcgttccgtgtaggagaagacggacctactcacgaaccggtagaacaagaagcacaagtacgcctgcttgaaaaactgaagaaccacaaaggacacaactctatgttggtacttcgcccggcggatgtggaagagacaaccattgcgtggaaacttgcaatggaaaacatgtcgactcctacagcactgatcctttcacgtcagaatatcgttaacctgcccgcaggaaccgattattcacaagctgcaaaaggtgcttatatcattgccgacgccgatgaaaacccggatgtgatcctagtagcttcgggttcggaagtttcaacgctggtggccggtgccgaacttctgcgcaaagaaggtgtgaaagtacgtattgtttccgctccgtccgaagggttattccgtaatcaaagcaaagagtatcaagaatccatacttcctgcaggagccaaaatctttggtctgacagccggacttccggtgaatcttgaaggtttggtaggttccaacggtaaagtgttcggtcttgaatcatttggtttctcggcaccctacaaagtgctggatgagaaactgggattcaccgcagaaaacgtatacaatcaggtaaaagcaatgctctga

SEQ ID NO: 2395 - DNA, 408 bp, B.fragilis
agcaataacatggacaatcggacagagcagtattcacttcgggaactgttagaaagcatcacagaaaatattaaaaccaagcgcctggctgacgtttttcgcttcatttcattccatcccggtgagatgtatggaccacatcagcatttacgtatcgaaataaattatgtgaaaaagggaagctgcattctccatccggatcatgagagtatcacttttcgtgaaggagaaattatgattatcacttcggacatcagtcatctgtttgaagccggagcagatggtacgaccttgatgcaattggaattcctacccgaaatcttttcccacttcaacttgaatgccacagccgattcgaacggctctgccctgctatggacaaatcgatttaagattaaaatagaataa

SEQ ID NO: 2396 - DNA, 618 bp, B.fragilis
catattataatggaagaaaataataatatatatccgatattcgaccggatgctgacccggcaggataaagaagaactcttgaaacagcgtggtgtgatgatctggtttaccgggttgagcggatcgggtaagagtaccattgccatcgctttggaacgcgaactgcataaacgcggattgttgtgtcgtatcttggatggagataacatccgtacaggcatcaacaataatctgggcttttccgaaactgaccgggtagaaaacatacgccgtatagccgaggtttcgaaactttttattgatacaggcattattacaattgctgctttcatcagccctaacaacgatatccgtgagatggctgcccgcattgtcggaccggatgactttctggaaatatttgtcagcactccgctcgccgaatgtgaaaagcgggacgtaaagggattgtatgccaaagctcgtcggggagaaataaaaaactttactggaatatccgcccctttcgaagctcccgaacatccggctttgtcacttgacacttccgtattgtcacttgaggagtctgtcaatcgattgctggaaattgtgttgcctcgggtaagcagacatgaataa

SEQ ID NO: 2397 - DNA, 2697 bp, B.fragilis
ctaatcataatccctaccacaatgaagaaaagtattattctgttattcatcagtttacttttatccccgctatgcataaaggcacatcaacccgaattctccactgccggatttttccggctggcagactccggacgagacgtctattccatgaatcctgcatggcgtttttataaaggaaattgccccggagctgaaaccggaaatttcgacgaccggtcatggacagtagtttctctgcctcatggtatcgaatatctgcctacagaagcaagcggctgtatcaattaccaaggcgaagtctggtatcgcaaacaatttacaccggatgcggcattgaaaggtaaaaaactttttttacattttgaggcaattatgggcaaaagcaaaatatacgtaaacggtaaattgctagccgaacatttcggtggttatctgccggtggtcgtcgatgtaactgatgcattggaatttggaaaggaaaacctgatcgccgtatgggctgacaatagcaatgaccccaactatcctcccggaaaacaacaggaagtgctggacttcacttatttcggaggaatatatcgggattgctggttgatagcacacaatcaggtattcatcaccgatccgaattatgagaacgaagaagcaggcggaggactatttgtcgcttataacaatgtatcggaccactctgccgaagtattactgaaaatacagattcgcaactccgggagaaaagctttcaaaggtgtagtcgaatacgaacttcagcaaccggacggacaacaagtggcttctctaaactccgtcatccggatcaagcccggaaaatcaacctattcatcagataagctgaccgtaaagggtccgatgctatggagtccggaaaatccggcattatataacctgatcgttcgtatccgtgacgaaaagggcaatccgatagatggttaccggcgccggatcggaatacgcagtatcgaattcaaaggagaagatggattctggctgaacggtaaaccttatgaagctccgttaatcggagccaaccggcaccaggatttcgcaattgtgggcaatgcggtacctaacagtattcactggcgggatgccaaaaagctgagagatgccggaatgaaagtaattcgtaatgctcactgcccgcaagacccggccttcatggatgcttgtgatgaattgggattatttgtaatcgtcaataccccgggctggcaattctggaatgatgccccggtctttgcacagcgggtatacagcgatatccgtaacctggttcgtcgagaccgcaatcatccttgcgtatggatgtgggaaccgatcttgaacgagacatggtatccggcaaatttcgcccggaacgcacatgacattgtagaggcagaatatccatatccctattgttatagcggatgcgatagcgaagccaaagggaaagaacatttccagatactttttacccatccgctcaatggagacggaggagcctattcgactaacgatatcaagaaacagctgacttacttcacacgtgaatggggtgacaatgtggatgactggaactcgcacaattctcccagtcgcgtagcacgcaactggggagagcaggccatgcttatacaagcacagcactatgcccgcccatcctacaaatacaccagctatgatgctctttaccgcactccgcggcaacatgtaggaggctgcctctggcactcgttcgatcatcagcgcggctatcatcccgatcccttctacggaggtgtcatggacgtattccgccaaccgaagtattcttattacatgtttatggcacaacggtcgcccataaaagaagagcgccttttccaaaccggtccaatggtttatatcgcccatgaaatgacaccgttctccggcaaagatgtcaccgtctattcgaactgtgacgaagtaagactcacttatctcaaaggcggacaaacgcaaacctatgtacataaacaggaaaaagaaggaatgccccaccccgtcatcacattcgagaatgtatacgacttcatgaaagataaagcactttcacgccaaggtaaacaagctgacgtttacttattggcagaaggattgattgacggtaaagtagtcgctacccacaaagtggctccggcacgacgtcccgaaaagctgctcctttgggtagacaatgaaggaacagacctgaaagccgacggttctgacttcgtcacagtcatagctgccgttgccgacaaagatggaaatatcaaacgcttaaacaactataccatcaaatttcaaatagaaggtgaaggacgtattttaggcggagcaggcaatttggctaacccggcccctgtccgttggggaacagccccgatattagttcagtctactttgaaacccggaaaaataaaaatcacagccagtgtcttgttcgaaggctcgcagatgccaagcagtgccgtgctggaattggaaagtaaaccgggagacttcccccagatatacgaccgggaagagtcagcacttattccgaacttcaccggacaagaggcagtaaacgccctggccccaaaatcagaggcggcattggaaaaagaaagactacagaaagctgaaaatgctgccaagctaaaagaagtagagcaacagcaggaagagttcggtgagaaaaagtaa

SEQ ID NO: 2398 - DNA, 1257 bp, B.fragilis
agcaaacaaatgaatcacaaaggcccttacatgaggaaaaacataacaattggcactactttgcgcagaatttcactcatattattctgtttacttcctttgaaggggatttgtcaaacaggagaggccactgttgacgcacttgttaagatgggatttgaaaatgtagggtggacagaagatactgaagaacgggtttttgtgatacaaaactcagcctatcgccttgagggagttggaataggtaaagcggttgatttgatccagaagatgggtttacccgaaaataagccatgtaggttaatagttttggacaataatgttcctcagatatccctctattatcagccgatgaaaggagatagtattgctgaagtcagtcgggctgattggagtgtaagttatgatttgggagaaggatggaaacaagcgagacggattaagaagcaaaatagctctttgtttaaagtagatatagtggtgtatccggagttgttgtttagaaactatattttatctaaggtctatgaaatagtggttaatgtttctcctgccatagaagtttctttgtggaaaggaatgaaactgactggacaagtaatttttcctatctataatgattatggacaaaggtataagcaaatccgtccaggttttgtgactttgtcgcagacagtacgtttaccacagcgtacattcctgactgcttcggtcggtttttttaataaatttcgttggggaggagatttgaaagcaaagcacttctttaaagatgaacgtttttcggtagatgcgcgtatcggatataccggaagaggatactttgaagattgggctttttatcatggaaccaaatggaccttgacaggttctattggggcgaatttctattggccaaagtataatacgcagtttagtttaaagggggaaagatatttagaaggagagtatggtgcacgttttgatatgattcgtcattttcgatacgcttctattggtttttatggaatgaaggtgcaacatgcgggtaacaaaggactgaatggcggcttcttgttccagatagcattgcctccatataaatataagagaaaaggttatatcccaagagtgatacccaataatttcggattccaatataatgcgggtaatgagcgtatatatggtaaaggatatagtcctcaggcaagtgataacgtgatggaaaataatagttttaatccatattttataaaatcagaattattaaatttttaa

SEQ ID NO: 2399 - DNA, 762 bp, B.fragilis
aaattgcagataatgatgaaaaagatatttcttataggcttgttcctttgctgtcatttggcactttcggctcagttgacgtacggaactaccggtctgcttcatgccccgtcagcagagatgcaacgggataagacggtaatgatcggtggaaattttttaaataaggagataactcctcctacatgggattaccatacgtataattactttttgaacgtaactatctttccctggctggaaatagcttatacatgtacgttgtttcagtcgcagacgatagggattgattggaaggtcggaaagaagaagtttacgaatcaggacaggtatttttctgcccgtttgcgagttttgaaagaaggacaattgtggaagtacatgccggctgttgtagtgggaacttcggatccctataccgagtctggcgatggccaagtaggttctgctgatggtaatggctatttctgccgtttttatgtcgcagccaccaagcatatcccgattggaaaggagaagataggtgtacatctgtcatatctgtacaatcgaagagtggattaccacttgaatggattagccggaggtcttacttacgctccatcttttgcccccgatctgacagtaatcgcggaatatgatgcgaaagactttgcgtttggtgctacctatttgcttttcaaccatttgcatgcgcaggtagaattgcaaagaatgaagtattttaccggcggacttacttataaaatctatttgaagtaa

SEQ ID NO: 2400 - DNA, 222 bp, B.fragilis
aaacaaaagattatgaaaggacttaatgtattagcagcttttctgggtggtgcagccgttggtgcagccctgggtattttattcgctcctgaaaaaggagaagatactcgtcacaaaatcgcagagattcttcgcaaaaaaggtatcaagctgaatcgtaacgaaatggaaaacctcgttgatgaaattgcagctgaaatcaaaggcgaagtaattgactaa

SEQ ID NO: 2401 - DNA, 417 bp, B.fragilis
gtgttcgagatacagaacgtcctgatgcaacaacccgcacggatgcttcttcatcaagaagatctacttatactcgtccaagtagtacacgtagtagctctagttataatagtaacgttcatccgaatcgttctacaaactctggaacatattcaagaagtactagtaggtcttcttctacttatactcgtggaagttcgacaacaacaccttctcgttcttattcaaatgaaggtacccgtcgttcttatggctcttcttcatcttctcgaagctattcctcaggtagttctactcgctctagtagtagttattcttccggtagcagaagtagtggtagcagttctcgttcgacaagtggtggaggtagctacagcagaagtagcggtggtcgaagataagaaaattgtgaattga

SEQ ID NO: 2402 - DNA, 1173 bp, B.fragilis
ttattcggtgtgccgatatgcctgctgcatgcagtttgtcggcacattaacaatgaacacattattatgggattacttgaatttaacaaacttccgataaatactttagtaggggcagactggcggacatttaaagctattaccggaggaagggagatcgatgcggcttatacaggtaaatatcgtctgacaaaggcagtttgtcgcttactgtctactttggctccacttcaggataaacgttatgagaagctgttggcaaataaaccgttggaacacgatccggtctttatccttggtcactggcgtagcggaactacttttgtacacaatgttttttcgtgcgattcacattttggctataacaccacttatcagactgtatttccgcatttaatgatgtggggacagccattctttaaaaagaacatgagttggctgatgccggataagcggccgacggataatatggagctggctgtcgatttgccgcaggaggaagagtttgcccttgccaacatgatgccttatacctattataatttctggttcttgccaagatatcagcaggaatatgcagataaatacttgcttttcgatactatcagtgaagcggaattgaaggtttttgaggagacttttaccaaattgattaagatctctttgtggaatacgcagggtactcagtttcttagcaagaatccccctcacacgggacgcgtgaaggaattggtaaaaatgttccccaatgcgaaatttatttatctgatgcgtaatccgtatactgtatttgagtctacccgtagtttctttactaatacgattcaacccttgaagctgcaggatatcactccggctgagttggagaacaatatactctctatttatgccaaattgtatcataaatacgaggccgataagcaattcattcctgaaggaaacctgatggaggtgaagtttgaagactttgaggcagacgctatgggaatgactgagaatatttatcatgctttggatattccgggatttgccgaagcgcgcggctcgatagagaaatatgtgggaggtaaaaaaggatataaaaagaacaaatataagtacgatgaccgtactgtgcagttagtgcaagatcattgggactttgcattgaagcaatgggattatagtttataa

SEQ ID NO: 2403 - DNA, 810 bp, B.fragilis
acatcagccgtactgacgaagttaaagaaggtgctttctgtcgtgaatacgacggtactccaaccggaactagttttcgtaactccgatggaagtgaaatttactcctgctgttgtcgtagctcaaggagaaactcctgaagttgcattggctactctttacttcaatgaaaagactaatacttgggaagctgaagaaaactatgctacttaccagaacggagtatttgttggcaatgttcaccacttctctaaattcaaattcggtttcgaagaagccgacagcaaagctacggctgaagcagccttggattctatgaaattcgacaaagcatgctacactgaaggtgaaactgccaaagtaaaaatggaaatcaactggaagggtggtatcaagtgcgaaggtggtgcttctgtagaagaaattatcaagaaagcacattccacactaactacaactactatcaagatggtcagcgcagctttggaagaagctatcaaagacgataatgccaatgttactccgggagctgcatttacagacaaaaagttcacatatgaacttgaagtaccagcttatactcagttgacaggattcgacgtaacaagaaacgttatcaagactacctatgtattgccgtttgctgtttataataaagcaacgaaagcaatcgaaaagaaaacagctgaagttacaatcagcaagatttcttcagtagttgttagaacgattgaagcgatcggtcatggacatggtcatggtcacggcgatgacctgaatgccggtggtggtattatcatctctgaataa

SEQ ID NO: 2404 - DNA, 195 bp, B.fragilis
atagcattagtaaaagtccaagttttttcatactccaaaacaattaaattatacattataaaaagtgtaaaagactattcaaatgaaataccaagcaaaaccggttttcataaaatcatctctccatatttttccaaattaaaatttaaatattccaataacactactcaaaagaaaaagacttatttaaattaa

SEQ ID NO: 2405 - DNA, 774 bp, B.fragilis
aaaaaagaagttatgacgaaagaagaaataatcaagcccgagaatctggtttataagaaaccgactctgatgaacgacaatggcatgcactattgtccgggttgcagccacggcgttgtacataaactgattgccgaagtaatcgaggagatgggactggaagacaaagcagtcggtatctcacccgtaggttgcgctgtatttatctacaattaccttgacattgactggcaggaagctgcacacggacgtgcgccggcacttgccactgccatcaaacgtctttggccggatcgcctggtgttcacctatcagggagatggcgaccttgcctgcatcggtacggcagagactatccacgcattgaatcgtggtgaaaatattacgattatctttatcaacaatgccatttacggtatgaccggaggccagatggctcctactaccctgatgggaatgaaaaccgccacttgtccttatggacgtgatccggaactccacggatatccgttgaagataactgagattgctgcccaactggaaggtacagcttacgtaacccgtcagtcggtacaatccgttccggctatccggaaagctaaaaaagcaatccgtaaagcttttgaaaattcaatgaacggaaaaggctccaacctggtagaaatcgtttcgacctgtagttccggctggaaaatgactccggagaaagccaacaaatggatggaagaacacatgttccccttctatcctcttggcgacttgaaagataaataa

SEQ ID NO: 2406 - DNA, 1233 bp, B.fragilis
aaatcttttttcatggacttttgttacctgtttgttacttataacagaataatgtctatattcataactaaaaacatacaaacaaataatatgaaaaaagaagtaaggattaaagaaccggtcaggatcaggactaaacgtctgtcgaacggttgtgagtctatatatttagatatttatatggatggaagaagacgatatgaatttttaaagctatatataatacccgagcatacacggacggataaagatttaaatcagagtaccatgaaactggccagtgcagtgaaggcacaaaggattatagaattgcagaatggagtatacggctttaaccatcaacaggaaaagaaagatataatgctgatagattatatcaagtatttggcagacaaagatatagaaaaaacttcaaggaaagtgtctatgtatacactgatataccatcttcagcattatgataagatgggtatcaggctcagacaggtagataaaaagtatatacttggctttgttgaatacttgaagacggcaactcagaaacactgtaaaagtgtgaagaatataagtgccaatactcaagttcattattataaggtttttcatcattgcctgaatagtgctgtaattgatgaaattataacttcaaatccaatggataagataaaaaatgaggaaaagcctaagcggagaaggactgaacgggcatttctgactattgatgaattgaaaatattgtcacaaacagattttcataatgcgactttaaaaaaggcttttctattcagttgtttttgtggactgagacatagtgatatagtggcacttacatggggaaatctgaaaaagggaaaagtcggtaaaatggagctgcatatgacgcaacagaaaactcaggaaatcctctctcttcctctgagcaaggaggctttgaaacaacttcctgtccgcggaaaagtacctgatacagagaaagtgttcaaagggcttatcagtttaggaagaaccaatgaaatattacccaaatgggctgctaaagccggtattcaaaagcatattacttttcattcggcacgacatacccatgccacaatgatgattactcttggtgccgatctttatacggtatctaaactcttgggacataccaatattcaaacaactcagatttatgccaagatagtggatgaaagtaaagagaaggctatcgatttaattccggatataacttga

SEQ ID NO: 2407 - DNA, 252 bp, B.fragilis
atagctctttcgcacaattatgaaactcgctatatagtgactgatctaacagtgaattccatacaagagttcaagaatggatatatcattaaaagagcagacacttcttatctcaatagcaaattaagaaacgagaaaatacgctctgatacaataagaataaggctatcctttgtaagagcaatcatgagatttactctacaatgccgatttatcacctacgtcacatacccttttgcatcatataaatag

SEQ ID NO: 2408 - DNA, 852 bp, B.fragilis
catatggactcatttttccaaaccctcgccttcacctacctgctctacccgatactgggattgctactggtaggcttaggcattttcatagccaagaaaaacgctttgctgaacaacaagcggctggtaggctataccatcggtgcaatcgtactcctgacactccctgccttgctgggattccttgattacggtttcatgccctatggctacattttccttgccatgctgtatctccttctgggcggttataacatccgaatgatagcatgggtgtataaggacgactacaagtaccgccacgaaatcattctcaccggttttatactggtagtatctatgctgttcttcacccttgtattcaatctctgcaatgaattgaaatatggtctgtgggcatccgcctgcctgcttccattcgtcattgtctcggtatttatccgcacataccgtatctttatcgccattccgattcccgtgtatgaagtatggagatatacagacgataccgagcaggacggatattttgacccgggcagcctgcaagtcctgcaaatagagctatacaaacaagaaagcgaccgggaaccggtcaagctcagtgtgaaagcacccgacgaaatgcaattcggcacatggtttcaccggatgattgacgactataatctgaagtctccacaagccccgatagacgactatgcagcaaaagagggaggatggattttctaccggaaacccaccttgctatctccccgacattacatagacttcaaccttaccgtaaaggataaccgcatccgcagccgtgatgtaattgttgctaaacgggtaatggaacataatgagaactaa

SEQ ID NO: 2409 - DNA, 567 bp, B.fragilis
gcggagagattgcggtctcctcggaagtgggcacaggaaccacattcaccttctggctgcctcttgagaatgtcatacaagatacggaaacgggaacgaacagccacttgccccggcgaagccgtcggaacacagccgtcggaagtgctcccggccaaagaggaaacgacggaaaaggaagaggaccttcgggcaaccgcagccggaacggagaaagccaccatactgatagccgaagacacagacagcaacttcgacctgctgaacgctattctgggtagaaaataccgcttagtacgcgccagagacggcatggaggccgtgaccatgtatgacgaggtaaatccggatctgatattgatggacatcaagatgcctaacttagacggactggaagctaccagaattatcaggcaactgtccgcggaagtacctatcattgcacaaagcgcatacgcttacgaacacgaccggaatgcagccgaagaagccggatgcaatgactttatctcaaaaccgatcgctcaggaaaagctaaaggaaaagataaagaaatggctgaaataa

SEQ ID NO: 2410 - DNA, 201 bp, B.fragilis
agtaacttgttggttatttgtggaaatgggaaactggtctatttgtggcgtaaaatggagttggataatgttctacgagctgattgttatgatacggaggaagagaagaaactctcacccgacatgcgtactgtttctgcatccaagttcatcgctctttatatgcctaaagacagcaataaactaatggagttatattaa

SEQ ID NO: 2411 - DNA, 2229 bp, B.fragilis
aagctttgccctatggattatgtactctatttacttcgcgctctatatcgagtaaaatggtggattctattgggaaccgccctaattaccgcaatcgtttatttccgtacaggaaatctcagaggtggttataatgtggaggcaaccttatacaccggtgtagtgtccggctatggagttgaagaaagtaccaaagtagattgggcgctggctcagaactcaatggacaaccttattaacatcatccaggccgaaagcaccttgaagcgggtatctctgcgcctcttctcacggatactggtaaaagggagtccggacaaagacaatgaaggcatcactgctgccagctataattacacctataaccatatgaaaaacagtccggacgggaaagctctcatagccttaatagatcggaccagtgaagacaagactatggagaactttcaaaagtacgaacgtcaggataagaacaactatatatatgggctgttttacttccagcatgtttactatagctatcaagccctgaagaacatcaaagtagaaaggaaaggaagcagtgacttgctgaaggtaagctatcaatcaggtgatccgggcattgcttataacacaattgagatattgatgaaagaatttgtcaacgaataccaagctctgcgatatgaggggacggacaaggtcatcgaatatttcaaagctgaattgaagcgtattggaggcgacctgaccaaatatgaagatgacttgacacagtataatgtagagaatcggattatcaactattatgatgaaaccaaagaaatagcagctatcaataaagagttcgaactacgcgaacaaaacgtgttatttgaatacaacagctctagggcaatgctcgaagaattggagaggcaaatggacgctaattccaaacggataatccacaatgtggaactggtagacaagttaaagcaggccaccaacctgaccggtaaaatcatcgagatggagacgatctcaacagccggagatagtacgggaatgaagctcacagaatacaaaaatcgcctgattcagagtcggcgggacctctcaaccattgccaatcaatacgttgccgggcagcagaccaaagaaggcgttgccaaagccaccatcgtggagcaatggcttgaccaactattgctctttgaaaaagccaaagcagaactcaagatcgtgcagagaagccgcagcgacctgaacgccaaatacacccatttcgctccggtggggactactatcaagcgaaaagagcgtacgataagcttcactgaacaaaattacctgacaaaccttaaaagttacaacgacgcattgctccggaaaaagaacctggaaatgaccgcagccattctgaaggtgcttaatccgcccgcatatcccatcaatgaagaggtggccagtcgcaagaagatcgtaatgatggcagcagccggcagttttatcttttttgtagccctcttcctgcttatcgaagccatcgaccgcaccctgcgcgactccacccgtacgcgcaaacagactggcagcatcgtattgggagcttatcccgccccattgaaactgagccctatcagcaaacagtgtgaagagattgccacgcgttatatgagtagcgccatcctccggttcttcaccgagcggaaggaaggcatgcctttcatcctcaaccttctcagtacggagcaaggtagcggcaagacctatctggcggaacaattacagggatattgggaaagtatcgggctgaaagtgcgccgtctcacggatggaacggatttcaattccaactcatccgcctttaccctggctaaaaatttgacagacctttatactcccggaaccgaagatatcttaattgtggaatatccgagcttggagaaagccaacatccccactccgctgttgcaagatgcccagctcaacttgttagtagcatcggctgtccatggctggaaagcgacagacaaggtcttgttacagaaactcaagtcccagttgggcacatctccgtacctatacctgaaccgggcacccaaatacgaagtggagacctataccggcatgcttcccccatatacatttgtacataaacagatgtatcgtttatctcaacttgctttgacggaaagcctgtttaactggaaaaagaacagtagaaagaagccgcaagatattgacgatgacgatgatgaatga

SEQ ID NO: 2412 - DNA, 939 bp, B.fragilis
atggtaactacccgaatactcaaaataccctttcacccgaaagcgatacatggaatatatggtgttaactattatttccataaaaaagatgctcttccacagaggctccaatttgaagcaacagttgagtattgcgggcagtatatggatgaatactctatataccatatcagtaaaaaagagtatgtagtcaatcggaatgaaacggatgaatatttatatgatattgccaagaagtgtgccgatattatatatccgattaccgtattactggatcggaacgggcatcccgtatttataagaaccgatgatatagtggaaaggtggtcggagaaaaggcatgagttggaccgatattacaaaggggatactgctgagtactatcttagcaaagtagaagaagcagtaaatgacccggtcaaaatgatgcaacttatatcgaatgacttatttttttctcaattattcacatttcaatattacaatacggtaaagtttgagaatgatataatgcttattccattttctattcctttgcggttcagcagtatacaagaaatggatatagatagtttctcagattcggaaagtgacacgattcatatcattcataaaggcagcaccaagaaccaatataaaaatggggatttctatggttcgtccgagatgaatgcaagtcaatacaatgccattttgtctgcaaagtatcgcattcgttatagtttaggaaaagaaaggcatgattttgaagcaatagagggtgattttgtggtaagcaaggaagaggaagatgtgaactctataaaaatggaagcgtacaaacttgatgaaaaggtactggaatatgggttcgataaagaattggagaaaagggaaagggaacaaaaaaggattgataattcattaatgaataaattgaaacggtattttaaaacttag

SEQ ID NO: 2413 - DNA, 471 bp, B.fragilis
aacgataatactatggctatatactcactacatgaaatggcaggactactcaaaacgggtctttggcaaggcggtgaagtcgagaagctcggatacatcgggacggcagttccccatgcttcccccgcaccggcttgcgggctgacgggagtatatatcagttatgataccatgttggagagatgcgaagtctcgatgcaaggcggcgggtgtgaattattcatttcacaataccacccctataccggaacttatatgacctatgttctggaaagcaatctttccgacaggagattacttttggctaagttggaggagatactggcagaccggaggaatccctacctatggtcgcataacttgtacaaaagaaattcattcggcatcgagcgccggtatgacacaggacatagcagtatgtggggcggtagaatagccgtaccacgacaaagtaaattctttggaagatga

SEQ ID NO: 2414 - DNA, 1287 bp, B.fragilis
cgtataaatactaaaatgaaagagaacatatctaggttcaaaattgactattcggtatgtaagaatagccccggtggcagtattttggaaaaagtctccaatttccaaaaagaactccaactacacgaagagaactcgctacacatctacgtcaaatccccaatggtttccggttgcggtagggaagtcgaggttgttgatagaaaaactaatgaagtaaagaaaatgctgatgttcggttccaatagttatttggatgctaccggcataccatcagtagtggaaaaggcggttcgtgtaataactgactatggagtaggaagtggcggggttccactattgagcggaacgacaatattccaaaatgaattggaaaaagagatagccaagctgaccggttttgatgacactatattattctcttctggcttcactgccaatataggtgtgatagtaggattgatacgccctaacaacttgctggtatatgacaggctcaaccacgccagtttaattgacggggctctaatgtccggtgccaaaatggtaagatacaagcataatgatcctaaagcacttgaaaaaatattaaaagaaaatgccgggcaatacaaggatggtatgatggtggtgactgacggagtatttagtatggatggggatattgccgatattccggctatcttagagattacgaagaaatataatgcattgcttttaatagacgatgcccatgcgacgggagtgattggaggagacggagccggaacgctaagctattatgatataaaagagcgcgaaaatataatcgttacaggaacgctcagtaaagcaataggatcgataggaggttttataactgccaaacaaaacattattgattacctgagggtttatgcccgtagcaacatgtattctacctctttaccccagagtatttgtgcagcatcccttgaagtaatcaaagagatgcgtaatacggacattcagaatgcactgaagcggaatgccgaatatgtaagaaatggattgaaagcattgggcttcaatacattaaattcgatgactcctattatacctgtgattgtgggagatgaatacatattgactcagataacaaaggaactttatgacagggatatatttaccaatgccatatttcctccggttgtacctcctaatatgtgccgaattagaattggcgtgatgtcgtcacatacgtttgaagactgtgacaggttgataaacgccttccatgaaataggcaaaaaatacggacttatctga

SEQ ID NO: 2415 - DNA, 441 bp, B.fragilis
aatgaagatactatgtttggacataaaagttttttgaggataggtgctttgggcgattccagtatttcgggattgtacaaagacagttatgaacttgaaaattgccatttcagttttaatcagggaacgaacacggatggcaaaccgcaaactgatgtacgaggtggaaccttgtacctgacctatgccggtttaccgcaagatgatatgctccgctggatactgaaccctaaaaaatatgaagacggggcaattgtaatatgcgatgacagtgatgaacctttggaaaaaattttatttgagcaggcagcctgtacaggattgaatattgaatatacgcaaaaaggaaaagcctatatacatactaaaattattctccaagcacgaaaaataaaggtaggtgagacaacgtttgaaaatcgttggactattaacgaataa

SEQ ID NO: 2416 - DNA, 1818 bp, B.fragilis
aatatattaactatggcatcgacaaacttggacgctgtaagcgtggagataaaagtagcaggaaaagtctgtgattatgtaacaatggaactttttcagtcggtcagtacacaccaccgtttcaaaatcaaagtaaactatcgtccggacaagccaagtgtctgggctatcggtcccgatgtgatattcaagcaactgggtgagaaggtatccatcatcatgacccaccatgagagtggagagaaaacggaatttcacggactgatttctgatattcatgtggaaggctttgacggtaatcagggatttgtcatactggaagggggaagccctaccatcctgctggacagagaccccgctatggactgctatgtagagcaaaacctgaatacgatagtcagtgacatacttgataagagcggggtgaaaatgaatgtgaccaacaatcccaaacatacggacatcatcccttatgttgcccgctataaagagacaagctacggattcctatcccgtctgctgcgctcctacggcgagtggttctattacaacggagaaacgctacagataggagaccctgaaatagagacggaaagccgtgcagggtatgatgtagatctgacgggagtcagcatcaatgccactatccgttcgttgaatcacagcacctatgagttcgaccccgtcaatgataagttctattacgactacagcggaacacctaagggtgctacccttggttcccgttcggctgagaaatgcagtgaacctatcttcccaaccgaggcaaaattaccctcgataagacctgcgtatagcgcaatggatttggaacactacggggatgccggatttcaccgaaactattcccaattgtctcaaatcaaggcttcaagccgttactgtggcatacgactgggagaattagtggttactcgtgtacctgaaagtttcccgggagttaagattaccgatttgggacgttaccgtattactgagattacccatacggtagatagtcggggacggtatagcaacactttctgcggtgtaccgggtggtacgcccgtcatgccgtggggagatgccgtgatgccggtagcctatccggaaatggcaagagtggtgagcaatgacgacccaaaaaatcagggacgtgtcaaagtacagttcatgtggcaggaggtagatggcggcgagagctactggatgcgggtgcaaagcccggatgcaggcaagagcgataaagttgccaaaaaccgtggttttgtgtttatccccgaaccgggtgatttggtaatggtaggcttcgagcaaggcaatccagaccgtccatatgtgacaggcagccttttctataaggctaattcagagggagcagcaacggataacagtgtaaagagtatccgtacacgcagcggacatatactggagtttaatgatgatgaaggtggagactggggcattacgattaaagaccgtaacggatgtatgttccacttagacactaaaggggaagaaatattaatatctgcacctcagaagattacaatagatgctaaggatattgtaatttcggcaaataatcaaataaatatggttgccgataagggtattttagccaatggtcgggaaaatatttctttcgttacaaaaacaatgcaaaccgatgtagaaaatgattgtgtactgagtgcgaaagagttcaccggaataactgagaaaacagaaattcagagtactaaagaaaaccttgtactaagctcaggcaaagaagttattaacaagagtaagtctaagaaaataaggctttcgtaa

SEQ ID NO: 2417 - DNA, 432 bp, B.fragilis
aaacaaataactatgggctttttcgacaggctgtttaaaggaaaagaagtgtttgcggatagacgcaatccggatatggtatgcgagataacgctttgcgggcagtcgcacatcttgtccgagtttgatattgcctatgagccggataattcctcgaaagaatatatggaagcatacgccgtattttcagagccggtgaatgcggaggtagaaaactggataatgagagcggacaggaaagaaaacgggacagtccgattctatctcaacagcgatgctatggacgaaggtgcactgttcgagataaatttcagtaatgcgagctgcgtgcattatcacaatgtatcgcagggagacacatcggtaaagaccattgtgatgacttttccgtctgtccggatgggaggtgatgaatttgaactaaaacgataa

SEQ ID NO: 2418 - DNA, 873 bp, B.fragilis
gttaatacaacaaaacaaacaacaagcatggaatggtataccaaatatttatcaattttcggactgaccttgtccgaaatccccggagacactctgtccgaaatcggcacattgttacatgaaaagcagtcggacacccctttggtatccgtagtagtgattgcgcacaacgaagagccccacatattaagctgcctctggtctcttggcaacaacgaatacagttaccccatcgagattttagtggtcaacaatcattccaccgaccggacggagcaggcattgcaagcggtaggagccacctacttcaacgaacttaaaaagggacccggatatgcccgacagtgtggtctggaccatgcaaaagggagatatcatatttgcattgacgccgataccatgtatccgccacactatatcgacacccatgtgcggaacttaatgaagcctggcgtcgcttgtacattcagcctgtggagcttcattccggacaagagacattcccgtttggggctgtggctctacgagtgcttgcgtgacttacacctgagcatacaggccatcaaacggccggaactctgcgtacggggaatgacattcggattcaatacagaactcggacgccttttcggattccgcacagacatccggagaggagaagacggttcactggcacttgccatgaagccctacggaagactgatattcattacaagtcgtaaagcccgggcactgaccagcaatagcaccattgatgccgacggttcattggccaggagtttcggggtccgtcttctcaaggccttaaaaggcgccacggggctgctttacaaaaaaacaacctataaagataaagactctaacctattatga

SEQ ID NO: 2419 - DNA, 969 bp, B.fragilis
cccctacaaacaaacgccatggaacaacccaacaagcaccccaaagtgagtgtcatcatccccatatacaacacttgccattacgtgcaggaagccctcgaaagtatttgccggcaaacattgaccgaactagagataatcgccatagacgacggttcgaccgacagcagccggaaagtggtggaacaggtggcagcaacagatatgcgaatcagggtatacagtcaggccaaccaggggcaaagcatcacccggaacaacgggatgcaatatgtccaggggaagtacgtctactttatggacagtgatgaccggctggaagccgatacactggagacctgctactccgcatgcgaagccggacagctggactttgtatgtttcgatgcagatatcttaaacaaagaccacccctgtgcccggcatttcaattacgaccggagcgcctgtgcccgaccgaagcaagtatacaaaggagtggaactactgcaacgacaactttccgcccgtgtattcagcccctcgccgtgcctgaacctgatcagcacgagctatctgaaaacctccggactgaccttttatccccggatcatccacgaagaccaactcttcacgtcgcaactgtatttaaaggcggaaaaggtaggatacattccccagaaattctttttgcgacgcttcagaaccgactccaccatgacccggcagttcacctggagaaacatggaaggctatctcaccgtgaccgacgaactgctgaaagcggctccctcttatccggaaaacgtccgcaggctgatacgtcagttcttatgtcagatgctcgacgcagccgtatggcaagcccacacactgcccctacgccaacgcatcgggcttttcctactctgcctgaggcactacaggccctacgtcaggatgcgtaccctgatggtactgatgctgaaaaaaaaggaggaggggagatga

SEQ ID NO: 2420 - DNA, 3108 bp, B.fragilis
ttaaataaaactatttgcacgataaaaagaaataagatgaattacatgcagatactctcttgctggcacaaattagaacatttttctccagctattctacccaaagataaaagtcttaaaccactgaaagaacttccttggatgcgtccattagaagctaaagatccgaaaaagacaattcagtatactatctatttaggggtgttttcccagatatctgtttcggattttgtgaaagacttcttcaaagatgaacgtaataatccgaacgtaacggatgccaaagtatgctatgcttctcttaaattggataatctgggagtatatatacaaaacacattcggattttctactatgccgtgggccttaagacagttggaggcgggcaaagtgaacaccaattcttggtcggaagattttgataaattgagaaagaacctgttagagcgattgggcgagaataggaaggaacttgcggaagattactcaagttatttgtcggagacccaaacgttagaaaatcttcaacagatacaagctctaatcatacaagacttaaagtggagcacttcgccggaaactgaaatatatgttcgaatagaagaagtatacaaaaaaaacaatacttcagataaggaagaagcgaatgcagacctattaaacagtttctacatcgacgatttggagcgaataattacttcatccgtaaaaggaagttacaataccgctttccgtaattatttgagtgcctgtttgaataaagactttgttcatttcgatttgtcacttcaaccagagatcttgaaagaatgtttagtcccggagaattatccggatggttgctggccatctccccatacggcgagtttgatgcagcaatttgccgtgaatacggtcagtaaagaattatcaggggaaaagcaggagggcatattctcggtaaatggacctcctggaacaggaaagactactttattaagagatatcatcgcagctattctggtgaaacgtgccaaaaagatggttaactttactgaaccggcaaaagcgttccgtaaaataggtgaagtgcaagtgagtgagaagtacacgccatccatttatgaaccggattcatcaatttgtgacggaggtatagttgtcgcttcctccaataacggtgctgttgaaaatatttcgaaagaacttcctttaaaaaaagaggcaagaggctattcggatcaggttggctattttcggcaagtgagtgaggaatgcgtgggcgaagaaagttggggactaattgccgctgtgatgggcaataaagaaaatcaacgaaaattgatatacagcatttgggatggggactcggaggaggaaagttatactttaaaacagcaactgaaggactataaaccaacagaagaagaatggttgaatattgtcgtatcttttaaaaataaacttgaagaggtggagattgagaaatctcgtctaaccggttttatgaaagatgcggaaagcatagaaaaacttcgtatccagcttgaggatgctgaaagccatttatctcatgtcgacaaggaactagagggactgcttgaggaaaaaaatttattgtctactgagataaaaagaggtaaacaacaaaaagaagatgctatgacggaattgaaactgttacaatctacccgccccggcttctttatccattggtttaataaaacggtacgaactcaatataaaaaggccttaactgctactctcacgaaatataatcaattatccgaagaaataaccaagcagaaaacctcgttgcaagcacttgacttacgtgtagaaaaacaaagaaaaatacaagaacaaagccaaaaggactacgacaggataaatagcgactatgctcgattgtcggaattgaccgaagccgcccgtcaggaattgaaaggagcctatgccgatgcttcattttggaaacagattgaatcaaaggaggtacaggaaatctctccttggtattcgaaaagacttaaacaattacaatctgaattgttcattgaagcaatgaaagtgaacgagttgtttatactacgagccaatgccacatcgagccgcataaaaacaacgctggatgttttctttaattttcttaaaacgggaggaaaccttacggaaagagaaatacaggcaatatggaatacattttggctgatagtccctgtcgtttcttctacatttgcgtctattcaacgcatgtttagccaaatgaaaacaggaacaatcccctggctatttgtagacgaggcagggcaggcagttccacaagcggcggcaggagctatctggcgttccaaacgggctgttatcgtaggagatccttttcaaatagagcccgtagttacgattcctgagcagattgtcaataatatcagtcatcatttcggattggataaaacacagatacagacttctctttccgttcagtctatggccgatcgtgccaatccgtatggttggataacaaatgatacttggaccggatctccgctacgggtgcatcgtcgttgtgttgacccgatgttttccatagcaaatgagatcgcgtataatggcatgatgtataactccactttggctgaaagttctcaactatttatgcggaatggatttttgcaagtagaggggaaagtgagcggacgacattacgtaccagagcaaggtatcttaatcagacaaatgattattgatgagatacaccacttacaggacttgcccgatttgttcgtgatctctccattttcagaaataccacctatcttgaaaaaagaattgcgtcagcctattaagcaagcactggctacctataaatcaatagaagacaacgaactaaaaaagtggttggatgcccatatcggaacagtccatacgtttcaaggtaagcaggcagcaggtgtaattttatgtctggggttggatgagaagtcaaaaggggctgcttcctgggcttcatccaaacctaacttattaaatgtggctttaacacgcgctaaacaacgatttgttgctgtgggagatggagatatttggttgcgacaaccctattttagcaaattgaaagcattaaattga

SEQ ID NO: 2421 - DNA, 426 bp, B.fragilis
ctattaaaaacaaacggtatggaattatttagttttctacaagtagacagcgacttaacagcatggtttatccttgatggtcaggaatatgaaatgagccatttcgatataaatttcgctcaatctgtcgaccataaagggcaaccgcaagatgaagtacgtggtggtatcatgtccattacattgtcacaaacgcttcctgaaaacatttacagatggggaatgacatccattcccaaaaatgggtctgtgatttttaaatcaaagacaacaaatcctcccttgaaaattaattttattaacgcatattgcatacgattcaatcgaagtatagccaacgaaggagggttagaaagtcaactggtaatatcacctgatgagatgttaataaacggaattagctttgacaatcattgggttaaataa

SEQ ID NO: 2422 - DNA, 363 bp, B.fragilis
gatgagaaaacttttctccagaataaaaaaatgatctttttccataaagtaatctgttttatcttaattatttttcgtcaactatcagtttgtgccacaaaggtgaagttttatttcttcacaactgtgtcccgtcaggacacaattattcaaaacatatacataatatttaataggaagcataacagtaacgcccaaacaatcatagcacagatgaaaaagaaaattacaaaaacacttttgatagaacccgaagatgaaaaaatcgaaatggtcaataatgtgatacaccaatccattgaggagctattggtaccctacgaaaaaaggcgaacttatctaccacggaagccaccgaaatga

SEQ ID NO: 2423 - DNA, 780 bp, B.fragilis
ttaaattttttattatttaataagtactatataataatgatgggacagggagataaaaaaattcgaataaggagaaccaatgagcagttggataaggaggtaatatctgaatttgaaaagcttgtaggtgagtttggttttggaaatgttaatttgagtgcattaatgaaagctgctgacttagaagctaatgtgttttacagaagatatggttcgatggataatctttatgacagactggccaagcaatacgacttctggatcaataataccattgatatttccacacttaatacattaggacctaaaaagttttttgcagaaacgttcaagacattgttcaggaatctgtcagagaacagtgtgatgcaaaagttgctgctttacgaaatgacaactattaatagtactacaaagagatctgcggaaacacgggatgttatgaacttaaacttaataacattttacgaaaatctctttgcaccggcgaaaatcaatattaaaagtattgcgtcaatcctaatagggggaatttattatttgatattacataaagagtgtgctaaaatctgcacgatagactataagactaaagaaggagaaaatgctttttcagaaggaatcgactttttaactgacattatttttgataggttggagatgtatgacagggataaaaaggcaatccggcaaatgatatcagatggcataagtgaatccaaaatatgcaagtatatgggcatcaataagaatgacctgaaaacattgctttcggaatag

SEQ ID NO: 2424 - DNA, 219 bp, B.fragilis
aaagaggctgccgaacgtgcaggtatcaaacatcgggtacatgtacacatgctccgtcactctttcgctacccatttgttggaacaaggtactgatctaagaaccatacaggagttgctggggcacaatgacattaagacaacaagtatatatcttcatgtaacgagtgcccataaatcgagcatacccaatccacttgatacactggatgattcgtga

SEQ ID NO: 2425 - DNA, 843 bp, B.fragilis
ataacatccgcaaaaatttcttacggtaataacaaaccaccaataaaaatatttatgactgactttaattggatgctttggatagtaactccaatcatcatcgtttactatctttatcgtcacgtatggcctgccgtacgcaagtttattcgcctttttcagggcatacgcatcaatccccgttctcacttgacggaagcggagtacaagaaactgtccgtaggttcactttatgccttgcagcagggagcctatcttaactccctgacactggacagcaaggataagcttcccaccattcttgccgattggtggggcatctgtaatgcccaagatgccaagcagactttggaatacctcggaaaaaagggatttgcttattacttcccccacgtttatcaagcttttctgttggatgacgaggaggcgaaagaccggattttccagcaacacatggatagtcaggaggattatgacaaagccgtggaacaattgcacaatctcgaagattgctacgatgaattgctggagtgtggtactatcacttgtcgggaagacctactgcgctacggtgtaacgggttgggatgccggacgtcttaacttcatggcacgtgcttgctatgacatgaagtatatctctgaagacgaagcgtggcattacataaatcatgcttacgaaatggtgcacagccgtttttcctcatggcatgactttgctatgagctacgtcatcgggcgtgccctatggggaggtaaaagcgcatccaattcaggcatgatgtatatggcagaggatttactgaaaagtgagaaaagcccgtggacaaaaatcgaatggtaa

SEQ ID NO: 2426 - DNA, 981 bp, B.fragilis
attatgaaagcattatttttaacagtaatactcatggcatttgccagttgtggcaatgcacaagtaaaaacaaaaacagaaaaagagatgaaacaagaaatagcaaaattagaagaactgataaaagaagagttgcaaatggtgaagacttatcctgaaaaacctgcctactatctgcaaatcaacaaaacaggatgcaggctgcttgttagagtggatgatattcccataggttatcattttgtagagaatgaaggtgaatccatgctatatcccattaatgacgttttattcggaagcggaaaacatacggtcagcatccaagtttatcctcgcaccggagagacagaagttactaagaatgcgagtgtaaatataaagattatttactatcaggaaaagttggtaggtatgcctaaaacactggtagagttagatactccggaagatattggaacgaaaaaatcaccaatatataccgattctgtaagttttaatgctatacttcctttcgactacaaaaggattcttgccgaggcgaaagacctgcagaaagtcccagacttagaaaagaaggtcttggctcattataacaaagtacgccaaatgatgattgaaggaaagtattatgagtacgaaaagatgcgtctttcaactacgtgggtattggccgatatgagctatttgggtcaagacgctttacgaaaggctcatattgatgaagactatttgtttcgttttctctgtgaacctattgattggattgcgttgcctatagaaaattatgagatggttatctgtggaaatagaaaattggtctatctacggcgtaaagtggaattggatgatgttctacaggttcgctattatgatacggaggaacaaaagagattatcacctgatatgcgtactgtttctgcattccagtttattgctctttacatgcctaaagacagtaatgagttaatggagttatattaa

SEQ ID NO: 2427 - DNA, 408 bp, B.fragilis
tgtgcaaattttctcactaatagtttatatgattttcaaattgatgatgatggtttcccggttcgtgagggttcggttgtatgtgtctctcctgctccatcgaggggcatgaggaattcttccgatgagccaatgatttacatggttatccaatccaaagaaaactctgtgggtaattattctacagaagatggtacaaggacattctatacagaattacttcattggataaaagaagtacttagtgagaatcttgatttgatgaagtcgcttttggataatgatctagccgaagaaaaagcaaagaatttggttggattagatgttactaacgattggagtcaagagtctattgaaatattattcaaactggttttaatgtatgccaatagagaaccatattattaa

SEQ ID NO: 2428 - DNA, 882 bp, B.fragilis
ataaaatattactgcattcgatgctttatttctaaaaaaaggggtatatttagggcattagttgcaaatttatcttatatttgcacggatttcgcaagcaaacagacaatatatacaaataagtacatcgatatgaaaagagttttattcatactatgtagtatacccctacttctattttcaccggtttctttcgcaaatgcccaggaaaccagtgatttctcaaaactaaacccggaagattacaccaacatttcacttcctcccctcgatctgttattcgaaaacgccaaaggaggaccgatctatgaacttgccagtgtaaaagagcagatcgaacgcaaactgctggcaaaagaaagacgggcgtttctacagtttttcagtgtacggggcagctaccagtggggccgtttcggagtagacaatacctttacggacgtagcgactccgattatgtacaattacagcacttccaaacagaaaatgtatactgtaggcggggccataaacattccgtttaatgaattatttgatttagtcccacgtgtaaggcgccagaaattaactgtcaaaacagctgttctggaacgggaagttaaatttgaagagatgaagcgggaaatcatagaattatatgccacggcaacctctcagctcaatgtgctaaaattgcgtgcagaagccttggaattggctaatatgcaatacgatattgcagagaagaactttgttaacaatacgatcaatacaggagacctttctgtggaaaaagaaaggcagtccaccgcattagaagcatttgagaaaagccgatttgaagtaaccaaaagcctgatgattctcgaggtagtcacccgtacccccattttaaaaaaataa

SEQ ID NO: 2429 - DNA, 993 bp, B.fragilis
aacaagccctacatggatgcaagcaaacaacggggaagtatcgtactgacaaaacaaaatatagacggtcaggattatatacggatagaatataccgataatcagactattgccttgctactttcgcaagacaaaggaattaaaacaatcgggaacggaagtgcatacatacaagcatccactttccagcttccggagttctacacccgttactctccccacgcttatattgattacagccgggtatatgttcgtcatcctaaaccccaacgtgaatacgtgctgccgaaaggctatttggaattactggaacagaagcgttacagtccctcgacaatcaagacttacaggatttatttcagtgatttcatggagtatcacaaagggcgtaacatcgactacctgaaagtggcggacatcaatcactatatactttatttggtaaatgagaaaaaaatctccgtgtcacaacagaatatgcgcattaacgctatcaagttctactacgagagagtgaaaggtgggaagtgtcaatattacggcggaatcacaggtgccaaagagtacaagacactgcccgaagtgcttagccgtaatgagataagtcgtatcctctcctgtttgcctaacttgaaacatcattgcatgatttcgttgatatattctgtcggactaagaagaagcgaactactgaaccttatcccgaaagacatcatcagcgaacggatgttagtacgcataatgggtaaaaggaaaaagtgccgttattcgttgttatcagaaaaagtattgaatgagctacgaacatattacaaagagtaccgtccgaagaaatggctgtttgagggggatagtcccggtgagcaatattcggcgagcgcattggttaaagtactgaaaagaggctgccgaacgtgcaggtatcaaacatcgggtacatgtacacatgctccgtcactctttcgctacccatttgttggaacaaggtactga

SEQ ID NO: 2430 - DNA, 684 bp, B.fragilis
tatggtttgtatgggaataaaatagtattttcgggattggaaaatataaaagactgctgtaaaatgaaaattacccgtgatgaattactgatagccgcgttcaagctgtttatgtccgtgaactatgaaaaagccagttttgcggaacttggaaagatgcttggaatgtcgaaagccggaatattcaaatactacaagaacaaacaggaactatttattgccgtagtggataaattttggttcagcacgcaaaatccacgaaacaaattcactgaaacaaacggtacatttgccgaatttatagacgaatatgtgcgtggcgtacaacggacaatggatatgctgggcgacctgataggtgcagagcgggaaaaggtggcacaaggaaagttcacatatcacgcccaatattttcattttctgtttcaactgctccaatacgatcctgatgcaaaagaaaaactccgtaatcttgtagatggtgattatgcttactggcgtgctgctatacaacgtgccatagctaccggagaactaagagaggatgtggatgtagaggatgcggtagtcatgttccgacaggtttacatgggactttcgtttgaaatggcatttatgggcggattgaacacccagcggcttgccaaacatctacatgccgtttactccttattaaagcgttaa

SEQ ID NO: 2431 - DNA, 708 bp, B.fragilis
aacttagagtatatgagtgacaaacatttggtatgtaaaggggctactgtttattgcagcaagtcaatggtaaataatagtccgggaactgcgatacccttaactataacaagtaatactcttgtagaactgaatggcgggaaagttgcggcaacggataaggattgtactcctgccaatatgtgttttggtaattgtaatacaggcactaatccccctcctccttgtgtggcgaatgtgcaatggagtaaattctacgaaggtgcggaggtgacagaggcggggatgaaacttctgacagaggagtcggaagctacctgcatggcttttggcggtaaagtgaagatagcttttcatggtcaggtcgctaatccccaaccggaagaaccaggtgaagtttcaccggaagtcatggctggtatcttgcctgtaaacccaagaccggaagaaacaattgtcattactgaaggggatgaagaaagagagaaaaaaataacggatgcttattgggttgatgaaaagacgcaggagaaaatgcaagaaatatatccagggaagaaggtgaccctttgtcttaaaacatcaggatatgttgaaggagaacaagctgacatcaaaatcaagatggaagacgggaaagaaaagaccgcttcgggcgaggtgaagcgggatggtactgttgtgatagaaaatttcgaaatagattaa

SEQ ID NO: 2432 - DNA, 756 bp, B.fragilis
cagtttcggtacgaagcagtcgggatattcgtgcaaggagattgcggcttatatgaaagagcaccgggtggacattatctgctttcaggagtttgtcgggcaaccggtacttttacttcagacagcatacggaacgcatttgcagactggcagtatgccgtcattccgcaagctccggacagcacacctatcttgcaggtagctctgttcagcaaatatccggtgaaggacagcagactgatcacttatcccgattcaaggaattgcagtatgtggtgcgatctggacgtaaacggacaaacggttcgtgttttcaataaccacctgcaaacaacggaggtcagccaaaataagcgcaggctggaaagggaactggctaaaaacgaactgacaggcagagaggaagcagtggccaggcaattgttggagggactcaacgaaaacttcaggaaacgtgcggcacaggcaaagactttggaacaattaatccgcaccaccccctaccctatactggtttgcggtgactttaactctctcccatcgtcctacacatacagtaccgtgaaaggtgacaatcttcaagacggattccagacttgcggacatgggtacatgtatacgttccggtactttaaacgcctgctgagaatcgactatattttccattccaaagaatttaaaggggtagattactattcgcctgacctcgatttgtgcagtgatcataatccggtagtgatggaggtgaagatgtaa

SEQ ID NO: 2433 - DNA, 2487 bp, B.fragilis
aatatggattttttgaacatcaatgaaacagttcagagcgtaatccgaatatcaaaaggtgtcgcccgtgagtatggcaatgccagctatgctccggcacaccttttgtttgccttgatgcacaaagaggtaggtctgcgttcgtttgtcgaatcgttgggtaaggacgccgattacttgcgtgaatgggcggaggtaagaatagaggagtaccccaaggctgccggcgcaggcgagataatgcccgatccgaaagttaacgaactgtttgagcaagccgataatgtacgaatcaagtggggactgctggaaatcaatccactttgcctgctggcagccattgctacacccgaagcaggtttcagtacggacgagttgcgctcgttccctattcgggagcgtgaaatacatgacctcttcacgagcggaatgggtaatatgaaaaaatccgtaagtacgcagactgaccttccggggagtgaagcccccctatggacagccggggcgggcaatttagataagtactgtacagataagactgctcttgcggcagacaagaaagtatatcctatcgtgtgccgtgaccgtgagacacgcatgatgatggaaattctggggcggatgggtaagcccaacgtgctcatcatcggcgatgccggtgtgggtaagactgctctggtagatggtttggcatgcagcatcattgagggtacagttccccaatatctaaaggacatgactatctatgagcttgacacaggaacactgattgcgggtgctacctacaaaggggagatagaagaacggctgaaaggaatcatcaaagaattgtcggctcacggcaatgcgattctcttcattgatgaaatacatacgctgatcgaccccaagtcgggcaacagcggagcggcaagcatcctgaagccggagcttgccaaaggaaatataacggtaatcggagtcactacggtggatgaataccgtaaactgattgaaccggaccatgcccttaaccggcgttttgaagtattgcaagtatcggaacctgaccttgcatccaccgtaaatatgatacaggcagctttggaaagatatgaaagctaccacggtgtgggggtagatgtagattcgttgccggaatgcgtggcactcgccaagcgttatgtcaaggaacgccgtttgccggatgccgctattgatttgatagaccgtaccctctctgcggttaagatgattaaccagagcggggaaaaagatataaagggactggcggagcagctcgccgcgattgaagcggcggaagaccagcccgaagcggagcgcacggagaagttgcggttagtcaacttcaccatgaagaaccggttaagccctatccttctgggaatgctctccgatggacagaatgaaccggagtcatcagactacggtgaatggatggattatattttaggtgtacttgaccgattgcgtgaattgaccaaagagaaaatcgggaaaatcacttcccatgaagtggcagccgttatttcttcttctacaggtatccctatcggcaagatagagtcgggcgagaaagaaaagttactcaacatggaagatattctgcgtcgtagagtggtgggacaggataatgcgctgaaggtattgacagatgccattgtcgaatcacgaagtggaatgaacaaaccgggacaaccgattggctcattcttcctgctgggacctaccggaaccggtaagactgaattggcaaaagcattggcagaagcacttttcaatgacgaaaaggcgatgattcgttttgatatgtcagagtttaaggaagaacattcggcagccctgctattgggagcgcctccgggatacgtgggctacgaagaaggtggcgtactcgtgaaccggatacgtcgtcagccttatgcggtggtgcttttcgatgagatagagaaagcccattcttccgtttatgacatcttcctgcaaatcatggacgaaggcaagctacacgaccgtttgggcaaagagggtgatttttccaattctatcgtactgtttacatccaatgtaggtagcgaatggcttagcaaacagattaatgagggcaagaatccttctaccactgacctgatggaagtcatgggcagttatttccgtccggagtttcttgcccgtttgtcggaaatcgtgcctttctctcctattaacgaaacaatgctggttcgtatctttgagatacagttaaagggagttatagcattgcttgagaagcaacatattgacattgagattacggagaaggcaaagaacctgctcgctacccgtggcttcactccaaaatacggagctcggcaagtggcaggtacgatacgtaactatatccgccgtcctatctcaaagatgattgttgcagggacattggcggcaggtaatacggttgttgtcgatgtggcggataatggagatattgattggaatgtgaaatga

SEQ ID NO: 2434 - DNA, 231 bp, B.fragilis
tgtaaacttcaggcgttgcggatagtggcgtatggagaccgcgaagatcaggatgcccgacaggatggggccgatgatcagcgcatagagcccggctccgcacagggctgccacgacggcagccgttccggtggctatctgtatgacgaaactccgcagggcgatgaacttaaactctttattgcggtagaacagcgcattgggaacgatggtggcggaagcaaaaaatag

SEQ ID NO: 2435 - DNA, 489 bp, B.fragilis
accattactaacaattgtgcgatgaataaaacagtccagtctatactatcattgactgctgtcagccttttactgatagtgataacattctttttgggtggcttaggcttcgggcgactatttggaatatatggtgttatggaagatagttttttaggtatgcttatggttatagatatgctggtaatctacaaggtctataagctatatttctgtcagcccaaagctataatgttattgtttggtttggaatgttgctctattcttttgtggcttgtctttatctgtttagaccaacatctattggattggcaaataaccaatctgttattgcaagcagtcagtttggacggcttcgcaggagatgaacgaggattgaatatgcttgcagtcttatgcggtatgatctatccgcttattgggattgggtgtttattcactggattgagatttataaataagttagtaacaacgaaagatagcatctga

SEQ ID NO: 2436 - DNA, 264 bp, B.fragilis
ggcaaaaataactgttggttcaaatataaacaagttatattaaacctattttcttgccaccttgctattcagtatgaattggctggtaataagaatgcaatgagtcaaggaatcatattgctattgaatatactatcatttcgcattgataatgtgcaaattttctcactaatagtttatatgattttcaaattgatgatgatggtttcccggttcgtgagggttcggttgtatgtgtctctcctgctccatcgaggggcatga

SEQ ID NO: 2437 - DNA, 1260 bp, B.fragilis
  unsure (1201): Identity of nucleotide sequences at the above locations are unknown.
ttgacttgcaaatgcacggtcccttccagccccgtggtgaagacgcctgccgcattcgttgcggcccaagacaaaggcatttcaacagtaaaagacggacagacagccgtcggcaacacattcaacacggacacagccaagcaagacagcacccctgccctttcgaaacgtgaactgcggcgtcagcgggtagcccggcgcaaccttcattacaatattctcggagggcccagctacacccccgacttcggcctgctgattggcggaagtgctttgatgacttttcgtatgaacccgagcgacaccacccagcaacgctccgtggtacctgtagccatcgcactgatgttcaacggcggactcaatttgttctccaagccgcaactattctttaaaggcgaccgcttccgcatcttcggacagttcagttacaaaaatacacaagaaaacttttacggcatcggttacagcaccaataaagattatgtgcgcagcgacaccaccagccagtaccgatacagtggattacagatcaacccctggttcctattccgcttgggtgaaagcaatttctttgccggcccgcaggtcgacctcaactatgatcacatgtacgatccggccaaataccttgtcgaccagccctcttacaaagctgccggcggcacggacaaaggctataagaacttcagttccggtgtcggcttcctgctgacttacgacacacgcgacgtgcccgccaacgcctatcggggcatgtacctcgacttccgtggcatgatgtaccaaaagttcctgggaagcgacaataatttctaccgcctggagatagactaccgccaatacaagactctgcgcaaacgcggcgtgcttgcctggacggcacaaacgaaaaacgtgtttggcgacgtccctctcaacaaatacgctctcagcggtactccgttcgatctccgaggttactacatgggccaatatcgtgataagtcgtcacatgtcgtcatggcggaatatcgtcagatgatcaatacggacaaaggcaattgggtgaagcgcatgctcaaccatgtgggctatgtggcttgggcgggatgcggattcatgggccctaacccgggaaaaatagaaggtgtcctgcctaacatgggtgtgggtctccgcattgaagtgcagccccgcatgaacgtccgcctcgacctgngacgcaacatggtgaacaagcaaaatctgttctacttcaacatgacagaagcattctga

SEQ ID NO: 2438 - DNA, 882 bp, B.fragilis
ataatctgcaataagatgggtaagaaaatagaaataaagaaattgtctgattttgaggcgatggtaaatgccggtaatacgacctatacgggattggtagaaggcatcgggtatgtatattggacaacggaaaccctatattttatccgcactaatccggaacaattatgggcgattcccaaatatcagcaaataccttttccatattttcaaaggaaagatgcaatcattgagaccaaaacattgcatacgctccatgtcttgtcaaaagatgaactgttgaaattggattacgatgcctattatgcattttatggtatcgtggaggagatgctaaaatttattcatcgggcggatgctattaaaagttattgtgaaatacctcttcccataataaaatccaaaggagcactaaagggaaatgacgcaagaaatgggatactatcattaggtagtcaaataaatgaccaaatcggagctccccttgatgcagcgaatatgctaatggataataaacatataggcaaaattggagatggattgtcgcttatttctattatagatgaggtaggtaatggtgaatattggtcagctgccggagacattttactgtttgcagccggaaaaacaaaattaagtccctatatgactgtcataagtttaggcacatggatgtatgagacggacttgatgcaatggagattagcatgtataaattatagcgattacaaaaaaacactaataaaatatcgagaattacaaaaaaaatttgaaagtggagacaaatctgtagaggaaaagatgaatgaatgtcacaaaatactgaattcacattatatagagatgcaaaaaaatttaggtaatctaggagttaaattctaa

SEQ ID NO: 2439 - DNA, 1755 bp, B.fragilis
ttgcaaataaattccgaacatttttgttatctttgtgccataaatatcaatacacattatttatatatggctgacgataaaaaaataattttctcgatggtgggagtaagcaaagctttccaacctaacaagaatgtactaaaagacatttatctttctttcttctatggagcgaagattggtattatcggtctcaatggttcgggtaaatctactttgctgaagattattgccggtctggagaaatcttatcagggggaagtggtcttttctcccgggtactcagtgggctatctggcacaggaaccttatctggataacacaaagactgtgaaagaaatcgtaatggagggtgtgcaacctattgttgatgccctgaacgaatacgaagaaattaatcagaagttcggtttacctgaatattatgaagatcaggacaaaatggatcaactttttgcgcgtcagggagagttgcaggacattatcgatgcaacggatgcctggaatctggatagtaagttggagcgtgcaatggatgctcttcgttgcccgcccgaagatcagtcggtggctaacctgtccggtggtgagcgccgccgtgtggctctttgccgactgttattgcaaaagcctgatatcctgctgctcgacgaaccgaccaaccacttggatgctgagtctatcgactggttggagcaacatttgcaacagtacgaaggtacggtaattgcagtgacgcacgaccgctacttcctcgatcatgttgccggatggatccttgaacttgaccgtggtgagggtattccctggaagggcaactactccagctggttggagcagaagaccaaacgaatggaaatggaagaaaagactgccagcaagcgtcgcaaaactctggaacgtgagctcgagtgggtacgtatggcacccaaggcccgccaggctaagggtaaagctcgtttgaactcgtacgataagctgttgaacgaagatgtgaaggagaaagaagagaagttggaaatcttcattccgaatggtcctcgcttgggtaataaggtgatcgaggcaaaacatgtggcgaaggcttatggtgataaactactgtttgacgatctgaactttatgcttcctccaaatggtattgtgggagttatcggtccgaatggtgccggtaaaacaactcttttccgtctgatcatgggactggaaacagtcgataaaggtgagtttgaagtaggggagactgtgaaagtggcttatgtagaccagcagcataaggatatcgatccgaacaagagtgtttatcaggtgatctccggtggtaatgacttgatccgtatgggaggtcgcgatatcaatgcgcgtgcatacctttcgcgcttcaatttctccggagccgaccaggaaaaactttgtggtgtgctttcgggtggagagcggaatcgtctgcatctggctatggcactgaaggaagaaggaaatgtgttgttgctcgacgagccgaccaatgatatcgatgtcaatactctgcgtgcactcgaagagggtctggaagattttgcaggttgtgctgttgtcatttcgcatgaccgttggttcctcgatcgaatctgtacgcatattcttgctttcgaaggcgattcgaatgtgttctactttgaaggttcttattcggagtacgaagagaataaattaaaacgacttggcaacgaagaacctaagcgtgtgagatatagaaagctgatagctgactaa

SEQ ID NO: 2440 - DNA, 921 bp, B.fragilis
aaaagaataaagggttcatcacagacatccatgaaacaaatacctcctttaatatcttttatcaccatctgttacaatgggctggacgacacttgcgtgttgatagaatcgctacgcgacacaatcagttccgtcagttatgaaatcattgtggtggacaacgcgtcccgccaggatgaagcctccctgatacaggaacggtatccctttgtacggactctccgcagcgagaaaaatctcggattctcgggaggaaacaatctcggaatacagatagcacaaggaaaatacctgttcctgatcaataacgacacctacctgaccgaagacggactgcccgccctgatagaacggttggagagcgatccccgcatcggggctgtatcacctaaaatccgttttgcctttccgccgcaaaacattcaatttgccggatataccaagctcagccggtatacgatgcgcaataaagcattgggcatgggatgtccggacgacgggactttcgacactccacgccccagtgcctaccttcatggagctgcgctgatgctgaaacgggaggtcatctggaaagccggactgatgccggagatctattttctctattacgaggaactggactggtgtaccaacatgacgcgtgccggctatcagctgtggtacgagccgcgctgcaccatcttccacaaagagagccaaagtaccgggcggcaaagccctctccgcaccttttatatgatgcgaaaccgaatgctttacgcctggcgaaacctcccgggaatggaacgttgcttggctatcgcttaccaaatgctgatcgtagctcccaaagacagcttgtgcttcgtcctgaaaggagagcccaagctggcaaaagccgtctggcacggagtgaagggtttctggaagctgtgttga

SEQ ID NO: 2441 - DNA, 459 bp, B.fragilis
agaaaacaaaaaaactcagatggccatcagataaataaaaatattcgttggatgcaaacctatttatacttacataaagagaatatcgaccttcctcacggtgtgtatcgggggaaatatccgctgaaacactttgattacggattgagccgtaatgtggggcgtaaaggtgaaatcacttccggcgtatgcggcggagaaatacgaatcgtcattgatggatttgctgacgctaccctgctgggatggctctttgacaccttccgtaaagaagatggagcgattgttacactggatgaacacgaaacgacctttgccaaactgcaattttcgggcgcatcggtaaggagctatcgtatgaactacgattcgcgggttaaaaaaggtgtggtgactatcattgtgatagaagccaaagagattgtaacggacaatgacttattttttaaaaacaaataa

SEQ ID NO: 2442 - DNA, 1170 bp, B.fragilis
gaatataaaaataaaactacatactatatggcaaagaaaaatttagtaaactggtcggactgtatgccgctgtcagccgccatcttcaaccaacatgacgattactttctggacagcattcgcgatagcatagaagtacgaaccaacagttataactacgggttgctgcccgcccgacaaaaccgggatggggagaacggtatccgcatcagccagcacgtgaccggacacattgaagtgcggctgaaatcctgtgaagcaatcacctcttcgggcatccgcatccaatttgatgccaccgaaacgggaagcgaattagtgaagaactattctgtagaatcggatacccgtaagaatatcacgcaatgggacattatcctctccgtggatccgttccaccgggtaggctcgggtgaccccaatccggaggaagttccaccccgccatccgaacgccttgccctcctatcggctgtttgtgatgcccaaaggagaaatcaatgtgagtgagctgggggcgcattacctgaccatcggacgtatccgcaaggatgccgaacgattcatggtagatgccgactttatcccgccctgtacgacgatgaaaagccaccccgaactgcaagagtatcatgccaagttcggaaatatgttccgctcactggagaattacagcaaaattatcatagccaaaatacataacagggataatcgcggcgaactgggtgcgcacatctctctgatatgccgggagatgctccgctatctcgccaccctgcaattcacttataccaataaagggttatacaatgctcccatagacgtattggaagccgtatcgagtctggcgcatatcatgtatgtaagtttcagctacctatcagggacgcaaaaggaggaaacacagaaatatttctacgaatggagcgacgtgacgcccggttcgttcgacgagcaactcgccgatacgctggagatgctgtacgaacatacggatatccgggcttcgatggttcgtgcctattcgtttatgtacacgcttaccgaattgtggcaacggctcagtacgctggaatatatcggtcagcataaggagaatattgtggtatcggaacgcacaacgggaaacaatactacgggacaaaacaaaacatggagcataatggattga

SEQ ID NO: 2443 - DNA, 1227 bp, B.fragilis
cctattatgaacaacacaattaccacctggctcgaaatccttttctggctctccctcttcctcgtattctatacccacctgggatacggaatactgctttacatgctggtcaaactgaaagaactctttgtgaaacctgtccggcgacagctccccccggacaagagactgccggacgtgacactcttcatcacagcctttaacgaagaagaggtggtggacgagaagatgcgcaactgtctcgggctggactacccggcggacaagctgcacatcgtgtggaccaccgatggaagcaacgactctaccaaccagcgactggaagactggccgcaggccaccgtccacttccaacccctgcggcaaggaaaaacggccgccatgacacggggcatgatgctggtggacacgccgctcgtagtgtttaccgatgccaatacgatgctcaaccgcgaagcgatacgcgaaatagtccgggcttttgaagacccgaaggtgggatgcgttgccggtgagaaaaggatagccgtgcaagaaaaagacggtgcggcggccggaggagaaggcatatactggaaatatgaatcgacactgaaagcactggatgcacgcctctactccgccgtgggagccgcaggcgaactatttgccgtacgccgggagctcttcacagtgatggaaccggacacactgctggacgacttcatcctgtcgttgcgcatcgccatgcagggatacaagatagcatattgcacgcaggcgtatgccatcgaaagcggatcggccgacatgcgcgaggagcagaagcggaaagtgcgtatcgcagctggcggactgcaatctatctggcggctgagagaactgctcaatccgttccgttacggagtgctgacgtttcaatacgtatcgcatagagtgctgaggtggtctctggcaccggtgctgctgttcgcgctgcttccactcaacatcgccattctactggcggggggctcccctgtctgttacggcaccatcctggcactccagctcctattctacatcatgggaggatggggctactacctttctacccggcaagtgaaaaacaagctgctcttcatcccgtattatttcctgtttatgaacattaacgtaatgaaaggtgttaactaccttcgtaaaaagaaaggaacaggagcatgggaaaaagccaaaagaacaaaaacggaatccttaaaccaataa

SEQ ID NO: 2444 - DNA, 459 bp, B.fragilis
atgattatgaaaaagttcttgtttattttaacggtaattacctgtttttttgcaagcagtgttgaagcacgacgtgtgaggtttacaatccctgtggacaacagcatcccgaaagtagtcactcttccggacagttcctattataaaacagatgagggcagtcatttagacttaggctatatcgaagaagatggcaaacgtacccttgtactattctctgagtccaagcctgatacttattacgacatttcggacgaatatgcagaagctatttgtagggacttgaacgtagaagaattggacactcttatccccaagcctacattttgggatcaatggggtggtagcatccttttctacggtattgccgcattagtggttatcggtgtggtgagttatctgaaagattttatattcaatcttttggggctgtcgaaaaagaaagaagaggaggagtga

SEQ ID NO: 2445 - DNA, 453 bp, B.fragilis
attctttggaagatgaaacagaaatactataaactaccggtacgtttggaaaagctcttcgaaggagatatccggcaactggaaagatgttccgaactggaatccatcgatcagcacatcgaactgttgctgaccacctgtccgggtgagcaccgtttcgaccccaaatacggttgtcggatttgggagttggactttgagcgcattgtttctaccgaacaatggaaagaactgtttaccggatacgtgatgcaggcgatttccacttatgagaaacgcatttccgacatcactctctcggtaaacctacaagaagtcgtcagggaagaagttctggataaccggatgatacgtaagcgggtagatattacagtactcgccacattgaattccaccggtgctccctgcggtttcggttacaaattatacatgggacctttatcaaacgaataa

SEQ ID NO: 2446 - DNA, 399 bp, B.fragilis
cttataaatgataacagcatggataaagacattatagtagcagaggatgaagatgttaaaatcatctttcatttcaaagtgttttgcgaactcttgaaagagtgcatgtctatatatggaaatactaccatagagaatgcacaacaactggttaaaaactttcatcctctccaacagccaataagcactactgatgatattgttttcttttctcacgaaaacatttatcactgggcaatgcttgctctatatggtgaaacgtattggcttatacatcctgaatgtgaaaaactgcccgatagctatgagaaatgggtagaaaatgctttatctcggcattcgttagatgactgttatgaatttatgagtaagaataataatgtgactaacaaagcatga

SEQ ID NO: 2447 - DNA, 1314 bp, B.fragilis
gactctgccgaaatgatcctctgtgtaatctgtggtgaaccacagttgaaccgatttacacaaatatatcgacccataacctacattaagacttatgatactcatctgagcttggtcgactggatcctgttcgttccgctggcactttgcgtagcctatctgttggtgtacgctattgcgtccaaattctatcgtgcgccccactatccggaagcggacaaattacaccgcatcgccgtcttcttcccggcctaccgggaagacaaagtcatcattgactccgtacgctctttcctcgagcaggactaccccaaagaaatgtacgatgtatacgtcatctccgaccacatgcaggactccaccaacaaagccctaagccgactccctatccgcctgctggtggctacctacgaagacagttccaaggccaaagccctcctactggccatcagcaccatcgaggaagacggaaaggcgaaaggactgggcaaccgccaattagcctttatgtatgacattgccgtggtgatggatgccgacaacgtgaccgtacccggattcctttccgaggtgaaccgtgcctactccgccggagtacaggcgatgcaggctcaccgcacaggcaaaaacctgaatacggacattgccttgctcgacggagtgagcgaggagatcaacaatggatttttcaggagcggacacaacgccctcggattgtctgccggactggcaggctcgggcatggcttttgattacttctggtattacgatgccgtgcaaagcctggaaaccgcaggagaggacaaagagctggaacttacgctgcttgagtgcggaatgcacaccgtctatctggaacacctacctgtctacgacgagaaaacgcaaaaaaaagagaacatcaagaatcagcgccggcgctggatggcggcgcaattcggcatcttgtgtgagggactgtctttcataaaaagcgtcaagcagatggaaggatggtggcggtggtggccctctttcgatctggtcgataaaatcatccaatggatgctccctccgcgcctggtgcaactggtagccgttttcggattcactctgcttgccacactggtctaccgtccggcagcgtctaaatggtggatattgtcggtagcacaggttgccgccatgtttatccctgttccagcccgcctgctcaacggtaggctactaaaagcactaatgcaggtgccttcgctggcattggggaccatagccagcctgttccacctcaaaggggccaacaagaaatttatacataccgaacacggtgagtga

SEQ ID NO: 2448 - DNA, 282 bp, B.fragilis
gaagaaaaactcggaaaaacctataagacaatacaagacaagaaaggacaagataaaacagaaacaatagaaaagaaacggaaaccggcggacgttcctgccgctgttgttgctgctaccattggtatggccgaagtttccggtatagccaatgctcccatcgctgccttcgctgttcctgccgccccctcctccgggaggagaaagggctacttccgttacgtccgtatgcgggttgggagacattggtggacgaaatacaagccaaccgtttctggatga

SEQ ID NO: 2449 - DNA, 303 bp, B.fragilis
agcaagcattgcccagtgataaatgttttcgtgagaaaagaaaacaatatcatcagtagtgcttattggctgttggagaggatgaaagtttttaaccagttgttgtgcattctctatggtagtatttccatatatagacatgcactctttcaagagttcgcaaaacactttgaaatgaaagatgattttaacatcttcatcctctgctactataatgtctttatccatgctgttatcatttataagttattccaagttgtgactaatgtattcaataaccacaccttatggtgtagttcctaa

SEQ ID NO: 2450 - DNA, 1404 bp, B.fragilis
cggaaagcctgtttaactggaaaaagaacagtagaaagaagccgcaagatattgacgatgacgatgatgaatgatgaactacaaaagaaacgagatccggatcaatctgagatagcattttatctcttgttttcagtccagttggtacttattgccatcggtatattcgttcccatccgaatgggggtaactacattgccattagttatagcactgagtatgatcacgctaatgcgatgcaccggacaagaaaccgattggaaacggggacagaatgtcatgttcggactattcatggtatggggtgcatattgccttttcgagataggcaaccccaaccatgttcaggcagcttggaacatcgctattacacattattgggtttatccgttggtctttgccttcgtcgtccctttggccatccgcaattataaagggatagaatggctactgcttatctggtctgtcttcgtacttattgccgccttcaagggatattggcaaaaaagtcatggtttcaatgccaaagagctatattttctatacacattaggaggctaccgtacacatcttatctggtcgggaatcagatatttctcttgtttccccgatgctgcaaacttcggggttcactctgcaatggctgtcaccactttcggcatagccacgttctacgtacgaaagagatggatgaaagtttatttcgccatcattgccatttgtgccatctacggtatgggtatctccggcacccgggcagcaatggctgtaccatttggcggaatcgcactcttcatccttgtgtccaaaagctggaaaagctttgcttttagtaccctggcatttattgcagtgttttctttcttcaacttcactactatcggagatggcaaccaatacattcgtaaaatgcgttcggccttccggccttccgaagatgcctcttatcaggtgcgggtggaaaaccgtaaaaagatgaagggtcttatggacgagaagcctatcggatatggtatcggactctccaagggagcacaatacggtcctaaagaggtaatgccctatccacctgactcgtggctggtagccgtatgggtggaaacgggcatcgtgggactaatgctttatttacttatccacggagtgcttttcgcttggtgttcgtggttgctgatgttcaggattatgaaccaacgtttgagaggattgctggccgcatggctttgcatgaatgccggattctttatcgcggcttatgccaacgacgtcatgcaataccccaactccatcattgtctatacgggctttgctctctgcatagcgggaccttacatcgatccggtgatgcagaaagaagacgaagagctggaaagggagagaaaagagaagaaaaaaagagattga

SEQ ID NO: 2451 - DNA, 450 bp, B.fragilis
acaataaaacgaagttgtatgggagatattgatattcttaataaatttgataatgacaagttgatagacgtagtgaaaaattataaacgttatggctatgatgacgaacttcgtgattatgctatcaacttattgggagagcgcggatggagcagagaagatttgcaacaatttggttatttaacaaactatgattatgatgaagctgaaaaacagtataaagcatacaatagaaattcattgataggcatttgtacgcttgtatttagtggagggattttggctgttgtttatttaatctttctaattctggcttatcggaatgttgcaaaattctataatgcgttagggcataatcaagatgaaaccgcattattcaacgctcttggcgtgctggcttattttcatctgaaaggaagaatgaaagaagaattaaaaggaataagataa

SEQ ID NO: 2452 - DNA, 810 bp, B.fragilis
ttgaagaggcgattaatgacgggagaattaaaccattcccgagagcgactagaaaaacaaaagattaaaaatgttatggcaaaaatatttattatattaataataacattatgtacaggttgttttgggaaacagcattcgtcaaaacacaacaatgtgtctaatataaatgaatctgacatccaattagattccttaccattgactaaatatgagtataagatgcggggaaatctaaaagatgatataggagataaacttggagcaatagaagattatgcacgagcaataaagatagatacttcatatgacacagcatattataatagaggtcttatgaagtctgcaattggggaccgggaaggggaactagctgattataataagacattaagcataaaccctaaatacttaaaagcttatttcaatcgaggtctgctcaaatatgaaatgggtgattacgaaggagaaattgcagattacaggctagctatcaagtattgtaaaccagatgcagatatatacaataatctgggacgcgctttatatgatttagagcgtttcaaagaatcggcagaagcctacggcgaaggtattaagtatttcccggaggactacagactgtattatggccgtggtttggcacgtaaacgcctgggcgaccgtaagggagcttgtgaggattgggtgaagagtagcgaattaggatgtacacaagcaaatatattgttgcccttgtgcgatgagtatataaaagaagaaaatgactctctgaaaaaagaaaaagagtcagctaataagatagaataa

SEQ ID NO: 2453 - DNA, 1899 bp, B.fragilis
attatgaatagaaatctattaatgcctgtagcggtgtcgttgattctgctgtccggctgtaaatataacgatgacaacttcgaaggattggacgatatgacccaaccgacgaatttgatgaagatagagtatacgctgactgatgctgactatgcaactatcagtacaaattctgtaaataaagattctgcagcgaatcataaacctgacgatttgtctaaggacctcgcgaatgtgaagactaacatgtatctgacagagaagattacaggagctacctacatacctgctttcttgcttgataagtattacactgccgataagggttcgagtgcaaagattacgtataagtacaaagaagcgatgtcttctttgctgtcggagtatgcttcggtgaaatatctgaaaccgacggatgccgaatacaagttggtttatggtgagaatgcatttgcgccttatctgaatgaaaagacagaaggtcagatgtctaagatcctgaacgagaagttcaaagatgccgaaaagggaacagctgttttcgttgactataagttgggagagggacagttggagaatccgttgatgtggcaaaacttcgaggcgcttcctaccggagatttgaaggagctcaaaggctggtttatcagctctaccggtgacactcagtggaaggttacttcttatgatgataaccagtatgttcagtattcggcaaacggtacgaaaggggcatgcgtcggctggatggttacccctgctatttctgttactgccggtgattatctcgcttttgacgtgaccgtgggatactataatgctagctgcttgtcaatactgatttcagagaatttcgatggtaaaaatgtcggtactgccaattgggttgatgtgacttctgatttcagcattcctaccaagccgacaagtggttacggtacgtttgcttctgcaggtaaagtgtctttgtcagcttatgcaggcaaaaaggtgtatgtagcctttaagtacgaaggtgatggtgccaataagaaaaccactacttatcagatcgataacatcatggtaggtacctccattccagccaacagtctttctactcctacttatgcggtgaaagtatacgatggaaagaactggaagaataagagcaatagcgtatatgtcctgacatatgccgattacggagatatgggacagagtaaacgctactttacttctgatgttccggctgtgaactatttgcctgcttatttgtctaagatggtggcatatcctgttgatggcgatgcacgtgtagtagtctacagattctataacggcaaagctttgaatatctacagtgatgaatacacttattctgccgaaaaagcgagatgggagttgaatacacgtattgtcgataagacagagcagtttgtattgtctgacggcaagtggaactttgatccgagtacagtggttacgctgaaggctgaaaagggtaatgtagaggctgccgcattctatcaggcaatcaccgattgggtgaaagagaatcatccagagtatgtgacttcatacggtaacaacgattattattatggtggttctgcttacaataataatttcgacttccgtccgtccgcatggaaggcacaaaatgcttccgcttatggttcgatgtcggatgccgatcttactaagttgatgttcgaacgtttgccagaagcattccttccgggattgaaagcaatctatggtagtgcggatgttgtggaaggtgtagatgtcttctatacaattaactttgccatttacgatggctcttctaccacacaatataccattaagtataaagtgacaggtaaaggacagtttgaatatgttgcagactccttgacgaagaaagtagaataa

SEQ ID NO: 2454 - DNA, 1395 bp, B.fragilis
aagacaataagaactatggaagataataaaaataagtctgaagttcaggcgcaagaaaccgttcaagtttcctataaagagaaaaacggggaatcctctctggcttcggcactggatgtgttgtccagattcggcggtttcaattttctggaatcaacagtagatggtgttcagaacctgaaccccgagcgtaaggcacgcaaaaagatattcttaaccgatgaacagaagcaagaagaacgggaagtgctgaagaataagatagatatgtggatcgacctgctgaactcatcatcggcagtgacggaaatgattgccacttctaaagctaaatcggaagctgccgcatcgcatcttgccaaaagccaattggtggcagtgcagagtgtgagggatatggaacaggcataccgtggagtgatgttgttctataagaatacggaagcggacaaagtgaacaacgtgacgatagtcaatgcttccaaagaacaactgaccgacctcgacaatccccgcttcattgatttcgttgcccgcgaactgaaacagaactatgacaagttggatttacgtcaaaattactcactgttagccattccgggctatcttggttcgaataaggtgcttgaaaaatgggcgaaaatcgcttatgagaataaagtgatgctctatacggactttgccgaccttgataagccggaagatgtggtggaactgttctcttcctccaatatggcaagtggggaggccttcaaaagcaatacctgcatgacctgcaactggctggtgggacgtgccggataccgggaaatcggtgaagaggaagacctccatatttctccgtctattgctttgatgggtaaagtttacaccactctgatgtctcaggtaactgccggtaagaagtatggcggcattaatgaaatagatgcggtggtattcccgttgaagaaaagcgaaatctcacaactggagaaaatgggtttaattccgatggttaatgaatatggtaaagtgatggcgttctccgcaaagacattgttcaacggtgacaatctgggattgcaaacttattctgtggtacgtgtattcgactatattaccaaggtattgtttgatttcctgaaccgccgttcgttcgagaactggagttctaaaaccgaacgtgacctgagagggcagattgtacagtatcttgatagtgtacagggagccgaccgccttatcgaaaaattcaagataatccgtttcgagcaagaccaaaagcagaaggaccgtatttatctggatattcacatgactccgttcttccctgccaagagctttgttatcaagttggacggcacgaaaggtgatgatggtacaaactggaatacaaattacgaacaggcgtaa

SEQ ID NO: 2455 - DNA, 2406 bp, B.fragilis
atcggacaaagcatggatagaatattgcatgacgtagacaatgcccacaagatacttcaactgacatccgacacactgatcttggtggacaaaaacggcacgtgtctggacatcgacccacacagcgatttgtggttcctgcaagaagacagactcttggggaaaaatctgttcaacctgcttcccgaccataccttccagaaactgctaccggacttcaagcgggtgacccaacaggggataacggtgaaccgtaactaccggctgccactggaagggggcgaaacgtattacttcaaatgtatcatgcagccgtacgactgtgacaaggtgctgtgccaatatcgcgacatcacggcgcgcaacaacgtgaaactgcaactggaacgcaccaactacgatctgaaggagatacaaaaagcggcacaaatagggcaatggaaatattcatcgcgagagaggacattctattaccggggatacaacggaatcgtatgcacggaagaagagcggagcatcaactttcaggattactacgaaaccatcctgagcgaagatctgcccgccgtgaacacatggatggaagccaaccgccgcgaactcctaaaggaatacatcgaataccgcatcctgctggaaggacaggtatattatatgcgccagcaatgctacctgcggaatgaagaagaagatggcaacatcgtcctggaagggtatatacagaacatcaccgacatacagcggaaacgaaacgacatcaacacgctgacgcatgccatcaacaatgccaaagaaagtgtgtacgcggcacgcagagacggcacgctgatatttgccaacaggcagttcaggctgaaccaccggatcgcggaacaggcggacttgtcactgatacgggtgttcgatgtcgtgggcgatatgacctgcatagaggactgggaagaacgttaccgcagcatacgggaaggccagaccctcaacttcctggcctaccaacccctgaagcacgataaaaacacactggcctttgaaggcaccatgtacagtgtgacaacggacgacggagaagaaaccttctggtcgttcacccatgacatatcggaacgtatccggtacgaatcgcagatcaaacgcttcaatcgcatcatggataccacgatggagaacatcccggcaggtatcgtggtaaaagatatcgagaacgatttcaggtacatctaccgtaaccgggagtcgtacaaccgggacatcagctcagaaaacgccatcggaatgaacgacttcgactactacccgccggaaatggcacagcagaagcgaaaagaggatatggaaattgccgctaccggaaaagggatgcactggattatggagggcaaggacaaaaacggaaatctgctgattctcgacaagcaaaaaatcatggtggaaagcgaggacttctctcccatcattgtcagcatcgaatgggacatcacccagctggaactgatgcgccgtgaactgatagaatcgaaagagaaagcggaaacatcggacaaactgaagtcggctttccttgccaacatgagccacgaaatacgcacgcccctcaatgccatcgtaggattctcgcgcatcatctcggagagtgacaatgcggaggaaaggagggagtattacgagattgtagacgccaacaacgaacggctgttgcaactgatcaacgaaatattggatctttccaaaatagagtcgggcatcgtagagttcacttacgggccggtgaggctgcacacactttgcaaagagattcatgatgcacacgtattccgctgtccgcagggagtggaactgaggttcgactcgccggacgaagcgctaagcatccactcggacaagaaccggatcttccaggtattctctaacctgataggcaacgcgttcaaatttaccacagaaggcagcgtaagctatggttacaaacaggaaggcgagcgagttgtattctacgtcaaagataccggactgggtatcgagcccgaaaagttgggaagggtatttcaacggtttgccaaactgaacaattttgcccagggtacgggtctgggattgtcaatctgtaaaacgatcatcgaacggctaggcggagagattgcggtctcctcggaagtgggcacaggaaccacattcaccttctggctgcctcttgagaatgtcatacaagatacggaaacgggaacgaacagccacttgccccggcgaagccgtcggaacacagccgtcggaagtgctcccggccaaagaggaaacgacggaaaaggaagaggaccttcgggcaaccgcagccggaacggagaaagccaccatactgatagccgaagacacagacagcaacttcgacctgctgaacgctattctgggtag

SEQ ID NO: 2456 - DNA, 465 bp, B.fragilis
aaacaaaaaagacaaatggcaatacttgaatatggaattggtggtaatgaagtgaaagttgatacttccgaagccatcgcaaacattccggagaatcgctccctcatagttgaacagttaactgctgacgaacctgtaactcctgaagcggtcaaaggcttaagcactatcgaagaggtgtttgcgcacttcttgcccaacattgatgttgaatttgaaaatgaagaagggcaaccggtaaaagaaaactttagatttagctcagtggcggacttcagtgtgaagaatatgacacagaatagtccattcctccataagttggatacggagaaaacattctacgaggggatggtgacacaattgcgttctaataaagttctacaacgggtgttggagaatccggaatccaaaaaggcgtttatcagcgcactggaggcattgagtaacgaattaaagaccgaataa

SEQ ID NO: 2457 - DNA, 2805 bp, B.fragilis
ctaacaaagagaattatgagaagacatctaattcatttcctgctggttgcagtgctgacggtatgttctgccgctacggccattgcccaggtaacagtgaaaggtcaagttgtggatgcggaaacaggtgagccattgattggtgcagccgtaacgattgtcggtaccacccagggtagtgtgactaacttggatggtatgttcacacaaaaagctgcctccggttcaacgctgcttatcaagtaccttggttacaaggaattcagcaagaagatcacccagaaaggtggtactgaagatttgggcgtaataaaaatggcagccgatgcaatggtgctgaatgacgttatcatcacttcttctgttgctgtttcgcgtaaaacaccggtagctgtatcgacagttgaccctgtctttatcgaggagaagctcggaacacaggagtttcctgaagttttgaagtctactccgggtatctatgcaactaagcaaggtggtggttttggtgactccaaagtgaacatacgtggttttaagactgagaactctgctatgatgattaacggtgttccgatgaatgatatggaatggggtggcatctattggtcgaactgggccggtttgagtgatgtgactcgtagcatgcaggtacagcgtggcttgggtgcatcaaaggtagcggctccttcagtgggtggttctatcaacattgtgactaatacaatcgatgccaacaaaggcggtttcgtatcttatggtatgggtaacgacggattgaacaaaatcctgttcaaggtatctaccggattgaccaaatcaggttgggccatgacccttttgggaggtaagacctgggccgatggttatatccagggaaccaactacgaagcctacaactggtttgtgaatattacaaagcgtttcaatgacaatcatcagttgtcatttactgctttcgctgctccccagtggcataatcagcgtggaaataaagacggacttaccattgaaggatggcaggaagttgcgaagaattatatgaatggtgagaagccttatcgttataaccctacctacggattcgggctgaacggacaaagaaagtcatcggcatataatgtgtataataaacctcagttgtcattgaaccatttgtggcagattaatgaaaagtcaagtttgagtacggctctgtatgcttctatcggtcgtggatatggctattccggtcagggattgaccagtgcggatcgcagtaactggtatggcagtaacaatggtaacctgaatatgactttccgtaaagccgacggtacatttgcgtatgatgaaatatatgctttgaatgaagcgagtgagaatggttcggttatggcaatgtcgaagtctaagaacttccataactggtatggtctgctttctacttatactactaagttcggtgattacttcgatttctatggtggtatagactaccgttattataaaggtacacacaccaatgaattggttgacctctatggtggtgacttttatgtagactcttcttcaagaaaaagtgttttggcttcaaacaatgccgccgctgctgccggttcttcatttgtgaaccagaaattgaaagtaggtgatattgtttatcgtgactttgatggctatgtgatgtctgagggagtatttgctcaaggtgaatacaacagagataagttgagtgccttcatttccggttcggtttctaataccggttactggcgttacgaccgtttttactatgacaaggcacacgccaaatcaaaaactgtcaacttcatcggttggaatgcaaagggaggtttgaactacaaccttaccgaaaatcataatgtgtttgccaatatcggttatatcagccgtgctccattcttctcgggaggtgctttccttaattcaacagtcagcaatgcgacaaaccccgatgcagtgaacgagaaagtgttctctttcgaaatcggatacggctatcgttcgagcttccttactgtgaacatcaatgcctaccacactcgttggatggacaaaaccactacccgttcacaggatatcacaaactactatgaaggcagccttagcgagccttacgatgcaagtaagctggtttctaccaagtctgttatcaatatgcagggtgtgaatgctttgcaccagggtgtcgaacttgattttgtagcaaaacctttccaatggctggatttgagcggtatgttctctatcggtaactggcgttgggatagcaatgcttcgggtagcttcactgtagaaggtcaatttgtgaacagcgcatctatcaagggaagcgatggtaaggatgtgaccgttcttgtaaatgcggcagctaacggactggaaccgggtacaatgaaactgaacctgaaagatgtgaaagtgggtggatctgcacagactaccgcagctttgggtgctactttcaagatcgacaaagcccttcgtctgggtatcgactggaacttatacgcacgtaattatgctgactggtcattgaactcaaacgacctggtgatgaacagtgagaaagacttttctactccttggcgtattccgactgcaagtactttcgatttgaacgcaagttataaattcaactttggtaaactgaatgcagtactgtcaggtaacgtgaacaacttattcgaccagacttatatttctgatgcgacagatggtagcaatcacgattggaagaccgcttacaatgtgttctacggattcggccgtacttatagcttgagattaaaagttaatttctaa

SEQ ID NO: 2458 - DNA, 255 bp, B.fragilis
gcatcttttgggagttgtaggctcttatatatgtgtgagctgttcggcgctgtttgcaagctggtttgcatggcattgggtacaccctttttcttatgtaaagtatttattgtgtggcttgcttactgcatttttgtttcatgcaggcttaactattggttgcagtattccaattatctttttatcttgttgtggggttcatgtgataagtacagaagctataactctgtgggaagtattaagctatctttttag

SEQ ID NO: 2459 - DNA, 219 bp, B.fragilis
ggagctattggtaccctacgaaaaaaggcgaacttatctaccacggaagccaccgaaatgatggaaatagaccgcagcctgctgagcaagccggaacacggcaaatacgtgtcaatcgacaaactagcggaaatcataacctataacatctcctttataaggggcaactcgaaaggaagaatcagtcagcaagaaatactcaatgaaatcaccacgtaa

SEQ ID NO: 2460 - DNA, 1488 bp, B.fragilis
attaaaaatggatatgctatgattgaatttattgatcctaacagcaataagctcgtttcgagcggacctacaatggcgcgtaaagcctactatatacacggaactacttcggataacgataggtggagtaattatccgtctactgtgcagcaactgaaccgaatagcgtttgggataggagtggataagaacgacacggaaggaataaatgatatggggagcgagaaatttaaagaggcgtgttgcgacttttctttcgagtggggaaataatggaatcctcaaagcggggaataactggtttctcaataccgttgaagacagacgaattgcaagcgaaaaacttattgagcatatcaatggaaatataggaaaatgtgaggaggttgttttaatcggacatagtcatggaggaaatgttgctattcaggctgcggataaaatattcagtaaaataccggctgttaaacgtgtgtttgtgttgacaataggaacaccggcgtttaacaggctgtttatcacgtcctatattaataacaaaaatcttatcacatttaatgaaaaagtatctgagaaaattctatatcttggtaaagattatgtagttcctgttataaagttgggacgtaaattctggggaccattaggaatatttctctatataaattgtgaaaatccggcaacatggaaaaacaaagacaagataactcatattgctttgtggaataagaaagaccatgtagacgatatggcatgggtattggataggaataagtatttcccttatcatggcatgacgaataatagtgcctattttactaattcaataactgataatgtggaatttgattttgctccggcagatataagagattactataaaagggaaattaagccttttgcagaatggcttgctaatctggattatttaagattttgtctggtggatttaagattgaaagggtatgacctaccgaaaatgcccacattgcttacatataaagagtatatcgtccgccgtaaaaaaatggaagcatcaaaactcgaggagaaaaagtatgtgaatgagcgggatgctttgcgggttgacattcctaaaccgaaacctataatgatgtgtgcttcgacgagattaagggaagaggcaaatgatcttcaagaattattcaaaagtaccaacggcttttatcaatttatgactgacatagatgaggcaaagaaagacagaagtaaagtagttgatacacaaatggtaatagatatatacaaacaaaaacatcctgaaattcaagccattgaagaaataaagcaagaaatgtatcgtgagactgagtttctggaaaaagcaatggctatctatttattggataatacttcttttggagagcacggattcgatttggctaatccgaagctaattgaaaaggcgattaatgacgggagaattaaaccgttcccgaatgcgagaaatattaatacagaattttaa

SEQ ID NO: 2461 - DNA, 789 bp, B.fragilis
tacagaattttaatcaatatgaaaaatataattttaataatcttagtactgttatcttcttgtggtttttcacaacgacagaataactggcgggatggtcatgttgagttagactccataccattaactgcgtatgaatataaagaacgtggtaaaagaaaatccgctaatggagataagcaaggtgccatagacgattacacacgtgctattatggttgaaccaacatatgatactgcatatcataatagaggagtcgttagagcagatataggatattataaagatgcaattttagactatactaaggctattgaaataaatccacatttcgcagcttcatatttttctcgtgctaatgcgaaagtggatttgagagataataaaggcgctctttctgactactctaaagctattgagttaaatccccgatttattgacccctatgttaatcgaggagtacttaaatctgaaatgggtgattatgagggtgaaattgcagactatcatttagctatcaagcattgtgaaccatccgtaaatttatacaataatctgggacgcgccttatatgccttagagcgtttcaaagaatcggcagaagcctacggcgaaggtattaagtattttcctgaagattacagactttattatggtcgtggattggctcgcaaacgaaccggagataaaaagggagcttgtgaggattggatgaagagtagcgagttgggatgcgtggaagcaaacttattgttacccctatgcaaagagtgtgatacgaagaagtga

SEQ ID NO: 2462 - DNA, 183 bp, B.fragilis
agattttctattaaattcattttttccaagatatcctcaagatatccgtatagtgaggagtacaaaaaggtaggagcggcaagaaaacaaaacctatccaatacaatgttattaactgatttccagaacttcttatatatctcttattatatcgctctccctgataataaaggtagtcgataa

SEQ ID NO: 2463 - DNA, 2316 bp, B.fragilis
tattcaaatatgaaatatatgggaaactctttaaataaaaacaaggaatggagcgtcacaaacagcccgattattaaattaaaggttgataaaaaagagcctaaattcaatgctacggaagctgttaagattcgaataacagcagaatgccataatgtgactatacccaaaaacggattagaatatgaatggagctatgtggactccacaggctttatgaagtcttttacgactaaaaaaggcgtggttatgttgcattgtcctaatttcttttgcggtcgtgttatgaccataaaagtaaaagttaatttagaaattagcaaattcgacgaaaagataaaattctcttcttttgatttcgggaaattcgatacattggaggatactattgagattaaacctcaatgtaataaaaagctttcagacaatgccgagtggcttccggacgaagtagaaatgcccaattgcgtacaaagctcagttacattatatggatataatggaagtgaaatggggctggtgcgaatgataaaagaaaaagggaaaattatctggaagggtgaagataaagtgatggtacgagataatgttgtctccgctctttttaatagaaaccactgcacctccagtacagcggatgacagcatatatactttgcaatttcaattgactgatgcccggaatggaagccttttaaaaagctattccagagactatacaataaagggacgtgaagctattaaacctttagccggatgtcctatacaaccggttgtagtaggagatataacaatagcagaaaataactttaagccttgtaaatacacgcaaattgatgtcgaatatacaaaagataaggagggtaaagaaaaacaaaaaatgacagttttcaaagaagggcttcagtcaacgaataccgtcaatctgatcggtggggagcgtaaaataactgtgaccttgttggagtataccccgaaaaaatgcacattgaaagaaaactctcataaaaagaaggaagaagttccttttatgctttatggagaaaacaaaagcaaacttcctatttccgtatccggcaaaaccggaaaaattgaaaatatcaagataaaatacaattatggtataataaatgccataaaaactttatggttaccgatgagtggtattgtacaaacaagcaagctctatacgagttatgccaattgtaggcatttcaacgatgtaattttcaatatgtatcctgatacaaaatgggaagcattcgttgaactcagttcttccaaaccgagattatactctcatacaaatatgccggcagaatattccatatttgaacggcatcagaaaaaagcattaagtgcggccaaagaagataaagacattggattgtcttttagcttaatggcaacgtatgatgatgatatagaaataaaattaactgctgatatagaaaaatccgtcaaaacggtatcccatgtattgaagactatccgggatgcattggatgtactgtcattcaaaaagtcggtggatgataataaagacaaattaaaagcaagaaatgttttaccgaaaagttctaaacttccggtttttattgagatatccagtccggttcttaaaattggtggagggtggcaatatgatttgaactccgaaaatcagcttatacgcaaaggtgaaattgcgattgcggcctcaccccttatcgaagctaaaggtggtattgacctgatagcttgctctacctttataccggttgtgggtcaaataataaaggctatcctcaaattaaacgactttgcagaatgggctactaaatacctatccaatgataaggcaaaatacgaggggctgatttggttcaatatatacctcaaaggaagcctttctattgttggtactgtcaagttgtcggaagaaaacagaacagttaagtttgaatcgccggtaaatattgtatttgtagtcgagcttggaataagtgcggaggtgaaggtagaaacggttaccattacgggtaataacacttacaccgtacgtgccggggcgagtggagaagcaagtaccggactaacctttaagccaagtatgggttatagtacagacgaaggtatatatttaggttttaaagttagtttcgacggaattatattaacggtgagtggggaagcgaagtttgaacaaaaaaagaaagggaaaaaaacactttctataggtcccgaaataaacggagaacctcttccccctttgattgccccctgttccatatggaaaggagaggtttatccattccgtgaaactaataaaaaataa

SEQ ID NO: 2464 - DNA, 966 bp, B.fragilis
tggattgatatggaacatcgcttacccaaagagataaaggggcttcttccgcccaatacaatggacaccgacttcaaggcagagctatacggagccttgctagcggaagccgggttcgacaccgctcaaattatgatggtgcgtgacggtaataacctgagcaatgtttcgaaagatatccgatcggtgaagtacagaaatcatgtcgggatagcggaggggacatacatagaactaaagaccaaccgccgggggatttatgattcgctgccggagggattgttccatgaggcgctctttcccggcaaggtgaaagatttgggacttattctggaagagatgcaacaacatagtaacgaagagttctttatccgccgttttttcagcctgctggagagcgaagtggacagagaagggatacaggcacaattgctcgaattgcggtacgataaaaagaacaaatattctgattatgcgaaactctttgccgcttgctggccggtcattcatattttgtccggacagggggcgttgctgttcatcaagttcatgccgcatatccattcgatccggggcagactggaagaggtaagcgacgcactgtcgcagattctggaagctccagtaaaggtacgcccgaaaatggtgcaacggacaataagggcgcaaaacccgaaccggttggggaacatgagactgggagcaaacagtgtgaatgtgggggtgcttaatagtgcgggagctgatttgcatatacacataagcgacctgccaacacgggaagtcgaaaggttcctgcccggcaaccgctcccgcaaagctcttgaaatgctggcggatatttttcttggtgcgtggcaggagttcgatgtgacggtcagcgttagtcctgacgaacgcaagacttatttaaaaccgacgggtgacgccagtccgtgttacctcggaataaacacttatttataa

SEQ ID NO: 2465 - DNA, 924 bp, B.fragilis
cagcctgatatcatgaacggactacagatcataaaaacacttgcactcaaaatacgctatgcatctattgtagagtggtacaacttctggtcaatagtattgcaacaccatcaaaacatcgttcccaccgtagcctccattgacgagaccatccgacatatcacggagggaaaccgttccatcagcagattcggagacggagagatgctactgacaagcccctccaaatccatcggcttccaggaaggctctccgctgcttgcaaagcgcctgcgagaagtgctggtcagccacgaagaaggacatctggtggctatccccgatgtattcagcggactgaaccgttacaggcgcaaatgccgtcggtttcagcgaactcacttcttcatttacggcaaatggtgggaccagctactgatccccggacgaaaatacgaaaacgcatttctctcacgcccttatatggactatacatccaaggaacattgcgcacgttggtttcgggaactcaagaccatttgggaaggacgcgacatcgtgttcatcgaaggcgcaatgagccgacttggagtaggaaacgacctttttgataatgccggaagtatccgacgcatcctctgcccgccccggaacgctttcgaacgctatgaccgcatcctgaacgaggcactgaaagtagaaaaggaagtactattcctgatagcattggggcctacggccacggtattggcatacgacctccacaatgctggataccaggcggtagatatcggacacatagatgtggagtacgaatggtggcggatgaaagcacggagaaaggtgaaactggaaaagaaatacgtgaacgaagcattcggaaacaagcgggtaaccgacgcaggtgaagggtatcggaaagagattatcgcccaaataagttaa

SEQ ID NO: 2466 - DNA, 477 bp, B.fragilis
tatatggatatagcaaaaattatatatgtaagtttaacaatgctgactgcatgggtgtttatgagtatagcatttccaatcgatacttataagcatcttttgggagttgtaggctcttatatatgtgtgagctgttcggcgctgtttgcaagctggtttgcatggcattgggtacaccctttttcttatgtaaagtatttattgtgtggcttgcttactgcatttttgtttcatgcaggcttaactattggttgcagtattccaattatctttttatcttgttgtggggttcatgtgataagtacagaagctataactctgtgggaagtattaagctatctttttagcattttcattatgtctttctattttgtgggaatttttacttttggacaatgcttgctaacagcgagcataacaaagataataatatggaaattgaatataagtaacaatatcactaataacgcaagataa

SEQ ID NO: 2467 - DNA, 321 bp, B.fragilis
attaccagcatatctataaccataagcatacctaaaaaactatcttccataacaccatatattccaaatagtcgcccgaagcctaagccacccaaaaagaatgttatcactatcagtaaaaggctgacagcagtcaatgatagtatagactggactgttttattcatcgcacaattgttagtaatggttcagcagggaacggcttgccgttatcttgcgttattagtgatattgttacttatattcaatttccatattattatctttgttatgctcgctgttagcaagcattgtccaaaagtaaaaattcccacaaaatag

SEQ ID NO: 2468 - DNA, 195 bp, B.fragilis
gataatacaatgccatatattactattgaaggggggtcactcacccgtgaacaaaaaagtgaattaatccgaaaagtgacagaagtagcttcggaagtcatgcaaatccctatggaattctttttatgtacggtcaaagaattaccagatgaaaatataggaataggaggtcggaccattgacttgattaaataa

SEQ ID NO: 2469 - DNA, 864 bp, B.fragilis
caaatgaaaataatggagattaaatatatattttgtatcgtcttttgtttttgggcaatgaaaacgacaatggcacaaagcgacaataacttgtttgctttggaaaaacagctttgttttattcaagatacactatctatactacggcaaaattatccctatacagatgataattactgcgattctttacaacatagattctctatcctgctggaagaactttgtgcagtcgataaagaaatgaaatacgattttatagaattgaggaaaaaagaacggcaatttactatggcagtatcagtagacgaggatatgagggtattttcccgaaacacttatttcggtggttcgatgccattgtttgcttcttatattcaatataaggataaagaacacttgtatttcttcgatataaacgaggataatgatatgggaatatgttatgatacaatttattccattcaggcattgaataaaagatattacctgctttcaggaacaagccaaatagcggcggcatatcctttagtggtaatgaaagctgttagttgtgcaaacggagagttgaagaaagaaataatatttgtttccggtaatcagcaaacagattatttgtctatctcttatcgctatgtaaaagataacatagacacacgattattcattagtggcaatttaacgttcccccgtattgtatatgttgaaacacaagaggaaatattaaagcctgttaccgtgagagataaagacgatatcaaatatatcggtggagaaattgacgtttataaacttgaaagaaataagaatgaaataaaattcatcaataacaacgaaagttaccacctaaacgatgatcctttctaa

SEQ ID NO: 2470 - DNA, 198 bp, B.fragilis
gctgagcggatagagtacggctatcaacaggatgctgaccatcaggggcgagatcagttggatggcgaaatggcgcaagctgcggtgcagcgtcatccggtacatcatccagtagcactgagcgaagttgacggtaaacgtgagcgtgatgcatgtggctacagcttcgagcgtgccgaaccaaaaaatgcccagtag

SEQ ID NO: 2471 - DNA, 336 bp, B.fragilis
  unsure (310),(312),(315),(320),(328),(333): Identity of nucleotide sequences at the above locations are unknown.
cgccagtccgtgttacctcggaataaacacttatttataagaattatgaaagcaaagaacagtgagaaaatcatccgtggatatttggagtttgccggcggactgttaatcagtacggctttgagcatggcactgctcacaggctttatccatacgaatggaagcgaatataaactgatggaatccaaaacgcaagaatacgataagatttacgccagacagattgccctggtggataaggtggattcgctgtataactacctggtgctgatggtcttcaccacggggctggaaagagccgctgcaattncnaanagccnctctattnccaanccc

SEQ ID NO: 2472 - DNA, 315 bp, B.fragilis
tttgtccgcttccggatagtggggcgcacgatagaatttggacgcaatagcgtacaccaacagataggctacgcaaagtgccagcggaacgaacaggatccagtcgaccaagctcagatgagtatcataagtcttaatgtaggttatgggtcgatatatttgtgtaaatcggttcaactgtggttcaccacagattacacagaggatcatttcggcagagtcttacagaatcctatagaatctcagagaattccacaggatttcactttctcgtttatggatatcccccaagaaaatgattcctctctgtgttaa

SEQ ID NO: 2473 - DNA, 3747 bp, B.fragilis
aaaaatcaagttcaaaacccgaaagtaatgacttcactcaaacatcaactcttttccggagtattctataccgcccttgccaagtatagcggcataggggtatcactcgtcgtagcgggtgtgctggcacgtctgatttcaccggacgacttcggcgtgatggccgtagccacggtaatcatcgcttttttcaacttgtttactgacgtgggactgtctcccgccatcatccagcacaagacactgaccggagaaaatctgtctggcctcttctccttcaccgtctggacaggcattgggctggcgctgctctttgccgctgcctcgtggcccatagccgcctattacgaccgggagattctgcgccccctgtgccagctgctggctgtcaacctattttttgcttccgccaccatcgttcccaatgcgctgttctaccgcaataaagagtttaagttcatcgccctgcggagtttcgtcatacagatagccaccggaacggctgccgtcgtggcagccctgtgcggagccgggctctatgcgctgatcatcggccccatcctgtcgggcatcctgatcttcgcggtctccatacgccactatccgcaacgcctgaagtttacactaggactggacgtgcttcgccgtatcttttcctactccgcctaccagttcctgttcaacatcatcaactacttcagccggaatctggacaaactgctaataggcaaatacatgggcatgtctcccttgggctactacgaaaagtcgtaccgcctgatgatgctgccattgcagaacattacgcaggtgatcaccccggtgatgcaccccatcttcagtgactatcaggatgacctcgagcgactggcttccggctacgaacgcatcgtccgcttcctcgccttcatcgggctaccgctgagcgtgctgctctacttcacggctggcgaagtgacattgatcatcttcggcgaccaatggacgccctccatcccggtattccgaatactcaccctgtcggtaggcgtgcagattatcctctcctcttccggctccatctttcaggcggcgggcgacacgaagaacttatttatgtgcggactgttctcgtccatactcaacgtcactggcatcctactgggcattttttggttcggcacgctcgaagctgtagccacatgcatcacgctcacgtttaccgtcaacttcgctcagtgctactggatgatgtaccggatgacgctgcaccgcagcttgcgccatttcgccatccaactgatctcgcccctgatggtcagcatcctgttgatagccgtactctatccgctcagcctaatgacagaaggaggcaacatttttctgaccctgattgtaaaaagcattatatttttctgtatatttgggtgctatatacagttgaccggtgaatacgacatcactggcaagggcaaaaagcatcataaacaaaaacaaacgatgaaagcactgtttcttatattccacggatttgaagaagcgaacggcatcagcaagaaaatccgctatcaggtaaaagcgctgaaagagtgcggaatggacgtgcacacatgttatctgaacgaggaaaatggacacaaatgccggatgatagacaatcacacgctgcgggactacggcagcggaataaaaggaaaactccggaaaagatttgagttacaaagcatcgtaaaatacattctgcaggaaaatatccggttggtctacatgcgttcgtaccacaacgccaacccgttcaccatcagcatggtgaagcagttgaaacgacagggagtgaaggtggtcatggaaattcccacctatccgtacgaccaggaatacatcacccgcagaatgaaactggatctgcttgttgaccgatgcttccgcagaaaactggcggcacagcttgacggtatcgtcaccttctctgatgcggaaacaatattcggaggacatacgatacgcatctcaaacggaatagacttcgatgccataccgcaaaagataacccggaatgacacttcccgagaactgcacctgataggtgtggcagaggtacactactggcacggcttcgaccggattataaagggaatggcagactactacgccacccacccctcctataaggtctacttccacatcgtgggtgcactaaccggcgaacgcgagcgcagagagatactgcctgtcattgcacagtataaactggaacctttcgtcatactacacggacagcagcacggagagcaactcgacaagatattcgaacagtccgatttcggcatcggaagcctggcaaggcaccggagcggaatcacaaccatcaagacactcaagaaccgggaatatgcggcccggggactacctttcatctactccgaaacggataccgactttgacgacaaaccctacgtactgaaagcaccggcaaacgaaactccagtgcggatacaggcgatagtagacttctaccaaacacaaacatgggatcctgccggaatcagacagtctatcagccacctgtcatggcatgcacagatgcagaaagtgatcggaaagtatcaagtaacctctgaaaaaaagctgaaaatagcctattgcattccgtcaatccactgtccgggaggtatggaaagagtgattagcctaaaggtaaattatttcactaagaaattcggatacgacatacaccttatcctgaccgatggcaaggacaaggccccctactatccgctgcatcccagcatcacgctacatcagttggacatcaattacgatgaaatggacggtatgcccgttttaaggcacatcacgcgatacgtaaagaaacaaaaactattcaagaaaagactggacgcatgccttaacgagcttaaacccgacattaccatctccactctacgaagagatatcaatatcatcaacaacatgacggacggcagcatcaaactcggagagatccatttcaataagtctaactacagagaactcagcgacaagcccttacccgcatttttgaaaaagtggatacgaagctactggatgaaacaattgataagaaaactgagaaagctcaaaagattcattgtattaagttacgaagacgctgccgaatggacggaactgaataatgtgacggtaatccacaatccgcttcccttcttcccggaccgacaatcagacggaagtcggaaacaagtgatcgccgccggacggtatgtaccccaaaagggattcgacatgctgataaaagcttggaaaatagtttcggaacaacacccggactggacactgcgcatttacggcgacggattcagagaagaacttcaaaaactgatagatggcttgggcatatcccggtcgtgcatcctggagcacaccgtcagtaatatagtagataaatattgtgaaagctcgatcttcgccctctcgtccagatatgaaggtttcggcatggtgctcgtcgaagcaatggtatgcggagttccgccagtatcattcgcatgcccctgtggcccgcgcgacatcattgatgacggcaacgacgggctgctggtacccaaagaaaacatcaacaagctagccgagaaaataggatacctgatcagccatgagaatatccgcaaagagatgggacaacgggcccgcatccatgtggaacggtttaaaatagaccatatcgcctcacaatggaaagaactttttaacagcctgatatcatga

SEQ ID NO: 2474 - DNA, 213 bp, B.fragilis
tacgaagaagtgaataatgccatcgagaaaatagggcaagagatgtatcgtgagactgagtttctggaaaaagcaatggctatctatttattggataatacttcttttggagagcacggattcgatttggctaatccgaagctaattgaagaggcgattaatgacgggagaattaaaccattcccgagagcgactagaaaaacaaaagattaa

SEQ ID NO: 2475 - DNA, 1467 bp, B.fragilis
gttaatggagttatattaatgacatgtaaatatgataggataatgaatataaaaacacttttgattatgggattagtgaatatgtttgggttaggtgggtgtgccaatgccgaaatagggaaacaagttctcaatctggatgacttggattatggcattgacgtagtccgctattatgctccggctatggaagagagcaaagacactgtagaagagcattattacgtaaacagagatacggtgaagttttatgatacggaaacggacaaacttcttccggtcttgattgcataccgccatcttgcgggagtggtgaaggaacaagccactttctgtggacatagctttacaaatgtgagcatggctacaatggaagacggacatttgataatggtgcagtgcgaagtcgagatgcagccagccgacctctcccaactactggcagcagccgtcaagaaatacggagagccttacacggaagaaaaggaccaatttggcaaacctgatcctaaatggcgctgggaaacaaaggacgagtatatccaactgaacgctaaaaatatgagcgggaaggaaacactaaacatagaaacgacggacaatgtggaagaacctgtcaaaataggaaatccgaaaccctatgtgaaagttgccctataccgctgggcgaaaaagtaccatgatttggtacttgccgaagaacccctatacggcttttcgccgctcaataaagaagccgaaacgcgttgggataacgaccacataaaaagtgcgaaattctatacaccggaggaagtgaaaccattcttcattacagcacattatctcgactcgctcgaacattcgggtgatgtatggggcaaaatcgaagcaagtttctattaccgtattccgaacagcaaagtaacagacgaaaccggtataacagattccgtaaaaatcaaccaagagggttgccttccttgctggagctttggtggacttgacagagattttaagaacggactgagtaacgcggcatatatagcccgccaaatgcaaaaaggcgtgaagtttaccgaaataatggaagacaaagaactgtgcccggatgtctattattatggtgaagcggaatggtggaagaaaaagaaagtattcgggattgtgcggtttgaacgggatgagaaagataatatggtgctgagagaacctgaaacagatagagacgatatacgcagaagggttcttataatcaatgacaatataaaagaagagttgcggaaaagcggtctggatttggagcatacaacagcgcgtttgatgaatgctccgggcgatataactcctttggctttcttcactgacgggaaactggatatgtttatgtgtatagacgaagggcgttacagcttctcaactcctaaccatgaatgggaatcaaacaaaatttatcggctttatgactatctatcggacataaagtaa

SEQ ID NO: 2476 - DNA, 360 bp, B.fragilis
ctcaaatcttttccggagttttccttttattccgctgccgtagtcccgcagcgtgtgattgtctatcatccggcatttgtgtccattttcctcgttcagataacatgtgtgcacgtccattccgcactctttcagcgcttttacctgatagcggattttcttgctgatgccgttcgcttcttcaaatccgtggaatataagaaacagtgctttcatcgtttgtttttgtttatgatgctttttgcccttgccagtgatgtcgtattcaccggtcaactgtatatagcacccaaatatacagaaaaatataatgctttttacaatcagggtcagaaaaatgttgcctccttctgtcattag

SEQ ID NO: 2477 - DNA, 393 bp, B.fragilis
aacatggcatttagagcaaccttaagctttgcaggaaaagagtttgacgtgctggattgcacgtacagtctcaagcgagatgtggattccaaaggacgcccatcttcaaacatttatggtggacaaattcgtctgcatgtggaatcgactgatgatacttccattctggagaacatgaccaatcagtttaaacctcattccggcagcatcgtcttcaaaaaaggagatgaagaagccaagatgaaggaacttacctgggaaaacggatacattaccgaatttaccgaaaacatcgacattgtcggctcgcagccgatgactatcacttttgtcgtatcggctcaggtaatcaagattggtggcgcacaatttgaacagaattggccgaagtaa

SEQ ID NO: 2478 - DNA, 1836 bp, B.fragilis
aatataaaattaaaacgtatggcaaatctattcacaaaagaaagcattaaagcccggatgttcaaacaggcggcaaccctatatgacatacgaaatatagatggcatagacccccttatccgactgctgattgaagccttgtcgggcgaaattttcaagctgtccggtgatatgcacgccattgaaagccgattgttggagaaagtcgcttccgcccttactccacacacggcattggttgccaaacccgcccatgctattgctgctgcccgaccatatacaccgcaagctactgtatctcccacagacctgttttcttataaaagcacggagatagtgaagaagtataagatgaaaaatctcttctttactccgctgcatgaaacccgcataatcaatgccgaactgaagtttctcgtgacggcggatgaattttgcacaatcactcccgaaggagaacgtgacgccactgcccgctttcgttccgatgtgccggtaatgggtcggaaaatcagtatcgggatgaaaataggcaacaatgtaactaccctcaacgacttgccgttatatatagatataccgcttgtagcagataaaagcagttatctgaaattactgccgtactgccattgcacgattgccggtattcctgtagaaattaaagggggaatcgagtacgcccccacacgttcggtcagtgagaaatacgatcttggcaggttgattacggaagaaataaccagcaaatatgcttcccattacctgacattgaaagctcacggattaaaagtcagagatttgtcacgtagcagagtgcccgaagaaatctctttcctgctgccaagtgatttcattgctgaatgtgatgcggatactgtttggatagatatagaatttcccaccgctttttcaaaagaaatactggaacagataaaggtgcagatgaacacttttatcgtagtaaacaaatatccggcaaagattaccagaaaggtagattccgtctcggccattctccctttggaaaagacggaatttgaatatttcctgtttgtggattcgattaccgataaccacggagaccggcttagggaaatttccggcacacaggatgaaggtagggccggctgttattcggtcagaaggggcggttgcgaacgcttcaatgcgatggatgccaaagattttctgaaccgcctgacagacctgctatatgacgaaagcatggccttctcttcgacagacaaagacggaatgaaagaggtaatcgagcagatagaagaacgggtaagccaattgggagataaaaataaagacggagtcggaggacaggaaatgttgtcgtatgtagtcatagaccaacgttatgacaaggatacccggttaactgtggattatactcttactaatggcgaatttgccaatgacatctatgcgggagagccattaaatgactgtgctaatcccgatatagacaaagatacactgcggtttgtcactttcgcccatggaggagagccctccccttccgtaaggcgccggatggatatgtacccgatcatgctgttgtcacacggcagtatatacacgaaagaggatatacgcaatttctgcatggcaaggtatggcgacagcatccgctctgtggaggtaaagctggggtatgcagccggtaaaaaagaaagcgaaggtttcataaggacgctggacgtgtatctacggctatcggaggggatgcaaggattagaccgggacgaattcgtcgttgatttggacagtgagctcaggcggttgtctccggaaacctataactaccgtgtttttattaactcatag

SEQ ID NO: 2479 - DNA, 552 bp, B.fragilis
  unsure (319): Identity of nucleotide sequences at the above locations are unknown.
aatgcgaaattcaaaacaatgggaaagaaagctgtatccaaactattttattgtacgtctattgcactgacttttgtcctggccggcatcaccattgccggagcattcgccggacacatacctcccgagcactccactctgatgcctttcatcgggctggcgctgtcaggactgttattgatcaatcttgtcgccgccatttactgggggattcgccggaggttctggatcatcattccgttgatagccatagctgccaactggcaatatctgggtcggatcttccaacttcttttacggtcggaggaaaaagaggcanatacactgaaaatagcgacatacaaggttgacagtttcggtacgaagcagtcgggatattcgtgcaaggagattgcggcttatatgaaagagcaccgggtggacattatctgctttcaggagtttgtcgggcaaccggtacttttacttcagacagcatacggaacgcatttgcagactggcagtatgccgtcattccgcaagctccggacagcacacctatcttgcaggtag

SEQ ID NO: 2480 - DNA, 996 bp, B.fragilis
gagttaaattctaaaataatgaatataagaaatttattttttttaggtagtatattacttttattgagctgcaaaaatagtaaacagcaggaagggtataattctattaatattattaaatatattaatatttataatgaaaacaacaggattctaactgcacaaggtactgaatatgactatctctattttggagacaataaagataaagagatcttggcgaatgtaaataattttacaaagacatatagttatgataatgattcttcctgctatactgtagaggaacccttgtcggaatcattgctaaaaacaatgagatacactgaaaataccatagaagaacttgtattggaaaataataaagacacatttagttatactttttctacctattatgataagaataagcctaagtataataaaagtattataatattaggagatgaaccctcttctgactcaagatatgaggaatactactactatgataataatggaaataatacgaagaaaatccatcatgatttaaacaccgggcaaagagaagaaacctataaatttaatgatacagattataaagaagctgttaatcttgtcccttcttccgattacaaacaaaatatcgagtgttcattgaaacaaactgttaatgataccttaatcactcggattaccttaaacggtgtacttaatagagtgatgaaggaatacattgatggaaaaaagaaaattaaggaagagttggacaatgatatgactttagtcaataaaaaaacagagtatgaagaaaacggactgaaagtaaacgtcaatcatactataagaagtacaggctactcaaccgacagtatctattataaagggaacaaaaaagttaagcatatctacaattccgactacaatggtaccataacacttgaaatctcagaatatgatgagcaaggaaatatagtaaagaaaacaaaaaaactcagatggccatcagataaataa

SEQ ID NO: 2481 - DNA, 303 bp, B.fragilis
ccaatattcctcactgctgcctcccgtaggagtttggaccgtgtctcagttccaatgtgggggaccttcctctcagaacccctatccatcgaaggcttggtgagccgttacctcaccaacaacctaatggaacgcatccccatcctttaccggaatcctttaataatgaaaccatgcggaatcattatgctatcgggtattaatctttctttcgaaaggctatccccgagtaaagggcaggttggatacgtgttactcacccgtgcgccggtcgccagcaaagaaagcaagctttcttcctga

SEQ ID NO: 2482 - DNA, 192 bp, B.fragilis
cctccaacaaagttggatgacattccttcagaatgccgggttgtcccattcggaaatcttcggatcaaaggtcatttgcacctacccgaagcttatcgcagcttatcacgtccttcatcgcctccgagagccaaggcatccgccatgcgcccttatttactttcttttatcgccagggatcatttcctttga

SEQ ID NO: 2483 - DNA, 189 bp, B.fragilis
tgtagaggtcggcagttcaactctgcctgggactaccaacagatagatattttatcttgtatgattgggggattagctcagctggctagagcatctgccttgcacgcagagggtcaacggttcgaatccgttattctccactccgataccgcaaccgaacaggcttgcgtgttatcaaacgatctttga

SEQ ID NO: 2484 - DNA, 2004 bp, B.fragilis
tccttaattcctcttattatgaaaatgactctcagcaatcagttacctgaatatccggtattcgccgaaggtattcgccgggcgcccgaccgtggatataccctttcgccggcacagaccgtcacggccttaaaaaatgcattgcgttatatccctgtagaactgcacagaaaactggctcctgaatttctggaggagttgcggacccggggacgaatctatgggtaccgttttcgtccggcaggcgacctcaaagccaaacccgtcgacgaatatcaggggaactgtattgaaggcaaggcctttcaggtgatgatcgacaataatctttgttttgatatcgctctctatccttatgaactcgtcacttatggcgagaccgggcaggtatgtcagaactggatgcaataccggttgataaaacaatacctcgaactcctgacgcgtgaacagacacttgttatcgaatcgggacatccgttagggcttttccattcccgtcccgatgccccccgggtcattatcaccaattcaatgatggtaggcatgttcgacaatcagcatgactggcatgaggcagcccagatgggagtcgccaactatggccagatgacagccggcggatggatgtacattggtccgcagggtattgtgcatggcacattcaatactctgctgaatgccggccggctcaagctaggcatccctcaagataagaacttgagtggacatttgttcgtttcctccggtttgggtggtatgagcggtgcccaacccaaggcagccgaaatagccggtgctgcttcgattatagccgaagtggaccgctcgcgtattgaaacccgttacaagcaagggtgggtggagcatgtcacgactgatctccataccgatttccggatggcactgagcgctgctgaacggcatgaatcctgttcggtggcctatcatggcaatgtagtagatctgcttgaatatgccgttcaggaagatattcctattgaacttttatccgatcagacctcctgtcacgctgtttacgaaggtgggtattgtcctgccggagttactttcaaagaacgtactcggttgttgcatgaatctcccgaagcgtttcgtcggttggtagacgaatccctccatcgtcattttgcagtgatcaagaaacttgtttcccgcggaacttattttttcgattacggcaactcgtttatgaaagctgtctatgatgctggagtcaaagagatttcacgaaacggaaccgatgaaaaagacggctttatctggccgagttatgtggaagatattatggggccagagcttttcgactatggttacggtccattccgttgggtatgtctcagtggtaaccccgaagatcttgccagaacggactgtgctgcgatggaatgtatcgatgtgaaacgtcgtggacaggatctggacaattataactggatacgggatgccggcaagaaccggttggtggtgggtacacaggcccgtatattgtatcaggatgctgtcggtcgcttgaagatagctctccggtttaaccaaatggtgcgtgacggagaagtcgggcctattatgctgggacgcgatcatcacgatgtgagtggtacggattcacccttccgtgaaacctctaatatcaaagatggcagcaatgtaatggccgatatggccgtacagtgttttgccgggaattgtgcccggggcatgagcctggtagctttgcacaacggaggcggagttggcattggcaaagctatcaacggaggtttcggtatggtgtgtgacgggagcctgagagtagacgaaatcctccgttcttctatgctttgggatgtgatggggggagtggcccgccgttcgtgggcccgcaatgaacatgcgatggaaaccagcgaagcgttcaatctgtcacatggtgatgcctaccacatcacgctgccttatctggcagatgaagagctgataaagagaatagttgcggaataa

SEQ ID NO: 2485 - DNA, 246 bp, B.fragilis
gtcgagctgttcgtgaaccagcaggttgacaatggcaaaattgacatcatccctgaatatgccctgcttaatgcccatcttaaaaaattcgatcgtactgtccgagtcccgctcccgatagttcttcagcagactgtgtactttcggatacttctttatatcttcaaaaaaacgcttgttagtccgatggaatgtctcaatgctccgctgataacacacaagaatgacttcaagaacattctttga

SEQ ID NO: 2486 - DNA, 636 bp, B.fragilis
agaattatgttagcagaattgaccgtaaaagaatttttagataaagtagccggtagtgatcctgtacccggaggcggcagtgtggctgctcttaacggtgcggtggcctcggcgctgactgcaatggtggccggacttaccatcgggaagaaaggatacgaagaacatgaagagttgatgaagcatatttcccgtctgagcatccggcaacaggagctttttgttgaatacattgaccgtgattccgaggcatacgaccatgttttcggttgtttcaagttacccaaatctacagatgaagaaaaggccgctcgtagtgctgctatccaggaggccactcgttttgcggccctcgttccgatgcaggtggcgcgcaatgcctgtgagctgatggagatcatagctgatgtagcgcgtttgggcaatcagaatgccattacggacgcatgtgtagccatgatggctgcccgttcggcagtattgggcgctttgctgaacgtccgcatcaatctgggttcgctcaaggataaaacctttgttgacgagctgaagcgggaagccgaccatttggaacaattggcatgcatgcgtgagaaagaattacttgaagttgtcaaccaagaactgaaccaatga

SEQ ID NO: 2487 - DNA, 984 bp, B.fragilis
agttgtcaaccaagaactgaaccaatgaacaatgtttattatgtaggctccggtgaactgactttcagtatcatcgaacgcatcattaacgaaaacctgaaacttgaactggctcccgaagccgaacagcgcatccggaaatgccgtgattatctcgaccggaaaattgcggcttccaccgagccgctgtatggtatcactaccggtttcggttcgttgtgcagtaaaaacatatcgtccgatgaactcaacaccttgcaagagaatcttgtgaaaagccatgcgtgcagtgtgggtgaggagttacgcccggtcattatcaagctgatgctgttgcttaaagcccatgctctttccctgggccacagcggggtacaggtcatcaccgtacagcgcattctcgactttttcaataacgacgtaatgcctattgtctacgatcgcggatccttgggggcttcgggtgatctggcgccgttggccaacctctttttgcctttgattggagttggcgatgtttattataaaggtaaaaagcgggaagccatcagtgtgctcgacgagtttggttgggagcctgtgagattgatgagtaaggagggacttgctttgctgaatggtacccagttcatgagtgccaacggagtttttgcattgctcaaagcctggaggctttcaaagaaggcggatatgattgctgccctttcacttgaagcgttcgatgggcgcatcgatccttttatggagtgtattcagcagattcgtccccatcccggtcagattgagacgggagagatattccgtcgcctgctgcatggaagtgagctgatagcccgtaccaaaaaacatgtacaggacccttacttcttttggttggattcctcaggtgcatggggccacgaaagatgccatccgggacggcttttccggtttggggaccgagataattccaagtgcggccattccgccctttttcccggataa

SEQ ID NO: 2488 - DNA, 930 bp, B.fragilis
tctgtggtgcccttaaaacgatgtagtatgaactggaataaaatagtagaatgcgtccccaacttcagtgaagggcgggatttggaaaagatggatcgtattgtcgctccgttccgtgcccggtctggggtgaaattgctcgattatagcaatgatgaagatcacaaccgactggtagtaacccttatcggcgagccggaagctctgcgtgacgctgttatcgaggctattggagtggctgtggaattgatagatcttaatcaccaccgggggcagcatccccgcatgggggccgttgatgtagtgccctttattcccattaaaaacgtgacgatggacgaagccgtctctctttcccgggagataggagagaaggtagccgggctttatcaccttcctgtcttcctttatgagaaatcggcgacagcccctcatcgtgaaaatctggcagctgttcgcaaaggagagttcgaagggatggccgagaagatgaaactgcccgaatggcatcccgattacggtcctgccggatgccatcctacagccggggtagtcgctatcggtgcccgtatgccgctggtggcttataatatcaatctgagtactgataatcttgaaattgcaaccaagatagccaaaaatatccgtcatatcaatggtggtttgcgttatgtcaaagcgatgggggtagaactgaaggaacggaacattacccaggtgtctatcaacatgaccgactatacccgtacggcactttatcgtgctttcgagttggtgcgcatcgaagcccgtcgctatggagtgaccattctcggtagcgaaatcgtagggctcgtcccgatggaagcactgatcgatactgcttcctactacctcggtctggagaatttctccatgcggcaagtgcttgaatcacgtataatggaatag

SEQ ID NO: 2489 - DNA, 309 bp, B.fragilis
agaagaaatcaagatatgaaatcagtattaatcacattcgatcaggcttattacgaacgtatcattgctttactggaccgtttgggttgtcggggcttcacctatttggagcgtgtgcagggacgtggttcgaagaccggtgatccgcatttcggcagccacgcctggcctagtatgtgttcggccatcataacggtggtggatgacaagaaggtggacccgttgctggatgcgttgcatcggatggacatgcagacagaacagctcggtctgcgggcttttgtcactaacgtggagcgaagcatttaa

SEQ ID NO: 2490 - DNA, 228 bp, B.fragilis
gacacggtccaaactcctacgggaggcagcagtgaggaatattggtcaatgggcgctagcctgaaccagccaagtagcgtgaaggatgaaggctctatgggtcgtaaacttcttttatataagaatagagtgcagcatgtatggtgtgttgtatgtattgagggtattatgcaaacgagttacagtcgtcttcaccacgcggctgtaagtatcgacgagcgatcgtaa

SEQ ID NO: 2491 - DNA, 303 bp, B.fragilis
ccaatattcctcactgctgcctcccgtaggagtttggaccgtgtctcagttccaatgtgggggaccttcctctcagaacccctatccatcgaaggcttggtgggccgttacctcaccaacaacctaatggaacgcatccccatcctttaccggaatcctttaataatgaaaccatgcggaatcattatgctatcgggtattaatctttctttcgaaaggctatccccgagtaaagggcaggttggatacgtgttactcacccgtgcgccggtcgccagcaaagaaagcaagctttcttcctga

SEQ ID NO: 2492 - DNA, 933 bp, B.fragilis
tttatggaaaagaacagtatgaaaggagaaaggcctatgaggctgaatagatggctgggggtgttgatccttttgctttccggtgtttggtcggttcgggcacaggaccttttgccagcctgtccgcaggtggataaaggcacgaaggcttgtaagccgatgcgtgaaccgggatcattgggggatactgtttcggtaaaaattgtttttcccgtagctttcaaaggtgtagggaggaatgaggtcgtggatagtcttgggatactggctccggtgctcgaacatttgcggctggtgcaaaacgggagttcggaagatactgtgcgcattgttcatattggtgacagtcacattcgcgggcatatttttcctcgtactaccggtgcccgtctgaccgaaacattcggagcgatctcctatacggatatgggggtgaacggagccacttgcctgacttttacgcatcccgaccgtattgcagccattgcagccctgaaacccgaactattaatactttcgtttggaacgaacgaaagccataaccgaaaatacaattcgaatgtacattaccggcagatggaggaattgcttgaactgttgcgtgacagtctgcccgatgttcctatcctgatgactacgcctccgggatcttatgaaagtttccgtcaacgtcgtcggcgtcgcacatacgctattaatccccgaacggtaacggcagtgaacacgattcatgattttgcccgccgccataaactggtggtgtgggatatgtataatgttgtgggcggaagcctgcgcgcctgcaagaactggtcagacgcccgattaatgcgtccggatcacgtacattatctgcctgaaggctatacgcttcagggagaattattatatgaagccattattaaagcctataatgaatatgtttcccattga

SEQ ID NO: 2493 - DNA, 663 bp, B.fragilis
caacaaaagaacgggttaatgattgagaatgcgaaagagaactcacaaagagtagaattgaaagacagaattattgagacagcttcggaggcttttactacacatggtatcaagagtataacgatggacgacatagccgcgtccttgggtatatcaaaacgtacactttacgaagtgtttcaggataaagagagcttgctgacccagtgtattttaaaacgtcaggaagagatgaatgcttttctggcagagaccttggccaactcaaagaatgttcttgaagtcattcttgtgtgttatcagcggagcattgagacattccatcggactaacaagcgtttttttgaagatataaagaagtatccgaaagtacacagtctgctgaagaactatcgggagcgggactcggacagtacgatcgaattttttaagatgggcattaagcagggcatattcagggatgatgtcaattttgccattgtcaacctgctggttcacgaacagctcgacttattgatgaatacggatatttgcaacaaatactccttccttgaggtttacgaagcgattatgtttacctacatccggggaatctcgacagagaaaggggcaaaggtattggaagattttataacggaatatagaaaacaaaggatacactaa

SEQ ID NO: 2494 - DNA, 3066 bp, B.fragilis
ttacctatcgacttgtatccggacatcgatacaaatacgattatggtaatgaccgcctatcccggagccagtgcttcggatatagagaacaacgtgactcgtccgttggagaatacgctgaatgctgtcagtaacctgaagcatatcacctcccgttcgtctgaaaatatgtctctgattacattggagtttgaatacggtaatgatatcgacgtactgactaatgatgtgcgtgacaagctggatatggtcagctcgcagcttccggatgatgtggagaatcccatcatctttaagtttagcaccgacatgattccgattgtgttgctgtcggtacaggccaatgaaagtcagtcggcactttataaaatcctggacgatcgcgttgtgaacccgttagcacgtattcccggtgtgggaacggtatccatcagtggtgctccccagcgtgagatccaggtatattgcgaccccggcaaactggaagcctataatctgaccatcgaaacaatcagttcgattatcggagccgagaataagaatattccgggcggtaacttcgatatcggtaacgagacctattcgttgcgtgtcgaaggagagtttgacgattcgcgacaattggaagatgttgtggtgggtagctacaatggagcgaatgtctatctgcgcgatgtagcccgcgtggtcgataccgtggaggagcgtgctcaggaaacatataataatggggtaaaaggagccatgattgtggtgcagaaacagtcgggtgccaactctgtggatatttcaaagaaagtggccgaggctttgccgaagttgcaaaagaatttgccgagcgacgtgaagctcggagtgattgtcgatacatccgacaacattctcaacaccatcgacagtttggccgaaaccgtactgtacgcccttttgtttgtagttatcgtggtgttcctcttcttgggacgctggcgtgccacattgattatttgtattactattccgctttcactgatcgcctcgtttatttacctggcagtcaccggaaatacaattaatattatctcgctttcatctctctctattgccatcggtatggtggtggacgatgcgattgtggtactcgaaaatgtgactacccatatcgagcgcggttctgatccgaaacaggctgccgtgcacggaacgaatgaggtggctatttccgtaattgcctctacactgaccatgattgcagtgttcttcccactgacaatggtaagcggtatgtcgggggtgatgtttaagcagttgggttggatgatgtgtgccatcatgttcatctctacagtagctgctttgtcactgacaccgatgctctgttcgcaattgttacgtttgcagaagaaacagtctaagactttcaaacttcttttcggtcctattgagaaaggtttggatgctctggatacaggctatgcccgcatgttgaattgggcggttcgccatcgtccgattgtcatcttcggttgtatcgtgttctttgtggtcagcttgttctgtgccaagagtatcggaaccgagttcttcccggcacaggataatgcccgtatcgcggttcagttggagttgcctatcggaacacgcaaggagctggcacaggaggtctcagagaaactgactaaccagtggctcaataaatacaaaggtgtaatgaccgtatgtaactataccgtaggtcaggccgactcagacaatacctgggcctctatgcaggacaatggttcccacatcatttcgttcaatatcagtctggtcgatccgggagatcgtgacatcagccttgaacaagtctgcgacgagatgcgtgaggacctgaagaaatatccggagttcagcaaagcacaggtgatcctgggtggtagcaacacgggtatgtctgctcaggcaagtgccgacttcgaagtatatggttatagtatggaagaaaccgacagtgtagctgcacgtttgaaacgtgaactgctgaatgtgaaaggtgtatcggaagtaaacatcagccgtagtgattatcagccggagtatcaggtagacttcgatcgtgagaagctggctttgcacggactgaacctggcaactgccggtaactatctgcgcaaccgtatcaatggtgccattgcctccaagtatcgtgaggatggagacgaatacgatatcaaagtgcgttatgcaccggagtatcgtaccagtattgaaagtatcgagaacattcttatttataacagtcgtggcgaagccgtacgtgtgaaagagttgggtaaagttgtcgagcgctttgctcctcctactatcgaacgtaaagaccgcgaacgtattgtgaccgtttcggccgttatctcgggcgaagcgttgggtaatgtagtgaatgcgggtaatgctatcatcgataagatggatattccgtcgaacgtaacgattcaggtagccggttcgtacgaagaccagcaagattcgttccgcgacctgggtacgctggctattcttattgtggtactggtgtttattgtgatggcagcgcagttcgaatcattgacttatccattcatcatcatgttctcactgccgtttgccttcagtggagtgttgatggcccttttctttacaaagagcacgctgagtgtaatgagcctcttgggagccatcatgttgatcggtatcgttgtaaagaatggtattgtacttatcgactacatcactctttgccgtgaacgtggactggctgtgctcaactctgtcgtaacagcaggtaagagccgtcttcgtccggtattgatgaccactgctactacagttctcggtatgatcccgatggcaattggtggtggacagggttcggagatgtggagtccgatggcgattgccgtaatcggtggtctgactgtttccactattctgactttggtcctgattcctactttgtactgcgtctttgccggtacaggtatcaagcatcagcgtaaggtattgagacggaaacgtgagctggaggcttactttgaagagcataaagatgaaatgattaagaaataa

SEQ ID NO: 2495 - DNA, 195 bp, B.fragilis
cggaatatagaaaacaaaggatacactaagacagggaataaagagattcccaaagaagataaacaactaaaattattgtatgaacaaaatgaaatgtttcttaagcaaaaagatgcttttggcggtggttgtactgctctcggtgggttatgtacaggcacaggaggcaaaggacatcgtgctactgacgcttga

SEQ ID NO: 2496 - DNA, 228 bp, B.fragilis
ggagaaaatagagattttaacaggaacttgacggaaattaaacggggtttaagcaaaaaactcggtgggacaccttggcgggaattgaacgggaatcagacagaaattgaacggaagaccgcgttaacattgttaatgcggttgggaagacatttatttcaggggcggaaagaacaaagctttggcttcaaaaagacttgttatttggaaacaaaaggcttgatttaa

SEQ ID NO: 2497 - DNA, 1260 bp, B.fragilis
agaatcatgagtgagaacttaattatattcaatgccaaagtagtgactccgctcggcttttcggctcggaaagggaaagagatggcggaactgcgaattttggagaaagcgacagtcgaagttgtagatgggatcattacctatgtcggtcccaaccggggtgaagtgcgtgatggatattatcatcacttctggcattacaatgctcgtgggaagtgtctcttgccgggttttgtcgattcacatacccatttcgtatttgggggagagcgggccgaagaattttcgtggcgcctcaaaggggagagttatatgtctatcatgcaacgtggcggcggtatagccagtacagtacaggctacccgtgaactctctttcattcatttgcgctctaaggcagaaggactcctcaagaagatgacagccatgggaattacgaccgtcgaaggcaagagcggatacggtctgaaccgcgaaacggaattgttgcaactcaaggtgatgcgcagcctgaataaagatgagggtgtacgggtggatattgtgcctactttcctgggtgcacatgcgttgcctgacgaatataaagagcgtcctgatgattatattgacttcctgatccgtgagttacttccggtgattcagcgggattcactggctgaattttgtgatgtgttctgcgaagaaggcgttttctccatcgaacagtcacgtcgtttgcttacagctgccggagattatggtctcttaccaaaacttcatgccgacgagattgtctctttgggaggtgccgaactggctgccgaattgggagctgtatctgccgaccatctgcttcatgcttccgatgccggtatcgaagccatggcgcgtaagggagtggttgccacactcctcccgctcacagcgtttgccttgaaggagccttatgcacggggacgcgacatgattgatgctggatgtgccgtagccctggctaccgacctgaatccgggcagttgtttctccggttccattccactgacgtttgccttagcctgcattcacatgcagctcactgtagaagaagcaattacggcccttaccctgaatggggcggctgcactcaaccgtgccgactctatcggcagtatcgaagtgggtaaaaaaggcgacttcgtagtgctcgactccgataattaccatattcttccctattatgtcgggatgaattgtgtaaatacgactatcaaaggcggaatgctttatccgtctgtctga

SEQ ID NO: 2498 - DNA, 1470 bp, B.fragilis
catcagaggagaatctgcgtgaatttcatgcagattctcctctctttttatgggttttatctatctttgcaacttcttattaaattaagagcgtgcatgaaaaattatttgaaatattcgttatggctgacattgatcgtcctgttcgcattaattggaatgcactggctgcctgctataacgatcgacggacatacgatgaggcgtgtcgatttgctgagtgatgtccgtatgcctgaacctgataaagatgaagtagtggcagacagtctgccgccggtcccggttgtgaaacctgcatttgtagatacgtgccgcagcgggatgacgtgtatcgaagattatagtgactcgacgatgcgagggatgactcctttttatcgtgcgctggacgaaattcagtccaaaggtcgcttggtccgtatagctgtgttcggtgattcctttattgaggcggatattttcacagccgatctgcgcgagatgttgcagaagcgtttcggcggatgtggtgtaggctttgtcaccataacttcgatgaccagcggctatcgtccgacggtacgtcattcttttggcggatggtctagtcatgcagtgaccgacagtgtttactttgataaaaagaaacaaggtatttccgggcactattttgttccccgtgaaagagcttacgttgaacttcgcggacaaaataaatatgcttctttactcgatacctgccagatagcatccatctttttctataataagggcgaggtcaatctttctgtatgtgtcaaccgtggggaagctgaagcgcgggacttttctactactggtcgtttgcagcagatgaaagtgaatggtcgtatcggttcggtacgctgggatatcaatcgggcagattccactttgttctatggggtggcaatggacggcacacaaggagttgttgtcgacaacttctctttgcgtggtagttcaggactttcccttcgcagcataccatccaaaatgctgcaagagtttaatgcccagcggccttatgatttgattattctggaatatggactgaacgttgcaaccgaacgcggaagaaactacgacccttataagaaaggacttctcacagccattaaccacctgaaagaatgctttccgcaggccggttttcttttgttgagtgtgggcgatcgtgactataagactgataccggtgaactgcgaacaatgcccggagtgaagaatctgatccgctaccagcagaatatagcggcagagagtggtattgctttttggaacatgttcgaggctatgggaggagagggtagtatggccgggctggtgcatgccaagccctctttggctaattatgattatacacacatcaacttccggggtggacgtcacttggcaggactactatacgaaacattgatttatggaaaagaacagtatgaaaggagaaaggcctatgaggctgaatag

SEQ ID NO: 2499 - DNA, 642 bp, B.fragilis
gatgcgtttatgaagaaattgtgtttcctgctgttgatgagttgggtagtgatggatgttactgcgcagaatgtcgtatattccaatctgaaagggctgctcgcttgtgaaggagatacggttgcctcgctgaaagtggagaaacgtacaaagaatcatattctgatgaccggtggtgccgactataagatcagtgccgggccggacgattccatgtgcaaatacctgaagtcccgctgttatgccgtgcaggcggacacttccctttatgtgaactgcaagagattacgctataagaagtttcgtttcggaggttggtatgctcccgccctacgcattggagaccatatttattttagtgccattcctttaggttccgtagctgccggcagcgatgccacgatggatgtgatgctgggtggtcaattcggcgatgcgattgctgcttccgctttaatatccaaacgggtatattatgaaatagatcctgaaaccaataaggtaggatttgtcggaaaagagcggatggaagaactgcttggggggcatcctgattggaaagccgcctatctgaatgaaaatagcgagtctgccaaagttaccgataaatatctgcgactgctgaaggcggaagagaagtag

SEQ ID NO: 2500 - DNA, 930 bp, B.fragilis
aatttgaatatgaaaagatgtttccaattagtagccctgctcgccgttgtgctattgggctcgtgcactggaggaaaagacaaaagtgctgctgaaaaaacagaggaaaagccgaaagtgaaattggccgatgtgacagcacgcccggtagaacagatacaggaatacacggcaaccgtagaagctgaagtgaagaataacattgctccgtcatcaccggtgcgtattgataaaatctttgtggaagtgggcgatcatgtgtccaaaggccagaaactagtgcagatggatgctgccaacttgaaacagactaagctgcaactggacaatcaggaagtggaattcaatcgtatcgatgaactgtataaggtaggtggtgcttcaaaatcggaatgggatgctgcaaagatggcctatgacgtgaagaaaactgcttatcagaacttgttggaaaatacttctctgctgagtcctatcagtggggtggtaactgcccgcaattacgatagcggcgatatgtatagcggtggtaatccggtgctgaccgttgaaaagattactccggtcaaacttttgatcaatgtatccgaggtttacttcaccaaggtgaagaaaggtgctcccgtgaatgtgaagctcgatgtctacggtgatgaggctttcgaaggcaagatcagcttgatttatccgacgatcgatccgtctacccgtacattccaggtggagattcaattgcctaaccagaatcagaaagtacgtccgggaatgtttgcccgtgccagcctgaattttggtacggaagagaacgtcgttgttcccgatttggctattgtgaagcaagctggtgcccggcgaccgttatgtgtatgtatacaaggatggaaaagtgacatacaacaaagtggaactgggacgtcgcatgggggctga

SEQ ID NO: 2501 - DNA, 1362 bp, B.fragilis
aattattgtatgaacaaaatgaaatgtttcttaagcaaaaagatgcttttggcggtggttgtactgctctcggtgggttatgtacaggcacaggaggcaaaggacatcgtgctactgacgcttgacaaagcactggaaattgcattgagcgaaaaccccacaatgaaagtggccggccaagagattcagctgaaaaaagaggctaagaaggaggcatacggcggactatttccggaggtttcattgacgggttcttactcgcggacactaaaaaaacagacaatggtgatggactttggcggagaatcgcaaaccatccaggtaggttcggacaactcgtataacggaggactcaatgtgagtctccctgtatttgctccgacgctttacaagagtatcaatctgaccaagacagatgtggaactggctgttgaaaaagcacgctcgtcgaaactagacttggtgaatcaggtgaccaaggcatattatcagttgttgttggcccaggacagctacaaagtgctcctgcagagttatgcgcaggcagaagccaactatgaagtggtgaaagccaaatatgagcagggaacggttagtgagtatgataagatacgcgccgacgtacaggtgcgtagcctgaaaccctcggtagtatctgccggtaacggagtgaatcttgcccgcttgcagttgcaggtactgatgggtatggatacggaggtggaaattgctgccgatggtaatctgaaggactatgaaatggtgatgttccgtcgtcagatggaaagcaaccagttgaatctgaataacaacagtgatttgaagcagttggacttaaatgccgacttgttgaagaaaacactggctgtgcagcgaaccaatttcatgccgacattggctgcatcgttcaactattcgtatacatcgctgaataatgacttcaagatgtcgcattacaagtggttcccatattctactgtcggtctgagtctgagtatccctttgtttaaggcaagtaactttacgaaggtaaagcaaactaagatccagatgcagcaactggccgagaaccgcaccaacgtatatcgccaactcaccatgcaagccaccagttatctggataatatggctgcaagtaccgagcaggtagtcagcaacaaagaaggaatcgtacaggcggaaaaaggacgtttgatagcccaaaaacgttatgaagtaggtaaagggactatccttgaattgaacgattcggaagtggcgctgacacaggcccagttgacttacaaccagtctatctacgactatttggttgctaaggctgatctcgatcaggtattgggaagagaagaagtaacagagtaa

SEQ ID NO: 2502 - DNA, 480 bp, B.fragilis
ttttctgccatcgcaatggccgaactgggcaacatttccgagcggcgggtagccccagttaattatggggttgcgtgtcttccggaatttttggtcgccaatccgggacttaattccggttttatgattcctcagtacgctgctgcctctatggtcagccagaataagatgtactgctatgcggcctcgagtgattcaatagtctcttccaacggtcaggaagatcatgttagcatgggagccaatgccgctaccaaacttttccggatcatggataatctggagcatatccttgccatcgagttgatgaatgctgcgcagggaattgagtttcgtcgtccggcaaaaacttctcccatccttgagcgctatctggctgcatatcgtaaagaggttccgtttgtaaaggatgatatcgtgatgtacaaagaaattcataaaacggtagcttttctcaatcggaccagatccgagtattag

SEQ ID NO: 2503 - DNA, 1578 bp, B.fragilis
tgcgtccggatcacgtacattatctgcctgaaggctatacgcttcagggagaattattatatgaagccattattaaagcctataatgaatatgtttcccattgatattgatttcagccgcctgttggaggctttcaaatataatccggatgcgccgatgatattcagcagcggaatttttctttggctgttcgctgcgtttatggtaatctatacactgttgcaacatcgcaatacggtacggattctgtttgttgctcttttctcctattatttttattacaagagtagtggaacctattttttcctgttggctatcgttactgttaccgattttatgatagcctggctgatggatcgaaccgatgtccgctggaaacgtaagttttgtgtggtactcagtgtatcggtcaatttgggattactctgctactttaaatataccaattttctgggtggggtcattgcctcgctgatgggaggggagtttacggcacttgacatctttttgcctgtcggcatctcctttttcacattccagtcgttaagctacaccattgatgtctataggaaagagatcaaacctttgaccagtctgctggattatgccttttatgtctctttctttccacagttggtggccggtcccattgtccgggcacgtgattttattccgcaaattcgtaaaccgctctatgtgtcgcaggaaatgttcggcaggggtatctttcttattgtggcaggtttgttcaagaaagcggttatctccgattacataagtattaactttgttgagcgtatttttgataacccgacactctattcgggagtcgagaacctgatggggctttatggttatgctttgcagatttattgtgatttttcaggatatagtgatatggcaatcggcattgctcttttacttggtttccatttcaatctgaactttaattctccgtataaatcagcgtcgatcactgagttttggagacgttggcatatttctttgtcgagttggttacgcgactatctttatatttctttgggaggtaaccgtcacgggaagttccgtcaatacctcaatctgattattaccatgttccttggtggactatggcatggggcttcatggaattttgtgctttggggtacttttcacggagtggcacttgctcttcataaagcatggatgtccattattgggcgtaaaaagggggagaccagtcacggtattcgccgggtattgggtgttatcattactttccactttgtctgcttttgttggattttcttccgtaatgctgactttcacaattcgatggacatgctgaatcagatttttactgctttccgtccacagcttttcccacaactgatagaagggtattggcgggtatttgcactgatggcagttggtttcctgctccattttgctccggatagttgggaaaatgccgtttgccgtggagtgatcaagcttcctttcttaggtaaagctattgtaatggtggctatgatttatctggtcatccagatgaagagcagtgagattcagccgttcatctatttccagttctag

SEQ ID NO: 2504 - DNA, 192 bp, B.fragilis
agcaagctggtgcccggcgaccgttatgtgtatgtatacaaggatggaaaagtgacatacaacaaagtggaactgggacgtcgcatgggggctgaatatgaattgaaatccggtgtacccaataattctcaggtagtcattgccggtcagacccgattgatcaacggcactgaggtagaggtagaaaaataa

SEQ ID NO: 2505 - DNA, 594 bp, B.fragilis
ataaaagaaacaagttcgataagcagaatgcaatctaatcatctactgaaaacacaaaaaagtttttcagacatatattctatatattatgtgagaatgcttcgtttctcgcaaacctatgttattgcggaagaggatgcagaaaacatagtgcaagataccttcctttatctatgggaacatctggagttattggaagatatagaccatctggatgcctttctttttactcttatcaaaaacagatgtctgaactttctgaaacatcagtcgtatatccaggccaaaacctgttcgctcaaagcagacgaagaactggagtctcaattgaacctatatgctttggaacaatttgacgaagctgtttcctctatttcggaagtagaaaacctgttgagccgaacgatgcaaaagctgcccgaacgttgcagagaaatctttttgctcagtcgcatagaaggattaaaatataaagaaatagccgaacgcctggatatatccgtaaacaccgttgaaaatcagatatccatcgcacttcgcaaactcagatcagaactcaaagaatatcttcctttactggtttttatcatttaa

SEQ ID NO: 2506 - DNA, 234 bp, B.fragilis
cagaaggttaaatcaagtaataggaagaggaaaaacaaaagggggaaaaggattgagaatgaaggaaatagagaaaaaagggggtattttctgggaaaagggataagtgctggtccgaaagggatagttgtgattaaagcaagtatgggggcagggaattttaaaaagcaaggttgggaatggaagcaggaggagcttactattaaaccccacaggacattgcttaaaaactaa

SEQ ID NO: 2507 - DNA, 2436 bp, B.fragilis
  unsure (2269): Identity of nucleotide sequences at the above locations are unknown.
acgtacgacaaagttatgaaaaaaaacttgttgcagaaatggtatgtccatcaacaacttgaattaacacatattatacgaattatgaaactgtccgtgttctttatattcgtttttctctttcagcttcaggctggtaacgtaaaatcgcaagaggtccgtgtgactctttctaagagtagcctgactttcggcgaattgatgcgcgaaatcgaaaaacagactaattatctgttcatgtatcgtgatgcagaaattgacctttctcagaaaatagaggtaaaaaacaccagtgctacggtaaaggaaatcctgacaacggcgctcagaaacaaaaagttgacgtataaattctctaataactacatttctctttacgtagacaaagagaaagctcctgagaccatggttacccagcaggaacgaaaaattaaaattaagggtgtagtgatcgatcaggtcggtgagccgattatcggagccaatatctcactaaaagggcagccgggaacaggagatatcacggacatagaaggaaacttcacattggaagtgccggaaaaggctgtattagtaatttcgtatatcggatatctgactcaggaaatacctgtgaatggaaaagcatctttcaacattcagatgaaagaagatactaaaaccctggatgaagtggtagttgtaggctacggttctcagaaaaagcaaactgtaaccgcttcggcttctacactaaaagtatcttcactcaaaaatgtgccaaccgccaacctggcttcttcactcggcggacgcgtcagcggcgtattgattcagcagaccggtggcgaggccggatatgacgatccgaccatcatcatccgcggatccagttcgcctacttcctcttctcccctgatcgtagtggacggcatcatcggacgtagcatgtcgcaactcgaccccagcgaaatagaaagtatgactgtactgaaggatgcttctgcagtagctccttatggtgcacgaggagccaatggcgtaatcctgatcaccactaaacgtggtaaaagcggtaaagcacaggtagactataacttcaaaataggatttggtacccctacccgtatgcccgaaatagccagttcttatgaccatgcccgctttatgaacgatgcatggcgcaacaaagaaatggacttgggcgaagatccgggtatgtatggcatttatactgaagaagagttgcagaagttcagagatggttccgacccttacggttatcccaatacggactggaacaaagaagtattgcttccgcgtgcctggcagcaaatgcacagtctgacagcaagcggcggttcggataaggtgaaatattttgcaggattcggctacgtgaagcaggatgccctctatggcgacacacgcaccaataaatcaacatccggcttcaaccgatacaatgcacgtgttaatatagacgccaacattgtagacaaatatctgaatttatcggcagacatggcttatcgtcaggaagaccggaacagcattgcaggcagtacttcggatgtattcaacaatatgcaccgtaacccgcagaccgacccgggacgctttcctgacggcaacctgggtaaagtgtcactgggtgtgaatcctatcggactggctaccgaaggtggttgggtgaaagaccgtaaaagtgtattgaacacacgcttcatgctggacttcaatgttccgggactcgagggcttgaacctgaaaggtattttctcctacgataaaatattcaatagcatcaaaagatggactactccggtagacttctatgtatggaacaaaattacaggagaatatgacggacattcacctaaccgtgaaggtgccgaactaaaacagacatactcaaccagtcaagccatgacattcgagttccaggcagcttacaacaagaccattgcacaagatcaccaattgggagcattattcgtgttctcacgttcggaaggggcagacgaaaacttctgggcttcacgcacaaaatatcgtatctattctatccagcaattgtttgccggaccggacaaagacaaagacaacagcggcagtgcctccgaaaccggtaaagtaggttcggtcttccgtctgacttacaattacaaagagaaatatatgctggaggctaacggtcgtctcgatggttcggaaaaattcccgaaaagcaagcgttatggtttcttcccatctgtatcggcagcttggcgcatatcggcagaacctntcatggaacctttctccggagtactcagcaacctgaagttaagaacttcatggggacgcgccggaacagacaacatcggtcaattccagtatatgtccgcttatggtaccggcggtgatgccgtatttggccggtcagaatccggaaatagccccgggatacactga

SEQ ID NO: 2508 - DNA, 1041 bp, B.fragilis
tactttttttgtatttcctttggtggtaaatgcattctcgattgtctttactataaaaccactcaaggaaccatgaatgatgaattagaaaaatatttcgcaggcaccctgtctgccaccgaaaaaacagaatttctgaataaactccgagataatccggaagctaaaaaagaattcgcacgcatgaaggcagtatgggctgtctccggactgatggcacaggaaggagaccctcaaaagactgtaaggggtatagcagagttcgataaacgtctgaaacgccgttctgtacatcgattccgtatagggttctttaaatatgcggctatgattgttttgcttatttccactacttggtttatcgctaactggtatacacaaaaagagcaaaaaaaacaatatacggagatcaatgttcccaaagggcaacgagtgaacatgacccttccggatggtacttccgtatggttaagcccacagagcaaaatcaaaatccccaatgaattcaaccggaaaaaccgtatggtggaattgaacggtgaaggatatttcgaagttaccaagaatgccaagaaaccttttatcgtgaagacacagttgttcaatatacaggtattaggtacccggttcaacgtattcgcctatgcaggaaaagagagtaagtttgaaacctgcctcgtagaagggcgcgtattggtttataacaaaaataataaaaacgagaaagtctatctgaacccacacgaaaaagtatcgttagtaaacaaccgtatggtagtgtctacttccaacttcgacaatgaagaatacctgaagagtggtattttcagctttcgctcaaagcctttcggagaaatcctgagctatctgaccctatggtacaatgtgcaattcaattttaccggagacgtgaaactggacgaacgaatctcaggcaaaatccgacaaagcgaagatgtggataatatcctgatagccttgcagggagtatatccttttaaattcaaaaaaacagatgatgaacattatgagatttactaa

SEQ ID NO: 2509 - DNA, 1146 bp, B.fragilis
gaacttcatggggacgcgccggaacagacaacatcggtcaattccagtatatgtccgcttatggtaccggcggtgatgccgtatttggccggtcagaatccggaaatagccccgggatacactgaaacccgtttcccgaaccccaatatcacttgggaaacttctgaaatgttcaatatcggtatagatgcttcgttctttaacggaaaacttaatctggaagcagactggttctataaaaagacaaacgacatcctgcgcgaacgtacggatatgccggccatcctgggatataaattgccggcagccaatgtaggtaaagtagacaacagaggtatcgacctgaatatcacacatcgcaatcacctgcgcgacttcaactattctattgcaggcaatctgacttgggctagaaacaaagtcattgacctgctggagccggccggtgagaaaaacaatccgagacagcgcagcacgggacactctatgagccaatatttcggttatgaagcattgggattattccagtcggacgaagaagccaacaactggcctcaaccgcaattcggcaaagcaaaggcaggtgatatcaaatacaaagaccagaacggcgacggtatcatcgatgcggaagatgaaatagctatcggacgcagcaactatccggaattggtatacggactcaatctgaatgccgaatggaaaggttttgacataaccttcttcttccagggagcagcactggcagacttctattacaatggttacctggccttcccatacatcgaaggacgcggaggagccctgctcgaacatcacatcggcaacacgtggacacccgaaaatccgaaagctgaatttccacgcttgtactatggaggcaatgccaataaccaattgttctcttctttctggatgcgtaacggttcatacctccgtctgaaaaatgtagaaataggttatgacttcaagaagttactgttatccaaggtatcggaaattcagggactgcgcctctacttcagcggctccaacctgctgacctggtcgcagatcaagtacttcgacccagaattgcgttccaccgacggaagcgcttatcctcaaatgaaaacctttgtgtttggtgctaacattacattctaa

SEQ ID NO: 2510 - DNA, 504 bp, B.fragilis
tttttttttatctttgtacttatggaaaaatattatagcacaaactgtccgattaatacgatcacaattattaagaccataattgttgcgatgcttttcattatcgcagctattatagtatttgccagtggaggatattggttaggaattagcataatattactgctgttagttatcatggttgtaacctatttttgtattcctcggaaaattattgtgaccgatacggatattgtgctttataatcatggatttaaaagaaaaattcccaagtgcgatatattgaaagcaagaagcgtcactgcaaaggatagaaatggtctgtggcgtaagtttgcagttgaaggtgtttgggggtattgtggtatttatgcttcaaaaatacacaagaacctttatatctatgcttctcaaaataagaactggattttgattgaaactgaaagaaagaattatattgtatcaccggaaaatctggatataatagatgtgattaataaataa

SEQ ID NO: 2511 - DNA, 285 bp, B.fragilis
aacgtgattatgaaaaagataaatacagccctgttttgcttatttgtattgctcttctgttcgtgcgatgtactgaacaaagctccactggacgaaatagcggacgactccttctggtcggacgaaacactggtgaaatattacgtaaacgatctatatagcgaaatctccgtagacggactgcaactacaagaaaaccgcagcgacaattccgtctcggcacagcgtgataaacaccgtgcaagctggtttaagttcaactatgacatggtcagtgcttccgat

SEQ ID NO: 2512 - DNA, 330 bp, B.fragilis
ctttttccctctttcagttgcacgctttgggtggaggtgatttccgtattgttgggcacagtccgtccgcttattgtcagcgtattgaaatgcactgtaatggtcctggcccctgcaaacggaaccatgcgtatggttgtactcagagtcgtcttcggactgaatgccgccgtattattcgtgttggcggctaccacattggtcgaagggccgatcttccatgatgtggagtttcccccttgctttacatatacacccgtgcaattggtgattgtattgcttggaaatccggtaggactgatggtaattgtcagtttgcacaacttctga

SEQ ID NO: 2513 - DNA, 1296 bp, B.fragilis
agatataaatcctcaaaagacatgaagatattactattaggttcgggcggccgtgaacacgccctggcatggaaaatcgcccaaagtccgaaagtagagaagctgttcattgcacccggcaatgccggaaccggtgaagtaggtgaaaacgtgaatatcaaagcaaccgacttcgccgctttaggggcattcgctcttgaagaaagtatcgatatgattgtggtaggccccgaagacccgttggtagaaggtatctatgaccacttccaaagtaacccctgcctgaaaaacatcgccattatcggcccgtcgaaagaaggagccaggctggaaggcagtaaggagttcgcgaaagaattcatgcaccgccaccacataccgacagcccgctaccaaagcgtgacagccgataccctgaacgaaggactggcatttctcgaaacacttgaagctccttatgtgctgaaagcagacggactttgtgccggaaaaggagtattgattctgccgactctcgaagaagccaagaaagaactgaaagagatgctcggaggtatgttcggcaatgcctcggcaaccgttgttattgaagagttcctgagcggtatcgaatgttcggtattcgtactgacagatggcgaccactataaggtgctgcccgtagccaaagactacaaacgcatcggcgaaggtgacaaagggctcaataccggcggtatgggcagtgtgactcccgttccgtttgccgacgaagtgtttatggaaaaggtacgtacccgcatcatcgaaccgactgtcaacggactaaaggcagaaggtatcacctataaaggattcatcttcctggggctgatcaacgtgaaaggcgaaccgatggtaatcgaatacaatgtccgtatgggtgatcccgaaaccgaaagtgtcatgctgcgcatacagagcgacctggtagaactgctggaaggggtggccgaaggtaacctcgacgcccgatcgcttgtcatcgatccgcgtacagccacttgtgtgatgatggtcagcggaggataccccgaagcctatcagaaaggatatgccatcaacggactggaagcagcccgggcaacggacagcattctgtttcatgccggaacagccatgaaggacggacaggcagtgacctccggcggacgtgtgcttgccatctgctcgtatggcaacgacaaggccgacgcactggcacaatgctacaaagtggccgacatgattgacttcaaagacaagaattatcgccgcgacatcggcttcgatttataa

SEQ ID NO: 2514 - DNA, 741 bp, B.fragilis
ctatttttgtccgtatataactttgtagactcaaatatcccgatgaaagcgatagaaattcaaaaagaactggagacttatattgatccggtaaaaagggaatatcttcccggattctttaaaaccggcaaggggcaatatggtgaaggcgaccggtttcttggaatagtggttcctgcaacccggcttgtagcgaagaagtataagaacgcgccttttgaggtgatggcggagcttttacaatccgaatggcatgaatgtcgtttgtgtgcattactgatgatggtggagcggtttaagaaaagtggtggagaggagcgggaagcgatctaccgtttttatctgtcgcagacggagcgcataaataattgggaccttgtggacctgtcggcaccttatattgtgggtgaatacctaaaggataagtcgcgtgatgatctttatcggctggcggaaagtactctgctgtgggatcagcgtattgctgtcgtatctacggttaccttcatccggaataacgatttcatcgatattctccgtctttcggaattgctgctgcaacacaaacatgacttgatgcggaaggctataggctggatgctgcgtgaaatgggaaagcgggacaagaccttgctgttgcagtttctggacaaatatagcaaagtgatgccccgcactatgctgcgttattccatagagaagctcacggacgaggagcggaagttgtatatggggcgatga

SEQ ID NO: 2515 - DNA, 198 bp, B.fragilis
gattttaggtcagagagagaaactataataaaaatggcatatgagatgatattagcaagttatcttcatatgccatcttactttttaaagacatttactgaatatcccgtagtatgggtgtttgtggcaggcccagaaagcccgttctttaaggtgtcaggcttactggcttctgacttcatctggcaaactcgctag

SEQ ID NO: 2516 - DNA, 207 bp, B.fragilis
actacactgttccgttacttccttgggttggtagtggttaggatcgttttcaaagaactgatttctatgattttcagacactatttgtttgccaatataaccgaagctccgaaaagcagaagtgatatagaggaaaatcgtgaaatgtcaaattggacagcttgtccggtcagagtattattgcacaagaagaatactatcttttga

SEQ ID NO: 2517 - DNA, 1845 bp, B.fragilis
tcgctatgcccttttttcatggatacaaatcaagaacttaaaaccagcgaatatctaaaaggaattgtttcaaatcttcctgagaggcccggcatttatcaatatctgaatgcagagggaactatcatctatgtagggaaagccaaaaacctgaagcggagagtctactcctatttcagcaaagagcatcaacccggaaaaacccgggtattggtaagcaagattgcagacatacgttatatcgtggtaaactcagaagaagatgcactactgcttgagaacaacctaatcaaaaaatataagccgcgttacaatgtcttgctaaaagacgacaaaacctatccgtccatctgcgtacaaaacgaatattttccaagagtattcaagaccaggcgtattatccgaaacggctcttcgtactatggaccgtacagccatagcccatccatgcacgcagtgctcgatttaataaaacacttataccctctgcgtacatgcaacctcaacctctcaccggagaatatccgtgcgggaaagttcaatgtatgccttgaatatcacataaagaactgcgccggcccgtgtatcggcctgcaatcacaggaagaatatctaaaaaatattgccgagataaaagagatcctgaaagggaatacccaggagataagcagattgttatacgagcgcatgcaggaccttgccgcagaaatgaaattcgaagaagcgcaaaaggtgaaagaaaagtatgcattaatcgaaaattatcgttcaaagtccgaggttgtcagctccgtattacacaatatagatgtattttccatcgaagaagacggcgaaaagtcagccttcatcaactatctgcatatcacaaacggagccattaaccaagctttcactttcgaatacaagaagaaactgaatgaaacaaaagaggaattgctgacactgggaattatagaaatgcgggaacgctacaagagcgcttcacgcgaaatcatcgtcccgtttgacatcgagatagaactgaatgatgtcactttcaccattcctcaacgaggagacaaaaagaagctgttggaattatctctactcaacgtgaaacagtacaaagcagacaggatgaagcaagccgaaaagttgaatccggaacagcgtagcatgcgcctgatgaaagagattcaacaggaattacacttggacagactgcctatgcagatagaatgttttgataactcaaacatccagggaacagatgcggtagcagcttgtgttgtttttaaaaaggcgaaaccatcgaaaagcgattatcggaaatacaacatcaaaacggttgtgggcgctgatgattatgcctcaatgaaagaggtcgtcagaaggcgttatcagcgcgctatagaagaggaatcccccctgcccgacctgattatcaccgatggcggaaaagggcaaatggaggtggtcagacaagtaatggaagagttacagttagatattccgattgcaggactcgccaaggatcgcaaacatcgtacatctgaagttcttttcgggtttccacctcaaaccatcggcatcaaacaacatagccccctattccgcctattggaacagatacaagatgaagtacatcgctttgccattaccttccacagggataaacgaagcaaacgacaagtagcatctgccctggacaatatcaaaggaattggcgagaaaaccaaaaccgccctgctgaaagagttcaagagcgtaaaacgtatcaaagaagccaccatagaagaagtgtcagccataataggtgaatcaaaggcaaaaatcataaaagagggtctcgataatcattaa

SEQ ID NO: 2518 - DNA, 867 bp, B.fragilis
acccggataccaataaccaacctcaagcaattcatggataaagaaagaaaaccccacaagcatacggaagcagcgacttcctcccccctcctctccatcagaggactctccgccgcctatgacggacgcacggtgctccacgatgtcgatctggaggtctacgagcacgatttcctcggcatcatcgggcccaacggcggaggcaagacaactcttatcaaatgcattctgggactgcttcgccccacaggaggagaaatcatcaaatatcacgaaccactcacgacgggctatctcccgcagtacaactcgatcgaccgctccttccccatctcggttctcgaggtagtcctctcgggactcagctccaagaagtcgctgaccggccgtttcaatgaccgtcaccgcgagaaagcccgacaagtgatccaccgcatgggactcgagggacttgaacaccgggccatcggacagctgagcggcggacaactgcaacgcgccctgctgggacgagccatcatcagcgacccgcaactgcttattctcgacgagccgagcacctacatcgacaagcgcttcgaagcccgcctctaccagctgctggcggagatcaaccgcgactgcgccatcatcctcgtcagccatgacatcgggacggtgctgcaacaggtaaagaacatcgcctgcgtgaacgaaacactggactatcacccggccgcaagcgtcaacaccgaatggctggaacggaacttcaactgcccgatcgagctgctgggacacggcacactgcctcaccgggtgctgggcgagcattgtcattgccacgagaagagttccgacacaccccatccccaaaccgataaataa

SEQ ID NO: 2519 - DNA, 1593 bp, B.fragilis
cggaactcgcctataagcatttggggcgcagtctctacaatagtcagaaaacactgtttaatgattagtggaaacactattaatcacaaaaataacatggccggattaaaatccctggtaaaagatacagccttgtatgggttgagtagtatggttggcaggttcctgaactatctgttggtgcctttatataccgcagttctgccggctgcatccggcggatacggagtggttaccaatgtgtatgcctgggccgggttgattatggtacttttgacgttcggtatggagaccggtttcttccgttttgccaataagtcggaagaagatccggtgaaagtatatgccaattcactgatttcggtagggggcatttcactgatatttgccattctctgcctgacgtttctccaaccggtctctcatctattggaatatggcgatcatcccgatttcatcggaatgatgattatagtgatggcactcgatgcttttctgtgcattccgtttgcttatctgcgtttcaagaagcggcccattaagtttgttgccattaagtttgtctccatcattgccaacattgttctgaacttgttcttcctgttgctgtgtccgtggttgcatgaacactttcccgcttgggtcgattggttctataacccgacctatttggtggggtatatcttcgtttccaatctgataacaacctgtctgcagctcttttgcctgattcccgaacttcgcggtttcgcttacagggttgataaacagttgttgaagcggatgcttatctattctttcccgatattgattttcgggttggtaggcattctgaatcagacggtagacaagattatctatccttttctctttgccgaccggcaggagggactggtgcagctcggcatttatggggccgccactaagattgccatggtaatggccatgttcacccaagctttccgctatgcctacgagccttttgtgttcggcaaacaaaaggaaggggataaccgccggatgtatgcacaggcgatgaagtatttccttatttttgcgatgttcgcttttctggtggtaatgttttacctggatcttttgcgttatatggtggcacctgattattgggcgggactgagcgttgtcgccatcgtgatcggagcggaaatattcaaaggtatctatttcaatctttcgttctggtataagctgatagacgaaacccgttggggagcatacttttccattgtcggatgtgtcatcattgtaggaatgaatgtgatgcttgtccccacttacggatttgtggcttcggcatgggcttcggtggccggatacgctgtgattacgatcctttcttattggatcgggcagaagaaatatcccattcactatgacctgaaacaccttggtacgtatgtgctgtttacagcagtgctttatgtgatcggagagtgggttcccattgagaatatcgtgctccgtctggctttccgtactgtattgttgctgatatttatggcttatgttgttcggaaagatttaccgctgagccagattcctgtgattaaccgaattataaagaagaaatag

SEQ ID NO: 2520 - DNA, 1356 bp, B.fragilis
atttctatcgctttcatcgggatatttgagtctacaaagttatatacggacaaaaatagtcaaaaaagccgcaatgagtggaaacatattcttaattttgtaggaaaattaacgggcatatttatggttttaaattacatctggatcgcattcttcgtgattgctttcgtagttgccgtctgcaaacttttgttcttcggcgatacccaaatattcacagagatcatcaactccaccttcgattcatctaaaacggcattcgaaatctctctcggcctgacaggtgtgctgtcgctttggctcggtgtaatgaagattggcgagaacagcggcctgattaatgccctttcacgctggctgagtccggtcttctgccgcttgtttccggacattccgaaaggacatccggtcatgggatctattttcatgaatatgtccgccaatatgctggggcttgacaatgctgccactcccatgggactgaaagctatgaaggaactgcaagaactgaatccgaaaaaagacactgccagcaacccgatgattatgttcctggtgattaacacttcgggactgatcattatcccgatcagcatcatggtctaccgggctcaaatgggagcggcccaacctacagacatcttcatccctatcctgctaagcaccttcatttctacactcgtaggagtcattgccgtcagcatctcccaacgcattaacctgataaacaaagctatattgacactaatgggttgcctgagccttttcttcggcggaattatctatctgacaactacactttcccgtgaagagatgggagtttattccactctgattgctaatgtaatcttattctcggtcattttactgttcattatagcaggtatccggaaaaaaatcaatgtgtacgactcctttgtcgaaggagccaaagagggattcaccactgcggtccggatcatcccctatctagtggcttttctcgttggaatcgctgttttccgcacttcgggtgccatggatatactggtcggcggcattggggcaatcgtagaattttgcggactggacaccggctttgtgggagcactgccaacggccttaatgaagtcactgagcggcagcggtgccaatggcctgatgatcgacaccatgaaacagtttggacccgattcatttgtcggacgtgtcagttgtgtcgttcgcggtgcatcggacaccaccttctatattttagcagtatattttggaagcgtaggcatcacgaaaacacgtaatgcggtcacgtgcggactgattgccgactttgccggaattattgcagccattttaatcagttacttatttttcttttaa

SEQ ID NO: 2521 - DNA, 480 bp, B.fragilis
tatatggacgcttttatagaaaccgtttcacagatacttatcgactggggatatcccggcctgttcatttcggcactgctggccggaagtattgtcccgttcagttcggaaatcgtgctgctgggactggtaaagttgggactcgatcctaccctttgcctcatttccgcctcgctggggaacaccgccggagggatgacctgttactatatggggcgcttgggcaggatagactggatcgagaaatacttcaaggtcaagaaggaaaagatagacaagatgcaacgcttccttcaggggaaaggcgctttgatggcgttcttcgcctttctgcccgccatcggtgaagtgatatccatagccctcggatatatgaggagcaatgtatggctgaccacggcttcaatgttcgccggaaaactgatacgctacatcatcctgctgaaagccatgcaggaagccctgaacctggttatgtaa

SEQ ID NO: 2522 - DNA, 1226 bp, B.fragilis
gaagaccagccgttttgttgtgcctggcttgtaacgaagcgggcagaacagtatctgtcaccgtgtccaatgccacctcactggaacgaagcggcgagatggtagaagtttccatgggtgaggtttcctctaaattgcatttacccgatacggcacagatagtagtggtagatgccgaaggacagcaagtaccctatcaaataacttctgacgagaaagtgatatttccggtcactgtgcaagcgaatggctcagccgtttatacgataaaagcgggtattcctcaagagtgcccggtgaaggcttgtggaagatattatcccgaacgggtggatgacgtggcttgggagaacgatctgacggcctttcgtgcttatgggcctgctttgcaggaaaccggagagcgtgctttcggatatgatatctggacgaagtataatactactgagccggtggtggaagcccgttatgaaggcgaactgaattcggatatgaaagctaaaatagccgaactcggaaagacggaccccaaagccgcgcaggaactttaccgctctgtctcttatcatgtggaccatggcaacgggctggattgttataaggtcggtcctacgttggggggaggtacgactgcattgatggcaggggatacaatcatttatccgtattgttacgctacccaggagatactggataacggtccgttgcgttttactgtgaaactggtatacaatccattggtcgtaaaaggagattctactattatcgagacacggatcattacattggatgcgggttcatattgcaataaaacagttgtctcttatacgaacctgaaagagacgatgcctttagccgtcggtattgtattgcacgaacccgatggagccattgttgcagatgcggcaaacggatacatgacttatgtggatccgacggataatgccggtggtgacaatggtaagatctttgtcggtgctgcgtttcctactttggtgaaggaggcaaaaggagttctcttcccggagaaagaaaagaaggaactgcgtggaggtgccgacgggcatgtgctggcaatcagtgagtacgaaccgggagcggactttacttactactggggggccgcctggagcaaagccgacataaaagatagcgctgcctggaatgcgtatatggccgattttgcacagaaggttcgcaatccgctgacggttacagtgaaataa

SEQ ID NO: 2523 - DNA, 762 bp, B.fragilis
gaaattatgtataaggtgatcattatagatgatgagaaggcggctattgagaccttacgccgggatctggaggtgcaggctgatctggaaataaaagggactgccggcaatggggcaaaagggaagaaacttattatggatatacatcccgatcttttgttcctggacatagagttgcccgatattcagggaatccgtttgcttagtgagattcgtgaacaggtgttgtgggatatgaaagtcgttttctatactgcctatgataaatatctgttgcaggccttgcgcgaatcggcttttgattatttactgaagccttatgatatagaagaactgaatttgattattgaacgttaccgcaagacgatggcttctgctcggcctctgccttcttttgcttctgctgtgggtactttgatgcccggtagagatttgtttatgattagtacagtaacgggatttagatttcttcgtcttgaagaaataggttattttgaatatctgaaagataagaggctgtggcaagtggaactttttaatcaaacgaaactttgtctgaagaaaaatacgactgccggtgatataatcggctattccgacgtatttgtacaaatcagtcagtcggctattatcaacatcaattatctggcaatgataaagagcaaacagtgcttactctatcctccttttagtgataaagaagacttgattatttcacgcggattcttgaaagaactacaagaacgcttttgtataatttga

SEQ ID NO: 2524 - DNA, 738 bp, B.fragilis
gagcatccgtacaaacctcactttactttctgctcatcacggcctgccccgggcatgcacctgctctatgcgggcgacgtcgctgctgtaacctttctcatttcgctctatttcctgttcaaaagctatcagcagcctcgtcctgccggttatctgttccattcgtttgctttgctgagcgccggcagtgtggcgtttcctcagctgacgtacttcatccccatctggctgatgggtgcatccggttttcagtcgctcacgttccgcagtttctgcggtgccataataggttggagcatcccctactggttcttattgggacatgccttttttcacaacgaaatagagcttttctaccaaccgttcatccatctggccgacttccgggacattgacttcggccgtgacttccaactatgggaagtcgtcacgctgggctatctattcatcctctacatagtcagttcgatacattgcatcgtggcaggatatgaggacaagatacggacacgcgcttatctgcactttcttattttcctcaacttctgcatcttcctgttcattgtgttgcaacccgccctgagcatgaatctgctttcgctgttgctgataggcatcagtatattagtgggacacttgtttgtactgaccaacagcaaatcgtccaacctcttctttatcggttcgatgattacccttatcgctttattctgctttaatatatggacgcttttatag

SEQ ID NO: 2525 - DNA, 3360 bp, B.fragilis
atgaaacagtacaaaaccgtaaacaacctcgtgggttggatcactttcctgatcgccgcaaccgtctattgcatgacgatagagcccacagccagtttctgggactgcccggaattcatcaccaccgcctataaactggaagtaggccatccccccggagcacccttctttatgctcaccgccaaccttttcacacaattcgtcagcgatccggcactggtagccaaaatggtgaactacatgagtgcgctgatgagcggtgcctgcatcctgttccttttctggagcatcacgcacctggttcgtaaactcgtcatcacagacgaaacgaacatcacccgcggacaactgatcaccgtcatgggatcgggactggtaggcgcattggcctatacattcagcgatacattctggttttcggccgtagaaggcgaagtatacgcctactcttccatgtttacggccatcgttttctggctgatattgaaatgggaagacgtagccgaccagccgcatagcgaccgctggatcatcttgatcgcctatctgaccgggctcagcatcggtgtgcacctgctcaacctgctctgtctgccggccatcgtactggtatactactacaagaaagtgccgggcgccaacgccaaaggatctctgctggcactggccggctccatggtattggtggcagccgtactttatggtattgttcccggtgtcgtaaaagtaggcggctggttcgaactgctgttcgtcaactcactgggcatgccgttcaacaccggtgtcatcgtttatgtagccctgctggcagccgccatcatctggggtatatacgaaagctacaacgagaagagccgcacccgcatgaacctctcttttctgctgaccatcgccatgctcggtatccccttctacgggcacggagcaagtgctgtcatcatcggtatcctggtgctgggagtactggcggcctacctcttcgcgtcaaagctgaacgaaaagatacgcatgtcggcccgtaccatgaacaccgccctgctctgtacaatgatgatcatggtgggatactcctcgtatgccctgatcgtgatccgctcggtagccaatacaccgatggatcagaactccccggaagacatcttcacgctgggtgagtatctgggacgcgaacagtacggaacccgtccgctgttctacggaccggcctactcctcgaaagtggccctcgatgtggaagacggctattgcgtaccccgccagaaaagtacagacaccaaatacgtccgtaaagagaaaacctcacccgacgaaaaagactcttacgttgaactgccgggacgtgtggaatatgaatacgcgcaaaacatgctcttcccccgcatgtacagctcggcacacaccgcctactataagtcctggcaagatatcaccggctacgacgtgccctacgatcaatgcggagagatgctgatggtgaacatgccaacccagtgggacaacatcaagttcttcttctcctaccagctcaacttcatgtactggcgctacttcatgtggaactttgccggacggcagaacgacatccaaagcagcggcgaaatagaacacggcaactggatcaccggcataccgttcatcgacaaccttctgtatggcgaccagaacatgctcccgcaagaactgaaagacaacaagggacacaacgttttctattgtctccccctcatactgggaatcatcggactcttctggcaggcatggcgcggtcagaaaggtatccagcagttctgggtggtattcttcctgttcttcatgaccggtatcgccattgtgctttacctcaaccagacacccggacagccgcgcgaacgtgactatgcctacgccggttccttctatgcctttgccatctggatcggcatgggtgtggcgggcatcgtacacctgctgcgcaactacatgaaggaagtccccgcagcagccctcacgtcggcagtctgcctgctcgtacccatacagatggcgagccagacctgggacgaccacgaccgcagcggacgctacgtggcacgcgacttcggacagaactacctgatgtcacttcaggaaagcggcaacccgatcatctataccaacggtgataacgataccttcccgttgtggtacaaccaagaaaccgaaagcttccgcaccgacgcacgtacctgtaacctgagctacctccagaccgactggtacatcgaccagatgaaacgtccggcctacgactctccggcactgcccatcacttgggacagaacggaatacatggaaggtcaaaacgaatacgtccccatccgtccggacttcaagaagcagatcgacaaagcctacaaagccgccgaagaagaggtgctgaacggcaagaatccggaagcactgaacaacatccgtgcccagttcggcgataatccttacgagctgaagaacatcctgaaatattgggtacgcaccaaagacggacaagcagtgataccgaccgacagcatcgttgtcaaaatcgacaaagaagccgttcgccgttcgggtatgatgattccggaggcattgggtgactccatccccgactacatgcacatatcgctcaaagacgaaaagggtaacccgaaacgggctctctacaagagcgagttgatgatgctcgaaatgctggccaatgccaactgggaacgccccatttacatggccatcaccgtcggtacggacaatcagctgaacatgcgcgagcatttcattcaggagggtctgacataccgcttcacaccgttcgatacggaagctctcggagccaccatcgacagtgaaaagatgtatgacaacctgatgaacaagttcaagttcggaggcatcgacaaacccggcatctacatcgacgagaatacgatgcgcatgtgctacacccatcgccgcatctttgcccaactgatcacccagctgatgaaagaaggcaaaaaggacaaagcgctggcagcactggaatacgccgaaaagatgattccggctttcaacgtgccctacgatgtacagaacggagcactcgaaatggcagaagcttactaccagttgggaaacaatacgaaagccgaccagattatcgatgaactggcaaacaagtctgtagaatacctcacctggtacctcagcctggacgacaatcatctgctcatgtcgcagcgtgaatttatcatgcacctcagcgcactggatatggaagtcaaaatgatggagaaatataagtcgaaactcgccggtaactataccccgaaggtgaacgaactatataacatatacgtgggacgcatgaaagcccaccagtaa

SEQ ID NO: 2526 - DNA, 918 bp, B.fragilis
agtgatatccatagccctcggatatatgaggagcaatgtatggctgaccacggcttcaatgttcgccggaaaactgatacgctacatcatcctgctgaaagccatgcaggaagccctgaacctggttatgtaaagaagaatatggaaagaatcattgaatatacggccgacggaagtgccaccctcttcgttccggagctgaacgagcactaccattccgtgaaaggggctctgacggagtcctctcatatctttatcgacatgggcctgaaagcctctgcttctcctgccccccatatccttgaaatcggtttcggaacggggctgaacgcattgctcacactgattgaagcggaaagatcgggcagacagatccattatacgggcatcgagctttacccgctgccatgggaaacggtagagaaactgagatataacgaccgaccgggaggggatggtgaacaacgattaacgaccggcgatgaacaggccgcgcaatggatgaaagccctccatacatcgccctggggagaagacgtgcggatcactccgcatttcaccctgaggaagatacagggagacttcacaatcatggaccgttcatcattgatcactgaccgtacatcgttattctccctcctttatttcgatgccttcgcaccggagaaacaacctgagatgtggacgcaagaactattcgatgagctgtacgttatgatggaagaagaaggaatactgaccacttattgcgctaaaggagtggtaagaaggatgttgcaagcggcaggattcatcgttgaacgtctgcccggacctccgggaggcaaaagggagatactgagggcaaagaagagatcccaggattctccggccgtaacgcaatgtaacgcgcaacccacattaaaacagaaaggataa

SEQ ID NO: 2527 - DNA, 972 bp, B.fragilis
cgcgcaacccacattaaaacagaaaggataaacattatgagaatgaatcgaatacatcagtcaatagtaacccatatccccgggagaggaatgagaggacagactgttctcttccttttcctcctgctcctttccgcctgttccggccgcgggaaaggcgatgcgggagagcggatcatcaccgtcacgatggaaccgcaacggtacttcaccgaagccattgccggagataagttcaccgtacgcagcatggtgcccaaaggcagcagccccgagacttacgaccccaccccgcagcaactggtatcgctgggtgaaagtgaggcatatctgcgcatcggctatatcggattcgaacgctcgtggatggaccggttgatgaacaatactcctcatatccaggtgttcgacacctcaacaggggtggacctgatctttgagtccgccttcgatcacggcgaccaccgccatgaaggaggtgtggagccgcacatctggaactccaccgccaacgcgttgatcatagccggaaatacattcaaggcgctcaccgtactcgacaaagggaacgaagcatactacaaggctcgctatgactcgctatgccaacgcatcgagcagacagacagcctgatccggcaaacgttgtcggtgcccggcgccgaccgtgccttcatcatctaccatccggcactctcctacttcgcccgcgactacggactgcatcagatcagtatcgaagagggaggcaaagagccgtcgcccgcccacctgaaagggctgatggatctctgtaaaaaggaaggggtacgcgtcattttcgtccaaccggaatttgaccgccgaaacgccgaaatcatcgcgaagcagaccggcacccgggtgatctccatcaatcccctttcgtacgactgggaagaagagatgctgaatgtggcgagaagcctccgtggtgaacccggataccaataa

SEQ ID NO: 2528 - DNA, 732 bp, B.fragilis
caaagaattaaaataaacaagagtatggcagaacaagcattatttcaaccattcaaccggaaccaacaaagggagaatttagagaacacaaaagagacgggtctactaatcagcctgatccctagtttacaggaagacttctacgtagacagcctgacaaccggagcaagcaaagaaaccctatccaaacttcttttaagaaaccccggaatcaaaaatgaaacggctgttattgaaatgattcatttcctgcatgatgaaggcgaccgcatttcattcagcattctcctaccctttttagtggccgaatatgatccgaaagaactggaagaaaagatacgcgaacgttttttcggcatagaacttttcatccgcaaatgcaacaatctgcaccatttcatcacttgtataaaagccgatcaaaccatcaaaataggagaagaggagctaaaaagaggggtgcttgcatgggatatgggaagaatggtgtgcctgacacgcatagcttatgatgcgggatttatagatgaaagccttgcatggaactatatttgctcggccggacaacaatgcatacaagcttttaatgattggactgaggtaggaaaaagtttcttattaggacaggcaatggaagctactgaaaaaaggaagcaggaactatacatccgtctttaccgtcaggccacagagaacccaaacagtccatggaaaaagagaacactgaaataa

SEQ ID NO: 2529 - DNA, 879 bp, B.fragilis
ccgaattataaagaagaaatagttatgaaggcagacaaccgaaacatttttgccattaaggcgtttctgagagagtatctcgatctgagaaaggataaggacaatgaactggcaaccgtcgactctatccgcaagggagttgagtttaaaggagctaatctctggattctgatttttgccattttcatggcttcactcggactgaatgtcaactcgacggccgtgattatcggtgccatgttgatttctccgttgatgggcccgattatgggggcggggctgtctgtcggtatgaacgatttcgagttgatgaagcgttccctgaagagcttcctgattacaactgcattcagtgtcacgacggcgactgttttctttcttttcactcccatcgctgaggcgcagtcggaactgctggcgcgtacgtcaccgaccatttatgacgttttcatcgcacttttcggcggacttgccggagtggttgccctctctaccaaggagaaaggaaatgtaattccgggagttgccattgccactgcgctgatgcctcctctctgtacggccggttacggattggcttcgggcaatctgatctattttctgggcgcgttctacctctatttcatcaattccgtatttatcagtctggctacgtttatcggtgtgaggctgatgcatttccagcggaaagagtttgtggataagaaccgggaaaagaaagtgcggaaatacatcgtattgatcgtaatcctgaccatgtgtccggctatttacctgactatgggaattatccgaagcaccttcttcgaagcggcagcgaatcgtttcgtttccgaacagctcaacttcgacaatacccaggtcttgaataagaagatt

SEQ ID NO: 2530 - DNA, 432 bp, B.fragilis
aaatcaaataatatggctataacttatcagacagagggtatcaaaatgcccgatatcaaaaaacgtgagactaccgaatggatcaaagccgtagccgccacttatgaaaaaagaatcggtgaaatcgcctatattttctgttcggacgaaaaaatattggaagtgaaccgccaatatcttcaacacgattactatacagatatcatcacttttgactattgcgagggcaatcgtctttcaggtgatttattcattagcctggaaacagtgaagactaactcggaacagttcaacactccttatgaagaagaactccaccggacaattattcacggtatactccacctttgcggaatcaacgataagggtcctggagaacgtgaaattatggaagctgcagagaataaggcactagctatgagaaagcagtaa

SEQ ID NO: 2531 - DNA, 363 bp, B.fragilis
ataatgataaagcaaatcatgaaaaccaacagtaaacaaaagagtgctttgttagtaatgctcttatctttactaataccaaacattatggcacaagaaccgaaaataccgaccttggaggatctgattccgggtggagctacctaccgttctgccgagaatatatccggcctgcaatggtggggtgaccaatgtatcaaaccgggaatagaagcagtgttcatgataaaccctaaaaacggaaaagaaacaccgctcaccacccgcaacatagtaaacaaggcgttggaagccggaaatcacggtaagttgcaacacttctacaatgccagtttcccatggccaaagaaaaccctatgctga

SEQ ID NO: 2532 - DNA, 1230 bp, B.fragilis
tacgagatgaaagaaatatttaaattaatattgttattagttatacttagtggatgtattgagaatgacgaagaaatcattttgaataatagcgatttagaggatgtatctgagtataaaagagccgaagacttgatatgtcaattcagtgagagaatagataaggagaaaggtggtacgagaagtagtacttcacaaattatattatctttagccggtaagaaatctgttgttataccgaaaatagctacaagaactggtgagataagtacggatagtgtgaatatgttcatatttgatacggaaaaggatggacgatttggatttgcaatagccaccggaaaagctgaagtaggaagagtttatgcttatgtggaaaatggaatcttgtcagatactatagaaaatgaaggtatggcttatctcgttagtcagattccggatattataaaacaggatcagttgaatccgaatttaacaagaagcggtgaacaaagaacgacacatgtttctataccattggtaaagactgaatggaatcaacattatccttataatgcacaaatgccgacaaacggaaagtgctctataagttattattatgcgggttgtattcctattgcagttgctcaggcgattacttattatagaaaatgcccggttgcttatgattgggatgcatttactgtaaatactggaatatacgatactaatctaatagctcctgtatctcaatttgtaaaaaaggtggcggatggtattaaggtcggttataaatgtgatggaacaggagcaaaaaatttaggttcaaccaatgacttcttgaaaggatggggatataacgttgaaaggcataaaacgaatgacgttgataagaatttattgtataagtgtcttataactaagaatgttgttatctttgggggaaagaagaaaaagagtacaggacatgtttggctagttgatggtggagtttttgaatattctggaaatatgatgattggctgcacgaatatacaggtaaaggcaattcattgtaattttggatggaatagagctaataatggctggtatgctattaaggatggggcttataatagacccgctaatagcgcttctcaagatggcaataatccaactaatgataaaaattcaccgaatggtaatttttatactgaaaatgattacatctattttcatgaagcgatgggaactgaaattttgtggtaa

SEQ ID NO: 2533 - DNA, 1218 bp, B.fragilis
ttcgttcaccttcggggtatagttaccggcgagtttcgacttatatttctccatcattttgacttccatatccagtgcgctgaggtgcatgataaattcacgctgcgacatgagcagatgattgtcgtccaggctgaggtaccaggtgaggtattctacagacttgtttgccagttcatcgataatctggtcggctttcgtattgtttcccaactggtagtaagcttctgccatttcgagtgctccgttctgtacatcgtagggcacgttgaaagccggaatcatcttttcggcgtattccagtgctgccagcgctttgtcctttttgccttctttcatcagctgggtgatcagttgggcaaagatgcggcgatgggtgtagcacatgcgcatcgtattctcgtcgatgtagatgccgggtttgtcgatgcctccgaacttgaacttgttcatcaggttgtcatacatcttttcactgtcgatggtggctccgagagcttccgtatcgaacggtgtgaagcggtatgtcagaccctcctgaatgaaatgctcgcgcatgttcagctgattgtccgtaccgacggtgatggccatgtaaatggggcgttcccagttggcattggccagcatttcgagcatcatcaactcgctcttgtagagagcccgtttcgggttacccttttcgtctttgagcgatatgtgcatgtagtcggggatggagtcacccaatgcctccggaatcatcatacccgaacggcgaacggcttctttgtcgattttgacaacgatgctgtcggtcggtatcactgcttgtccgtctttggtgcgtacccaatatttcaggatgttcttcagctcgtaaggattatcgccgaactgggcacggatgttgttcagtgcttccggattcttgccgttcagcacctcttcttcggcggctttgtaggctttgtcgatctgcttcttgaagtccggacggatggggacgtattcgttttgaccttccatgtattccgttctgtcccaagtgatgggcagtgccggagagtcgtaggccggacgtttcatctggtcgatgtaccagtcggtctggaggtagctcaggttacaggtacgtgcgtcggtgcggaagctttcggtttcttggttgtaccacaacgggaaggtatcgttatcaccgttggtatagatgatcgggttgccgctttcctgaagtga

SEQ ID NO: 2534 - DNA, 423 bp, B.fragilis
caatttaaagacttaaaaacagatatcatgaaaacaacaggatttttaaaaacagtagcattgtcagcagttcttttggtaagcagcgttgcagtttccgcccggaactatgataacaatcttatttataactccgaagaagaaaacggcatgttaataggacaaaccgtttataagaaagaaggttcttccctagccaattatatgaaatataactataaatacgatgacaataaacgcatgattgaaagtcagactatgaaatggaacagctataaaaataattgggagaacgatttgctggttcgctatacgtacgaaggcaaaaccattaccacaaactattataaatggaataaccggaaaagtgaatttatactggctccggagatgaccgttacaatggataaccctaatctataa

SEQ ID NO: 2535 - DNA, 909 bp, B.fragilis
gtgaacatggaaatgaatgatacccctcaagacaagtacctgaccgcattggccaagtatgacacgcaactgaatgatgctgatgtacaggttcaggttgctgcattaatcgagaaaaaggttcccgaaaacaatacggaagaagtgaagaaattccttttcaactgtattgacctgaccactctcaatacaacagacagtgatgaaagtgtcatgagattcacagaaaaagtaaatcggtttgatgatgaattccctgacctgaagaacgttgcagctatctgtgtatatccgaattttgcacaagtagtaaaagacacacttgaggtagaaggtataaacattgcctgtgtatcaggaggctttccctcttctcagacatttaccgaagtaaagatagcagaaacagctatggcattggctgacggagccgatgaaatagatatcgtaattcccgtaggggcatttctgagtggcgactacgaaacgatgtgtgaagaaatcatggaattaaaagagacttgcaaagaacaccatctgaaagtaatcctcgaaacaggcgctttaaagactgcctctaacattaaaaaagcctctatcctatccatgtattccggagccgatttcatcaaaacatccaccggaaaacagcaaccggcagcaaccccggaagcagcttatgtaatgtgccaagctatcaaagagtactacgaacagacaggaaacaaagtcggtttcaaacctgcaggcggcatcaataccgtaaacgatgcattgatttattataccatcgtaaaagaagtattgggtaaagaatggctcagcaacgagctgtttcgcttaggaaccagccgtttggctaatcttcttttatctgaaattaaaggtgaagagctgaaatttttctaa

SEQ ID NO: 2536 - DNA, 1884 bp, B.fragilis
acaaggcgttggaagccggaaatcacggtaagttgcaacacttctacaatgccagtttcccatggccaaagaaaaccctatgctgatcgccctgcggataaatacatcgtatacgatttcgactaccgtgaggttatcagcacacgtccattgccaaaggaaggtgccaatagagattatcaccctgaaacgggacatgtagcctataccataggcaacaatctgtatgtggacgatcgggccgtaaccaacgaaccggaaggtatcgtatgcggccagtctgttcatcgcaacgaattcggaattaagaaaggaactttctggagtccctcgggcaatctgctcgcattctatcggatggatcaaagtatggtagcccaatatcccctggtcgatgtcacagctcccattgccgaagtcaacaacatccgctacccgatggcagggatgaccagccaccaggtaaaagtaggcatctacaaccccgctaccggcaaaagtatctatctcaatgccggagacccgaccgatcgctatttcactaacatcagttgggcgccggatgaaaagagcctttatctgatcgagttgaaccgcgatcaaaatcatgccaagttgtgccggtatgatgttgaaacaggcgaattgacggccactctttttgaagagaagagcgacaagtatgtagagccgcaggaccctatcattttcctgccttgggataacagcaagttcatctaccagagccaaaaagatggcttcagccacctttacctgtacgatacgaacggccggcaaatccgtcagttgaccgagggagactggctggtaaaagaggttctgggcttcgacaccaagaaaaaagagattattattgccagcacagagttctcgccattgcagaacaacctgttccgcctggatacaaaaaccggaacacgtactcccctgggcagtgcagaaggcgtacacagcggccagttgagcccttcgggacgctacctgattgaccaatacaactcaccgactgttccgagaagtatcaatatcatcgatgtgcaaagtggtaaaagcgtcaatctgctcacagcagccgatcctttcaccggctacaagatgccgggtatcgagacaggtaccatcaaagcagcagatggcaagacggacttatattaccgattaataaaaccggccgatttcgatccgaacaagaaatacccggctatcgtatacgtatacggcggtcctcacgcacaactggtcaccaacggctggcagaacggtgcacgaggctgggatatctatatggccaacaaaggttacatcatgtttaccgtagacggacgtggaagcagcaatcggggactcgattttgagaatgttactttccgccagttgggaatcgaagaaggaagagaccaggtgaaaggaaccgaattcctgaaaagcctcccctacgtcgatgggaaccgtatcggagtacacggctggagctttggcggtcacatgaccactgcccttctccttcgctatcccgagatatttaaagtgggcgtggccggcggtcccgtcattgactgggggtattacgaagtgatgtacggagaacgctatatggataccccgcaaagcaatccgaaaggatataaagagtgtaacctgaaaaacctggcaggcaacctgaaaggacatctgatgatcatccacgatgaccacgacgacacctgcgtgccgcagcacaccctctcgtttatgaaagcgtgcatcgatgcccgcacgtatccggacctcttcatctacccgtgccacaagcacaatgtgtcgggccgcgaccgtgtacatctgcatgaaaagataacccgttatttcgaagactatttataa

SEQ ID NO: 2537 - DNA, 399 bp, B.fragilis
aagaagaaatgtggtaactttgcttttgaaataaaaaaacacataacaatgaaaacaaagatgattgtattagtggggatgctgtttacacaaatagtattcacgtctaataatgtttatggagaggatgtaatggctattatgaaagatagacataaggtacatttgattactcataaggaggcaaatctgcagagaagtactctacttgttgcttgtggttatattgaagagagccaactatttttaaattttaattcctccttagaaaatagaaagatacaggttgttgattccgaaacagggcagactgtttttgatgatactataacaggtacttctttctctatctttttggaaagggattctgatagttttgacatttatattggaaggtaa

SEQ ID NO: 2538 - DNA, 456 bp, B.fragilis
tttgagttgtgcattagggaaagaagtgaaaacaggagaattcggagccgacatgaaagtagagttattgaacgacggacctgtaactatttgcatcgataccaaaaacaaggaataatgacattagaagaagcacagaaagccgttgatgaatggatacacaaatacggtgtacgttatttcagcgaattgaccaacatggcagttctcaccgaagaagtaggcgaactggcacgtatcatggcccgtaaatatggagaccaatctttcaaggaaggtgaaaaagacgatatcagcgacgagataacggacgtactctgggtactcctttgcatcgcaaaccagaccggggtaaacctcacagaagcatttgcacgaaatctggaaaagaaaacccaaagagacaacaaaagacatatcaataatccaaaactgagtgaacatggaaatgaatga

SEQ ID NO: 2539 - DNA, 1134 bp, B.fragilis
gtaagaaagtgtttcgcgccaagctttttgtggtttttatttatcggtttggggatggggtgtgtcggaactcttctcgtggcaatgacaatgctcgcccagcacccggtgaggcagtgtgccgtgtcccagcagctcgatcgggcagttgaagttccgttccagccattcggtgttgacgcttgcggccgggtgatagtccagtgtttcgttcacgcaggcgatgttctttacctgttgcagcaccgtcccgatgtcatggctgacgaggatgatggcgcagtcgcggttgatctccgccagcagctggtagaggcgggcttcgaagcgcttgtcgatgtaggtgctcggctcgtcgagaataagcagttgcgggtcgctgatgatggctcgtcccagcagggcgcgttgcagttgtccgccgctcagctgtccgatggcccggtgttcaagtccctcgagtcccatgcggtggatcacttgtcgggctttctcgcggtgacggtcattgaaacggccggtcagcgacttcttggagctgagtcccgagaggactacctcgagaaccgagatggggaaggagcggtcgatcgagttgtactgcgggagatagcccgtcgtgagtggttcgtgatatttgatgatttctcctcctgtggggcgaagcagtcccagaatgcatttgataagagttgtcttgcctccgccgttgggcccgatgatgccgaggaaatcgtgctcgtagacctccagatcgacatcgtggagcaccgtgcgtccgtcataggcggcggagagtcctctgatggagaggaggggggaggaagtcgctgcttccgtatgcttgtggggttttctttctttatccatgaattgcttgaggttggttattggtatccgggttcaccacggaggcttctcgccacattcagcatctcttcttcccagtcgtacgaaaggggattgatggagatcacccgggtgccggtctgcttcgcgatgatttcggcgtttcggcggtcaaattccggttggacgaaaatgacgcgtaccccttcctttttacagagatccatcagccctttcaggtgggcgggcgacggctctttgcctccctcttcgatactgatctga

SEQ ID NO: 2540 - DNA, 915 bp, B.fragilis
aatataaatcgtttaaaaagaataaccgaatcaatgaaaatagtaataaaggaaaaagtaataccgtatattttgatttccctgttcagtttcatcggactttcagcgtacggttacaaggcagagggacaaggcggtagcaaagcggtcgtttggtcgatatccaaaattgatacgatgcaaaagaatgtacaacgtaacgatgagcggaatcctaatatacaaaacatcgaatatctcaaaaaaatgtttcggcaaaaagctgtcgacgaaatatccgaaaatatagtttatccattgaagagaacatcccctataccgagtgttgagaatgcagaggaattgaaagaaagattcgattcaatcttcgatgaagacttaatccgtattattacgagttcggatattgatcaatggtcggaaatgggatggagaggaataatgctggacgatggcatactttggatggattacgacggaaaaattacagccgtgaattatcaaagcaaatacgagaaaaagcttgccaagaagcttacctccaaagtaaaaggtgacctatcctcggatttgcgacataacttcaaaggggaagtatataaatttaagacaaaaaattattttataaggatagatgaactgaaaaacggcatgtaccggtatgcctgttggaaaaaagagaacccagaatcgaccaagccggatttagtcttggaaaatggaaaaatagaatttagtggaagtggaggaaatcacgtgattacatttaaaaataatatctatgaatacaaggtgttccataataaaatagccgcgtcggggatcgcggacatcactcttgttgtagagaaaaatggcaaagaaatactctcggaagatgggaaattggaagacgacatcactcaaactgattag

SEQ ID NO: 2541 - DNA, 1635 bp, B.fragilis
tatatgaatagaacttttattatgcgagagtgtctcggtaaagccttatggctgtgtttttgcctttcgataacaggatgtgcggaagatgacagaatgactcccctgtctgctgacagcggggatactgccgacgagttaattcctatccatatcagtctgacaggtgacaacgactatcattcttcctcttttaatgacgcttcgacccgtagccactctcccctgatcgccgaatgggtgggggtaaaagctttctcacctacacgcacaggagagcaaccggactatgacggtccccggatagcctcgatggaactgacggaagataccctaccccgtgtaagtacccgtgcaacagtgcctgcgggagtctatttccggctgattgttttccggaagtccggaagtgaatatgtcttccagtcggctgccgattacacctccaatggtacgggcactcctgtactcaaacaagggagactgctgacacgctcgggaacgatacgtgtggtgggttactcctttaataccactacagctgccgacttgggaactatgccttccacgtatgcctacaacagcagcacagtgtctatccctaacatgagcaaggacttcatgaccttcgattccggagatataacgaatgtaaacagcctcagccacaaccttccggtgagtttcaatcagaagttgtgcaaactgacaattaccatcagtcctaccggatttccaagcaatacaatcaccaattgcacgggtgtatatgtaaagcaagggggaaactccacatcatggaagatcggcccttcgaccaatgtggtagccgccaacacgaataatacggcggcattcagtccgaagacgactctgagtacaaccatacgcatggttccgtttgcaggggccaggaccattacagtgcatttcaatacgctgacaataagcggacggactgtgcccaacaatacggaaatcacctccacccaaagcgtgcaactgaaagagggaaaaagctatacgatgaaaatacagttcaaaaaagccatcggaattaatgtacccgcaagtaacattaatcttacgcaaaatgggtgtacagaaaacgacaaaaccatcttatcaaaactccgatgggctgaaggtaatctcaattcccaaagcaactataatctgacatgggcttcttctactaccgattacggttattattatatatggaagaatgtatatgtatcatctgggtatacaggctatggtgctgttgatccttgtacacgtcttgacgaaagtaaatacggtagtggttggcgtactccaacaagaagtgaattcataagtctctcccgctgtagcaacaagcaattggtaaagtataacggtatccaaggtatgtggtttatgaatagctcgaccggtctatttttgcctgctgcaggctggcgagatggcaacaatggcagtggtactactgctaccgcttataccgatggtacaggcagctactactggagtagtgacctcaacggtaattcagcctatggtctttatatccttaaaaatgacgtcttcgtagacgctaacggtaacaggaagtccggtgtttctgtccgatgtgttcacaatctctag

SEQ ID NO: 2542 - DNA, 465 bp, B.fragilis
caattatccaggtcggatattactattacatacaatactatgacagagttcagatacagtatttgcgaaccacttaatccgaaagtgatagaaaaaggaatgatagcccctgactccgttatcgggttgttcaatgattttcagtgggactattatttaaagcagatagaagtcgctgaaacgaggaaaatggacatttatttttctccctcgctggaagtggagaataaagcgaataaaaacgggcttacgatctctgctgtcggcgatccggaagatcctgagttttatattttttacaaacgtcccataagcgtggtgaagaagcagttttttcgtaaaccgcaaacggtcgtggaggattatgtcagtgagatcactggtcaaacgaaagaggatattattgaatgtctgaatgcccttatcaaaaacgatcaggaattcctaaggagaaaaattgcataa

SEQ ID NO: 2543 - DNA, 477 bp, B.fragilis
caaagattaagcaatataattcgaatgagagtagttatacaacgcgtcagccacgcatcagtcacgattgacggacactgcaaatcggctattcagaaaggaatgatgatcctggtaggcatcgaagagacggacagccgggaggatatcgattggttatgcaagaaaatcgtaaatctccgtatttttgacgacgaaaacggagttatgaataaatcaatccttgaagacgaaggtaacatattggttcttagtcaattcacactacatgcgtctactaaaaaaggaaatcgtccatcctacataaaggctgctaaaccggaaatttcaatcccactttacgaacaattctgcaatgatttgagttgtgcattagggaaagaagtgaaaacaggagaattcggagccgacatgaaagtagagttattgaacgacggacctgtaactatttgcatcgataccaaaaacaaggaataa

SEQ ID NO: 2544 - DNA, 576 bp, B.fragilis
accaggaaaagacgctcccatgcccttccgcagacacttccgcccctgagcgcgagtccgccgtttccacaaaatccaacaatcatggctaaatacaaattaacgctcaaaaaaaatccgaacaagagaaacgaacccggaaaatggtacgccatccccaccaccgtgaacagcctcgacacccgggccgtcacccgggccgtgacacgcaacaccaccgtggcccccaccgaactggagacttcgatgaacctcgtatgcgacggtatccccgccctgctgcaacagggcaacagcgtccgcatcgggtcgctcggcaccctgcgcctctccttcggcagcaccgggacggagaacatcgacgacttcaacgccgccacgatgatcaaaaacgtcaagatcgtcttcacaccctccaaggagctgaaagccgccgtacaggagggactctcgttcgagaacgcgggagtgatcgaaacgggattcacctaccccagcgtgcaggactacaagaagtacaaagtggccgaccgaccggcgggcggcggcgacatcgtggacgatcccacggcctga

SEQ ID NO: 2545 - DNA, 912 bp, B.fragilis
aatagtctcataatgagtccactgaacttcactcacatcctgacacagacagtcgatgagctatcggaaagcgaatcatacaaaggactgtttcaccaacataaagacggtgagccattaccctcgccacgggtattgtgcgatgttatcgaattagcgcgttccattctctttcccggatattacggaaactcaacagtcaacagccggactatcaattaccacattggtgtcaatgtagaaaagctgttcaatctgctaacagagcagattctcgccggtttatgtttcggtaatggtgaccggtgcgatgaatgtaccgaggccaaacgtgaagaagcagcgcgcctggctgccaagtttatcagcaaactaccgcacttgcgccgtgtcctggctacagatgtggaagctgcttacaacggtgacccggctgcacaaagttttggtgaagtgatcttctgctatccggccatcaaagccatcagcaactatcgcatcgcccacgaacttctggaattgggtgtaccgcttatcccccgtatcatcaccgaaatggcacatagcgaaaccggtatcgacatacatccgggagcaagaatcggcacacatttcacgatcgaccatggaaccggtgtagtgattggtgcgacaagtatcatcggtaataatgtgaaactctatcagggagtgacattgggtgccagaagcttccccctggatgctgacggcaaacctattaaaggcattccacgtcatccgattctggaagataacgtgattgtatactccaatgccaccattctgggccggattaccatcgggcgtgatgcgaccgtaggcggtaacatctgggtgacagagaacataccggcaggggcaagaatcgtacagacaaaagcgaaaaaataa

SEQ ID NO: 2546 - DNA, 1896 bp, B.fragilis
gaaataaacattgattcaatggattttaagtacgacgttattgtaattggtgccggacatgcaggctgcgaagcagcagcagcggcagcaaacttaggctcaaaaacctgcttgatcactatggatatgaacaaggtagcgcaaatgagctgtaaccccgccgtaggagggattgctaaaggacaaattgtacgtgagatagacgctttaggcggatatatgggattggtaacagatcagacagctatccagttccgcatactaaaccgctcgaaaggaccggccatgtggagtccccgcgcccaatgtgaccgaaacaagtttatctgggcctggcgcgaaatattagaaaatatcccgaaccttcatatctggcaagatactgtaaaggaaatcatcgttgaaaacggtgaagttgtgggattaaaaacattttgggatgtgacgtttcacgccagatgtattgtattaacagcaggaaccttcttgaacggattgatgcatgtaggaaaaactcaactcccaggtggacgcatggcagaaccggcatcgtataaattaaccgaatccatcgcagaacatggcattgagtacggtcggatgaaaaccggaacccccgtacggattgacggaagaagtgtacactatgagctgatggatacccaagatggagaatgtgactttcacaagttttcattcatgaataccagcgtgcgtcaccttaagcaattgcaatgctggacatgctttactaatgaagaagcacataatgttcttcgtaacggattagcggattctccccttttcaacggacaaatacaaagtatcggcccgcgctattgccctagcatcgaaacgaagatcgtcaccttccccgacaaagagcaacaccagctattccttgaaccggaaggagaaaccacacaagaattatacctgaatggattctcttcttcattgccaatggagatccaaatagaagcactaaaaaagatccctgcttttaaagacctggtgatttatcgtccgggatatgccatcgaatacgattatttcgatccaacgcaactaaaacatacgctggaatcgaagaaaatcaaaaacctcttcttcgccggacaagtaaatggtactaccggatatgaagaagcaggaggacaaggtatcattgcaggtatcaatgctcacatcaactgccacggtggagaacctttcactttagcaagagacgaggcatatatcggcgtattaatagacgacttggtgaccaaaggggtagatgagccttatcgtatgtttacttcacgagcagaatatcgtattctacttcgtatggatgatgcggacatgcgacttacagaaagagcctataaactgggattagtaaaagaagaccgctatgctctattaaagagtaaaagagaagcagtagaaaatatcgtaaactttacccgcaattattcgatcaaggcagcattaataaacgatgcacttgagaatttaggaacgactcccctgcgtcaaggatgcaaactgatcgacttgattaaccgtccacagattacaatagaaaatatctccgaatatgtaccggcatttaaacgggaactggataaaatcacagatgaacgaaaagaagagattctggaggccgctgagattttaatcaaatatgaaggctatattggacgggaaagaattatagcagacaaactggcacgattggaaagtattaaaataaaaggtaagttcgactatgacagccttcaatcactttcgaccgaagcccggcaaaaactgaagaagatcgaccccgaaacaatagctcaggcaagccgcatccccggcgtgtcaccaagcgacatcaatgtattattagtgctttcgggacgatag

SEQ ID NO: 2547 - DNA, 1365 bp, B.fragilis
catactggcatgttatccatttttatgagcgaacaatttgaaatgattgccaaaacctttcaaggactggaagagatactggctgaggaattgacaacacttggggcaaacgacgtacaaataggccgccgcatggtctcgtttaccggtgacaaggagatgatgtacaaagcaaatttctgcctgcgtaccgcaatccgtattttaaaaccaattaagcacttcaccgcaaaagacgctgatgctgtatatgaacaaatcaaagccatccgttgggaagaaatcctggatgtagacaaaacctttgctgtcgacgcagtagtattcagcgatgaattccgccactccaagtttgtctcatacaaagtaaaagatgccattgtcgattatttccgcgaattgaatggaaaacgcccttctgtgcgtatcagtagaccggatgtactactgaatatacacattgcacagactacctgtacgctttcactcgattcatcgggcgaatcgctccaccgcagaggttaccgtcaggaagccgtagaagctccattaaatgaagttctggccgccggtatgattttgatgaccggatggaaaggcgaatgcgacctgattgacccgatgtgcggttcaggtactattcccattgaagcagccctgattgcccgtaatatcgcgccgggagtgtttcgcaaagagtttgcttttgaaaaatggggagatttcgatcaaaacctgttcgaccggatctacaacgacgacagtcaggaacgtgaatttacccacaagatatacggttatgacaacaatcccaaagccaacgaaatcgcaacgcacaacgtgaaggcagcaggggtatcaaaagacattatcctgaagttgcaaccgttccagcaattcgaacagccggctgaaaaatcgatcattataaccaatcccccttacggagaacgtatttcgaccaacgacttgctgggactgtacaatatgatcggcgaacgcctgaaacacgcttttgtgggtaacgatgcatggatactttcttatcgtgaagagtgtttcgatcagattggcctgaaaccgagcgtaaaaactcccttattcaacggtcctttggaatgtgaattccgtaaatatcagattttcgacggtaaatataaggaattcaaaagccaggaaggcggtgatgaaaacggtgaacgtgctccgaaggaaagaagagagttcaagccgcgccgggaggaaggcggtttcagaggagaaagaagaccacgcgaagaacgtaattcggaatacggagacagaagaccgagagaattcaaaggcaaccgtgagcccaaaatcaaaaagccccaggaggactaa

SEQ ID NO: 2548 - DNA, 1701 bp, B.fragilis
agtattttaattatgaataagacatttgtcggttttatctttttattgtttttagtgggcggagtagtttcttgtcaacgttcctcgtcaccgtatccgtattctttgagatatgccgattctttgatggagatatctcctgaacgtacgttggcttatcttcgtaaacttgatgtttctacttattcagcgggtgacagggcatactttagcttactgttcacgcaggctactgataaaaatatgctttctcttcttccatgtgactctttgattgatactgcattagattattatattaaaaaagatggtgtcaatttggctaaagcttggctttataaaggccggattcaaaaaaaaatgaatatgactgaacaggctttgaagagttgctttactgctctgcagggagttgaaggaaataccggggaggaattaaaactgaaaggaatgctatatgaagatatgggatcgatttatttacatcaatctctttatcagaaagcgtttgatgcgttttatcgctcttatcaatgtgattctttactgaatgaccatagattggtaatgtatcctttgtcaaatatggggtgggtgcgtgtgattcaaggaaaaacggtagaagctttttattatttgaaccaatctatacaattagctttgagattgaatgattcagcttttgttagtgatatatatgaacgaatgagtttgaattgtgagaatgtcgattctgctttcctatatgcccatttgtcacatcaatatttgacaaaggatggcgactctattagtttatggttaacatttggtgatttgtatttagacaagcaagaactagactctgctgaatattatttaaagcgtatacttgatactgctgattttaaaaggaagattctagcgtcgtattctttggctgaagtcgagaagattaggggtaattatcaacgggcctttgaatatcagtcttattatggtgataatatagattctatttttttgttaaataaagcctccgatattgagcgcttagcgtataaatatgattcagaagcaaaagtagtaaaggaaaaggaaaagcagaggtttttcattcagcaactttgttatggaggagttttgtttctgctggttattgctataatttttcaacgtatttatcggcgtcgtcaaatagctcgattactgtacgaacagcgtataacttatttaaatgagaaaacagccttatctcaattacaaatagaacgtttggaagttcaaatttctgctttaaagcagtctggcatggagcgtgaacaggaaatagatttgaaacaagcagaattatgctgtgttattgatgaaaaagcacgattgcgtaactgtttgtttatggaaacttctatttttaagcatattcgagaactaagcactcaacccaggttgggacaaaatggaacaaaggggagtccgaaagttcttcttatgaaagaacaggaacaattgaaaaacatattgtttggtatttatgatgattatattcgataccttaagggtacttatcctaaaataacagataatgactgtatttattgttgcttgaaactttgtgaatttgatgatcaaaccatagcttattgttttggtaatgtaagcaagcaaattgtagcgcagcggcgtttacgattaaagaaaaaaatggctgaagccaattga

SEQ ID NO: 2549 - DNA, 939 bp, B.fragilis
gttactataatggaaacgaagataaacagtaaagccctgaaagccgaagccttgcgcctcggcttttctgcttgcggcatagccccggccgagccaatcgatcaagcccatcagaatgctttgaaaatgtggctggatgcggaccggcaagccggaatgacttatatggcgaatcatttcgacaaacgctgcgacccggctttgctggtcgaaggcactcgttgcgtggtttccgtagcactaaactattaccccgccacccgtatacctgacgaggaatatcaattcgcatggtacgcttacgggaaggactatcacgatctcatgcgtgaaaaactggctgccctgttccgctttatacaagaatcagacgtaccggagctgaacggacgcatgttctgtgacaccgcgcccgtaccggaacgttattgggcctggcgtgccggcctcgggtggatcggaaagaacacccagctgatcattccccatgccggttccactttcttcttaggcgagctttttctgaatgcggaagccgatacatacgaccggcctcaacccaatcgctgcggccgatgtaaccgttgcctgcaagcatgccctacaaaagctttagagacgccatacagcctgaatgcacaccgttgcctttcatacctcaccatcgagaataaaagcgaaattccggactctatcgccccctttatgggaaaccgtgtgtatgggtgtgacgaatgtcagaaagcttgtccctggaaccggtttgccactccctgccggacaccggaactgcaaccctcaccggagttcatgaacatgaagaaagaagactggaagcaactgagcgaagagaaatacagagccctcttcaaaggcagtgccgtgaagagggccaaatatagcgggctgataaggaatataagacaaatggaagactaa

SEQ ID NO: 2550 - DNA, 723 bp, B.fragilis
cagccttcaatcactttcgaccgaagcccggcaaaaactgaagaagatcgaccccgaaacaatagctcaggcaagccgcatccccggcgtgtcaccaagcgacatcaatgtattattagtgctttcgggacgatagactgctgcgtttcacgtgaaacaaaacatttaaagaaacaacataaaagaatgattatgagcaaagaaaagcttatcaaaagcatccgtgagatacccgattttccaatccccggaatcctgttctacgatgtaaccacactattcaaagattcggaacgtcttcaggaactttcggatattatgtacgaaatgtacaaggataaaggaatcaccaaggtagtaggcatcgaatcgagaggcttcattatgggaccgattcttgccacccgcttaggcacaggatttatccccatccgtaaacccggcaaactccctgccgaaacaatggaagaaagcttccataaagaatatggcaaagactccgtgcagatacacaaagatgcattgaacgagaacgacgtcgtattactgcacgatgacttactggctaccgtaggtactatgaaagccgcctgcaacctagtgaaaaagctccatccgaaaaaggtatacgtaaacttcatcattgagttaaaggaactgaacggaaaacaagtatttgaaaatgaccaagacgtagatatacaatcagtattgtcgttataa

SEQ ID NO: 2551 - DNA, 2040 bp, B.fragilis
atcaaaacaatgaggcatagagcaaacctggcaattgtatttttttgtttgttattaccgttaacaggctgtaagcaaaaaataaaccgttctgattccgcttttgggggtatgagcatagactctgtggaacgttgtgctcaggattcattgtttagtaatacccgatattcacgttctttgttgcgacacgccatggcggatgctccggatagcctgtcttattattaccttttgtcattttattccaaatcttattttgttacggcagactttgattcagtcttgtattacaatcggcttgtgaagcgcttttgtaatgaagtggagctttccgcggaagtgcatgatctgctttcgactgtttataatatggaaggcaacgtcttgatgcagcgcactcagcccgattcggcgattatctcctataaaaaagcctacgaagaaaggcttcaaggacaacaaacggactatctaccggacttgtgcataaatttggctgatgccaatgtgcataagggagattatgcgtatgccgcttattattatcgtcgcgcactgttcatttgtgattctctcggattgcccgatcgtaataaatttccggtttactatggtctcggacagacttatatggaattacgtgattttgagctttccaatcattattatgaacttgcaggaaacttttttcctcagatgagcgtgtctgagaaatggacttacctgaataaccggggaaaccatttttattataaaaaagactatccgcaggctgttcattatattgggcgtgcattagaggtcgtgaagtcttatcctcaaatggtttttgaacagaatttgtgtaaggcaaatcttggagaactttatgtgattaccaataaactggattcagcgcaattatatctggacgagagctatcgcttcttttccggaatcgggaatcaatcggcgctttattacatagagactcaaatgatcgagcttgcacttaaaaagggaaatgtcgctcttgccggagatataatcagacgatcagccgattacgggcatatagatgccaatatgatcaatatccgtaatcactatctacagcattattacgagcaggtgggaaactataaaaaggcttatgaatatcagaaacacgatcttcaacttaatgattccatccgtaatgaacgtgtcaggacgcgtgtagccgaactggatatgcgttaccggcaggatacgattgtgatgcggaaagaattggtgatcgagaaacaaaaaggagagatggaggtgctgaaactgacaacctatatatgggctctgatcggtattgtatctgttatcgtagcgggacttgtttattggtatatgaagaagaaacgcatgtttcttcaggaacggcatatcaaccagatcagccgtttccgtatggagaatatccggaatcgtctttcaccgcatttcacgtttaatgtattgaatcgtgagatcagtcggtttagggatggggaaacgttgtgtggtgatctgacagaattggtgaaactacttcgtaagagcttggaattgacagagaaactcagtatttctctttatgatgaactggaatttgtgaagacttacatccatcttgagcaaggacgtctcggaagtgatttttcaatggatgtgaagatcgaggaagacttggatattcagcaggttgtcattccttcaatggtagtacagataccggtggagaatgcattgaaacatggattggccggaattgacggtttgaagttacttggtatatctgtttgccgaaagggaagtggaatccttattgatatttgcgataatggacgtggatattctccacaaactttatcatctacacgtggaacaggaacagggttgaaagtgctttatcagactattcagctattgaatgataagaatcgcgagaaaatacgttttgaaatcaagaatctggtgaataatggacagaccggaacacaagttctaatctatataccattggattattcttacaatttataa

SEQ ID NO: 2552 - DNA, 624 bp, B.fragilis
ccgaaggagatgtttatagagcaaccgccttggtttttccgcgcaatctatcccgacgccatcttccggatggaccctgacgaaaaggctgtttacctgacctttgacgacggtcccatcccggaagtgacgccttgggtactggaactgctggacaaacacaacatcaaggcaacctttttcatggtaggcgacaacatccgtaagcacccggatgtgttccgtatggtagtagagcgcggacaccgcatcggcaaccatacgttcaaccatatccgcggattcgagtatctgtcgtcaaactatctggccaacacggacaaggccaacgagatgatgaaaacggatctgttccgtccaccccacggacatatgcgctggatgcaatatatgacgttgaagcgtcactataaaatcatcatgtgggatcttgtcacacgagactacagtaagaagctgcgtccgccccaagtgctggccaatgtgatgagatatgcccgcaacgggtctatcataaccttccatgattcgctgaagtcctggaacaacggaaacctgcaatatgcgcttccccgtgccatcgacttcctgaaagaagaaggatacgagtttaggttactataa

SEQ ID NO: 2553 - DNA, 1116 bp, B.fragilis
acgtacttcgtaaaggaaaaactctgtgaaactctgccttactatgtagcgaaatctatatctttgctacctatttataaaaaaggaatggaagaagattttaatatacgtgatcatcagctgaccagcagagagcgggattttgaaaatgccctccggccattgagtttcgaagacttcaatggacaggataaagtggtagataatctccgtatttttgtcaaggcagctcgtttgagagcagaagcactggaccatgtattgcttcacggcccccccggattgggtaaaaccactttatcgaacatcatagccaacgaactgggagtaggatttaaggtaacttccggaccggtactcgacaaaccgggtgatttggccggcgtcttaaccagtctcgaacctaacgacgtgctgtttatcgatgagatccaccgcctttcaccggtagtggaggaatatctgtattcggccatggaggattaccggatcgatattatgatcgacaagggcccctcggcgcgtagtatccagatcgatctgaacccgtttacattggtgggagccactacccggagcggattactgacggcacctctgcgtgcccggttcggtattaacttgcatctggaatattacgatgacgatattctgagcaacattatcagccgttcggccggcatactcgatgtgccctgttcgtctcaggctgcgggtgagattgcttcgcgcagccgcgggacacctcgtatagccaatgcgctgctgcgcagggtgcgtgattttgcacaagtgaaagggtccggttctatcgatacggagatagccaactatgcgcttgaggcgctaaatatcgataaatacggactggacgagatagacaacaagattctctgtactattattgataaatttaagggtggtcccgtggggcttacgactattgccactgcactgggcgaagatgccggaacgattgaggaggtctacgaaccgttcctgatcaaagagggattcctgaagcgtactccccgcggacgtgaggtgacggaactcgcctataagcatttggggcgcagtctctacaatagtcagaaaacactgtttaatgattag

SEQ ID NO: 2554 - DNA, 1065 bp, B.fragilis
ttcatatttttcagttttttcatggtaaaagtacaaaaaaataccgtattaaccgttttattattacttttgtgctcaaatagtgtgtgcatggatagcttatctttaataaagtccccgattactacggagctggaagatttcaaaaatctatttgatagttctctgtccagttcaaatcttttgcttaataatgtgattgctcacatccggcagaggaatggtaagatgatgcgccctatccttgtgttgcttgtagcaaagctttacggagaaataaagcctgagacattacatgcggcagtatcccttgaacttcttcatacggcaagtctggtgcacgacgatgtggtagacgaaagtacagaacgtcgcggacagttatcagtgaatgctatttttaataataaagtagcagtgctggtaggcgattttcttttggcaacaagtctggtgcatgccgaacgtactcgtaatcatgatataatcggtgtggtagcgtgtttgggacaagatttggcagaaggggagatacttcaactctctaatgtcagtaaccgggaatactctgagactatttacttcgatgtgatccgtaagaagacggctgccctttttgccgcatgtactaaagctgctgctctttcagtagaagttaccgatgaaaaggctgaatttgcacgtctttttggtgagaacatcggaatttgctttcagattaaagacgatatattcgattattttgagagtaaggagattggaaaaccgaccggaaatgatatgctggaaggtaagcttactctacctgctttatatgtactgaataccacgactgatgcgtgggctcaggaaatggcccttagggtaaaagccggtacggctacagtagacgaaatcacccgtttaattgagtttatcaagcaaaacgggggaatagaatatgctgtgaaagtgatgtatgaatacaaagagcgtgctcttgacctattgcgcactttgccggattcggcagtaaagacctccttgattacctacttggattatgtggtcgatcgtgataaataa

SEQ ID NO: 2555 - DNA, 411 bp, B.fragilis
aattttgtggtaaaatataaacttataattatgaaaaaggtattctttttgtattgcatttctttattatgtatttatggatgcaatgatgattctgataaatattcttctaattttctgaagagtagggaagtgactctgaatgcggaaggaggagatattactgtagaaggaagagagaagtttatacttgtacagacagaagagattctaaatcaggatactattttcagtataggcgagattaatggcgttgaatatcagggaggatggtatcaattagaggttaatggaaaagaaatgactctcaactgtgacagaaatttaacgggaaataagcggaaagttgttttgcatttccaagggaccggtaattcatttgatgttttttctctgacacaattagaataa

SEQ ID NO: 2556 - DNA, 3006 bp, B.fragilis
gcaatcacattattaagcaaaagatttgaactggacagagaactatcaaatagatttttgaaatcttccagctccgtagtaatcggggactttattaaagataagctatccatgcacacactatttgagcacaaaagtaataataaaacggttaatacggtatttttttgtacttttaccatgaaaaaactgaaaaatatgaatcaaaacagcaaactattcctcttggatgcttatgctcttatctatcgggcgtactatgcgttcattaaaaatccccgcattaattccaagggttttaatacttcagccatactgggattcgtcaacaccctggaagaggtgctgaagaaagagaaccccacccacattggagttgcattcgatccaccgggacccacattccgccacgaagcttttgaacagtacaaagctcaacgagaagaaactccggaagcaatccgtctttcggtacctattataaaagatattatcaaggcttaccgaatccccatcctggaggtagcgggatatgaagcggacgatgtaatcggaactctggcaacagaagccggcaatcagggtatcactacttatatgatgactcctgacaaggactatggtcagttggtaacggatcatgtatttatgtatcgccccaaatatggagacaaagaatttgaagttatgggggtagaacaagtaaaagctaaattcgatattcaatcaccggcacaagtgatagatatgctcggactgatgggcgactcttccgataatattccggggtgtccgggtgtgggagaaaaaactgcccaaaaattaattgccgagtttgggagtatagaaaatctgcttgaacataccgatcagttgaaaggagcactgaagacaaaagtcgagacgaatcgggaaatgattattttctccaaattcctggcaacaatcaaagtggatgtacctatccggctcgatatgaactcactcgtccgggaacaagcagatgaggacacgttgcgtaaaatatttgaagagctggaattccgcacattgatggaacggatattcaaaaaagaatcatcacccgcctcccctatcgccggtacattatttaatcaggaaaacggcccggttcaaggcaatctctttgaagaatttacgcccgatcatacgaatgaagaaaaaaaatcaaatctggaaagcttaaattcattaagctacgactaccaattaattgatacagaggagaaaagaaacgaaattattaaaaaactacttacatccgaaattcttgcgttagatacggaaaccaccggaacggatccaatggatgcagaattggttggaatgagttttagtattaccgaaaatcaggcattttacgttccggtacctgccgaacgggaagaggcaatcaaaatcgttcgggagttcgaacctgtcttcaaaaacgagaagtcactcaaggtcggtcagaatataaagtacgacatgctcgttctgcaaaactatgggattgaagtccgaggtaaactcttcgataccatggtagcacattatgtcctccaacccgaactccgtcataacatggattatctggccgaaatctatctgcattatcaaaccatacatattgaagagttaatagggccaaaaggcaaagggcagaaaaatatgcgcgacctctcccctcaagaagtttatctgtacgcctgcgaagatgcagacgttacactaaaacttaaaaatatactggaacaggaattaaagaaaaatgatgccgagaagttattctatgaaatcgaaatgcctctggtccctgttcttgtcaatatcgagagcaacggagtgcgtttagatacggaggctctgaaacaatcgtcggaacacttcactacgagactgcaaagtatcgaaaaagaaatttatactctcgccgaaggagaattcaacattgcatctcccaaacaggtaggagagatactttttgataaattgaaaatagtagagaaagctaaaaaaacaaaaaccggacagtacgtcacctcagaagaggtattggagagcttgcgaaataagcacgatatcatcggtaagattttggaataccggggacttaagaaactattaagtacttatatcgatgctctgccgcaattgatcaatcccaaaaccggacgtatacacacctcctttaaccaaaccgttaccgcaacaggaagattgagttcaagtaaccctaacctgcagaatatcccgatccgggacgaagacggtaaagagatacgcaaagcttttattccggatgatggttgcagttttttctccgccgactattcacagattgagctacgcataatggcacacctgagtgaagataaaaacatgatcgatgctttcctcagtggctatgatattcatgcggctacagctgccaagatttataaggtagatataaaagaggttaccgccgatatgcgccgtaaggccaagactgccaatttcggtattatctacggtatctccgtatttggcttggcggaacgcatgaatgtcgaccgcaaagaagccaaagagctgatagacggttattttgaaacctatccgcaagtaaaatcctatatggacaagagtatccaggtggcacgcgagcacggttatgtggaaacgattttccatcgcaaacgctttttaccggatattaactcccgtaatgccgtagtacgcggatacgcagagcgaaatgccatcaatgctccgatacagggaagcgcagctgacataatcaaagttgctatggcacgtatttatgaacgtttcaaagcagaaggcctgaaagcaaaaatgattttgcaagtacacgatgagctgaatttcagtgtaccggcaaaagagaaagaaatagtagagcaagtggttattgaggaaatggagaaagcctaccgtatgcatgttcccttaaaagcagattgcggatggggtacaaactggctggaggcacattga

SEQ ID NO: 2557 - DNA, 771 bp, B.fragilis
agtcttatctcaaaatggaacgcattgcccaaaatgaagccgaataagtttatcatagagaagcaagtctcagagtttcgtatggacaatggacttagcgctacggagcctatcactttgaaaagcttacttttgaaactaaacatactcactgttttcagacctttatccgacaacttctcaggaatgtgtttgaaagataattcagagcaccgtttcatgcttatcaattctaatcaaccacgaggaaggcaacactttacgatagctcacgaattataccacctttatatagagaaaaaaccgactcctcacaaatgtaatccgggatgtgccagcaaagatccgatagaacaatgtgccgacatgtttgcttcctctctattaatgccggagggcggtatatgccagttaatacccgaaatggaattaaaaaccaaaaacatttcgatggcaacagtcctaaaacttgaacactatttttccgtttcccgttccgctttattgtatagattacaaaatatcggacttataacagaaagtacacgttcccaattggcagaaataaaagtaaaatactctgccaaatgtttcggatatgacacagctttatacgaaccggccaacgaaggactggttatcggtgattttggtgaaaaagcccgcaagctattcgaacaggaaaaaatttcagaaggtcactatatagagttactccataaaataaacatcaatggaacacaagaaaacgaagatagtactctatgctga

SEQ ID NO: 2558 - DNA, 216 bp, B.fragilis
caaacccgattcgctttttctctccaaaagtttcccgttttggaaaactttctgtatcaggaagaaagaaaagttctccaaaaattcttgttaaaacaagaacaacttattgctttaactgttacctttgtagcagatttcagtactaaaaagaggtttagtcataagggaacgctgtgcaaatcggcgacagtacccgctgctgtaattctctga

SEQ ID NO: 2559 - DNA, 801 bp, B.fragilis
catacgaactctgtgacagttaatttattattcacacaaacaaacttacttatgaaaacaaacttctgtcgttttttaattgggttggttgcctttgttgtcggcatcccggttatggcccagacgggaccggataaggtgaagcctttcagccatttatccgtttcgctgaatgccggaacactggggggaggactccaggttgctgctccgttgaatgactatctgggacttcgtgccggattctctttactgaagttcaagtgtaattacgattatgacggaattcgtgatgatcagttgattcaggatgccggtactcgtaccggttacaatccggataaatactataccgttcctctgaaagcaaaagcaaatatgacaaacggcatgcttttgctcgactattttccattcaagagatccgtctttcatgtgaccgccggactgctgttcggtacttcatccatcctgaaagtatcgggacagacagacgaacggatagaggtgggagatatcattatcgagccgggagcggacggacgtgtggaagcagctttgaagaccaatgccgtgaaaccttatgtaggtattggattcggacgttcggtagctcattcacgcgtagggttcaagttcgaattgggagctatgttccatggtaatccgaagattgaagccactaccggaaagattgtggaagaggcgatcgatcaggacctgagccgtttcaataagttcctgaaaaactttaaagcttatcctgtgcttaacttccagttatcataccggatattttaa

SEQ ID NO: 2560 - DNA, 1059 bp, B.fragilis
ccaatcttatcagaaaagaagtacatttgtttccgtaaatcaacactccaattcatgaaactgcaaaaaatatatcgtcaactgtggatggaagtccatccgcgtctgcaatcggcagataccgatcaatggtatgtcgattttgccaacaggctgctgcccctatttgagaagtcggagcttaccggacagatgattcataaaaaccgggccgttctttatttcacctggtatctggaagattgtgtgaataattccggtggatggaataagttcatccggttgcacaagcggttgtacgggcgttttctgcccttttataccctgacaggggcgtatgccgatgatgaaataaattttgaggatgtgtcgttcctgttatggtcgcttctttctcctgtcacagacgattctccggttccttggaatccgacggataaatctctgcttcgacttgcgactgatatttatgcgctacttgaagcccattttgaacaagcccctcttaccgatgacgagtcgatggactggcttccggagattcgtgccctgttgcctcctccgggacctgttttggatattttcccggaaatggagcttccccatgatgtgaccaagttcctgaatgccacccaagggaagcagcttgtctattttgaggattatgcgggcttgcgccgtttctgtgtcgatgcgttggagtgggccgacgaagacgattcgttaatgcccgaattggccgatgaagaaaattttgtattttttgccaatccgaaaggcatcttgcttgctcccaatatcggtgcttgcttccgggatgaacgaaactcgacatataatcccgggattgccgaacaagaaggggccgagttgttttatgttcccggactttgtcccatcgacttgttgcactatgccatgcagcatgatttattgtccgaggtcacttttccttttgaggatggcaggagggtgttgcacgagaactgggattttatagcccgcagatatttaggcaaatattataatgaagatttttatgaagaagagcggaaatag

SEQ ID NO: 2561 - DNA, 279 bp, B.fragilis
gagaacagtccgttaaggaatctggaagcaactgtaccgcacagaaaaaagattatcaccctgaaagaagatactttcagggatctttcggttatggcagcaaagcagggtacgaacctgaaacggttaatagagtccatgctcgacaaggcagcggatgaatacgatgggaacgaatcctaccgctacctgtctgaaaattaccctgatggaaaggtaatgctgggaaaggaagaacgtgaagagtttatagactggttgggagtggttgagaaatga

SEQ ID NO: 2562 - DNA, 930 bp, B.fragilis
agaaatgtgttaaacaaaaccaataaaaagatgaaaaaagtaagagcagccatcgtaggttatggcaatattggtcgttatgtgctggaagccctccaagcggctcccgattttgagatagcaggtgtggttcgtcgtgcaggtgccgagaacaaaccggctgaactgaatgattacgcagtagttaaagatataaaggaacttcagggagtagacgtggctattctttgtactccgacccgcagcgttgagaaatacgcaaaagagattctcgcaatgggcatcaacacagtagacagctttgatattcatacaggcatcgttgacttgcgtcgtgaactgggtgcttgcgccaaagaacacggagctgtatcgatcatctcggccggatgggatccgggaagcgactcgatcgtacgcaccatgctcgaagcaatcgcccccaaaggaatcacttacaccaacttcggtccgggtatgagtatgggccatacggtagccgtcaaagctatcgatggagtgaaagcggctttatcgatgactatccctaccggaacaggcattcatcgccgtatggtatacatcgaactgaaagacggatataaattcgaggaagtggcagcagccattaaatcggacgcttatttcgttaacgacgagacacacgtaaaacaagtgccgagcgtagacgcactgctggacatgggacacggtgtaaacctgacccgcaaaggtgtatccggaaaaacccagaaccaactgttcgaattcaatatgcgcatcaacaaccccgcactgaccgcacaggtattggtatgcgtagcacgtgcttcgatgaagcagcagccgggatgttacaccatggtggaagttccggttatcgatctgcttccgggcgaccgtgaagaatggatcggccacctggtataa

SEQ ID NO: 2563 - DNA, 618 bp, B.fragilis
attatgaacccaactgaaagaataactaccccacacaaaacgggtgaagccaaagtaatcatcttttctgctccttccggatcgggtaagtcaacaatcataaattatttgttggctcaaaagttgaatcttgcattctcgatctcagccaccagtcgtcccccccggggaaacgaaaagcatggagtagaatattttttcctctctcccgatgaattccgtcaacgcattgcaaacaatgaattcctggaatacgaggaagtatataccgaccggttctacggcactctgaaagcacaggtagaaaaacagcttgctaccggacaaaatgttgtgttcgatgtagatgtcgtaggtggctgtaacatcaagaaatattatggtgaacgggcactttcgctttttatccagcctccctgcattgacgaactgcgccgccgtctgatcggacgcggaacagatactcccgaagtgatcgagagtcggatagccaaagccgaatatgaattaagctttgctccgaaatttgataaggttatcattaatgacgacctggaaacagccaaggcacacgcattgaaagtgatcaaagagtttctgggcatcgatacagaataa

SEQ ID NO: 2564 - DNA, 459 bp, B.fragilis
ctccctggccctatagccacactggtgacagcaccggcagccggatatctggtggaacgcattcatcccggcatactgggcagcatcgggatggcattgttctgtatcggactttactctctgtctacattaacggcggattcatcggtcaccggcatcatcctgcgattgatgctttgtggtgcaggtttcggtcttttccagacaccgaacaacagtacaatcatctcttccgcccctacccgacgttcgggaggagccagcggaatgttgggtatggcacggctcttgggacagacattcggtacgacactggttgctttgctcttcagttttgtagtacacgagaagagtacggcggtctgtctgatagccggcagcggatttgcgtttgtcgcagcagtggtaagcagcatgcggctttcacaaccctccacattaaagacgaagccccgataa

SEQ ID NO: 2565 - DNA, 2460 bp, B.fragilis
gtcagaagacctgctgaaaaagtaaacatattaaaaaaaaatctaaagctttcgggagttaaagttatgaactacgcggaaatttgtatcatcaaacgagatggtaaaagggaggacttctccatcagtaaaatcaagaacgctgtatcaaaagcgtttagtgccacaggaatcaatgatgaacagcaattgattgctgacatcacgatgaatgtaatcggacaatttgcatctcctaccattacggtagaagaaattcaggacctggtagaaaaagagctgatgaaggttcgtccggaagtagccaaaaagtacatcatctatcgggaatggagaaataccgaacgagacaaaaagacccagatgaagcatgtgatggacggtatcgtagccattgacaaaaacgatgtcaacctgagcaacgccaatatgagcagtcatactcccgccggacagatgatgacattcgcctcggaagtaaccaaagactatacatataaatatctgttgccgaaacgttttgccgaagcccaccaactgggagacatccacatccacgacctggattactatcctaccaaaacgacgacttgcatccaatatgacatggatgacctcttcgaacgtggattccgcaccaaaaacggcagtatacgtaccccgcaaagcattcaaagctatgctaccctggctaccattattttccagactaaccagaatgaacagcacggaggtcaggccataccggcattcgacttctttatggcaaaaggtgtgagcaaatcattccgtaaacacctggcatcattcatcagcttctatgtacagatgaacaagggtgaagagatagaagaaaaggctatccgtacagtgattgccgaacatctgtcgtccatcaaagcatcggaactggaacgcgaaacgctgcgcatggctctgactgccctacagatcaatatcgacaaagaacatctgaaccaaattatagagaaagcatttgtgcagactcagaaagatacgcaccaggccatggaaggctttatccataacctgaacacaatgcactcacgcggcggaaaccaggtagtgttcagttcaatcaattatggaacagacacttcggccgaaggacgcatggtgattgaagaattactgaaagcaaccgtagagggactgggcacaaggggagaagtgccggtgttccccattcagatattcaagataaaaaacggagtatcgtacacagaagccgattatgaaaaggctatggctaatttcgatgctgccatggaaggtaaattaaaatttgaagcacccaacttcgacttgttcctgaaagcttgccacactacggcaaaagcactcttccctaactatatgttcctggatgccccgttcaaacaacacgaacaatgggacgccaacgacccgcaacgttaccgttacgaactggccaccatgggatgccgcacgcgtgtgtctgagaatgtagccggcgagaaatcgtctttgggacgcggaaacctttcgttcaccacgctgaacatgcctcgcctggccatcgaagcccgtatcaaagcagaaaacatgacggaggacggacacaataaagatgccgtcgagagaaaggctaaagaaattttcatcgaatcgatacatgaaacggctaccttgatagccgaacaactctacgagcgatatcaatatcagcgtacagccctggcacgccaattccccttcatgatgggaaatgatgtatggaaaggaggagctgccctgaacccgaacgaacaagtaggcgacgtgctgcgcagtggtacgctgggtatcggcttcctgggcggacacaatgccatggtggctctctatggagagggacacggacacagccagaaggcatgggacaccctttatgaagccgtgctggaaatcaacaaggtggctgatgaatacaaagccaaatacaacctgaactattcggtactggctacaccggccgaaggactttcgggacgtttcacccgtatggaccgccgtaaatacggaaaaatcaaaggagtgacagacaacgattactatgtcaattctttccatgtggatgtaaaagaaccgatcagcattgtagagaaaataaaaagagaggctccgttccacgccatcacccgcggaggacacatcacctatgtggaactggacggagaagcccagaaaaacgtacgcgccattgccaagatcgtaaaagttatgtttgacgaaggaatcggctacggctcaatcaatcatccggtggatacctgccacaattgcggatacaagggcgtgatctacgataaatgtccggtatgccaaagtgagaatattttgcgcatgcgccgcatcacaggctacctgaccggagacttgagttcatggaattcggccaaacgtgcagaagaaaaagaccgtgtaaagcacggataa

SEQ ID NO: 2566 - DNA, 1446 bp, B.fragilis
tattttacgtttttaattgtttatatgtctgaaatatctgttactaaaaaagatattatttgggggtaccttgctcaatttttcttggttgcgtctggtttaataacattacctttagttttgaatatattatctgctgaagaaattggaatgaactacttgatgctcactatagggagtttagtttcacttttagattttggttttgctccacagtttggaaggaatattacatatatttttagtggggcacaaaaactgcagaaggaaggtataagcacagaaaagggtgatttaaattataaattattggctacaatgatttcagccgcaaagttgatttataaagttatggctgttgtcgttttagttataatgcttactttgggcactgtttatatttacaaagcaacaatgggatttacaagtgtaaagtatgcgttgttaatttgggtaatttattctatttctgcattttttgcgatatactatacttattatacgtctttgttgatggggaaagggttgataatggagtcgaagaaagctatgttagcttcgaggatcacatgtattttactgacttttatatttttattcatggggtggggacttttaggtatagcggttgctaacttacttgctccttttgtgaatcgttatttttcatatcgttatttttttgtgccagaattacgaaataagattgagaattactatgtgaatagaaaagaaaaatgggaaatctttagtataatttggtataatgctaaaaaactgggaatggtttttattggtaattatgcgattagtaaattgagtttatttttggctggactatatttgtcattacaagaaatagcatcatatggtttgatgattcagttggtgacagttttaacagtttcttctgttacattatttacaatatctgagccttatttaatttctttaagaatagaaggtaaacggagtgaattattgaaacggttttcattcacaatgaatgtgtactattgtttattcattataggtagtctttttcttattattttagcgcctctgttattagaatttataggatctaatactaaattgccatcaacttatattcttactctttattgttttgttatatttttagaaaataataattgtaatttttcaacatttatacttcttgataataaaattccctttatgtggccttccttatgtactggagtatttattattatgggtgatttcttaatattacagtatacttcatttgctcttggtggattgattatggttcaattgatatgtcaatcagcttatgttaattggagatggatctatgtcgtttgtcgtgattttaagatatcattttcttcatttttagcattaggattaaaggaaacttttaataaaatcagattgtcactttttatgttaaaatactga

SEQ ID NO: 2567 - DNA, 285 bp, B.fragilis
tgggggataacaggtacgaccagcatgatcatgctgatgaaaaggagaaaagagactatgtaccgtttattcctcattcttaatttagattattgcgaggcaaagatagtctatcattggataaaaaacaaacagtgttacttaaaaaacaaaaagacagatgcgtcgtactttttaccacggagtatcacagagcctttttttgttaatgatcaacgactgaaaatcgactccatgttactctgtgtcctctgtggtgagtttcgacatacctgtcttaaatga

SEQ ID NO: 2568 - DNA, 1005 bp, B.fragilis
tatgttaatgctatgacaactccgacagttagctttataattccggtgtataatgttgataagtatttgagtcaatgtattgaaagcatactggtacagagttatcggaactttgaaattattcttgtaaatgacggttctatcgacaatagtccgtatttgtgtgatatatatcaatctaaggatgagagagtaaaaactgtgcataagaaaaatggtgggctttctgatgcaaggaacgttggtttgactttggctaaaggtgaatatataattttcctagatagcgatgatttttggatatcacaaaacgatttacagttattagttcatcgactggattctcttataaattgtgacttcatgtgcttcaattgttgctattattatccgtcaaaacatttattcaaaagatggactccttttgcagatgaattattattgagtgtggataaatctaaaagtattatatctttggtgagctctggaacatttccaatgagtgcttgtctaaaaattattcgaagaaattttttgctagagaataatattacttttcaaaaagggattcaatcagaggatatactttggtttatggaattgttggagaaagcacattccatagcattcttaaatcaatacatatatgcttatagacgtgaagtggaaaattcgataacatcttcattcacacctaaaaaatataatgacttgttttctgttttagaaaatgggattcaaagaatagaggcatataaatgggatatacagactaaaaatgcattgttgtcatttatggcttatgaatattgtacgctactcgctttcttgtattattttccatttgcgttgagaaaagagttggagggcaagttgtttcaatataattggttacttaaatataagctaaatcctaaagtaaagaaagtatctttttgtatgcgttttttgggcaaacgtttaactcttcttttgttatataggtatatgaagaatttagtataa

SEQ ID NO: 2569 - DNA, 291 bp, B.fragilis
acagtgatcgccatcgaagtgaatatttccattatgcgagcttttgtagctgtccgccaattggtctcggctcttccggtgaatgatatcaccaggctgcaagatgaaataaaagagttaaaagaatatgtagaagcggcatttgccgattacaatgatattaatgaagatacgaggatgcaacttgaattaattaatcaggcaattgctgaattgcaggccaaagacaaacaggcaggcggaaaaactcgtaatccgatcggttttatatcttataataaggaaaaatga

SEQ ID NO: 2570 - DNA, 357 bp, B.fragilis
tacaacctttattatctttgcgtcatgaagaaaataataacgtacaagaattactttgcagagtttatggataaactctctgagcttgaacggaagaagatacaacgcgctctatctctttttaaggcagaagacaagataccgagccattacattaaattcattcgtgatggagtatatgaatttcgtgtggcctgtgggaacaatgaattacgcatcttttttatctacgacggtgagaacgtagtggtattgttcaattgttttaggaagaagacgcagaaaacccctgataacgaaataaagaaagctataaacttaaaaaaagaatattatgaagctaaaggaaataagtaa

SEQ ID NO: 2571 - DNA, 720 bp, B.fragilis
tcaatgattctctcttctttggtacataccgattttcagccttatttacttcctaatacggatgcatgggctttacctagggataaggcgttggaattgttggtttatcttaaacagcaaggtgtcaggcagatctactgtgtacctccggtaaaggtggaaaatgaagggaatgctttttcttttctgaaagatgcctttcaatatttacagcagcaatactccggtaatatctctctgcgtttgtcggcaagatatcgtttggatgaaggatttccggctttgttggagaagggagatttgttgacgataggaggggggaaggagttactggtagatgtgtctcctttacaacagccggaaggactcagtgagatgattcatgccatctgccggtcgggttatatccctgtcctgatgcaaccggaacgttcgctttattggggaacggaagactatctgcacttgcgggaatcgggatgcaggctgatgctgaatctatattccttgttcggttataatggtgacggagcgttgaattacagccgtatgttgttgagaaaggagtggtatacatatctctgttcgggtagggaggatacgaaagtgatgcgctatggtgaatcgttttcgatagaggatgatgatgatttggcgatgaaattgcaggagatagaaagaaacagcaggctgttgtggtctgctacggaaaacgggtaa

SEQ ID NO: 2572 - DNA, 504 bp, B.fragilis
aataaacaatatacgcgtatatatagaaatatccatataagaaccactaattttgcattcgtaataaaaaaacttattagacgaaatgagcaaaaaaaaccgaatgaaggagtggtattaaacatgggaaataccccttacgtagtaatcgtcaatgaaaaaagtgacgaaggacagaaagtgttggaagcactggaagaaaacatagaaaagatggatataggctcgcatagggagcttgtcatcttctttttcgtatggctgaaccatcagcagaaagatcccaaaaagagaaaaaacatacgggaactggcaaagatcatgcaccggtcactgttcttcggacaaaaacacaacagcaacgaggagatgaagccggattccattgaaactgagatatttaagatactaaggatattaaaaagcatgaaaaaagcggaagataaagacttgattataaatctattagacgatatcagcctgtttctggatgaaaacgtctaa

SEQ ID NO: 2573 - DNA, 558 bp, B.fragilis
gattggctacatttgcaccaatttatgaactttacggcaatggatattacgctcagaacgctcacggaaaacgacttgccttttgtaaaagacatctacgactattataccctccacacgacagtggtgtactttgtacactgcgccagcatcgacgaactaaaaaactacatccccgtaggcgatcctgtctaccggtcgttcatcattgaaactcccgaaggagcaccctgcggattctgctatttcgcacgcttcaagccccgagaagccttccgcatctcggtagagctgaccctctacctgaaaccggagtttacaggaagaggatatggaaaacaagctatactccgactggaagagatcatccgccaagaaggcttcagcaacataatggcactgatttcgggagagaacgaagccagcatccgcctgttcgaaaaatgcggtttcgaatgttgcgcaaacatccggcaggtagcggagaagttcggcaaaaaactggatttgaggatgtatcagaaaattatttcagacaattcacatctcactccctga

SEQ ID NO: 2574 - DNA, 183 bp, B.fragilis
cacagtgttaaaacttgttctttggatgtgaataaaaagttctttaaatgcaaaagacttgttatttgcgcacaagaacctgacaacctgcaaaaggcgttaacaatgttaattgaagaaaggtataaggatgaagataccggttcaaacggcgtaaattcacttcctaaacttgagttataa

SEQ ID NO: 2575 - DNA, 1113 bp, B.fragilis
ctcaaaactaaatcattaatcgatatgaaaccttatttgttattgacccccggaccacttactacctcagagactgtaaaggaaaccatgatgaccgactggtgtacatgggatgaagactataatttgcacattgtcgaagcattgcgtaaagagctggtcggcattgctacccgcaatacggaagagtatacatctgttcttttgcaaggaagcggaacctattgtgtagaagccgtgattggtgctgccatcggtaagaatgataaacttctgatttgcagtaacggtgcttatggtgaccggatggggaatattgccgaatattatcatatcgactacgagctccttgcttttgatgaaacggaacaggtatcggtagactatgtggacgactatctgagcaataattcagatgttactcatgtggccttcgttcactgcgaaacgactaccggtatcctgaatccgttgaaggagctggcacatgtagtgaagatgcatggcaagaaactgattgtagatgctatgagtagctttggaggtatcccgatggatgttagtgagttgggaatcgacttcctgatcagcagtgccaataaatgtatccagggagttccgggattcggatttatcatagcccgccgttcggaactggtgcgttgtaagggagtagcccgttctctttctctggatatttacgaccagtgggaaacgatggaaaaagggcatggtaaatggcgttttacttcaccgacccatgtggtgcgtgctttcaagcaggcccttaccgaactgattgaagaaggtggagtggaggcccgtcaccggagatattgtgagaatcaccgggtactggtagagggtatgcgttcactcggttttgtaactttgctcgatgacgcaatccagtcacctattatcacttcattcttgtatccgaaaaccggattcgactttaaggccttctataccgcccttaaatccaaggggtttgtaatctatcccggaaaaatttcaaaagcggatactttccgtatcggtaatatcggagatgtacatccggaggactttgcccgtctggtggaggtggttagagagactgagtactaa

SEQ ID NO: 2576 - DNA, 210 bp, B.fragilis
gttttcgctaaaagcagtaatcattcacctccgaagcccggttcttcgacccgatatcatcaggagataaatgattatctcctgatgatatcggaagttactcctattcttttccaaagaagtgccaaattgttaatctatactaaatctgctcttgacaaaaagaaggcaagaacagagatgttgtatctttgtttctttgtaaactaa

SEQ ID NO: 2577 - DNA, 1167 bp, B.fragilis
  unsure (348),(460): Identity of nucleotide sequences at the above locations are unknown.
caaattaataaatcaatcataaagaatatgaaaacttatcttgtaaccggtgctgccggatttatcggtgccaattatctgaagtatattctggctaaacacagtgatatcaaggtggtagtgctcgatgcactgacttatgccggaaatcttggaacgattgccaacgacattgataacgaacggtgcttttttgtgaaaggtgacatttgcgatcgtgaactggccgaccgcctttttggtgagtacaagtttgactatgtagtgaattttgctgctgaaagccatgtagaccgtagcattgagaatccgcaacttttcttgatgaccaatattctgggaacacanaacctgttggatgccgcacgtcgcgcatgggtaaccggtaaagatgaatacggatatcctacctggcgtaaaggggtacgttatcatcaggtatctaccgatgaggtttacngttcgcttggtgccgaaagctattttcatgaaacgactccactctgtccgcatagcccgtacagtgcatcgaaaaaccatgccgatatggtggtaatggcttatcacgatacctataagatgccggtgactatcactcgctgttcaaacaactacggtccgtatcattttccggagaaactgattccgctgattatcaagaatattcttgaaggtaagaaacttcctgtgtacggagacggtagcaatgtgcgcgactggctgtacgtggaagatcattgcaaggctatcgacctggtagttcgtgaaggtgtggaaggagaagtatacaatgtgggcggacataacgaaaagactaatcttgagattgtaaaattaacaatcgcaacgattcatcgcctgatggcagaacatcccgaatatcgtgaggtgttgaagaaaaaagagaaaaatgccgatggtgaaatttcaatcgactggataaacgaagatttaattacgtttgtcaaggatcgtctggggcatgaccagcgctacgccatcgatccgacaaagatcactaatgccttgggttggtatcccgaaacgaaatttgaagtcggcattgtgaaaacaatcgaatggtatctgaataatcaggaatgggtggaagaagtaaccagtggtgattatcagaaatattacgaacggatgtatagcaaacgttga

SEQ ID NO: 2578 - DNA, 1371 bp, B.fragilis
attgtaaataatctgatggaaacatttttaatccgtgccctgcaattgattatgagcttatctttgctcgtcatcattcacgaaggagggcactttctctttgcccgcctgttcaaagtacgggtagaaaagttttgtttattctttgatccttggttcacactatttaaatttaagccaaagaaaagtgagacagaatatgctgtcggttggttacctttggggggatatgtcaaaatagccggaatgattgacgaatcgatggataccgagcaaatgaagcaaccggaacagccgtgggaatttcgttctaaacctgcgtggcagcgcctgttgattatggtgggaggtgtgttgttcaacttccttttggctctgttcatctattcaatgattctgtttaagtggggagatcaatacattcccgtacagaaggccccattgggtatggactttaatgaaacagccaaagcggtgggatttcaggacggagatattttgttgtctgccgatggagtcgattttgtacgctacgatcccgatatgctcagccagatagctgatgcccgggaggtaacggtgttgcgtgagggtaagaaggcatctgtatatatccctgaagatatgatgcagcgtctgttgggtgacagtgttcgctttgccgaattccgtttcccctatgtagtcgatagtgtgatggtcaattcacctgcagccatggccggtatccagccgggcgacagtatcattgctctcgacggaaagccggtttcttatacagacttcctggcagctatggctgaaagaagacaaaatgcgaaagcgttacaaaatgacagtatcaatccgcaccagatctcattgacttatgtgcgtgacggaaagaccgatgtattgactttgactacggattcagctttcaaaataggagtagcggtcaatccatatacggatcaacttcttcctgtaatcaggaaagagtatggtttctttgaatccttcccggccggtgtagcattaggagtgaagactttgaaaggctatgtaggcaacatgaaatatcttttctcaaaagagggagctaaacaattgggcggtttcggaaccatcggaagcatcttccctgcaacctggaattggcatcagttctggtatatgacggcattcttgtctatcatccttgcttttatgaatattctgcctattcctgcgttggacggcggacacgtcttgttcctgttctatgaaatcattgcccgtcgcaaaccgagtgataaatttatggaatacgcacaaatggcgggtatgattttgttgttcggccttttgatttgggctaacttcaatgatatattgagattcttcttctga

SEQ ID NO: 2579 - DNA, 666 bp, B.fragilis
cagacaaataaacaaaaacaattaaaaaacaacagtaatatgaaacgtatcattatcgctttgatggtagccgtaactttctgttcgctggcaatggcacagaacccaaccatcacccaagacaacaagaactcttccgactccaccatcgtgaccgaatacactgacatagtggatagcagtacggttgacaccgactaccaaagcagcagtttcgacttcggcaatgaatttccgttcaacatagacaaaggggccattaacggaggcatactgacaggattggtagttatcatactgatattcggattccccttctttatcgtattcatcgccttctacttccggtataaaaaccggaaagcaaagtacagactgatggaacaggcactggcaaccggacaacctctgccggaaggtatcttcaaagacactctgccgcaggactaccggacgaaaggtatcaagaacatctgtaccggaatcggactgttcatcttcctctgggccatcacagacgaattcagcataggatgcatcggattgctggtgatgttcaccggaatcggacagtggatcatctcacgcaatcaacagcatgaacggccggaagaccctttcacacgccctacacacaaagacgaaactttgaatgaacaaaaataa

SEQ ID NO: 2580 - DNA, 738 bp, B.fragilis
tctgaaaataatcatgtaaatttgcgtcaatttaataatctgattcttatgtcgtgtatcctacatattgagacttctaccgccgtttgttcggtagcagtaagtgaagacgggcagaatatttttgtgaaagaagaccttaaggggccttcacatgccgtttcgttgggagtatttgtggatgaagcgttgtctttcatcgatagtcatgccattcctttggatgcggtagccgtcagttgtggtcccggatcgtataccgggcttcgcattggcgtttcgatggcaaagggtatttgttacggacgtaatgtcccgttgatcggtatcccgacattggaagtgttgagtgtacctgtgctgctttatcatgaattgccggaagatgcattgctatgtccgatgattgatgcacggcggatggaggtatatgcggctatctatgaccgtgcgttgaatgtgaagcgtgagatttccgccgatatcgtggacgagaattcttatcttgaatatctggaacagcatcctgtctatttctttggaaatggagccgcaaagtgccgtgaaaagattacgcaccccaatgcgcattttatagatgatcttcatccgttggcaaagatgatgttcccgcttgcagaaaagaccgttgcaatcaacgactataaagatgtggcctattttgagcctttctatctgaaagagtttgtggcttcgcaacccaagaagttactttaa

SEQ ID NO: 2581 - DNA, 918 bp, B.fragilis
ctactgcgtaatcattcagttcagccggtttgttctcggcacctgcacgacgaaccacacctgctatctcaaaatcgggagccgcttggagggcttccagcacataacgaccaatattgccataacctacgatggctgctcttacttttttcatctttttattggttttgtttaacacatttctttatttcggttgcaaaattagtcattttctttgttttcaggtctcttaagggtgttaaagttagtttttgttattcaaggttcgtgaagcacaatatttattatctttgcgttctgattataaccattatgatagaatacatcaaaggcgaaattgccgaactgagtccggcaaccgcagttatcgattgtaacggattaggatatgccgttaatatatcactcaacacttattctgccattcagggtaagagcagttgtaaactctatatctacgaagccatccgcgaagatgcttacgttttatatggctttgccgacaagcaggaacgggaacttttcctgctgctgatttccgtttcgggtattggaggaaacacggcccgtatgattctttctgctctttcaccggccgaactggtgaatgtgatcagtaccgaaaatgccaatatgctgaagacggtgaaaggtatcggactgaagaccgcacagcgtgtcattgtcgatttgaaagataaaattaaaaccggtgccatggctgcaactgccgtgggaggtgctgccggtgctttgttgccggcaatgaatgcggaagtacaggaagaggccatcgctgcattgaccatgctcggatttgccgctgcaccttcacagaaggcggtgcttgccatattgaaagaagaacccgatgctccggtggagaaagtcattaagctggctttaaaaagactttga

SEQ ID NO: 2582 - DNA, 933 bp, B.fragilis
tcagtctgcaaaggtacaacttttcgctcttcactttccactcttcactctaaatttgtatttttgccctctataacaaagaacaacaaaatgaagaaactgattgtcctgacatgtacattgtcactactgacagcttgtggtgacagcatcgaaaagaaagcgggtgaaaagcttgccgctgcccgtgcagcctttgagcataacgactacaacgaagccaagttgcagatcgacagtattaaaattctctatcctaaagctttcgacacccgtaaagagggcatcaagttgatgcaacaagtcgaactgaaagagcaacaggaaagcctggtttatctcgacagcatgcttcaggtcaaacagaaagaattcgaagcgatcaagaacaaatatactttcgagaaaaacgaagaataccaaaaaatcggtaactacttctggcctacccagaccgtagagaagaacctgcatcgctctttcctccgttttcaggtgaacgaacagggagtaatgacactgacgtctatctactgcggaccaagcaacatccaccacgtagccgtcaaagtgatagcaccggacggaagttttgccgaaaccccagcctccaacgacagctacgagactaccgatctgggagaaaaaatcgaaaaagccgactacaaaatgggagaagacggcaacgtcctcagtttcctctacatgaaccgcgataagaaaaatatccgtgtcgagtatctcggcgaacggaaattctccactaccatgactccttccgaccgtgaagcactcgtcggtacttacgagttggccaaattactttcatccatacgtcagattcagcaagagaaagaagaagccaacctgaaaatcgaatttgtgaaaagaaaaatggaacagaaagcccaagaagaggctgcggaaaaataa

SEQ ID NO: 2583 - DNA, 609 bp, B.fragilis
catatggcaaagactaaaaccggaatcttcagcggctctttcaacccgatccacatcggacatctggcactggccaactatctgtgcgagtttgaagggctggatgaagtctggtttatggtcaccccgcacaatcctttcaagaatcaggctgatttatggccggacgaactgcgtctgcaactggtacagcttgctattgagggatatccgcgattccgggtatccgatttcgaatttcatctgccccgtccttcttatacgatccatacgctcaatcgcctgaaacaagaatatcccgaaagagaattccagttgattataggatctgacaattggatggtatttgaccgatggttcgaatcggaacgtatcgtctcagaaaataagatactcgtttatccccgtccgggattctctgtagataagtcacagttacccccgaacgtacacgtagcagattctcccatattcgaaatcagttctaccttcatcagagaagccctggctaccggaaaagatatacgttatttccttcatccggctgtatataaaagaattatacaacagaccgacagcattgattcttcccactcctgccatacctga

SEQ ID NO: 2584 - DNA, 441 bp, B.fragilis
atggtaaaaaagataacaataagtaaacgtgaccgggagaagctaaaggagcagaaacgtaaggagaagcaacaacgtaaagaggaacgccaaagtaacggtccgagttcttttgaggatatgattgcatatgtcgaccagttcggtgttttgcattcagtgccgcaggaaaggcttgaggaagaagtggatgcctctcatatcgaggtttctgtacccaaacaagaggatgtggaagtggctccccttatgggacgtatcgagtattttaatgccgcgaaaggctatggctttgtgaaggatgcggattgtggcgaaaagtatttcttccatatctcttctgcccctgcgacaattgcggaaggtgatagagtgacatttgaaatagagcgcggtatgcgtggaatgaacgctgtacgaatatcaatagtgactgaatag

SEQ ID NO: 2585 - DNA, 1317 bp, B.fragilis
tcacctcgaaacatggcttcatttgtaatcgaaggagggcacagacttagtggggaaattcatccccaaggtgccaaaaacgaagtgttgcagattatctgcgctacattgcttactgccgaagaagtaacagtgaataacattccggacatcctggacgtcaataacctgattcagttaatgcgggatatgggcgtgacggttgcaaaaacaggtgtcgattcgtatagttttaaggccgcgaatgtcgatctggcctatttggaaagtgacaacttcctgaagaagtgttccagcctgcggggatctgtgatgctgatcggtcctatggtcgcccgtttcggtaaagccatgatttcaaagccgggaggagacaagatcgggcgtcggcgtctggatacgcattttataggaatccagaatctgggagccgattttacttataatgaagagcgggaaatatacgaaatttcggctgaagaattgaaaggtacatctatgttgctcgatgaagcttctgtgaccggaactgccaatatcgtgatggccgctgtactagccaaaggtaaaacgacgatttataatgcggcctgtgagccctatctgcagcagctttgtaagatgctgaaccggatgggagcgaagatcagtggaattgcttcgaacttattgactatcgaaggagtggaggaacttcacggtaccgatcacactgtgttgccggatatgatcgaggtgggtagcttcattggtatggctgccatgacccgtagcgaaatcacaatcaaaaatgtgtcatacgaaaatctgggtattattcccgaaagtttccgccgtctgggtattaaactcgaacagagaggagatgatatttttgttccggcacaggattgctatcagatcgagtcgtttatcgacggttccatcatgaccattgccgatgctccctggccgggactgactccggacttgttgagcgtcatgctggtagtggctacccaggcaaaaggtagtgtactgattcatcagaagatgttcgagagccgtcttttctttgtcgataaactgattgacatgggcgcacagattattctttgcgatccgcaccgtgcggttgttatcggacataatcatggatttactttgcggggaggcaatatgacctctccggatatccgtgccggtatcgctttgcttattgcggctatgagcgccgaaggtatcagccggattcataacatcgagcagatagaccgcggatatcaaaatatcgaaggtcgactcaacgctatcggtgcaagaattacacgaatatga

SEQ ID NO: 2586 - DNA, 465 bp, B.fragilis
ggaatcatgaacatcttgtacacgtatcccgaaacaatcgttgacggagaaggtatccgctattcgatctatctggcaggatgcaggcacggctgtccgggttgtcataacccggaaagctggaacccgcaagccggtgaggaactgtccgaaggacggttggcttccatcatccgcgaaataaactcgaacccgttgctcgacggagtgactttctccgggggcgatcctttttatgatccggaagcatttttgcctgtcatccggagagtaaaaacagaaacgggacagaatatctggtgctacacaggatatacttacgaggaaatagaatcggatccgaaactggcagccatattgccttacatagatgtactggtggacgggcgcttcaaacaggaactttattcaccgcatctggaattcagaggaagcagtaatcagcggattatcaaactgaaatag

SEQ ID NO: 2587 - DNA, 633 bp, B.fragilis
gatcacatgaatgcaagcaagactgatattcgcattacatcacctgaccgggaggtactttcgtactccggtgtccccaaagaacatccttttgtgaaggaatccccagagctgttttggtatgccgttcgtgtcacttacagccgtgagcttgctttaaaagagtatctcgatggcgaatgtatcgagaattttatccccatgcactacgaatacatcgtcaagaacgagcgccgcgtgcgtaaattggttcctgcggtccacaacctggtgtttatccgttcgagccgtgaacgtatcgatcgtatcaaagacgagatgggcatgacccttccgatccgttatatcatggatcgtgaaagccgccagcccattgttgtccccacttcccagatgcgcagcttcatggcggttgccggcagttacgaccagcaactggtctatctcgaaccctcagccgtagctttccgtaaagggcagcgtgtgcgtgtgacaggaggcatctttgccggcgtcgagggtgagtttatccgtgtgaaaaacgatcggcgtgtgatggtttccatccagggtgtcatggccgttgccaccacctacatccatccctctctaatcgagccgctcgatctttaa

SEQ ID NO: 2588 - DNA, 1425 bp, B.fragilis
ggaaaaatgaaattacctatatcatttatcgaatcgacccgtgcgttgatgggagatgaagagtatcaagaattgtctgttgccttggagcaagaacctcctgccagtgtccggctgaacagtaagtttcccggtttagccgcctgttcatccatctcaggacgtatcccctgggcggcagaaggctattatctgaaccaacgcctgacgtttacgttcgatcccctttttcatgccggatgttattacgtgcaggaagcctcgtcgatgtttgtggaacaggtgctccgccgttacgttacaacccctgtcaagatgctcgatctctgtgccgctcccggtggaaagtcgacccatgcccgcagtgtattgcccgaaggcagtctgctggtagccaatgaggtgattcgcaaccgttcgcagatactggcggagaatctgacgaaatggggatatgccgatgttgtggttaccaataacgatccttctgatttttcccggatcggttcttttttcgatgtcatactgacggatgtgccttgttcgggcgagggaatgttccgtaaagatcccggtgccatagaagagtggagtcccgagaatgtagagatttgctggcagcgccaacgcaggattatcactgacatctggccttgcctgaagccgggaggaatcctgatatacagtacttgtacctataatacgcgcgaggacgaagagaatattgcctggatcaggcaggagttcggtgctgagccgttaccgcttgccgttcccacggagtggaacattaccggtagcttgcttgtcggggtcgatgcacctgtctatcgtttcttgcctcataagactcagggagaaggtttctttctcgccgctcttcgtaagccggaagaagacagggaggcggatacagatcttttttctccgaagaaaaagaaatcgaagggggacactgctgcttcacctgtatctaaagaaaatctggctattgccaaaagttggttggcgtcttccgacgaatataatctattggtgaacggcactgcgattactgcttttccggtgtactaccaaaatgatctggcactgcttcgtcagtctctccgcatcgtccaggccggtacggaagtggctgaagtaaaaggcaaagatctgattcccgcacatggacttgctatgagtcgtctgttgaaaacgtcggttttttcaaccgaagcattgacttacgaacaagccatcgcctatctgcggaaagaggctatcgtccttccgccttctgttcccaaaggttatgtactggtcacttataaagagattcctttgggatttgtgaagaacatcggcaatcgcgccaacaatctttatccgcaggagtggcgtatccgaagcggatatctgcctgatgacatacgaactctgtga

SEQ ID NO: 2589 - DNA, 3099 bp, B.fragilis
cgaaaaaagaatatgctaaataaaatcatacatttctcacttcagaaccgtatcttggtacttgtagcctcggtactgttactgattggcggaacttataccgccatgcataccgaagtagacgtgttccccgacctgaatgcaccgacggtggtcatcatgaccgaagccaacggaatggcagccgaagaggtggaacaactcgtgactttccccgttgaaacagccgtaaacggtgccaccggtgtgcgccgggtacgttcatcttccacgaacggattctctgtcgtatgggtagaattcgactggggaaccgatatatacctcgcccgccagattgtaagcgaaaagctggccatcgtaggtgaagaactgccttcaaatgtaggcaaaccgacactgggtccccaatcctccattctgggcgaagtcctgattatcggattaaccgccgactcgacctccatgctcgacctgcgtaccattgccgactggaccatacgtccgcgcctgctctctaccggaggtgtagcacaggtagctgtattgggaggagagttaaaagaatatcagattcaactcgatccggaacgtatgcgtcattatggcgtatctatgaatgaggtgatgaccgtcacccgcggcatgaacctgaatgccaacggaggtgtactttatgaatatggtaacgaatacattgtgcgtggtgtactctccaccgcaaacatagaacaactgggtaaagcggtagtaaagagtatcgacagcgtacctgtactgctggaggatatcgctgatgtccggatcggaccgaaagcccccaaactgggaacggcttcggaaagagggaaacctgccgtactgatgaccgtcaccaaacagcccgccaccagtactctggagctgaccgacaaactggaagcttcgttgcaagacctccgaaagaatcttccaccggatgtaaaggtatctaccgatatcttccgtcaaagccgtttcatcgacagttccatcagcaatgtaaagaagtccctttttgaaggcggtatctttgtagtcatcgtcttattcctgttccttgccaacgtgcgaaccacgattatttcgctggtgaccctgccgctctcactgctggtatccatcctgactctacatttcatgggactgactatcaataccatgagtctgggaggtatggccatcgccattggttcgctggtagacgatgccattgtcgatgtagaaaacgtatacaagcgcctgcgtgaaaaccgtctcctcccggagaatgaacgtctttcggtcatccaggtggtattcaacgcctccaaagaggtccgtatgcctatcctgaactctacactgatcattgtggtcagtttcgtacctctctttttcctttccggtatggaaggacgcatgctggttccgctaggcattgccttcatcgtagcattatttgcctcgacgatagtggcattgaccctgaccccggtactttgctcctacctgctgggcaaagaaaaaggtgataagcttccgaaagaagcattcgtagcccgctggatgaaaggggtatacgaaaaagcactgacttgggtgttaattcataaacgtctgaccttgggaagcaccatcggactgttcatcattaccctgggattcttcttcacgttgggacgctcgttcctccccccattcaatgaaggttcattcaccatcaacatcagttcgctgccgggcatctcactcgaagagagcgataagatgggacaccgtgccgaggaacttctgctctctatccccgagatacagacagtggcccgcaaaaccggacgtgccgaactggacgagcatgctttgggagtcaacgtctcggaaatagaggcaccgtttgaactgaaagatcgttcgcgcaacgaactgatggcagacgtacgcgaaaaactgggtactatcaccggagcaaacatcgagatcggacaaccgatcagccaccgtatcgatgctatgctcagcggtaccaaagccaatatcgccatcaaactgtttggtgacgacctgaataaaatgttctcactgggcaatcagataaaagaagccatcggcaatatccccggcattgccgacctgaatgtggaacaacagattgaacgcccgcagctcaaaatcactcccaaacgtgaaatgttggctaaatacggcattaccctgccggaattttcggaatacatcaatgtggcactggccggagaggtgatttcgcaggtttacgaacagggtaagagtttcgacctgattgtgaaagtaaagaataacttccgtgacgaagccgaaaagatacgcaacctgatggtcgacacccaagacggtaaaaaagtgcccctgagttatattgccgacgtagcctcgtccatggggccgaataccatcaatcgcgaaaacgtaaaacgtaagatcgtgatttccgccaatgtagccgaccgcgacttgcggagtgtggtcaatgacatccaaaagcaagtggacgaacaaatcaagctccccgaaggttatcatatcgaatatggtggtcagtttgaaagcgaacaggcagccagccgtacattggcactgacctccttcatgtccatcgtagtgatcttcctgctgctgtatcatgaattccgcagcgtgaaggaatcggcagttatcctgataaacctgccgctggcactgatcggcggtgtgtttgccctgctgatcacaaccggcgaaatcagtattccggccatcatcggtttcatttcgttgtttggtatcgctacccgtaacggtatgttgcttatcagccattacaaccacctgcaacaggtagaaggtttgggagtatacgaaagcgtaatccgcggatcactcgaccgtctgaacccgattgttatgacagccctttcgtctgccttggcactgataccgctggcattgagcggaagcctgcccggtaacgagattcagagtccgatggcaaaagtgattctgggcggtctgctcacatcgactttcctgaacggattcattatcccgattgtttacctgatgatgaacggaaaaagaaaataa

SEQ ID NO: 2590 - DNA, 420 bp, B.fragilis
aaagcaaacctattatataaaatggatattgaagaaattaaagattttcgtccccttattcttgtggccgaagatgatgatagcaatttcaaattgattaaagctattatcggtaagaaatgtgacattctgtgggcgaagaacggtgaagaaatgttgaacttataccgtgaacacactcaagatgcacatgctatccttatggatattaaaatgccgattatgaacggattggaagcaacccggattattcgtgaagaaggagcttccctccctattattatgcagactgcttatgctttcagctcagaccgggagaatgccatgcaagccggtgcatccgaagtattggtgaagcccattacggtaagtgcacttcgaggttgtttaagcagctattttccggagatcaagtggtga

SEQ ID NO: 2591 - DNA, 1452 bp, B.fragilis
tatatgaacctgaacccaataataaataatttccaacgcccaatacgaaaagtacaaatctgttgcatattgatattcagttgtgcagcctgttcgctcaatatcccctacgagaatcagtattcagatccggatgccattaccacagtaactgccgcacgcgaactattggcatcagcctatgatgcaattcccaaaccggaattcagtttatccgtattgagcgacgacttccagcctacttttttaataaacttgaatgccgacctgaataacctgtataaatggcatcctaaaccgatggaggacttatcgaactctctgtgggaaaaatattactcagccatagccatagccaatacggtactggagcgcatccattatgtatcccctatttcagacagtgacaagcaagagttgcaatgtatcgttagcgaagcgaaaaccctaaaagcgtattgttacttcaatctgctcagactttttgcccccacctatccggaaggtcccgaaaaagacggaatcatcttaaaagagcggttcgaacttgcttttctaaaacgctcgagcatcagtgaatgtgtgaatgctatccgccaattgctgaccgaagcagttaccgtagacaaccgtccttcacaggtctactggttttcccggcaaagtgcttattatctattggcagccttagaactctatgccgaaaattacgataaagccgaagaatatgccttaaaaatcctgtcttcaaccaatgcatacaatgtcttggcccccgtacattataaaaaactatgggaacaagaaccatgcgaggaatgtattttttctctgcataccaccaattcatattataccgatatgaattacgaaaggaagaaaggagactacttcacgatcaactccacactcacccaattatatactgccaatgacatccgttacgaagcaacggtctatccccaagaaatgcctggtgaaagcatcggcgagaccttaccggtactatatctgggaaaatacaacaaacagaactggaattataagcctatacaatatatcaacaaacttcgtgtatccggcatctgttttattcttgccgaagcctattgtcaagaccagaaaggtcacgatgcattggccctggaagtaataaacaactacctggcccaacgtgaagctcccttgcttgacacatcactttccggcgctcccctattgaaagctatccttcaggaaaagtggaaagagtttgccggtgaaggtgaacgttactttgatttaaagcgctatcggaaaagcctgctttccgattggaatctctctgccacaatgaaaaataaaccaatcaaaccagatgactaccgctggcttttccccattccgaaaggcgaatatctatataacgaaaatatatcacaaaatgcaggatggactaaaatcgaaaaataa

SEQ ID NO: 2592 - DNA, 1290 bp, B.fragilis
ataaagactgaggttttgaaattatacgttttaataatagcgatcattctctctataggcactgcccgaacacagaatattgacagcctgttgatgcagcgggaggacaccacacaattcatccgaagcgactccctcgtgttacaatttctggaatactcgaatatccccataaccgataataataaggtgaaacttatcaaaagcggacgggaaaaatttgaggacttgttcgaagccatccgtggggcaaaacaccacattcatctggaatattttaattttcgcaatgactccatagccaatgcactgttcgacctgctgggcgaaaaagtgaaggaaggtgtcaaagtaagggcgatgttcgatgcattcggtaactggtcgaacaacaaaccactcaagaaaagacatctgaaagcaatccgggagaaaggaatcgaaatcgtaaaattcgatccgttcaagttcccgtatatcaatcatgcggctcaccgcgaccatcggaagattgcagtcatcgacggcaaaataggatataccggcggaatgaatattgccgactattatatcaacggactccccaagataggcacctggcgcgatatgcatatccgcattgaaggcgatgcggtaaacatccttcaagaaatcttcctcgacatctggaataaaaccaccaagcaaaacatcgtgggcgaagaatattttccgaaccacccggagcgggccgacagctgcaatacggtcatttcgattgtagaccgcaccccgaaacggaattcccgcatgttgagccatacgtatgccatgtccatctatgcagcgcaacatgatgtacgcatcgtgaacccgtatttcgtaccgacttcatccatccgcaaggcactcaaaagggctttgaaccgggggacgaaagtggaaattatgatttcttccaaatccgacatccctttcacaccggatgcttcgctctatgccgtacagaaactgatgaaaaaaggggcaatgatctatttgtacaacggcggatttcatcactcgaaaatcatgatggtggacgacctgttctgtaccgtgggtacagccaacctgaacagccgcagcctgcgatatgattacgaaacgaatgcgttcatcttcgacaaggacattacgcagcaactgaatgacgttttcgaagccgacatgctgcactgcacccgcctgaccccggaaatgtggaaacaaaaatcagcctggaagaagtttaagtgctggtttgcgaacttattcacaccattcctgtaa

SEQ ID NO: 2593 - DNA, 1347 bp, B.fragilis
atcgttgatgaaattggcggcaacctgcatcagtccggcgaacaaacagcagatcaatgccggtatccaattgaattttccgtcggcaaaagccaatgcacaacctatcattaccggagtaatggcacctgccagtgttttggggcgggccgcaagtatccatgcctgcaacgagttacgtttcacttcttccattttctttttctatcatccgtttttgagagaacaaagatagggcaaaaaacgtatatttttgcttttttgtctatctttgcgctcctgatattagagaatatgaagaagataatatacctgttggcggcacttttgttgctgctttcctcttgtaaatcgaagaagaatctggtttctccgattcctcgtccggtattgaatgttgattctgtccgtccggatagctccgatgtagtggcccggctgttctcgccggatacctccgaactcaaaaaattctcagtcaagcggaagagagaaaaaacgcatgttgcctctcctgttataacgcgctctgctccttccattgtagcccgggggactcgtattaccagttctgcggtgagcgtatcttccgtttatccgggtatcgaccgggtgaaaaagtacgagttcacccatcgtgatgtgcctgatgcttttgacggtttccgtattgcttttatttcggatttacattataagagtctttttcaaggagaaggtctggagagtctggtacgtttgttgaatgcccagcatgccgatgtactgttgatgggaggtgactaccaggagggatgtcagtacgtgcccgagctctttgcggcgttggctaaagtcaaaactccaatggggacttatggagtgatgggaaataacgattatgaacgttgccatgatgaaattatccgtgagatgcaacgttacggcatgcgacctcttgaacatcagatcgatacgttgagacgtgatggagcacaaattatcttggccggtgtacgcaatccgtttgaccttgccaataacggagtttcgcctactttgtccctttctccgtctgatttcgtaatactattggtacacacacccgattatgccgaggatgtgtcagtcgctaattctgatttggtgctggcagggcatacacatggcgggcaagtccggattttgggatatgctcccattattccttcacactatggcagccgttttctgacaggattgaagtataactcggctaagattccgatgattgtgaccaatggaatcggtacctcaaataagaatatccgtatcggtgcacctgccgagattgtgataattacactgcatcgtctccgaaatgaataa

SEQ ID NO: 2594 - DNA, 1449 bp, B.fragilis
aagatgatagagttgactcaggaggaattgaagcagcatttcagtgagcccattttcggtcagatctcagagacggctgatgcgttgggattggagtgttatgtggtaggcggttatgtccgtgacatttttctgcaacgtccttctaaagatatagatgtagtagtggtggggagtggcattgcgatggccgaagcgttgggaaaacgtttgggacgcggtgcgcatgtctctgtttttaagaatttcggtacggcccaggtgaagtgtcacggtacggaggtggagtttgtaggtgcccggaaggagtcgtatcaacgggattcccgtaaaccgatggtggaggacgggacgttggaagacgatcagaatcgccgggactttacgatcaatgcactggctgtctgcctgaacaaagggcggtttggagaactggtcgatccgttcggcggcatgaatgatttgaaggagaagatcattcgtactcctctcgatccggacataacgttcagtgacgaccccttgcgcatgatgcgctgtatccgttttgctacccagctgaatttttacatcgatgatgatacatttgaatctctttgccgtaacagagaacggattgagatcatttcacgtgaacgcattgccgacgaattgaataagatcatgctttcacctataccttcgaagggttttatcgatctggacaggagcgggctgttggaattgatttttcctgaattagtggctttacagggagtagagacccggaacgggcgtgcccataaggataatttctatcatacgctggaagtgctcgacaatatcagcagagtgacggataacctttggctccgttggagtgctctgttgcatgacattgctaaaccggtgactaaacgttgggagccgaaagcgggatggaccttccataatcataatttcatcggtgaaaagatgattccgaatatcttccggaagatgaagttgccgatgaacgagaagatgaagtatgtacagaagatggtgagcctgcacatgcgtcccattgtgatagcggatgatgtggtgacggattcggctgtacggcgtctgctttttgaagccggagatgatatagacgatctgatgacgctttgtgaagcggatataacctcgaaaaatatggaacgtaaacagcgcttcctgaataattttcaattggtgaggcagaaattgaaagatctggaggaaaaagaccgtgtccgtaacttccagccacctgtgagtggagaagagattatggaggtgttcaatctgggaccttgcaggcaagtgggctcgttaaaaagtgctataaaggacgctattttggacggagtgattcccaatgaatacgaagccgcctatgcatttatgcttcaaaaagccgcaaaaatgggattgaaacccgtacaaaacaaagaggtttag

SEQ ID NO: 2595 - DNA, 618 bp, B.fragilis
catcgagcagatagaccgcggatatcaaaatatcgaaggtcgactcaacgctatcggtgcaagaattacacgaatatgataaaaagagaagatgtatacaagataggcttgttcaataagccacacggcatacacggtgaattgtcgttcacctttaccgacgatattttcgatcgggcggattgtgattatctgatttgccggttagatgatatttttgttcctttctttatagaagagtatcgtttccggtccgattccacagctttggtgaaactcgaaggtgtagacactgccgaacgtgcccgtatgttcaccaacgtggaagtttattttccggtgaaacatgccgaagaagccgctcccggggagttgtcctgggatttctttgtcggattccgggtggaagatgtccgtcacggtgctttgggagaggtgacggatgtggatacgtctaccgttaatacactgtttgttgtggaccgtgatggcgatgaattgctgattcctgcacaagagaaattaattgccggtatcgatcagaagcacaaaatcattacagtcgatttgcccgaaggtctgctgtctttggacgagtgcgatgatgaagaaagttaa

SEQ ID NO: 2596 - DNA, 297 bp, B.fragilis
aatcataaagaacttttttatggaagtgctacaaaaataaacaaaatcggacttcttcggttgggggaggtagtgatatataagtttttttacacattgaaacttgatggggagggagtggaaggtcgtcttcaccacagatttcacagatcgacttccaatgttatcgttgatagtccgtccgataaaccattgatatttgtgcaatctgtggtgatttcgacgcttgtttatttatatctatttcagtttgataatccgctgattactgcttcctctgaattccagatgcggtga

SEQ ID NO: 2597 - DNA, 1215 bp, B.fragilis
acggaaaaagaaaataataagaacttcaataattatatgaaacgaataaccatacttgccgctaccctcttcgcgctatccggactgcaagcgcaaaccagtatagacggggtgctgcgcaacattgaaaccaataataaagagttgcaagccaatgcgcaattgattgcctctcaaaaactggaaacccggacagacaacaatctgcctgatccgactctttcgtatgcccatttgtggaataataaagacaagaataatacgatcggagaacttgtagtctcccagagctttgattttccgagcctgtatgctacccgcagtcaactgaaccggctgaaagccggtgcttttgacgggcagaagagtgtattccgtcagggcatcctgctacaggcaaaagatgtgtgcctggatatcatcatgctgcgaaagcaacagcagatactgaccgaacggctgcgaaacgccgaagagctctcagccatgtacgccaagcgtttgcaaacaggagacgccaatgtaatcgaaaccaataagatcaatctggaattgctgaacgtgaagacagaagcgtcactaaacgaaactgctttacgcaataagattcaggaactgactgcactgaacggaaacataccggtcgtgtttgaagatgctgactatccggctgtcatcttcccttccaactacgaagaactgaaaactgaagtcctggcatcggactataccctccaggcactcaacagcgaaagtgccgctgcccgcaaacagattgcggtcaacaagtcgcaatggctacccaagctggaactgggttaccgtcgtaacacagaatcgggcgagccgttcaacggagttgtagtagggttctcgttcccactattcgagaatcgcaataaagtaaagatagctaaagcccagtcgctcaatgtcgacctgcaaagggctaatacttcggtacaggtagaatcggaactgacccagctctatcgtgaagcccataccttgcgcacttcaatggaagaatacgagaagacttttcaggcgcaacaggacttatccctgctgaaacaagcattgacgggcggacaaatcagtatgatagaatactttgtagaagtatcggtagtctatcagagcaaacagaactatctgcaactggagaatcagtaccagaaggcaatggcaaagatatataagaataaactgtag

SEQ ID NO: 2598 - DNA, 531 bp, B.fragilis
acatcaatggaacacaagaaaacgaagatagtactctatgctgatgtaattatccatttcatggaggctaattatttctcaatattacccgatatatttcctgagtacgaatacttgatattggatgtggtatataatgaaatttcccaaaattccggtacaaaagattttatagataaatatctccatttcttccctaaattgaaaaaagaagttttttccccaaagagggaatcaatgaaagagttctttttattgcaacgcactctgggaaaaggagaaagtgcatgcatgatctattgcagggacaaccgagacgtattgggaagcagtaacctgaaagacataaaagaatattgctccaagaataatattacctatctgactacacttgattttttatattatgcttactgcagaaagaaaatgacagagcaagagtgtaaggaattcatgcaggaagtaaataatgcgggaagcaaacttccgatcatcgatataacccaatatacatgtaccgtacaaatttaa

SEQ ID NO: 2599 - DNA, 903 bp, B.fragilis
aaaatgatacttcaaaccattaaacagatttcatgcctgctctgcctgtgctgtttccttcagcagtcagccttctctcaggatgataaggacaaaccggcctataccctgttcgacaacacaggaaaacaaatcagctacggagaattaatcaaacgactctccggctatgatgttatcttcctcggggaactgcataactgccccatcacccattggctggaattcgaaataacccgttccatctataacattcataaagatcaactgatgctgggagccgaaatgttcgaaagtgacaatcaactgatttttgacgaatacatgcagcaaaagatctcttacgaccgctttgaggccgaagcccgtctatgggataattaccggactgactattatccggttgttttctttgccaaagaacatcacattccgttcattgcaaccaatatcccgagacgctacgccaacattgtaaaaaataaagggttcgaagcactcgactcgttatccgaggaagccaaacgatatatagctcctttaccgatcgatttcgaatatgatgaagcccaaagcgcagcagctttcagtatgatgaacatgatgggaggacgccgggccggcgacaatcggaagttggcacaggcacaagccataaaagatgctacaatgggatggttcatagcccgtaatatcaaaaataaattcctgcatatcaacggtagttatcattccaaccgacagggaggcatcatcccttatctgctccgttaccgccccaatacgagtatagtgacggtaacctcggtacgtcaagagtccatccggaaactggatgacgaccataaaggcttggcagacttttacatctgcgtacccgaagacatggtaaacagttactaa

SEQ ID NO: 2600 - DNA, 318 bp, B.fragilis
tatgtcgtttgtttttgttatctttatgctattgtaaagttccgattatttattaatttaaaattgaaaaacatgaaagatttagaagatgacgagagagagtttcctatccgtgtatatacaaaagtcgagttggctctgctttatgcaccccatttgtctgaaaatgccgccctcaataatctcagccgttggatgcggcacaacaaactcctgatggctgcgctcgaggaggtgggatactataaataccgccattcatttacgcccaaggaagttcgtctgatctttcgatatatgggagaaccgggagcataa

SEQ ID NO: 2601 - DNA, 888 bp, B.fragilis
ctcgtaacttgtaacattcaaaatatgaaaggaattattcttgccggcggtagtgccacccgactctatccgttgtcaaaggccatatcgaagcaaatgatgccggtgtatgacaagccgatgatatactatccgctttctacattgatgcttgccggaatacgggaagtgttggttatttctactcctcgtgatctgccgttgttccgtgaacttctggggagcggtgaagagtttggaatgtccttttcatatctggtgcaggagcagcctaacggacttgcccaggcttttgtgctgggagccgattttctgaatggtgaaccgggctgtttgatattaggagataatttgttttacggacaaggtttctcagctatgcttcgccgggcggctaccattgaaaagggagcttgcatctttggatattatgtgaaggaccctcgcgcctatggcgtcgtggaatttgatggaagtggaaaggttgtttcgttggaagagaaacctgctgtccccaagagcaattatgccgtccccggactttatttctatgatgctacggtgactgaaaaagcgcttgctttggagccttctgcccggggtgaatatgaaataactgatttgaacaagctatatctcgacgaaggaacactgaaagtcgaactctttggccgtggctttgcctggttggatacggggaattgcaacagtttgctcgaagcctctaattttgtggctactatccagaatcgtcagggattttatgtcagttgtattgaagagatagcctggcgtaacggatggatttcttctgctcagttaaaagctttgggcgagaaattggaaaagaccgaatacggtaaatatctgatagacttagcaaattaa

SEQ ID NO: 2602 - DNA, 1188 bp, B.fragilis
aaaatacattgtattctaataatgaacgagataaagaagaaacaaatagctatcttaggctctacgggttctattggtacccaagccttgcaggttatcgaagagcatcccgaactgtacgaggtgtatgcactgactgccaataataaggtagatctcctgatagcccaggcacgtaagtttatgcctgaggctgtagttatagccaatgaagagaaatatgcccaactgaaagaggctctcagcgacctgcctgttaaggtgtatgcaggtgctgccgcgttatgccagattgtagagtccggccctatcgatgtagtcctgaccgctatggtggggtatgcgggattgaagccgaccatgaatgccattcgtgccggaaaagccattgcccttgccaataaagagacactggtagttgccggggagttgattaatcagttagcccggcaataccgtacaccgattcttcctgtcgattccgaacattcggcagtattccagtgtttgaccggagaggtaggcaatccgatagagaaagttatcctgactgcttccggaggtcctttccgtacatgtactatggaacagttgaagactgtgacaaaagtacaggctctcaaacatccgaattgggaaatgggagctaagatcactattgattctgcctcgatgatgaacaaggggttcgaagtgatcgaagccaaatggttgtttggcgtacagcccggccagattgaggtggtggtacatccgcagtcggttattcattcgatggtgcagtttgaggatggagcaataaaggcccagttgggaatgcccgatatgcgtctgcccattcagtatgctttctcttatcccgatcgcatcaattcgtctttcgaccggcttgatttttcgaaatgtacgaaccttacttttgagcaacccgataccaagcggttccgtaatctggcattggcctatgaatcgatgtataggggagggaatatgccttgcatcgtaaatgcggccaacgaggtggttgtggcggcttttcttcgtgatgaaatcagctttctcggcatgagtgatgtgatagaacataccatggggcaggtgtctttcgtacagactcctacttacgacgagtatgtggcaaccgatgcggaagcacgccggattgcccgtgaattaatatgtaaataa

SEQ ID NO: 2603 - DNA, 879 bp, B.fragilis
aatgaatcatgcggaattcatttttgctctgtacgggatgccctacttttgcatcagattcaaaaacaaggaaattatagacataaaatgaaaaagattgaatgtatcattatggactgggcaggaacggcagtcgattacggatgtttcgctccggtggctgctttcatcaaagcttttgccgggaagggactcacgatcgatgtcgagcagactcgtaagcctatggggttgccgaaaattcagcacatccgtgaattgctgactatgcccgaagtaaacgaacaattcataaaccgttatcgacgtgcctggacagaggaggatgtcgtagaactgaaccacctgttcgagaaatatctttttgcttcactgaaagagtataccgatcctattccgggtgtgatccctacgttggagaagttgcgtgccgaaggactgaaaataggttctactacaggctatacccgcgagatgatggatgtggtactgcccgaggcacaggccaaaggataccgggtggattactgtgccactccgaatctgctgcccgccggtcgtcctgctccctatatgatttttgagaatctcacgaaactggcggttcccgatccggatacagtggtgaaggtaggcgacaccattgtcgatattcaggaaggtgtacatgccaaagtatggagtgtgggagtggttctcggaagtaacgagatggcactcaccgaagaagagacgcacgccttgccggctgccgaactcgagaaccgtattgctgaagtgaaacaacgtatgctggctgcgggagcctcgtatgtcattcgaagcattgaagaacttcccgcactgattcaactaattaactcaaaactaaatcattaa

SEQ ID NO: 2604 - DNA, 327 bp, B.fragilis
tctgaggttcgcttctttatctcacggatggactcttcgggcgaaagctgggatacttgcttttttgtcaactataaacgagggcttacacgtccgaaaactgaattagattccatgagtaaaagaaaacttgccacccaatttgaagaagaacctttttcgtatgtgttcggttgccgcaccttcgttatcgaaataccggattctaagattattatggcagaaaattcaaaacagtttcttctaaccaagatgtcttttttatccatttacagcgattatcttaaaattatcccgtatttttgcacaaaacttttggtaatatga

SEQ ID NO: 2605 - DNA, 288 bp, B.fragilis
aaaagaaaccgtatgaaaaaattagttttctgtgctgcttttgtcgcagcaatgtgcatggcaggcactactactgcccaagctcaagacgtaaaaaagaaagaagtcaagaaagagcaatgtgacaaaaaagacagcaaagcatgctgtaaaaaggaaaaaaaagcatgttgcaagaaagaagcagataagaaaacaactgacggatgtaaacacaaagctgattgcaaggctaaagccggatgcaaagacagcaaatgtaccaaagacaaaggaggcaaaaaataa

SEQ ID NO: 2606 - DNA, 1689 bp, B.fragilis
ataaacaagcgtcgaaatcaccacagattgcacaaatatcaatggtttatcggacggactatcaacgataacattggaagtcgatctgtgaaatctgtggtgaagacgaccttccactccctccccatcaagtttcaatgtgtaaaaaaacttatatatcactacctcccccaaccgaagaagtccgattttgtttatttttgtagcacttccataaaaaagttctttatgattctacatacacaaactccggtagttgacgaaacagacggccttcctctcccgcaccgtatatgggcagttgtcggtatttcttttgccttatgcatgtcggtactcgatatcaacattatcaacgtggtactcccgacactttctcacgacttcggaacttctccggcagtcacgacctggattatcaacggctaccagcttgccattgtcatctctttgctttcattctcgtcactgggagaaatttatggataccgcaaaatatttctttcgggaatagctatgttcatcgtcacttccctgatctgcgctttgtcccattcattttggacattgaccattgcccgcattttccagggattcagtgcttcggccattaccagcgtcaacacggctcagttacgtacgatttacccccgaaaacaaatcggccggggaatggggatcaatgccatggtagtggccatatcggcagcagccggcccctcggtagccagcggaattctatttgtcgcttcctggcactggctattcgctatcaacgtccctctcggattagttgccctgactttgggattaaagtacctgccccgaaaagaggaacgttcgaacagaaaattcgacaagctgagtgccatagccaatgcaatcaccttcgggctcctgatttatactttggatggatttgcccaccacgaaaacaatgattatatagtgatacaacttgctgtattggcagttgtcgggacttattatgtgcgcagacagttgaaccaaccgtctcctctccttcccctcgacctgttgggaattcccattttcaggctttccattcttaccagtatctgttcgttcaccgctcaaatgctggcaatggtctctttacccttcttcctgcaaaactctttgggatacagcgaggtcatgaccgggctattgttaactccctggccctatagccacactggtgacagcaccggcagccggatatctggtggaacgcattcatcccggcatactgggcagcatcgggatggcattgttctgtatcggactttactctctgtctacattaacggcggattcatcggtcaccggcatcatcctgcgattgatgctttgtggtgcaggtttcggtcttttccagacaccgaacaacagtacaatcatctcttccgcccctacccgacgttcgggaggagccagcggaatgttgggtatggcacggctcttgggacagacattcggtacgacactggttgctttgctcttcagttttgtagtacacgagaagagtacggcggtctgtctgatagccggcagcggatttgcgtttgtcgcagcagtggtaagcagcatgcggctttcacaaccctccacattaaagacgaagccccgataaccatctcaatccacgtatatcgtcccaccggaagccagagtaacacaaagtga

SEQ ID NO: 2607 - DNA, 714 bp, B.fragilis
acaagtgttagtatgaaatgggaaagtagcttggtggagcatctccaatggtcggacacgatcaccaaccgggagagtaaggagcagttagcccgtatgattgccatgcgtgtgcaagaaggggagattattggggcaggttccggatcgaccgtatatctggcattgctcgctattgccgaaaggatacgtacggagaatctgcatgtcaccgtgatccctgcctcgatggagatatcgatggagtgtgtccgtttaggcattccgcagactactttatggatgtgccgccccgattggacgttcgatggcgccgatgaagtagatcccgatcataacctgatcaaaggtagaggcggagcgttattcaaggagaaacttttgatatgcagcagcaatcgtactttcattttggtggacgaaagcaagcaggtttcttttctgggaagccgttttcctgttcctatcgaagtgtttccgatggctctgccttatgtggagcgggaagtgcttactatgggagctttgcgtacggagttgaggcttgctaaaggtaaagacggtcctgtaattaccgaaaatggaaatctgattctcgatgcctggttcggcaatattcattcgtctctcgagaaagagataaaatcaatcacaggagttgtcgagaatggattgtttatgggatatgatgtcgaggtgatggtagcaaaataa

SEQ ID NO: 2608 - DNA, 2106 bp, B.fragilis
ggtatgaataggatgaaatgtggattttacacttacagaggtattgctttttgttttgtagccgcgatgttctgcggacaaacaatggcacaggttgtagaaaaaaggggattcgactctcagaaaaagattaatgcatttgataacacgactttttgtactgcttatttgtctgacggagccctgtataccatgcgtgatatcgctattaatgatgtacgaaaaattgagcgtatcgtgtttaacccgacgggaagctccatcgctctgttgagggcgaagaatccgataagtatttactcttttcgcgacaggaataagaagcttttcgaactgaaggagaaacgtaagaaattgaaggctaaaccgatgccggtgtcgatgtgctattctgctgacgcccgtagttttattgtgggtaactcgttgggagaaattgtgatttatgatacgaaagaatatatgccgttagcttatattcaaggggaggctccggccactgccctggccatgagttcgaacaattattttatcgccgccgcggcaggacagaatattaatatctggaatttccagacaaaggagttgagaaaagcgattcctatgccggcagtcgttaaagaggtgactttctctccggatgctgcattgctggctgtaactacagatgacaatcacttgaccattatcgatacgaaaaactgggataaggtagatatatttgataagctgggaggaacactcagttctccgtcattccatccagaaggaaaatatatcagtgtggtgaaagatggaaagaatatagagatcatcaacctgaagaatggtgttgtggaacaagatatcgttgatcctataggcgatgttaccggcgggcgtttctttaagaacaaccagaacagcgaggtatttctgctgaccaatcgtacgaaacaaatggtcttctgggatgcaaacggactgaacccgttctatggtaagattatgggtcgggaagtggatgccaagatgaacgaatgggtgaagatgatgcagggggaatcgatggaagactatgcgattcgtgtaaacgatgaaacccgtatcaaacagcaacagctgtttgctcaggaagttgctacggcattggcgggtgaccgtatttctatggataatccttttatagatggttatgatgcttcgaataatatgttgaatatcggttttaagggactgccgtctatcggactggaagttccctccaatgaagcgggcgactttaaagacggtaagatgaaattctcgaatgccgtatatgtgctgaatgataaagatgaatttgagttggcctatgttgaagttaccaacgaaacgacgaacaaggtttatatttatgataatatcggacgtacaaaactgactgctctggaagcagatgaaaactttgttcctctggaaattatgcagcaggctacccgtgaggaagcacaattggccgagatcaaagaacaggtcatcgaggagaaaaaacaagataaactgatcactgataatacgcagatcaatgtgaagacagaggtaatcccgggagtggatgcgaatggtaaaaagattctgaactacaaggtgggttaccaatatgaagtgatcaataaagagttttcggctaaggaagacttcccgtcgggaggttataatatcgaacgttcgaatgcagccatgtcattgatgaagattatcaagaatgcgtttgaaggtgactttgccaaatatctttctgaaggtaagcaggtgaaggtgattattacgggatcggcagacgcagccccgattcgcggacgtctggcttatgacggacgttatggagaatttgtggacgaaccttattataaggatggtaacctcgataatatcacagtcaccaaggccggaggaatcactcagaatgaacagttggccctgatgcgtgcagcaggcgtaaagacttatattgagaagaacgtgacaacattgggtaatacaaagaacgaatacgaatatcatgtggaagtagccaaagagcgtggtggagaattccgcaagatcaacgtagagtttgtaattatggatgcatttcaacaataa

SEQ ID NO: 2609 - DNA, 417 bp, B.fragilis
tctaaattaagaatgaggaataaacggtacatagtctcttttctccttttcatcagcatgatcatgctggtcgtacctgttatcccccatcatcatcatgccgatggcgtgatttgcatgaagaacgacttgacaccggaaccccagtgtcctaaacattatcatcatccgggcaacgattcgtgctgcaatgacggatgtatgacacgcctcaactcaccaaccccttccgtacaggcagacaataatcctcattacctatttactgccatcttatttacggactttatcatagagaatttattcaggccccaggagcgacgtattaagaattattacgcataccgggagtctctccacggtacggctgtcaaccgtgcatttggccttcgtgcccctccataccctgttgtatag

SEQ ID NO: 2610 - DNA, 300 bp, B.fragilis
tgtacaataagaattcccaaaattgcagaaaagaacaatccaatgcactcttttgaacaaacagaagtccaaatacaaaatgtaggtaaactcaaaataataagaagaattttatcatctatcaaatttcttatatctaaaatatcaacagcccattttatcaatccgaaagagagtaacataaaaggaaaattagatacaacattaaatcctcctaaaacacttcccagtattccgcctaaaaacctcattaaatctgtagaagaagtaaatgggaatggaattccagaagtcatataa

SEQ ID NO: 2611 - DNA, 1122 bp, B.fragilis
tgtactaaaagaatgaaatttcaaatatctggttttaaggtaagccgtttttggtttatttattttgttgttcgtcttttttatcttttattttcagtgctggtgtttccaacgttaacgacttttggcgatccgatccattatatgacttctggaattccattcccatttacttcttctacagatttaatgaggtttttaggcggaatactgggaagtgttttaggaggatttaatgttgtatctaattttccttttatgttactctctttcggattgataaaatgggctgttgatattttagatataagaaatttgatagatgataaaattcttcttattattttgagtttacctacattttgtatttggacttctgtttgttcaaaagagtgcattggattgttcttttctgcaattttgggaattcttattgtacattatcttaatggaaactttaaaattcatttcagagattatgtggcattttctttgtgcttattttttaaacctcaatatttaccatttatagtttctactttattttacttgaggtttgcgtttggattacattcacgaagaaggttgattatcttatctgtcttttatgtatctgccattatatttgttttgtatctttctcgtgatttgattgatttatattcgttgggagtacagaaagcttttgagtttgacagtcaattttcaaattctactagagatacattgtttttcgtgaacaaatatgattatttctctaaagcccctatggggatttttattgccttttggggccctacattgactgaagctttacaaaaaccatttcaaatggctgtttatattgaaagctttgttgtcctttgtgtttttatctatttcttaaaaactccacttaaaaaattgattgtaaatggcatagttaatttacgattgattgttagttatagtatattatttcttggaattttattagtgcactatccttttggggtgtttaatgcaggatcggcaacaagatatcgtactaattatcttttcttatttattatattattgatgtatcttttttcctattataggaaaaaaaatgataaagtagatacattattcgggtgctaa

SEQ ID NO: 2612 - DNA, 2868 bp, B.fragilis
tttatgaaaagaaataataaaaacagatatttatacatagcagctatattcatagctgctatgctcccatgtatagcctgcccacagtccactccaatccttcttccgaccggaacggtagagggacgccttcccaacggactgcactatcttatcctgcacaatgcttctccggcatccagagtagagttcaggctgatcatgcgggtaggttccgtacaagaaacagagcaagagaaaggttgtgcccacttcctcgaacacatcactttcggcggtacccgtcattttcctaaacgctctttagtagagtacctcgagtccttaggaatgaagtacggacaagatatcaacgctttcaccggtttcgaccgtacaatctatatgttcgcagttcccaccgattttgccaaagacgaagctctcgatcgttcattactaatcctgcacgattggttggacggtgtcactatagatccggaaaaagtagagaatgaaaaaggaatcattcttgaagaactacgcggattcgacccggaagacgatttctatccgctcaaaatcggacaaggcatattcagtcaccgtatgcctttgggcacaacagacgatatccgcaaggtcaccccgcaggtgctcaaaaattattatcataaatggtatgtgccctctttggcaacattggtcattgtaggcgacatatctcccctggagatcgaatctaaaatcaaagaacgtttcaaatccttgcccggacgtccggtcaatgacttccggaactacccgttagagtacacccagggaattcatctggcctccatacgagactctctgcaaccccgtacaaaggtcgaactaatgattccacacccttgcacagtagagcgtaccatggaagacgccatagcaaaggagaaagggcgcctgctcgtcagtgccatttcttcacgattccgtgcacgaaaactaaagaccgatgttacagaccaatggtatttaagtgacaagaaccattttgttctgacagtggaaggagaaaacagaaaagaaatacttacatctatttctacaaccgtatctctgttgaatgatctgatacgcaacggatggcaagaggacgaattacaagatattaaaaacaatttttgccgccggatgaaattgtccaccgatgccccgtcacgtccttcctccatgtggtgtgacgattttgccgattacgtcatatcgggagaccgctatctgaccgatccatcccaacagcagcaactcaaagaagccatgtcccgtgtctccggccaatctttgcaaacattgctcaaggagtggatgtcttaccgtgaagaaactctattagtagcctgttcaacccatccgggactgggagccccgttatcggaaaccgaaatagcgtcggcatgggcccaaggcgagcaagtcgaatgcactccctttctttatttccgtcctgaaaaacaagaagagatcgacattgagactcctccatgtctggcagcccgttttcctttcgatcctgcatccgtattacgacaaacagaatatccgcaaaacaggattcgtgaagtagaactgaagaacggcatacggttagtcctcaaacctaccctcgaagcagattccaccctgctgatcacttcttttgcccctttcggcacttcttccctatccgatgaagaatatcctttattagagggatttgccggatacatagatatgggagatatcgcaaaagtagatggacaagttttgtccgattacctcttccggaaagaaatctcactttccatggcagtcgaaaatcactggcatggcttcataggcatgtctcccactgcaaatgctcccgagctattcaatctgatttatgaaaagatattcgatcccgaattaaaatatgacgaatttgaggaaatacgccaggaccttttagaaaatcaagacaaagaaacgatattggagaaaatgcttcaacgaagtcctgaccggttattatctgcccgcataaacgagttgaccggaaccggtttcgcccgctcttcccaaaagctttcgtccgaacaaatcaaaaatctgaatctggattccatcgcagctttttataaaaagctctatacgaatccccaaggaaccacctatgtcatttgcggcaatttcaatgcggacactctcatgcagcagtttgtctccgttttcggacgtattcctgtttcgtcacatttgtcccgattttcttatccgcatttcaattttccagtcagaaagcatatagaaggctttcccaatgataatgacactcagacactgttcgactatcttctccccggccactatcaaccgggattaaaaaacacactcactttaaaattgatgcgtgaccttattcgcaaccgtttgatctccgtcctcagagaacaaaaatcccttgtctactctccttacatttcattaatgtatgaaggcatcccacaaggaattttctactttgacatcaatgcatccgccgataacgataacatgcctcaaatagaacagttgctgaaagagattctccaccaattaaaacagcaagaagtggataatgaagaactgaatacccttaaacgttcatttctgatagccaaacgcgaagcgttaaacgaagaatcaccttctgcctggcgagccgccctggtcggtttactaaaaaacggtgaaaccatcagcgacttcgatcactacgaacaatgtctcgacagcatcactcccgccatactccgcgaagcattccgtcgctatctggataccgagaattatatccttttatatttaagcaaaaacaaactgaaaaatgatacttcaaaccattaa

SEQ ID NO: 2613 - DNA, 2163 bp, B.fragilis
aagatgaaaagcattagtattaccacttacaggggtttcagcaaagtgaaagggaaatgttcactgcaggaattgatcggatgggtacggagcagacaatacgccaacctgatagagaaaataggaaggctggtcagtgaaggaaaaaccaaggaggcggagaatgtgaagcggcaactggactacttcaccgtcacggcaaactatcatgaatgcaggctggcgcacagcatagcagcatacaacgacaccagcaccatcgacatcgacaagctgcgggaagaggaactggaacgcatacgggctctgatagaagccgacgaagcgacgctcgcctgtttcctcaccgccaagcagcacggtttcaaaattctggcttacctgacagaccttgaggcggaggcgtggagaaactcgttcttcaagacagcaaccatcacctacgacagactggaacagtatcacgcaggcatctacgaactgacccggaaacactacgagaaactgctgcaaacagaggtggacaccagcggaaaagacttgtcgagaggtgtcttcgcctcgtatgacccgaaggcgttttactctgccgaaagggtggcacgcatccccgaacggacactcaccatcgaagctcccgaacctgcacaaaggggaaggaagaaaaagaaagaacccgaaacgggacagacgggagatatcagcgcctatacgtgtatggaattcaacaaatgcctctgctccacgcaaaggctgatgaaatatacggaaggaagccgcaattcgttcctcttcaccctgggaaacaaatgtttccgaaaagggctcgaagagtcggaagtgaagcgcctggcggcggaaaggctgggagacggaggagggatggacacggacacacccatcggaaacgcctacacatataccgacaggacggaacgggcagaggagaagaaaaagataccactcgtggaacaggtgatagattatctgaacaagaattatgctttcaggcgaaacacggtgctcgaccgcctcgagatgtgcgacttatcccaaacggaagagaaatctttctatgccatgcggaacaaggatttcaactccatcttcctgaacatcagcagacagggcatagcttatccgctcaacagcctgaaatcggtcatcgactcggactattcaccggagttcaaccccttcacgcactacttcgaaggaaatgcccggtgggacaggaagactgaccacatcagaaaactggcggacaccatacaggcggaagatcaggagttctggagggagggattccggcggtggatcgtggccatggtggcctcggccctccgaccgggcaaagcaaaccaagaagcactggtgttgcacggagcacagggaaaaggaaaaagtacctggataaggcatctgctacctccggaactggcagaatattaccgaaacggaatgatagatccggcaaacaaggacgacctcttactgctgtccacccgcctgctgatcaacatggaagagtttgagggtgtgaaaacgggggacatcgccgaactaaaacgaatcatcgggcaagaaaacgtcaccatccggaaagtatatgacacccaggcacaactgtatccacgcagggcatcgttcatcggaagcaccaacaacatgcagttcctcaaggattacggaggaaaccggcgcttcctggtcattcctgtaaagaccatcgactaccgcaccccggtagaccacaaaggggtgtacgcgcaggcggtgcaactgatagaggacggtttccgctattggtttgaaggaaacgagatagacgacatcaacacccgaaacgaacgccaccgcatgaaagacccactggaagagaacctgtatgtttacttccgtccggcaggagaaaaggactttgaggtgaaatggaaacccgccgccgcaatactggctactctatctgtatacggacggacacaggccaacgcgcaaacgcaacaagtgttggtacagattctggaaagggatgccttcggcaagcgtgtaaacatccatggcatcacggagtatgccgtagtggaactcacacaacaggaggtgagcgaaaacttcaggaaaagggataagggaaaggaaatggatgaactcccgttttaa

SEQ ID NO: 2614 - DNA, 2766 bp, B.fragilis
acaatgaagagattttttttactgacaatcattcttactgttgttgtaacaggtaaagtgggggcacaagaagctgcctccgcttcaaaacgtgccaaccaacagtatgtgctttttgaaagtgagcgggataagggaacgaacgtaacggccatgtatgattatttgatggatagttacgaaaatttcatgaaggttgtagaggcaccggataacagtcagtatattggaggcgccaagaatcgactgagagcgttgtatccttatctgctgaacggggcagtgtactattcggaacagaaacaaccgtccaaagcattggattttgctgctgcttatatcgatatgccgcagctgaaactgttccgtagtgaattgttgccgaaagataaccgatatgcttcggtggtgtattacgcagctgtagcggccttcaatctggagaagaacgaaaaagctttgagatattttcaggaatatctcaataccggtacggaggcccagcagaaagactgctatgtttatatgaatatgatttatcagaagcagaagaagtatgcggaccaagaacgtgtgctggaacaggctattgccaagtatcccgtttcgcttgatttcctatacaatctggtgaatgtgcatattgctaccaataatatggagaagctgattggagcaatagaccgtattctggctgtcgacccgaataatgataaagtgttgcctatcaaggcacgcatcctggagcgtcagggaaagaatgtggaggcattggatatttataaacgtctttatgcactgcaccctgagagttttgaattgatgacgggagtggcacgtgccaactttaactgtgctacggagattgtgaacaatggtgccactattgccaacgatacggaatatgctttggtacgtcaacgtgcatcgggttatctgatggatgccaaagacctcttcctgaaaattttgcagaaagatccttcttccaaaatgtatatgcagggactggccggggtgtatcagtatatggatatgaaaccggaatatgaggtgctgaacaaaatcgttcaggatggggcttcttataccgcctttccgtctcgtcttgcggcctataaagaggcattgaaaaaaacggagaatgtggctcaagagcaacaagcggttcccgtgcctattgaaccggctatgctggttatcaaagtagaccagtttacggatgctaataacaataaggtgatcgatgccggcgaaagttttgctatacggttcaccatagagaatcagggtaagggagatgcctacaatgtacggcttcgcctggctgaacagcagggctatgatcagtattttgacggccctcgtgaactggacggtggtaatattgctgccgggaagtctaaggaatacactttccgttatatagccaagaaggagttgccgacaagtctggccaagattaatatttatgcgttcgaggcgaatggatttgatgcggatccttccgagctgattgtgaacactcaggaatatgcaatgcctcgtctgcgtgttgccgatcaccaattcttcgcttccgagggttcttccatcactttgggtaagaacggtaagctgactgttgccttacagaatttcggtacgcagactgcacgcaaggtgaaagtgaactttactttgccgaagaatgtatatacgactgatacgccggaaattattgtcgatagcattgccccgggagatgtagctatactcgactatggttttttggtgaataaacgttttgatggagattcgattgcagttatgctggctgtcacggaatctactcgttcggcttctctgaatgaagcttataaggtgaaagtcggagagtacctgagtgcttccgcttcgatgaacctgagtggaaatgtagctgcacgtaaagtgaatgtgaaagacttctcactcggctttaagagtgaactgatggaggatgtgcctgtgggagctgtcaatcgccatcggtatgcattgattatcggtaacgaggattatagcatgacaggggctaatgcggaaataaatgtaccttatgcggtcaatgacgctgtgttgttccgtgagtattgcgtgcgtacttttggggtgcccgacggacaaatcaaggtagtgccgaatgccacagccggtatgatgcacgagcaactcgactggctggtgaatatggcaagtacggatccgcaggcggaattgatattctactattcaggacatggaaataacgacgaggctaccaaagaaccttatttgttgccggtagatattaccggtaagaatattcgtttgggtatctcgttgagtgacttgtataaaaaactggctacatatccggtgaaaggggcttatgtattcctcgatgcttgctttagcggtggttataagagtgctgctccgttattggcacagaaaggggtgcgtgtggtaccaaaggtgggtttaccacaaggaaacacattgagcttctcgtccagtagcggtgaccagacttcaagcgtttatcatgaaaagaaacagggatattatacttacttcctgattaagaccattcgggacgcaaaagggaatatctccatgaaagaactgtttgacagaaccagtgctgccgtgaaacgtgcaaccgcattgatcgataagattcaggaacctcaatgtatggcttctcctacgtggataggctgggaagatataaaactggaaactccggttgtgacgccttag

SEQ ID NO: 2615 - DNA, 2103 bp, B.fragilis
ctatatttgggcaaaccttacgtgcaaatggaaaacaaataccaatacttcaagagagatattagttggctatcattcaactaccgggtacttctggaagctgacgacgaccggctcccactctacgaacgtatcaattttatctctatttattcctccaacctggaagagttctacaaaatcagagtagccgaccacaaagctgtagcctccggcgtaacagatggaacggaagaatccctgcaatcggccaaggacctgctggaagaaatcaaccgggaagtgaaccgacaattggaggatcgtatccacatctatgaaaaaaagatcatacctgcattacgcaaaaatcacgttgtcttctatcaaagccgcaatgtagagcctttccaccaacaattcgtaaaagactttttccgggaagagatattcccttacctacaaccggtaccggtatccaaagacaaagtaatctcttttctgcgcgacaaccggctctacctggcagttcgcctgttcctgaaaggtacaaacaaagaagatgctgatcatctgcaatattttgtgatgaaactaccctacagtaaagtgccccgctttatcgaattacccaagcatggcagagagtattatctgatgtttatcgaagatattatcaaagcgaacatagacgtcattttccccggatacgaagtagattgcagttattgtatcaagatatcgagagatgccgatattatgatagacgacacgatcaacagtgtcgacctggtggaacaagtaaagaaaaaaatcaaaaagcgcaagataggtgccgtatgccgtttcgtctatgaccgcgccatgcccgatgattttctgaacttcctggtagacgctttccgaatccggcacgaagagttggtaccgggagacaaacaccttaacctggaagatctgcgtcacttgccgaaccccaatcattccattccccggattgagagaccgatcccaatgaaactgaatcgactgaacgacaaggaatccattttcagttatgttgaaaagaaagatttattgttatactatccttaccattctttcgaccactttatccacttcctttacgaagcagtgcacaatcccgaaacccgtgaaatcatggtaacccaatatcgggtagcagaaaactcggctgtcatcaacaccttgattgctgctgcacaaaacggtaaaaaagtcacggtattcgtggaactcaaagcccgtttcgatgaagagaacaacctcgccactgccgaaatgatgaaagcggccggtatcaacattatctatagtataccggggctgaaggtacatgccaaagtagctctgatacgccgtcgcagcttcaacggtgaaaagattcacagttacgcttatatcagtaccggcaacttcaacgagaagacggctacactgtatgcagactgcggactgtttaccagcaatccggtcatcgtacatgacctcacaaacctgttccgtaccctcagaggcaaagagaatcctcgattcacccggttgcttgtggcacgtttcaacctgattcccgaactgaacaggctgatcgacaaagaaatagaactggccgaaaaaggaagagggcggagaatcatcttgaagatgaacgccctgcaagacccgataatgatagaccggctctacgaggcctcacaaaaaggtgtaaaaatagatctgatcgtacgaggcatttgttgcctgatacccggacaagaatatagttgtaacatacgtgtcacccgtattgtggacagttttctggaacatgcccgcatctggtatttcggtaatgccggacatcccaaagtatatatgggttcaccggactggatgcgtcgtaacttatatcgacgaatcgaagcggtggtacccattctcgataatgaattacgggaagaaatcgtcgatatgcttcatatccagttatcggacaatcaaaaggcttgcttcgtcgatgataaactgaataatatatttaaattcaaaacaaatgccgcgcccgtcagagcgcagtataccttctataattacctaaaagagaagaatgaaacatttctgtaa

SEQ ID NO: 2616 - DNA, 363 bp, B.fragilis
  unsure (11): Identity of nucleotide sequences at the above locations are unknown.
aataaacattnttggacatccacattatatattgtcgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 2617 - DNA, 1134 bp, B.fragilis
cttccagttatcataccggatattttaaattcgtgcccgttccgtgacggagcggctgacagacacaaacttaattctcaaaataaaacacaaatgattagaacaatgattgcgtcatgcttgttggcatgcagcgggttcgtatccgcacaaatgacgggtggaaatcccgaagaggtgaaacaaactgctccggctcctctttacagagatcctgtttatgacggagtggccgatccggtcgtagtctggaataaagaagaccgcagttggtggatgctgtatacacagcgccgggccaatgtgaatgccgggaacgtagcttattgctatggaaatgatatcggtatcgcttccagccgtgaccatggcaggacgtgggtttatcgtggagtactcgacctcaatatggagagaggaaagaacactttctgggctccggaggtggtaaacttcaatggggtatatcatttgttcgtatcttatatcgagggggtacgaaccgattggggcggacatgcgcgcatggctcactatacaagtaagaacatgtgggactggaaatttgaaggctttgtgaagctgtcatccgataaaacgatcgatgcgactttcttccggatgcccgatggaaaatggcgtgcctggtataaagatgaaacccgtaatgcggctatcatgacggcagaaagtgatgatctgttccactggacgctgaatgatacaccggtgattgaccagagtcgccaggaagggcctaaggtattccgtttcggaggttattactggatgcttaccgacgaatggcacggcatgcgtgtgtatcgttcaaaagatgccactacatgggagaagcagggagtgattctagataaacccggtacccgtcccgaagatacgccgagcggtgcgcatggtgatgtggttgtggtaggagataaggcttatgttatctattttacccatcccgggcgtaaggcacattccgaagagaccaaagatgaagacggtaacatcccttatcatttgcgccgttcgtcggcacaggtggcagaattgttgataaaggacgggcagttggtggcagaccgttcgcctgagtttaatttctatttgcccgatatggaggaataa

SEQ ID NO: 2618 - DNA, 1203 bp, B.fragilis
atgaaaactataatgaaaaagctgtttatctacgcagtaggcatctgcctactgcctgccttcacgtcatgcaaagacgatagagaagaaaataaatatacaggaatcaacaaaatctacctgtctgccgaaaccccggttattaccgagtccgaaaacattccattaacagtaaatgtagatttaacattgacctgtgaacaggacctcgtactcaactttgaattgcccgatgataaaaacggagttctaaaattagagaacaatcccgtcacgattaaagccggaaaacgttctgcaacattcgaagtagtttccaaccaaaagaatttattaaccgaagatacatactttcaagtcggaatttctcaattccctaccgataatttaatgttaaacgaaacattgcaggtacgtgtcaagcccaaccctaaaattccggaattgtcccctcagcaaaaagcgttaatcaaaggttataagaccaaatacggcattgacctgaataaatggctcggagtcctctcttgccataccactgtgcaaagccctgcagatgggtatctccaaccctttgcagcagcatttacgaaagaatatgatggcaagaccgtcatcactctcagtgagcaggccacagaagacatgccggtattaaaaatgacagacaatccattcggactgaccgaatatttatactttgtactccgttccgagaccgtagcagatccggaattctggactcaacagccggaaccgcaaaaactgatgaaactactcaactggaataaagaaagtaaagagacatttgccgtatcattggatgcaatcagactcaaagacatcacttccacttcaacccggctggaatatctgggtccgggaaaaaactattatggagatcctattaccatcgttccatttacctaccaattcagtgctttagaccgtcaaaacaagctcttggaaagtggaaacgcagaaattaaagagatcaatgaccagggagcttccgcagatccggcttactacctcaactgctacgatcttgtcaattccgacaactatgacacccccgaaaactttatcaaatccaccggaaacatagactttgccacagataaaatgacttatcaatttctcctgagccatgtcaacgccggaggatatacacgcataaccgtagtttatgaaaagaaataa

SEQ ID NO: 2619 - DNA, 1254 bp, B.fragilis
agaatttatatcatcatgaagaaacttatctttatgggaatcctcggattgtttatcctgggttcctgcaacagtaaatcgggtggcaaccacgaaggccacgaccatggaacagaagcacacgaccatgaacacgaagggcacgaccatgaacacgaaggcgaagaccatgaaggacatgatcacgaaggtgacgaacacagccggagcagtgaaccggctaccggtcacagtgacgaaatcattctgccgaaagccaaagcagaagcagccggagtgaaaacaagtattatagaaccggaagtatttgaacaagtgataaaaacaagcggacaagtactggccgcacaaggtgacgaatccgtagcagtagccaccgtagcaggagtagtcagctttcgcggtaaagtgaccgaaggcatgagtgtaggcaaaggtactgcactggtgaccatttcatccagtaacattgccgatggtgatcccgtacaacgcgcccgtatcgcttacgatatatccagaaaggaatatgaacgtatgcaagcgctggtaaagaacaaaatcgtatccgacaaggaattcgcacaagccgaacagaattacgaaaatgcccggatcagctatgaggcccttgccaagaatcattcggcaggaggacaggccgtaacctctcccatctcaggatttgtaaaaaacatcctggtgaaagaaggtgattacgtaaccatcggccagccattggtcagcatcactcaaaaccgtcgcctcttcttgcgtgccgaagtttcggaaaaatactatccgtctctgcgcaccatcggttcggccaatttcaaaactccttatgacaataaggtatacgaactgaaagaactgaacggccgtcttttgtcattcggtaaatcggcaggagaaaattcgttctatgtaccggtcactttcgaatttgataataaaggagacattatcccgggctcgttcgttgaagtatatttgttgtcgtctcccatggagaacgtactgtcgcttccccgcacggcgctgaccgaagaacaggggcttttcttcgcatacctgcaactggatgaagaagggtataaaaagcaggaagtcaccctcggagccgacaacggcaagagcgtacaggtactttcgggtatcaaggccggtgaccgggtagtgacccaaggggcctaccaggtgaaactggcttcggcaagtaacgcaatacctgcacacagccacgaacactaa

SEQ ID NO: 2620 - DNA, 3060 bp, B.fragilis
aacgctaatatgaaagcagtaatcatttctttttttatcaccctttccacccttactagtcatgctcagcaaagagatattgtattgacaggaacagttacggatcatcaaaacgaaccgcttcccggcgccaccatccgcattaagggtacccaattcggtacagtaacagataccgacgggcactatctgttacgtggcaaatggaaagaaaacgatctaattcttttctctttcataggaatgaaagagatacgtgtgaaatataccggtcagaaggtacaagatgcagctatgcaagaagatcccaaagcactggacgaagtaatcatcgttgcccggcagaatatcaatgaattggatattcgtgccaaatccggtgttgtacaacgggtcgacgtagaacgtctcaacagtaaacccatgatcgatatgtccctcgctctacaaggaaccgttcccgggctgatcattaccaacaccggcgacctgggctccaaaccggaaattcgtattcgaggcaattcatctttccgtaaaggagatatggctaacgaacccctctacgtcatggatggcaaagtaatatcatctgatgccttcatgactcttaatcccgccgatattcaggaaataaaggttctgaaagatgccgtggcttgtgccttatacggaataaaagcagccaatggtgtaatagaaatcacctcccagcgtggcaatcccgacggaagactaaccaccagttacagtttcaatataggtatcaccacccgtggacgcagaggagtcaagatgatggatagcgaagaaaagttagaattagaaagacgtttacagaatatatcgactccgggatatcgatacagtgaagattactatcggaaatattatgctaccgcccccaacctcgacgagctgatcgcagaaggacaacaagtactcgactcattaaagaatatccataccgactggtttgatgaactgatacatcgcagcatctaccagcgccataaccttagcataaaaggaggaacagataagacatcttattatatatccaccaattatgccaagcagggaggacgagtaccgggtaatgacactcaacgtttcaccgcccgtatgagcctcgatcagaaactgggaaactggggatatttttccttaagcaccgatgcaggttattcggcaaccgatactcccaacggcagcacccattcccctacagatctgatttatcaacttaatccttatgaaaccaaaaccggtaaattaatctcctactccgaaaaatcatccgaatatacattaaatgatttgatgagccaataccatagtaaatctaccgataagcgtggcggagtaagcggaagtttcaacttaaggccactcgaaggtttggagatagatgtagtaaccggcatcgatttccttctgaacgaagcccttacgcttgttccttccacgtctatagcagagcgggaaatgggaatagcgatagccgaacgtggaaaattaacaaaagaaaaaaatacaacgaccaatatttcctccaatatacgtatcacttacaacaagacattcgccggaagacacgacctgacaatcggtggaaacatggactactatctgacccagacagacaacatgtctgccaccggatacggagtagggacacaaatgtcactaaacgcaatcaaccactccatcaccggagcccggaagccgacagccagttcgcttctggacaaaacggctcagttaggattcgggatagtcatgggctacagttttgattccacctatgacctttttgctacttacaaagccgatgcttcttctgttctccctccggacaagcgctggaatgcagcatgggcagtaggcttggggtggaccctcagccgataccctttcctgaaaaacaataaggtcatcactctcctgaacctgaaaggttcccatggacgtatggcaaacctatccggagtatctgcctccgccacaatcggcaccttcagctactccaccaattattacggaaatgcccgtctgctacagttactcggattttataataccgatctgaaaccggaacagacttccacaacagacttcagtctatccatcgaattcttcaaacggctgacattaggtctcaatctataccgccgcgaaacgagtgatgcactgctggacgtccccatccccctttccaacggtttcaataccatgaaacgtaacatcggtgtattacgcaatgaaggctacgagctgaccgccgcactaaaagtgctcgatacaccggactggcgtgtatctttacgcggttcactggcctacaaccgtaataaggtaatcagcctgtactataccgaccgtttatacaccagcgaaaccgccctgactcccgactatgaagtcggaaaagcttataacatgctttatgggctgaagtcattaggcataaaccctatcaccggtcttccggtatttcaaggagccgatggaagtgaaattcccccgacacaaaatccggccagagaaaacttcatcgttttaggacatagcactcctccctatagcggtacattcaacctgaatttctcctatcggaatttcgatttggatatggacttttactatgtgttcggcggcattaaaccctacaattattcttatgtccgttcagccgacagtgccaataagaatgccattcaaaagcaattagaaaacatgtggttccaccgaggagatgaaggaaaaatataccattctccattttacatatctcctgccaatgcttcactccaacagcccaatacagaaaccgtcgggaaaagcgattatctgaaattggccatgttgtcgctacgctaccgggttccacacacctttctggagaaaaattgtcatttcataaaatatgccaatatcgcctttcaggcatccaacctttttatgattactccttataaagagtccgatcccgaaacaggttcattggccggagctatgcagcccgtattaaccatcaatcttagtttgaccttctaa

SEQ ID NO: 2621 - DNA, 501 bp, B.fragilis
attgtaaatatttccatgaactctttagattctcaaattaccgctttgtacaccttggcgcacgaacttctttatctcggttccgatggcagccccatctacagcgaccacttcagccggttgaacggtgatgtactcagtcgtgccaatactttatatccccatcatggctccaccgacgaggaagaagcccgtttgtgcctttcgcttctgatgggttataacgcgacgatctacaataacggtgacaaggaagtccgcatccagcagatcctgaaccgttgttgggaagtgctcgaccgcttgcccgcttccttgctgaaggtgcgccttctgacttattgctatggtgaagtctttgacgacgacctctcccgtgaggcgcatagcatcatcgacagctggggagagcgtgccctttccggcgatgaatgtgagattgccgaacaactccgcagtcttgaagagaatccttatcccaactgggaagtagaggagtaa

SEQ ID NO: 2622 - DNA, 318 bp, B.fragilis
aaaaagaatattatgaagctaaaggaaataagtaaagacatctacgatgtagatgcgtggctggacgaagaacttggcaaggagggaactcctgaacgcgaagcgtctattgaaaaggcatgggaagaatataacgggcagatattgctggatgcccgcaaaaatgcacgtttgacacaggaagagcttgccaacagaattggtgcggacaaatcttacatctcaaaaatagaaaggggattgattactcctaccgtttctacgctttaccgcattgcggccgctatgggtttgtcggtagagttgcgcccactttaa

SEQ ID NO: 2623 - DNA, 540 bp, B.fragilis
aatactgatatgaatatatttggtacgtatgcttatgcatattttaaatatctattacttaaagatatggatgtattgatttcttttttcaggaaaaagggaatctgtataggtgaaaactgttttatttattctgctatatgtactcctgaaccgtatttgataataataaaaaacaatgtcactatatctgtcggagttcagttaataacacatgataatagtgtttgtaaagtcttgccaaatagaacagatgcttttggtagaatagtcattgggaataatagttttattggtgctggttcaataatacttccaggagttacaattggggataattgtattgttgcagctggaagtattgtaacaaagagtttaggtgataatgttgttattggaggaaatccagctaaaataatatcgacaatagatgagtataaagataaaatctctgataaaagttttaatgtaaatgggatgacatttgttcaaaagcgaaatcatatattatcttctttggataaattaatacagaaataa

SEQ ID NO: 2624 - DNA, 1644 bp, B.fragilis
agaagcgatatgatttcagtagacggactggccgtggaattcggcggaaccacattatttagcgatatttcatttgtaattaacgaaaaagaccgcatcgcgcttatgggaaagaacggtgcaggtaagagtaccctactcaagattctggcaggcgtacgtcagcctacccgtggcaggatatctgctcccaaagagtgcgtcatagcctatctgccccaacatttgatgacagaagacgggcgaacggtttttgaggagactgcccaggcctttgcccatctgcacgaaatggaagctgagatagaacgcatgaacaaagagctggagacacgcacagactatgagagcgacagctacatggaactgatagagaacgtgtcgactctcagcgaaaagttttatgccatcgacgccaccaactacgaagaggacgtagaaaaggcacttctcggattaggcttcatgcgcgaagatttccaccgccagaccagtgacttcagcggtggatggcggatgcgtatcgagctggctaaacttttattgcaaaagccggatgtgcttttattggatgaaccgaccaaccacctggacatcgagtctattcaatggttggaagacttcctgatcaataacggaaaggcagtaatcgtcatcagtcacgaccgcaaattcgtagataacatcactacccgtaccatcgaggtgactatgggacgcatttacgattacaaagtgaactactccaaatatctggaattacgcaaagaacgtcgtgaacagcaacagaaagcctacgaagaacagcagaaattcattgctgaaaccaaagatttcatcgaacgtttcaaaggtacctattcaaaaacactccaagtgcaaagccgggtaaagatgctcgaaaaactggaaatactggaagtggacgaagaagacacatcggcattgcgtctgaagttcccgccttcaccccgttcgggcaactatcccgtcattatggatggtgtaggcaagagctatggtgataaagttgtcttccgcaacgccactctgacagtagaacgcggtgataaggtggcatttgtcggcaaaaacggtgaaggtaaatcgacactggtgaaatgcatcatgaacgaaatagagcatgatggaacactgactttagggcacaacgtacagataggatactttgcccagaatcaggcatcgcttctggatgaaaacctgactgtattccagacaatcgatgatgtagccaaaggcgaaatacgtaataaaatacgcgacctgctgggagcgttcatgtttggcggaccggaagagtcgatgaaaaaagtaaaagtactctcgggaggtgaacgtacccgcctggccatgatcaaactgttgctggaacctgtgaatctgctgattcttgacgaaccgaccaatcaccttgacctgaaaaccaaagatatcctgaaacaggcattgaaagatttcgacggtacactgatcgtagtatcacacgaccgtgacttcctggacggactggtgaccaaggtatacgaattcggaaaccaaaaggtgaccgaacatttatgcggtatctatgaattccttgataaaaagaaaatggattcgttacgtgaattggagaaatga

SEQ ID NO: 2625 - DNA, 1422 bp, B.fragilis
cattattgtattattcacatagggcataaacagaatattcaccgcactaaacgcacaagaaatcagcaagatcgttatcatcgcctttcttggtgtgaaacccattgccaggaacttatgatgaatatggttcttgtccggttcgaaagggctcttgccactgcgaacacgaaccatcaccacacggatcacatcgaatgcagggacaatcagcgtactgaaagcaatcacgaaagcaccttcggtatacggggtgacatccagattgtactggctgtatttgatggcaaggaaagagagcacatagcccaaagtcaggctgcccgtatcacccataaaaatcttacgggcacgttccgcactgccgaagacgttatagtaaaagaaagggaccagcacaccgaacgtggcaaaggcgagcatgctgtacgtccaaagttctttctgcatgaacaggaagccgaagacaagcagggcaacgctgctcagaccggaggcaagaccgtcgataccgtcaatcagattgatggcattggtgacaaagacaaccagaagaaccgtaaaaggcatacctatccaggcaggaagggcatacaggccgaaaagaccgtagaagttattgatccaaaggccggccaggggaaaaaacgaagcacagatgatctggatcacaaatttctgacggtagcgcactccgacaaggtcatcggcaatacccgtcaggtagagcaaagtcatcccgcagaccagaaacaagcactcgggcaacaagtacaccgcacggagggcgggaacatcataacccatcaggatgcgaagggcgaacacgccacaggaggaaagcaggatggtggggaagaaagagacaccgcccaaacggggaatggcacgtttatgaaccttgcgctcactcggcatatcgaaaagcttcttccgcaaagagataagcaggatgcggggaatgataagccgggcaaccgaagcagagatgacaaaagccaatatgatgaaaaggatattcaagacaaaggggatttaggttatatacagtgttgtgtcgaaaaagaaaagagtttactcctctacttcccagttgggataaggattctcttcaagactgcggagttgttcggcaatctcacattcatcgccggaaagggcacgctctccccagctgtcgatgatgctatgcgcctcacgggagaggtcgtcgtcaaagacttcaccatagcaataagtcagaaggcgcaccttcagcaaggaagcgggcaagcggtcgagcacttcccaacaacggttcaggatctgctggatgcggacttccttgtcaccgttattgtagatcgtcgcgttataacccatcagaagcgaaaggcacaaacgggcttcttcctcgtcggtggagccatgatggggatataa

SEQ ID NO: 2626 - DNA, 570 bp, B.fragilis
agtattggtatttgttttccatttgcacgtaaggtttgcccaaatatagttacctttgcagagataaacaaagaaagtatgacaaaagttggcttattgtccgacacacacagttggtgggacgaaaaatatttgcaatatttcgaaacttgtgatgaaatctggcatgccggagatattggttcagtggaggtggcacagaagttggcagctttccgtcctttccgtgctgtgtacggtaatattgatggtcaggaaattcgccggatgtttcctcaagtgaatcgttttacggtggacggtgctgaagttctgatgaagcacatcgggggatatccgggaaattatgatccgtccatcaagggaagcctattggtgcatccacccaagttgtttatcagcggacactcgcatatattaaaggtaaagtatgataagacgttggatatgcttcacatcaatcccggtgctgcagggatgtccggatttcataaagtacgtaccatggttcgttttgccatagataatggtgtgtttaaggatttggaagtgattgaactggccggctaa

SEQ ID NO: 2627 - DNA, 498 bp, B.fragilis
ttattaaccataaaaaactatcagacaatggcagttccatacaaaaaaatcgcgagaaaagatccgcgaaaaacggatgctatagagaaattttatccgcaactggtcactttaggccaaagcgcaagcctggaaagcattgcgtacgaaatgaaggagaaaagttcgttatcatcgggagatattaaaagcgtactcaccaattttgtagaagcgatgcgcacctccctctataacggacaatcagtcaatatccgggattttggagtattcagcctttcggcacgcaccaaaggggtggatacggaaaaagaatgtacggccaaaaacataatggcagtgaaaataaactttcgtccgtcatcgagtgtacgtccgaacctgacatcgacccgggccggtgataaaatcgaattcatcgatatcaaagccgcactggaaggtaaagaatctgaaaaaggtggagacggagacattgtggatgacccgacggcataa

SEQ ID NO: 2628 - DNA, 627 bp, B.fragilis
tttaactacatgcagtataatactcaacagaaaagaatgccgctgccggaatatggtcgcagtatccagaatatggttgactttgcgttgactatccaggatcgttccgaacgtcagcgttgtgccaataccattatcaatatcatgggtaatatgtttccccatttgagagatgtacccgatttcaagcataaattatgggatcatctggctattatggccgactttaagcttgatatcgattatccttacgagattatccgtaaagacaatctggtaacgaaaccggatccgattccttatccaagtactaagatccgctatcgccactatggtcgtacgttggaaatattaatcaaaaaagcgtgtgaatttcaggaaggggatgaaaagaagaatctggtagcccttatctgcaatcacatgaagaaagactatatggcatggaataaagatacggtagacgaccggaaaatcgccgaagacctggccgaattctcgggaggcaaattgcagatggatgacgagattctgcgtctgatgtctgaacgtattgctcagaactaccgtccacgtacgaataacaacaataaccagagaaataataatcagagaagaaaattctga

SEQ ID NO: 2629 - DNA, 873 bp, B.fragilis
tattctataataatgccgaaaaagaaacgtagtaaagccttttggaacaatatcaagttcaagtataaactcactatcatcaacgagaatacactcgaagaggtggtgggacttcatgtatccaagctgaatggtctttccgtgttactttcggttctgaccgtgcttttcctgtttgccgctgccattatcacttttactcctttacgcaactatttgccgggatatatgaatagtgatattcgtgctcaggttgtggaaaatgccttgcgggtagattctttgcaacagttggtagaccgtcagaatatgtatatcatgaatatacaggatatcttcagcggcaccgtgcgggtggatactgtacagtcaatggattcattgaccaccatgcgtgaagattcgctgattgcccgttccgaacgtgaagaagctttccgtcgtcaatatgaagagaccgaaaaatataatctgacctctattaccgcacagcccgatgtcaacggactgattttttatcgtccgacccgtggcatgatttccgatcattttgatgccgaaaagaaacattttggaaccgatattgccgccaatcccaacgaaagtgtattggccactttggacggtacagtcatattgagtacctatacggccgaaaccggttacctgatcgaggtacagcataaccaggattttgtatcagtctataaacattgcggttcgttgctgaagcgtgaaggcgatactgtgaagggaggtgaagctattgccttggttggaaatagcggaacgctcactaccggtccgcatcttcattttgaactttggcacagaggacggccggttaatcctgaaaaatacattgtattctaa

SEQ ID NO: 2630 - DNA, 558 bp, B.fragilis
acaaaaataatgagccagctcaatgatatatcgttagtcgcacaggtcgtggtgttcagaaacaccagggccttcgaccaattggtacagaaatatcagtcgcctgtacggcgcttctttctgaacctgacctgcggcgacagcgaactgagcgacgacttggcacaagatacgtttataaaagcctacacaaacattgcaaactttaaaaatctctcaagtttctcaacatggctttacagaattgcttataacgtattttatgattatattcgcagccgaaaggaaacaacagacctggatgcccgcgaggtagacgctgccaatagtaccgaacaagtaaacgtgggtgaacagatggatgtttaccaatcactcagaacgctgaaagaaatagaacgcacctgcatcactctgttctatatggaagacgtaagtatagacaagattgcggggataacggggtgcccggtaggaacggtcaaatcgcacctttcaagggctaaagataaattagctatttacttaaaacaaaacggttatgacggaaacagatga

SEQ ID NO: 2631 - DNA, 1026 bp, B.fragilis
atttataaaatagttatgaaaatatacttagtttgtcaaacatggtcaaatactaaaaacaatcatgcagggattttgtatttgtgtaatcagttagccgctataaatccagatatacaggtgattgctatgcctgagtttaaatctattggaagattttttttgtatcatatttggcatttatattatgcattttatttatacttgtcaactaaagatggcgattgcgttatattaatggagtatcttttatctaaatcattagatcaaagcctgatcgcttcatttttgaagagaacaaaaccaaatgttcgtattattgctttaccacatttagtaagtaagcttattaaaaaacatttttcagaaaaagaaatagtagatcgtatatcaaaggtagattcagtatgggtattaggcagtagtttgaaaacatttttatgttcattaggtgtacccaatgataaaattagagtgatttttcattatgttgatactgaatattataaaggagaagtctgtaaagttcctaattttagattgagagttgttgtaatggggaatatgcagcgtgactatgatttgttatttgaggttatttcggcactaccattaattgattttgatgtgtgtgcaggcgtttctaaggcaacagagaacttaacttctttaaaaaatgtgactttacattcctatatgtcggaagatacgcttagagggataatgaataaagctgatgtttcacttaatataatgaaagatactatagggagtaatgtcattgttacttctatggcaatgggacttgctatggttgtaagtgatgttggatcaataagagattatgtggatgagtctaatggccttttctgtctaacatcaaaagattttataattgctttatcccgcttagaggctgatagagatatggtaaaacgaatgcaattaaagtcagtgtctaaagcgcaaggaatgaatgtttctgaattttatcgttggtttcgtactatggtttatgaatcctga

SEQ ID NO: 2632 - DNA, 906 bp, B.fragilis
aaaaagaaaatggaagaagtgaaacgtaactcgttgcaggcatggatacttgcggcccgccccaaaacactggcaggtgccattactccggtaatgataggttgtgcattggcttttgccgacggaaaattcaattggataccggcattgatctgctgtttgttcgccggactgatgcaggttgccgccaatttcatcaacgatttatttgactttctaaaagggaccgaccgcgaagatcgtctcggaccggaacgtgcctgtgcacaaggctggatttcggcagccgcgatgaaacaaggtatcttcatcacggtaggcctggcctgcctgatcgggtgtactctcctgttttatgcaggatgggagttgattcttataggtgcgttgtgtgtattgttcgccttcttatacaccacaggaccttatccattatcctataaaggatggggagacgtattggtcattgtattcttcggcttcgttccggtagggggtacttattacgtacaggctctcaattggacaccaaacgtcacggttgcatcactggtatgcggactgattgtagatacattactggtagttaacaattaccgggatcgggatgccgaccgaaaaagcggaaaaaagaccgttgtagtccgtttcggtgaatccttcggcagatacttttatttactgctcggcattacagctgcctggctttgtttctggtttctattcaacgggcacctatacgcaactctcttaccccaactttacctgttcttccacattcggacctggaaaaaaatggtacagatacatagtggcaaaaaattaaacagcatattgggcgaaacttcacgcaatatgctgttaatgggaatcctattgtcaataggacttgttataaacggttag

SEQ ID NO: 2633 - DNA, 723 bp, B.fragilis
ttatcaccgataatcgaaaagataaaaatctgcggtcatcttttattagataaacactccggcttacacacaatgaagaacaaacggtactcacgcggcgaagagctgtccaatactttaagccatggcgcaggcaccctgctgggcatcaccgcaggatattttcttttggaaaaggcgctcgccaaccctcacccctattgggcaacaggctgtgtactggcttatctggtggggatgctggcatcgtacatcagttcgacctggtatcacggctccaggcccggcaagcggaaagaacttctgcgcaaatttgaccacggcgccatttacctgcacatagcagggacttacactccgttcaccctgttagtgctacgccatgccggcggatggggctggggaatcttcacttttgtatggctgtcggctattgtaggattcatattagccttcaaaaaactgaaagaacacagcaatctcgagacgatctgttttgtagggatgggctctgccatcctggtggccctcaaaccactaatggactgcctgtccgccatcggggcctctcccgccttctggtggcttctcggaggaggagcttcgtatatcatgggagccgtgttttactcgttgcgaaaaccttatatgcacgccgttttccacctgttttgtctaggcggaagcataggccatatcatagccatctggttgattctttag

SEQ ID NO: 2634 - DNA, 1107 bp, B.fragilis
atcccctttgtcttgaatatccttttcatcatattggcttttgtcatctctgcttcggttgcccggcttatcattccccgcatcctgcttatctctttgcggaagaagcttttcgatatgccgagtgagcgcaaggttcataaacgtgccattccccgtttgggcggtgtctctttcttccccaccatcctgctttcctcctgtggcgtgttcgcccttcgcatcctgatgggttatgatgttcccgccctccgtgcggtgtacttgttgcccgagtgcttgtttctggtctgcgggatgactttgctctacctgacgggtattgccgatgaccttgtcggagtgcgctaccgtcagaaatttgtgatccagatcatctgtgcttcgttttttcccctggccggcctttggatcaataacttctacggtcttttcggcctgtatgcccttcctgcctggataggtatgccttttacggttcttctggttgtctttgtcaccaatgccatcaatctgattgacggtatcgacggtcttgcctccggtctgagcagcgttgccctgcttgtcttcggcttcctgttcatgcagaaagaactttggacgtacagcatgctcgcctttgccacgttcggtgtgctggtccctttcttttactataacgtcttcggcagtgcggaacgtgcccgtaagatttttatgggtgatacgggcagcctgactttgggctatgtgctctctttccttgccatcaaatacagccagtacaatctggatgtcaccccgtataccgaaggtgctttcgtgattgctttcagtacgctgattgtccctgcattcgatgtgatccgtgtggtgatggttcgtgttcgcagtggcaagagccctttcgaaccggacaagaaccatattcatcataagttcctggcaatgggtttcacaccaagaaaggcgatgataacgatcttgctgatttcttgtgcgtttagtgcggtgaatattctgtttatgccctatgtgaataatacaataatgttaataggagatattactgtgtgggtgggactgaatttatggtgggatagaatcagggataataaatgttga

SEQ ID NO: 2635 - DNA, 432 bp, B.fragilis
gcaaatattgtgtggcaatatttgtatatacaagaaattatcggtacttttgccacagaaatcagaagaagagcagtaatgaaaacggttaatcaaattattggagagaatctaaaaaaaattagagagttatccggttttacgcaagaacaagtagcccaatctattaagatagaacgctctacttacagtaattatgaaggaggaaccagagagattccttataccattttggaagatatctcaaatttattcggttgtgaaccttttatattgtttgaggacaatattcagacgaataatgaaattatggctacagctttcagaatttcaaatttaggagaaaatgatttgaaagaaatagcagctttcaaagatatcgtaaagtcttatctcaaaatggaacgcattgcccaaaatgaagccgaataa

SEQ ID NO: 2636 - DNA, 2328 bp, B.fragilis
aacatttctgtaacatgtatgacatttctctgcaatacgaaaatccgtcctttgcagtcagaaataacatacacatttatggagacaatttatctatgtattattatcttcctattcgtacttgccgtattcgacttgatggtcggtgtaagtaacgatgcggtaaatttcctcaattcggctgtcggagcaaaggcggcatcttttaaaacaatattgttcattgcaggtgccggtatcttcatcggagcgtccttatcaaacggtatgatggacatcgcaagacacggcatctaccaaccggaacatttctatttcgccgaaatcatgtgcatcctgcttgccgtaatgctgacagacgtcgttctgctcgatgtattcaactctatgggaatgcctacctcgaccactgtttcaatggtattcgaacttttgggaggtacttttgccctggcacttatcaaagtgcacaacagtgatacactgggattgggtgatcttatcaacaccgacaaagccttgtctgtcatcatggccatctttgtctccgttgccattgccttctttttcggtatgcttgtacaatggctggcacgcatggtgtttacatttaactacaagagcaatataaaatacagcattgcactattcggtggcatcgcttctactgccatcgtttatttcatggtgataaaaggattgaaagacagctctttcatgactcctgagaacaagcagtgggtacaagaaaacacgatgatgctggtaagttgtttctttgtcatctctaccatcctgatgcagatattacactggctgaaagtaaatgtattcaaagtagtcgttctgctgggtacatttgcattggcacttgcatttgccggtaatgacctcgtcaactttatcggtgtacctttagccggttattcttcgttcatagactataccgccaacggaacttctgtcggaccggacggtttcctgatgacctctctgatggggtcagccaaaacaccgtggtatttcctgataggtgccggagccgtcatggtatacgccttgtgtacttccaaaaaggcacatgccgtaatcaagacctcggtagacctctcccgtcaggatgaaggtgaagaaaacttcggaagcacaccgatagcccgaacactggtgcgtttcagcctcacactggccaacggtatttcccgcattactccaccgagtgccaaacgctggatagatacccgcttccgtaaagacgaagccatcattgccgacggtgcggcattcgacttggttcgcgcttctgtcaatctggtattggcaggtctgttgatcgccgtgggtacttcgttaaaacttcctctttctacaacctacgtcactttcatggtggccatgggtacctcacttgccgaccgtgcctggggacgtgattcagccgtttaccgtatcaccggtgtactaagtgtcatcggcggatggttcatcactgccggagctgccttcaccatctgtttctttgttgccatggtcatccacttcggaggaagcatagctatcatagccctgatcggtctggcagcattcactctgatccgcagccagttgatgtacaaaaagaaaaaagagaaagagaaaggaaacgaaactttgaagcaattgatgcaagccacaagcagccacgaagctttagagctaatgcgtaagcatacacgcgaagagttgagtaaagtactggaatatgcagaacagaactttgagctcaccgtgacttcattcttgcacgaaaacctccgcggattgcgccgggcaatgggatctaccaagtttgaaaaacaactgatcaagcagatgaagcgcaccggaaccgtagcaatgtgcaaattggataatcacaccgtacttgaaaaaggactttattattatcagggaaatgactttgcaagtgaactggtatacagtatcagccgcctgtgcgaaccctgtctggaacacattgacaacaatttcaatccgctggatgctatccaaaaaggtgaatttggagatgtagccgaagatatcacctatctgatccagcaatgccgccaaaaactggaaggcaacaattacagcaatcttgaagaagacctgcaccgggccaatgatctgaactcacagctatcacacctgaaacgccaggaactacagcgtatccagagccagaccggaagtattaaagtaagtatggtttatctgaccatgatccaggaagcacaaaacgtagtcacttatacgatcaacctgatgaaagtaagccgtaaattccagatagaaacagatatttaa

SEQ ID NO: 2637 - DNA, 894 bp, B.fragilis
tgcgtcgatgtacttatgaacgaactggaagatatatacaaacgaatcgaatatctccgtaacaacggagtgaaaatgaaagaaatagccgactggatacacatggctcccagtgtgctgtccgcactctactccagtgtgctgcccacctatctgaacctgcaaaagaccaagccccgggaagaggctctggacgaggcactggcactggtaaacaatgtgtcgaagaaacggctgctcggcaatctgggagaaatgaaagaacggctcttcgatctggaacccaatcaggaagccaacataacaggaaatgcttttctgaaattactggaaaaggaaatgcaggaatctgtaggggaagtctacaattacagtggcacgtacctaagctacagcctttcttcatcgacagacagcctcaaggcagaaccctatctgatctgtgcatcagaaaacaatgattatgtgaaagtaggcatgatcaatgcctataaatcagtacactggggaagtggcattatcagtaatcatcaaaattcatacctgatgttcaatgaacgggaacttccgcagtttgccctggtaaccatctatctgcaattaccccattatgagtttccgcatatgctgaaaggattatatctctgtctggactataaccataacccgatagcccggagaattgtcctggtgaagcaatcggacagcacagacatagacgagttcctgaaaatggaaggaaagttaatctccagatcggaactgacccctgaagaagagatctattataattatacatgccaggaaggagactatatcaagacttgtacggtaccctcacccaaactgaatgaatcggatctggaaagagaaaaaaagatgctgaaaatataa

SEQ ID NO: 2638 - DNA, 915 bp, B.fragilis
aattatcccgtatttttgcacaaaacttttggtaatatgatacaatccatgacgggatatggcaaagcaactgccgaacttcccgataagaagattaacgtagagataaaatcgcttaatagcaaagcgatggatttgtcggcacgtatcgcaccggcataccgtgaaaaagagatggaaatccgcaatgaaattgcacgtgtgctggaacgtggaaaagttgacttcagcctttgggtggaaaagaaagagtgtgcagacgctgccactcccatcaaccaagtattggtagaaggatattacaaccaaatcaaagctatctccgaaaacctccacattgcagtacctactgactggtttcagactttactccgtatgccggatgtaatgacccgcaccgaaacacaggagttgagtgaggaagaatggggaatagtgtacgcagcagtcaaagaggctgtttcacatttagtcgatttccggaaacaagagggtgctgctctggaaaagaagttccgggaaaaaatcgcgaatatccatcgtctgctcgaatcagtaaccccttatgaaaaagaacgggtagataaggttaaagaacgtatcaccgatgcactggagaaaacactcaatgtggactatgataaaaaccgtctcgaacaggaactgatctactacatcgagaaactcgatatcaacgaggagaaacaacgtttgggcaatcatctgaaatacttcatcagtacgcttgaaagtggcagcggacaaggtaaaaagctgggattcatcgctcaggaaatgggacgggagatcaatacactcggcagtaaatcgaaccacgctgaaatgcaaaaaatcgtggtacagatgaaagacgaactggagcagatcaaagaacaggtgctgaatgtgatgtaa

SEQ ID NO: 2639 - DNA, 1131 bp, B.fragilis
tcaatacacgtatatgaatatatgaagaaaattctttttatgggaaataccgcttggagtatgtataattttagacgcgtggtattttctgatttgatctctcttggttacattatttacattgtagctcctttggatgtaaaattccaaaaagaattggagaagttagggtgtaagtttatctctttagatataaaagctaaaggaactaatccttttagggattttattttaatttttcagataaaaaagattttagaaaaggttcaacctgatttttgttttttttacactataaaacctaatatttatgggagtattgcagcttcaatgttgcacatcccacatattgcaattattacgggattaggttatacttttattaatcataatctaatatcgtatattgctaaatgtttatataaaatagctttggttaaggctaaggaagtatggtttctaaataaagatgataaagagacttttgtttcaaaaaagattgtaaaaggaactaaagtgcagctgttgccaggagaaggtattgatttaaaacgttttagtaagaaacctatggtaccggatgtttcttttttattgatggctcgtatgttgtgggataaaggcatcggagagtttgtagaagctgccaaatttataaagcaaagatatcctgatacaaggttctgcttattggggtttattggagttgataatccaactgcaattcctaaagaacggatagaagaatggtgctctatgggacttgttgaatacttgggggtaacttcagatgttagaccttttatagagaactgttcttgtgtcgtattgccttcatatcgggaaggagttccagtatccctacttgaaggagctgctatggggcgccccttgataactacggatgctgcgggatgtaaggaagctgtagaagatactgtaaatggctatttatgtgaagtcaaggatgttgagacattagtttccgcaatggagaagattattttaatgagtatggaacaaagagttaccatgggagaagctgggcgtgtaaaaatgcagtgtgagttcgatataaaattagtaactgagagatatattaatactttacattattatttaggattctag

SEQ ID NO: 2640 - DNA, 378 bp, B.fragilis
tacacaaaagtgatggaactgcagatcatacagagcaagatttacgggatacggggacagaaagtgatgttggactttgatttggccggattatatcaggtggaaacccgtgttctgaatcaggctgtaaagaggaacagcaaacaatttcctacggatcttatgttccagttgaatacggaagaatgggaaatcttgaagtcacaaattgtgatatcaagttggggaggtacccgtaaacttccctttgcctttaccgaacaaggactggccatgctctccggagtgttaaacagtgatcgccatcgaagtgaatatttccattatgcgagcttttgtagctgtccgccaattggtctcggctcttccggtgaatga

SEQ ID NO: 2641 - DNA, 342 bp, B.fragilis
aacaaaacggttatgacggaaacagatgataaactcctgaagcaattcttcggcgagcaaaaacaggaaatagaagacaacggattcagccgccgcgtcatgcgtaacctcccgggacggaaccaccggctggttcaggcatggggagcagcctgcgcagtagtatgcgtcattttgttcttcactttgggaggtctgcaagccaccatcagtacactgcgcgaagtatttgtctcgatggtccagcaaagtgccacaacaggattcgacccgaaatccctgtatatcgccgctctggtacttgccttcttcggagcgcgcaaggcatggtcgatggcataa

SEQ ID NO: 2642 - DNA, 195 bp, B.fragilis
atattaaccaccagcgtgtcttttttgtttgtcactttcctgtatatgtggcaggcaaagttcgcaaagttaagtgacttaacaaaatcttttctgatttatctgtggggctttgttaaaagagagctgttttattgcaattttgttctctggagtaagcaaattgtctacattttgttcagatatgggctctga

SEQ ID NO: 2643 - DNA, 456 bp, B.fragilis
ggtacggattatgctccatccggtcagtttgagaaaatgtttaatactgatttaggagcaggtgtaggaactggagtggctcagattgcgggtggacaagccgatggatataacttcttccctcagcaagatctttcttctcctaccacaaaggaagatgttatgaagaaatcgatccatgttatcatggaagttgagtttgataagaaagttggtggctcaggtccggaaaccggctggcttaatgtggttgctttaaaggataatacagctactaactatattacagactttgaagccggtaaggtatactttattaaccttgccgatatcaaggatattatggatgttccggttcctcctgtaactccggaccccgatccggaaactgtttctgtagatcttactgtaagcataggtcagtggactgtagttcaggttaagcctgaagtttaa

SEQ ID NO: 2644 - DNA, 621 bp, B.fragilis
atttttattaaaatgagaattacaaaatcgattctggccttaatggctgcaaccatgacgttcgctgcatgtagcaacgatgagaaaattacggagagtactcctaagacggtagctttaactgtgaagctgccagagttcggcggagcttcgagtagagctattgatcctgagactactacggggaataaagtgactattaatggacctgtaaaaattatcgcacgtgtttcacaaggtggtgcaattaccaatacaattagtgaaaacattacagctggttcaatgtccactattacagtttctggtgcggcacagtggattgaggtagaggctaatggtgataatagtactgaaactgataatgtaaacactcgtcaaggatcagctacatcaagtaaagtgcgtttgtttggaggagcaacgataaatccaggaagtggtggaaatgcaacttgcactccgacaataaaccctgatatggcgcgtgtggaagtaaagggtagtctggccggcccctggacacatctgaatgatttaaagataaaggggatttacattaataatgttaagcttaccagaggtgcttcttcattgaccagaattgtgtcggctgcttag

SEQ ID NO: 2645 - DNA, 804 bp, B.fragilis
tgtatgacaaaaagaacttgccaatttccgaagcacacatgccttcgagaaatcaactttttgaagatagcaggtatcagtctcctgctattctgcacgacatcacaaattgccgtagcagacagttatgaaaaaaatgctgtcacagccacacagcagagtaaaacagagaaaataacaggtaaaatagtcgatgagagcggagaggccatcatcggtgcctcggtaaaagtacaaggaagcactatcggtaccatcaccaatatggaaggagagtttatgataccgaatgtccccaacaaggccgtactcgaaatcagctacatcggatacaagcccttagaagtcgctgtcggaaaatccaaagatttacgcatcacgatggaagaagacactaaaacgctggatgaagtcatcgtagtaggttacggtacgacttctaaacgcaaaacaaccgccgccattgccagtgtcaatacagaagacattatcaaagcaccgacggcaaacatcacccaaagcctggcaggacgtgctcccggtctgttggtcacaaccagcggaggcggtctgaataacttttccagtgtctctatccgtggagggggcactccgctttatgtaatagacgatgtgatttccgaagagcgggatttccgcaatctgaatgctgaagacatcgatcagatcacaatcctgaaggacgccgcttctaccgccgtttacggagcacgtgccgccaacggtatcgtaatgatagtaaccaagcaagggcaaagcagggaaaatgagcgtcaattataa

SEQ ID NO: 2646 - DNA, 1623 bp, B.fragilis
ttaattcaaaagaaaatggcaaatttagatttaagcaagtacggtattacaggtgtaactgaaatcctgcacaacccgtcttacgatgttttgttcgctgaagaaacaaaaccaggtctggaaggctttgaaaaaggtcaagtaacagaattgggtgctgtaaacgtaatgactggcgtttacactggccgttctcctaaagataaattcttcgttaagaatgaagcttctgaaaattcagtatggtggacttctgaagaatacaagaacgacaacaaaccttgttcagaagaagcttgggctgacctgaaagctaaagccgttaaagaactttctaacaaacgcctgttcgttgttgatactttctgtggtgctaacgaaggtactcgcatgaaagtacgtttcatcatggaagtagcttggcaggcacacttcgtaactaacatgttcatccgcccgacagctgaagaacttgctaactacggagaacctgatttcgtatgcttcaacgcttctaaagcaaaagttgataactacaaagaactgggtctgaactcagaaactgctacagttttcaacctgaagactaaagaacaagttatcctgaatacttggtacggtggtgaaatgaagaaaggtatgttctcaatcatgaactacatgaacccgcttcgtggcatcgcttctatgcactgctctgctaacacagatatggaaggaactagctctgctatcttcttcggtttgtctggtacaggtaaaactactttgtctactgacccgaaacgtaaattgatcggtgacgacgaacacggatgggacaacgaaggtgtattcaactacgaaggtggttgctacgctaaggttatcaacctggataaagaaagcgaaccggatatcttcaacgctatcaaacgtgacgctctgttggagaacgtaacagtagctgctgatggcaaaatcaatttcgctgacaaatcagtaacagaaaacactcgtgtttcttatcctatctaccacatcgaaaacatcgttaaaccggtgtctaaaggtcctcacgctaaacaagttatcttcttgtcagctgatgccttcggtgtattgcctccggtatctatcttgaacccggaacaagctcagtactacttcctgtctggatttacagctaaattggctggtacagaacgtggtatcactgaaccgactccgacattctctgcttgcttcggtgctgcattcttatcattgcacccaactaaatatgcagaagaattggttaagaagatggaaatgaccggtgctaaagcatacttggttaacacaggatggaacggaagcggcaaacgtatttctatcaaagatactcgtggtatcatcgacgctatccttgacggttctatcgacaaagctcctactaaggttattcctttcttcgactttgttgttcctacagaacttccgggtgttgatccgaagatccttgatcctcgtgatacttacgctgatcctgcacagtggaatgaaaaagcaaaagaccttgccggtcgcttcatcaagaacttcgctaagttcactggaaacgaagctggtaagaagttggttgctgctggtccgaaactctaa

SEQ ID NO: 2647 - DNA, 1617 bp, B.fragilis
agacaggaaaatatcatgaataataaaagaaaaaatatgagtatatatataacagtcctgttatggattttgattccattattgataattaacgggcttattttcttaactagtgatatgctcagtgtttttgtcggggggatgttatccttaaagttgctatgttatagccttttcttttcatatagtttcttgcttggatataaggcacaaacaggaggtggtattattattcttgtacttttgctgattttagggctttttttatggcaatcatttattagttgggttgaacccgggacgttgtggcgggaagcagtgggtgccattatattcttgggagtaattctttctgtcgggattttatgccgctatggcattaaagccggtggacttcttcgtttaagttcgattttggcatttgccatcgtagcgtttgtttatattacagtctgtttgtcgacagtatgtggcgcttattctcctatacctgaagaactcttctggaaagatgcgtatccggagaaggggaaaaatggtactgtcttttttcatcattcgaaactgcatataaatcccttcgattcgagagtaataggtgtttttcgtttcaatgataaaaaagagtatgtcggttatagtgccagcatgtatgagagtcatgaaatagtcaattcgggatttaaagtggatgacacgataaaagcttcaacatgtgactttatacatagtagttatgagccattattgagtaactttatgtccgattgccaagatgcactctatatgaaagaaggagattattgcgtgtttctatatactgaaaaaggagcgctgtacagaaaagagtttgattatcatcgaaatgggattgtgaaacaagcacgtacttatacgtatgaccggaaaaccggatttcatattgaaagagagaaaacaatagaatttgacgaactaggtttctgcgataaatcaggccgggtaagatggaatataaaagatttccatcaaacagatacagtgatagatatggaatctcgttatgggcaggcatacgatccggcggcaagaaatagaaaatacgctttaccccaacaactcataatagactcttttgttactgttgaaagtaagactgcttctcccgattcattgagaaaatatagtagcctggattttccgctggatgaatactataaattaggtggtgtgaatgggcatgcaatatcggtatatgtaaatacggacgaatataaatggcgtaagatatatttgtctgattttactcagttagggaacgtggagcaaatgtattcttttatagatgctttggaattgagttgtttggataccgggatgtgggtgagaattggcgagcaatcaatggttgtgggtgaagacgatgaatgttgcagctttgtactgaaagaagttgtcaaaggtggcaaggctctggcattgtatttctttgatgactatgcggttacgacagattcgagattctgcttttattttaatccctctattcataaagacatggagatacagaaaagagctggggcggcttggaatgaaatgaaaaagatctttatggaatataaagaaaaagagaattaa

SEQ ID NO: 2648 - DNA, 183 bp, B.fragilis; identical to SEQ ID NO: 1953

SEQ ID NO: 2649 - DNA, 1914 bp, B.fragilis
tattcaaagaacacactaacaccggttcatgttaatcctaaatttaaatatataaatagaattatggcagacgaaatgatggttaaagaattggaagaagtggttgtccgcttctccggcgattccggcgacggtatgcagttggccggcaacatcttctcgaacgtgtcggctacggttggaaatgacatctgtacatttcccgattatccggcagatatccgtgctccgcaagggtcactgacgggcgtatcaggttttcaggtacacgtcggtgcaagtaagatattcactccgggtgatcattgccacgtattggtagctatgaatcccgccgcactgaaaacacaaattaaattctgcaaaccgcaggggctggtcatcacagattccgactctttcggagaaaaagacttggaaaaagcacagttcaagacaggcaatcctttcgaagaaatgggaatcacacagcaagtgcttgaagtccccatctcgtcgatgtgtaaagaaagcctcaaagattcagggctggacaacaaagccatgttgcgttgcaaaaacatgttcgctctcggtttagtatgctggttattcaaccgcaacctgtctgctgccgaaaaaatgctgaacgagaaattcgcaaaaaaaccggaaattgccgctgccaacatcaaagtgctaaatgacggctacaactatggagccaacacgcatgcctctacttccacttacaagattgaaagtaaaacgccgaaagccgcaggactctataccgatattaatggtaacaaagccacttcatacggtttgatcgccgctgccgaaaaagcgggattggaactttatctgggatcttaccccatcactccggctaccgatatcctgcacgagctcgccaaacataaatcgctgggcgtgaaaaccgttcaatgtgaagatgaaatcgccggatgcgcttcagctgtaggtgcagcatttgcaggcgatctggctgtaacgactacttcaggaccgggtgtctgcctgaaaagtgaagccatgaacctggctgtcattgccgaattaccactggttgtggtcaacgtacagcgtggaggcccttctaccggtatgccgaccaagtcggaacaaacagacctgttgcaagccctttatggacgtaacggtgaaagtccgatgcctgtcattgcagctacttcacccaccaactgttttgatgctgcttatatggctgctaaaatagctcttgaacacatgactccggtagtactgctgaccgatgcctttatcgcaaacggttctgccgcatggaaactacccaacatggatgagtacccggctataaatccgccgtatgtaacaccggatatgattggtacatggaccccgttccaacgtaacgaaaagaccggcgtacgctattgggccgttcccgggaccgaaggattcatgcatcgtataggtgggctcgagaagagcagtgaaacaggcgttatttccacagaaccggaaaatcaccagaaaatgacacttctgcgtcaggccaaagtcgacaagatagccgacagtattcctgaacaggaagtacaaggcgatgctgatgccgacctgctggtagtaggctggggtggtacttacggccatctttattcggctgtagagcatatgcgcaaaaatggaaagaaagtggcactcgctcacttccagtacatcaacccgctgcctaagaacacagccgaaatactgaaaaagtataaaaagattgtagtagccgaacagaacttgggacaattcgcaggatatctgcgcatgaaagtacccggactgaatatcagccagttcaaccaggtaaaaggccagccgttcgttacgagagaacttgtagaagcattcactaaattattggaggaataa

SEQ ID NO: 2650 - DNA, 669 bp, B.fragilis
aacgcagttgaaaagatgaagattattaatttaagtgagacagactcaatattgaatcagtatgtatcagagataaggaacgttgaggttcagaacgaccgtttgcgttttcgtcgcaacattgaacgtatcggcgaggtaatggcttatgaaatgagcaagacgtttgcttattcggtgaaggagatacaaactccattggggatagcacctgtcagaacaccggacaatccattggttattagtacgattcttcgtgccgggttacctttccaccaaggattcctgagctatttcgattatgccgagaacgcttttgtttctgcttatcgtaagtacaaggatacgttgaaattcgacatacatattgaatacatcgcttcaccgcgtatcgacgggaaaactcttatcattacagatccgatgcttgccaccggcggaagtatggaactgagttatcaggccatgttgacgaagggacatccgtctgaaattcatgttgcttcgattattgccagccaaagggctgtcgatcatatagccagtattctgccggaggataaaactacaatttggtgtgcagctatcgatcctgagataaatgaacactcttatattgttcccggattgggtgatgcgggtgatcttgcttttggcgagaaagaataa

SEQ ID NO: 2651 - DNA, 1014 bp, B.fragilis
gagatgagcgaaacagtatatacagcaaaagattataaatcaggtcagcctcgctggtgtccgggatgcggtgaccatgctttcctgaactccttgcacaaggctatggccgaactgggagtagctccgcacaacattgccgtgatctccggtatcggctgttcttcccgcctaccttattatgtcaacacatacggcttccacaccatccacgggcgtgccgccgctgttgcgacaggtgccaaggtagctaatccggatttaaccatctggcaaatctccggtgacggtgatggtctggccattggcggtaatcatttcatccatgcggtacgccgtaacatcgacttgaatatgatcttattgaacaaccgcatctacgggttgaccaaaggtcagtattccccgacttccgaccgtggattcgtcagcaaatcatctccttacggcactgtagaagatccattccacccggcagaactctgtttcggcgcgcgtggccgtttcttcgcacgttgtgttgcggtagacggaccggcttctgtcgaagtattgaaagccgcagccaaccataaaggagcatcggttgtggaagttctgcaaaactgcgtcatctttaatgacggcacacacgaatcggtcgcaacgaaagaaggacgttctaaaaacgcaatctatctggaacacggcaaaccgatgttattcggcgaaaacaaagagttcggcctgatgcaggaaggtttcggcttgaaagtggtaaaattaggtgagaacggcgtgacagaaaaagacattcttatccacaatgctcacagcatggataatacgttgcaactgaaactggcattaatggaaggaccggatttcccaatcgcactcggtgtgatccgtgatgtggaagctcctacctataacgatgcagtcgccgagcagattgatgaagtgaaagccaaaaagaagtatcataacttccaggaattgctgatgaccaatgaaacatgggaagtaaaataa

SEQ ID NO: 2652 - DNA, 183 bp, B.fragilis
cagggcaaagataatgcacctgcaaaaagaatcacttatccaaagcaaccatttacttcaccttttccgagattatattttaagattctgattatcaatatgcttgtctttgagctgcctgaccaactctcttggggaattaccgaaattctttttgcagtatttattgaaactggccgctga

SEQ ID NO: 2653 - DNA, 1248 bp, B.fragilis
tttattttggagaagaaaattggaaagttaagtatcagggtgttgttgaatacccatcgtagaaatgattgtgagatttatcctctgattatccgtgtggtttatcacaggcgtaaaagtgagtattctcttgggtggaagattcatacttctaatttctctgcagatcgtgagcgtgttgtctattcatcaaccggtaatcttaagcgcaaggatctgggacttatcaatgatgccatttctcaggagcgtgaacgattgctgaagatttttgcttttcttcaacagaatatgccggggttcagcttatctcagttgatggataagtatcgtatggagcgcaatttgcgttatgtcgatgcttttattgtgcgtgagatagagaggcttcggcaggaggggcgttctggtactgccggcctgtaccttagcggattgtactctttacgacgttttttgcgtggtcagaagattacgtttcgcgagttgacttattgttttcttacggattatattcattttctacgtatgcgcggtatctctgaaaatactgtgaatatgtatattcgcaatctccgcgctgtctataacaaagcccaaaagcaggggataaatatgggttgtgagtctcccttccgggagcttaagcttcaaactcaggagactgcgaagcgtgcgttgtgtaagcatgatattgcccgtatagtatctgttgatctttcctccgaacctttattggatcgtgcccgggatctttttatgtttagtttctatgcccgtggtatgccttttgtcgatattgtctttcttaaacatgactcgataattaatggaatcatttattatgagcgtaataaaacggggcaacgcatgcaagtccgtgtgattcctcctctcgcagctctgattgagaagtatcggagttcttatccgtatgtattgccgtatataacgtctttttcggaccgtacgtcttatatgcagtatcgttatgcattgggtaatgttaaccgcctactcaaacggttgggcaggcgattgcacctgcctcttgtactgactacctatgttgcccgccatagctgggcgactattgccaaagaggagggattttctatcgcatctatcagcgaagggcttgggcatacttctgaggcaacgacccagatttatcttcagtcttttaatagtgaggtcattgataagattaacgagcaggtcgtagcctccataggaaggcatatctga

SEQ ID NO: 2654 - DNA, 354 bp, B.fragilis
gcagagggggaaagaaaagagaacgaaggtaactgtttaacagtgacctgcctgatctttatatcttcatccgtattttttcgtatctccagactcgcctttgaagcaatgcgctccaactcaaccgagaacgctgaattccaggttaatccttcatccacactgacttcccctgtgaccggagttgaagaggctgcatttcttatccggatatccagatgcttgcataccacaaactctgccgtatctacaggtagagtaaccggtacacttttaatttctgataaagatggctctccggttaatgcggaattcatgcccgtcgtttcattaccgatcacaaacaaatcgtaa

SEQ ID NO: 2655 - DNA, 903 bp, B.fragilis
tttacaaaactaaaaatgaaactacattacaaaaaagagcacatctcatgcaccaattataaaagtgaatcgtatgagggattcgggattggaacgcttacaagcggcagtaacttcaatagtcagaccttatctgttaaaactaatttcctgatcttcattcttgaaggtgaagtggagattattcccaaagaaggcaaaataaaaagggtaatagcccaggaattctttttcatctcggcattatccacttacgagatacaggtacgagtccccggacgctacatttatatgagcttcctatacaatgacattaaactatgtgagaaacacatgttagagagctatctaaaagaagtgagagaagcatctgaagaggtcggaatactatcggtacgccacccgctgaacttatttctggaattaatggatgcctacctgagagccggagtcaactgtaagcatttgcactccattaaggagaaagaactctttattattttgagaacaagctatagcaaacaggaaatagtaaatttatttcatgaaatcataggaacgaatatgagcttcaaagctgctgttttactgcatgttgatcgcgtgaacaatcgtgaggaattagcacaggcaatgggaatgagtattaccgatcttgccagaaagttcaaggtagaatttggcgaatcagtatattcatggttgctgaaacaaaaaaacaagaaaattatttatcggttggcgcaacccggagccagtgtaaaagagattgtgtatgaattcggcttctcttcagcggccagtttcaataaatactgcaaaaagaatttcggtaattccccaagagagttggtcaggcagctcaaagacaagcatattgataatcagaatcttaaaatataa

SEQ ID NO: 2656 - DNA, 786 bp, B.fragilis
  unsure (83),(131),(164),(239),(248): Identity of nucleotide sequences at the above locations are unknown.
atgtgtatgcgttcgactccctcggcatttatcggcaaaaatgtttcgggacaaaggagcacatttgaagaaatggctaccgnaatgcctattgaccttcctgaggggaaatggacctttttatgcttggnaggtaaggttggtgattacgagattggcatttntagacaggtatttcctcacaagtttagtccggctgtctctccggggattaccactctttcggattttcgtgtaanagcgtattntgagcagaaagaaaatttggaatactcacttggtgagttgttctttgggcgcctggactccatggagatcacagctgataacggtgggacaggtgtagtagacttaatgaaaaacacgaataagatagaagtccgtgtgaagggaatcgctgatggttcatcagcccgtatcacctctgataacggacgctttaactcagaaaatgttacgccggccgatgccggtacgattatatatgttccttattatagcgcatctcaaacggatgatacccgtgttttccagtttgatgtattgcgcctgtatactgacgggcatctgttccttaaattgctgaatcccgatggaacagatgttattccgggatttacaaaagatttgatcaatgctattatgtcctctcccgcataccatactcaggaagatttggatagagaggatacctatctgattgaattggtgctttctaaagacggagtcattgtctctttgcgggtaaatggctgggaaactgtcagtactactccggaggtctga

SEQ ID NO: 2657 - DNA, 246 bp, B.fragilis
  unsure (144): Identity of nucleotide sequences at the above locations are unknown.
aatcgacagcggacgcttttgtattgcaaacctacaacaatgtcctcccctctatcacgatatccgcacggaggagcaatggaccttgaattcgtcatgcgccagactgcccgaatgagccagagatctatgaaccctgacttntcatggggattcaccagtttggacccttcgccgttgaacctgttaatcaaaaaatccaaggtttttccgggtttgcccgttccgtttaaaaaacattggtag

SEQ ID NO: 2658 - DNA, 834 bp, B.fragilis
agtatagtcagagtggaaaaaagattttctaagatattttcaatagtcgtttacgcattcttagctttatggatgggagcatgtaagagtgaacctgtccgcttgccggaactgagcggacaccggggagcggactgtattgctccggagaatacgctggcttcggcggattcatgtataaagtataagattgacttcatggaatgtgatatttgtatcagtaaggacagcgtattctatttattgcatgattctaccttggatcgtacgacgaatggaaccgggctgattagagagtggctttcggcagacatcgatacattggatgcaggttcatggtttggcgaaaagttcagcggacagtgtgttccccggttggacgttttattgcggaaggctaaacagaacggtctgaagctgacgctcgattatcgtacgggagactttggacagttgctggatctggttcgcagggaaggaatgttagagaattgtacatttactttctggtcggacaaggaggcaaaagcttttcgccaagtggctcctgaaattcggacattacaggcgtatgtaggaggtggtgccgaacttgataaggttatagctgaaataaatcccaatattgcggttattcggatcgattcactggataagctcctggtggaacggtgccataagaaaggattgaaggtgcttgcattggcactgggtactgacgatgtagaagagtctgaccggaaagctattgaactcggggtggatgtgctggccacggacagaccggagctgtttgtaaagaaatacagaccagagcatacatggacaaaatga

SEQ ID NO: 2659 - DNA, 189 bp, B.fragilis; identical to SEQ ID NO: 1954

SEQ ID NO: 2660 - DNA, 2397 bp, B.fragilis
ccaagcaagggcaaagcagggaaaatgagcgtcaattataactttaactataactggagccaacctgccaatatgcccaataagttggatgcccacgatgcagccttctacaagaacatgagtatgaccaatgacggattggcaccggcctatacggacgatgaactggaactgttccgcaacggatcagatccacgcagatatcctaatacggactggcaaaaactctgtttgaagaactccgcaccggaaatgcaacataccctgactgtcaccggtggtagcgaaaagataaaagcatatacctctttggggttctacgatcagaagtcactctataagttcgatgtaaacagtttcaaacgctacaacttccgcacaaatatcgtagcagatttcaaagaaataggtttgaaagtaacttccagcatcgaagcttacaaaacggacttaagatcgcctaatgccaaatcgggagacagctattatcacacctggggacacatccagaataaagccccctgggaaatagcatacaatccgaacggacaaatattcaacacaccggataacccattgatggagatctcccccgacgccggatacactaaaaacgaaaacctcagtgccatagcaaacctcgcactggagtggagcgtaccttatgtaccgggcctacgattgaaagcactgggtaactaccgtatcaacaacgacaagtcaaaaagttggaaaaaatcacctttagcatacgattgggatggcaaccccaacgatcccggcaaaccttcactgagcaagtcttattcaaactggtcatcgtacaccgtgcaaggctttgccaattatgaccgtactttcaatcaggtacacacaatcagcgccacagccggtatcgaagcctataaactctttaaagacgatgcctcgttatcccgcgaagaatatttgctggacgtagaccagatcggtgcaggtcctgtatctacagccaaaaacagttcttcggaaggtgaagaagcgcgtgccggtgtagtagcccgactgaaatatgactatgccagcaaatatgtggccgaggccagcctccgttacgacggtagcgacaatttcccgcgaggtaaacgctggggaacattctatgccggctctcttgcatgggtcatttcggaagaaagcttctggcagacattaaaagaccgtcatatcttcgaccagttcaaggtaagagcttcttatggcgagatcggttcagacgccatcggacgctatgcttacctgcaatcatacggactgaacgaccgtggctacctgcttaacggaagttggtatccgggattttccgaaggtgccttggtcagcaaagacattacctggtatactacccgcgactttaacatcggattcgatttcggatcgctcaataaccgtctttcaggttctgtagactatttccgcaagagcaccaaaggttatctgacctctccgtcggcagtagcttataccgacccgttgggtatcgcattacccaaagtaaagtcaaatggcgagttcatccgccaaggtgccgagttcatcctgcaatggaaagagaaaagaggtgattttgaatacacactttcgggcaacttcacctacttcgaccaatactggaacatcaatccgaacgaagcggaaaccgataccaagaacccatacaaacgtactacacaagccaaaggatattggggtatcggatacgactgcctgggttattatcagaatcaggaagacatcatgaactcacccaaacgtcagagttccgtcaacttaggtgcaggcgacctgaaatacaatgacttcaacggcgacggtatcattgacggttccgaccagcaccgcatcggcaaaaacagtatgccccgcggccaatacggcttcagtgccgacttgaactacaaaggctggttcatgaacatgctgtggcagggagctactccggccgacctttatatgggcggtatgattcagggaagccaaagcggcagcggttatcctcctgttatctatgacttccagaccgacgtatggactccgaataatacgggagcccgctatccacgtttgagaagtacggcaagctacaacggcagtaacaactacggcagctcagacttctggctgatcaacacaggctatcttcgcctgaagacattatccatcggctacgacttcaaacataaactactcaaaagagtggcatggatgaataaatgcaacgtttctctgaatggttataacttactgactttcagcaaagcgaataagttcgacatcgacccggaaatcggcgacggcaacctctacacctatccggtttcaagagtatactccatcagtgtcaacgtaggattctaa

SEQ ID NO: 2661 - DNA, 1740 bp, B.fragilis
tctcatttcttattctgttgtaagatgatacatcaaaaaaagttcgtcactatatcgatagggtatcgtatctataaaatgttagggatgctctgtctctgtgtgctggtatattcatgcggttcaaaatctcctttgactatgcgtttgtttatgcaggctggcggagctactgtcgagctgccgaatacttcttctgcggatagcgtttttacagtctccgaaactgtcggtttccgggatagtgtggttgttgacaatcccgtttcttcggttgattctcttgaagaagatatctggaaatcaattgatatggatcgcattgatattgttgctcagcgtaaaagtatagagcgaatcttggaacgtaatggcgaggtcaccctgatgttttatgtaaaagctcctaaagtcctattggacagttgctggaagttgacaatgtacccggaactgatagaaaaagactcttctgttttgctgtctcctgttattctgcggggaaaagaatttatccgtacacaggaaagccagtataaagcatacgatgatttcctaaagggtattataccggagagtaaatatgacagtgcttttgtggatcgtgaaggtatccgcaaagatatttttgcacggcagaggcttttctggaaggtctatgaagcagagcgacgtagacgtctggcttatctgaggtggaaggcacttatggataagcgtcatggatggatcagtacgaaagcagagggaaaccgtaatactttgaagcaacgtatgcagcgtaatgtcttggaacgcagcgtggaaaaattcatcgccggttatgatacggttggtatacgtgcttcgtaccagaaaaaatacgatcgccgtacggatttttggccggcttaccgtttgcctcgtgcaatgacagttaaagatgttccttcccgctttcaggaactttatctgtccggtgggcgtcttgaggatattcgtaactacagtttcactcgccgggattctattgagatcgcttcccatcgctacttccgaaaagcgattgcagagaatgaatataaccgggatcatcaggatttgattcgtgaccgtattatccgcttcccttatgctgacagtgcaatggtcaatcaaacagctgatccttcggaagacttctcctatctgtatatgtatcgcatcccggtacgtgagggaatgaagaaattatatataactcttcggggaaacgtgctcgctacggaccatagcgtatggagtcttcctccggcggatacattgacattcgtaattgcgtctgttgccgacttggctgatgctactctggcgcgtcgttttgatatagcgggtgacagtgtgaaccatcttactcctgagcgtgaggagtatgcccaaggacttgaggccctgtccaatcgtgaatatcagagagctttgggtatcctggagaaatatccggactacaatacagctgttgccttgacttgtttgggctatcatgcaaagtcggaagatttgttaaagcaactgcctcaaacagctgcggttgaatatctccgagcgattgtgaatgtgcgcttggaagactaccaagcggcagcagaacttctgttggaggcatgccgtaaagatactaaatatgtataccgtacagaaatggactctgatattgcagcacttcttcccagatttatgggcctgaaggaggagctggagcgaatagcttctgaagagtaa

SEQ ID NO: 2662 - DNA, 570 bp, B.fragilis
ataatagttatggcgtttaagcgatctgtgtttctctttctgttggttgtttcttctacgtttttaggggtcgaaatagctcgtgggcaggtttattctttgcaaactaatgttttgggttggggtactaccaatatgaatcttgagttcgggctgaagttttcccatcgttggaccttccactttcctcttcaatataatcccttctcttttggagatgcgaggcttcgcaatttgtctgcttctcccggagtgcgttattggatccgtgaatcttatgggcgttcttatttccttggaattcacggagtgagcaccatgtataatgtcggtggagtttttggcgataaatatcgttacgaaggttacggttttggaggtggactttctttggggtacaatcgtcctctttctcctcattggaatttagagtttgaggcaggtcttggggtcttgtggacccattatgataaatatgtttgtaaggcatgcgggcagaaagtggctacttttaagggagcacgtctgattccgaccaagttggcagtgaatatagtctatttattctaa

SEQ ID NO: 2663 - DNA, 1179 bp, B.fragilis
ttgcataaaatgagcttattaaagaaaaagtatatgagatgtgtaaaaggaatatatatattctttttgctactgtcttttatctcttgtgaactggaagataaaataggaagatatacttcgggagacaatccggtagaagtagaacttatgactcgtaatgtcactttaggaggaagtgaatccggagtgactctgaagcgcttgcgtgtaattgctgtggcgaaaaacagtggaaaggtggaaatgaatcgccgtgccgatttaagtgatccttcatcatccggtttagagcatacagggggagtgtttaaactctatcttcgtccgggtgattacgatttgtttgtgatcggtaatgaaacgacgggcatgaattccgcattaaccggagagccatctttatcagaaattaaaagtgtaccggttactctacctgtagatacggcagagtttgtggtatgcaagcatctggatatccggataagaaatgcagcctcttcaactccggtcacaggggaagtcagtgtggatgaaggattaacctggaattcagcgttctcggttgagttggagcgcattgcttcaaaggcgagtctggagatacgaaaaaatacggatgaagatataaagatcaggcaggtcactgttaaacagttaccttcgttctcttttctttccccctctgcttatccgctttccggcgggcttacggttactgatacgcgttcgttttctacacctgtttctatcgccggagagaaagatgttccctcaggatatccgtatacatctgttgtacagggaaagaatagctttatcttgccggagtacatttgggataatacggcagggaaggggcgtgcttcttttatggaaatagaggctgaacgtaatggagcgtcagaaacatggcaaatattattgggaaagagtacggatattccggctgactactcacttgggcgtaacacttactatcgatatatgctgaccgtgaatccgctgaatgtcgatgtaaatgtaagtgtagaaccatggcagaatacgactgcttatgatacgattcccggagcaaagatcgttttctcacgggtcaatgtcggttattcgtatgcttctgagagtgttgttacgtttacaaccaaaaacttgcctcctgtatctgtcagcctatag

SEQ ID NO: 2664 - DNA, 273 bp, B.fragilis
tatatgatatttgtcgggaagaaaaacagcacttcgttttttctacttatttcactcattttaggactggctctctatacagccttatttagcagttgtgtttacgaggacttgagtaaatgttcacggatgtttatgttacagccacgttatcttttgcatacgggtgaaggcgatcgttttggagaagctgtccaccatatagatgtgtatgcgttcgactccctcggcatttatcggcaaaaatgtttcgggacaaaggagcacatttga

SEQ ID NO: 2665 - DNA, 201 bp, B.fragilis
tccgggtattccggcatatacagaatagaaacaatgcgcttcccttctctgataattgaaaaggcgtcttactcttttgcgcatatcattggggggcttgtcgtattcataaagaccgaatgtggagtaatcttggattttgacagtactccttttttacaggatgctatcatgcagaatcggatttttccgcctcgataa

SEQ ID NO: 2666 - DNA, 1332 bp, B.fragilis
tcactcgttaaacccatagacagtatgattaaactttatttcaaacaagcctggcaactgctgaaacaaaatcctttgttcagcagtgtgtacgtgcttggtacaggattaggcattgccatgaccatgagcttggtgatcatctattacatcaagatggcaccggtctaccccgaagagaaccggaaccgaatcctggtgagtaaagggatgactgcaatagagcaaggcaatgaaaataactggttcagttcgaatgtatcttttcagacggtgaaacgcttctattatccgctgaagagtgccgaggctgtggggtgttctttggacgggcatactacatcgctgcttgaactgtcggagagtaaagatctgaaagaggtacaggtgaaactggtagatgccggattctggaaagttttcagcttcgcttttgtagacggtaagccgttcacccgggctgattttgattccggattgcgcaaagccgttatttccgtgacgttggctcgccggctttacggagataatgctccggtgggccgtacctttgttctcgactcggacgaatatcaagtgtgtggcgtggttaaagatgtgtccttcattactcctgctacgtatgccgacatctggttgccgctgacggtagatgctgaggtcgtagaggagaaagagggtagttatgagttgattggaaatctgagtgtttatatgttggcaccctctgtcggttcgaaagataaggttgccggggaagtgcgggatgcgttccgtaaatacaatttctctcagaaaaaatacaaggtcgatttatatggacagcccgtatcttattggaaaagcactttttatgaatattgtaattcggcacccgattggggaaaactgatacggacgtatgggactatcctgctggctttgctttttgttcctgcactgaatctggcaggaatgatcgcttcgcggatgaaacgtcagctttctgaaatgggtatacgtaaggctttcggggcctccaaagcttcgctcctgatgcaggtcttttgggagaatctgtttcttacggggcttggagggttgttgggcttattactttcgtatctgattgtctattgcgggcgtaattggttaccagacctgctaagtgcatattcggatgtgatacccgagggagttgacagtttcttaactcccggtatgttgctgaatcctgtggtgataggcattacatttctggtcagtttgatactgaatgtgctgtcggctttgattccggccctgcatgctttgaagaaagatattgtatattcgcttaacgataaaagataa

SEQ ID NO: 2667 - DNA, 1278 bp, B.fragilis
atagctatgaacctgatgatgatactccgccaactgtggaaccagcgtgctgccaacggatggattctgggcgaactggtggttgtgacttatttcttatggggagtagtcgaccctgtgtacgtattattgtccgacaaggcattgcccgacaattacgacctcactgatacttacttgctgagcataggtgcatactctgccaatcataccagatataatccggagttggattcggactcattgaaacaggttgattttatgcgtattgtagatcaggtacgccgctatccgggagtctctgatgtgactgtcagctttttcaattcatatccgcaaagcggtacctggaatggaggacagcttttcaatgatacgatctttgcaaatatacagcagatgacatttctttccggcaccgactattttggagtcttccggatacatgatgcccggacgggagaaatacctccggtgcttgcggaaggagaacagggaatctatctgactcctgacgttgccgaaaaactgttcggtgaaaagtatccgcagaacaaatggatacattggggagacagtacccgtaaatctccgttgactgctgtaatcgatcccttgcaaatcaggagtatcagtcagcccggtccgttggtattcaaagctacttctgaattaatccatcttccgggagcggcccgcatctgcttccgcgtacgtgacggactggcatcaccagctttcaccgagacttttaagcgtgagatgcgtccgcggatgcagatcggaaactattatctggcgtcactcacggattttgaaacggtgagtaaacactttgagtattatatgggaactacgggcactatccgtttgcagatcatccttgcttcattttttctactctgtgtgttcttggggatgggcggtactttttggttacgttgcaactcacggcgggaggaaatgggaatttacatgacgatggggtctactcgccatcggttgatccggcaatttcttctggaggcctggtggatggttactattgcatttgtaataggagccttggcgcaattccaaattgtatatctcaatggttttgcatttgcgccggatgatccgaatccggattatatacagaatcgtccggtgttacacttccttattgtatcagccatttcatatattttgatcctggctgtttcgtttgtggctacttacatcccggtgtcgaaagctgcccggatgaatcctgcggatgctttgcgggacgagtaa

SEQ ID NO: 2668 - DNA, 342 bp, B.fragilis
ttgagagtgaaatgtgtgggaaacactgtggctttcgacaagtcgactaccgttaccaaagggtgcaatgtctcgagaccatacattttattatactggtctaccgagttgagcttgattacttcttccataggacatctggttgtttattctgtgacaaatgtaagaattttcattatatgtagtatgggtgaggagattaaaacaggaataggggtaaaaatatccgtaattagggttgtatcgtcggcatttttcctgccaatgtacccgagattaatagaacttttagttcaccaacgggcagtatgttcattttcggacacccaactctccgcttaa

SEQ ID NO: 2669 - DNA, 915 bp, B.fragilis
acaaccagatgtcctatggaagaagtaatcaagctcaactcggtagaccagtataataaaatgtatggtctcgagacattgcaccctttggtaacggtagtcgacttgtcgaaagccacagtgtttcccacacatttcactctcaattatggattatacgctctgttcctgaaacagacaaagtgtggcgatctgcgttacggacggcaaatgtatgactatcaggaaggcacagtgacaagtttcgcaccgggacaagtagtcgaagtaaagctaaacgatggtgtacgcccgatgtcacacggaatacttttccatcccgaccttatccgcggcacgtctttgggacaggaaatcaagcactactcgttcttttcatacgcatcgaatgaagccctgcatctttcggacgacgagaaaaagatttttcaggattgccttgacaaggtacaacaggagttgtcccgtccgatagacaagcatagcaagcgcctgatcgcaagaaatatcgaattgttattggattattgcatgcgtttctacgaacgtcagttcgtgacacgttcgaaagtgaacaaagatgtattgatgaagttcgaagacctactcgatgtctatttccaaagcgaacaatcgccaaacgaaaaattgcccacagttaaatatttcgcagacaaggtaaacctgtcatccaactatttcggcgatctgattaaaaaggaaaccggaaagaccgctcaagaatacattcagggaaaaataatcaatatagccaaagaaaggatattggcttcggaaaaaactgtcagtgaaatcgcttatgaactgggattccaatatccgcaacatttcacacggatatttaaaaaggtggtcggctgtacaccgacagaatatagggtcattcaggtatga

SEQ ID NO: 2670 - DNA, 1290 bp, B.fragilis
aacatgatacgactaataatgaaaaacctctgggcccgccgccggaagaacggatggttgctggccgaattaatattggtatcgattgtcacatgggtgattgttgatccgttggtggtgctgacacatgaccggaatttgccggaaggctatcgtcccgatcaccttttcctgcttcagttggcttcataccctgccgggtcggagcaattccgtgccgaagagaatgatacattggcgcgtaaagccaatttcgaacggttgctcaataaactcaaacactacgagggagtcaagtatactactttcatcttgaacgaacagtatccttcggcactttccataagcaacggcaacacgatgttcgataccattccggtccgcactctccgtcttgcctttatacctcataccgattatttccggaccatggggatggagggagccgagggtatgacggccgaacaattggataaccgtgatttcctgtggaccgaatcggtgctgacagcggatatctcacaacggctgaaagacggaaaaccgctttacggacgccgccttggaaacggggacgaggaagactaccgggtggggggagtgatagctcctgttcgctaccggagttatatgcagcccatgcccatagagttatatgtgtatgaagagtttcctgattatatgtactattatattccgctgatagctttgcgtatagacgatcatttgtcggagaagtttttcttgcatcacttccgtgagtggatgaataaggagttgacagtcggtaactattatgtgaagtcagtgcagtcgtttagcgacattcaggagcagcatgaattttccgagggtatcaccaatcagtatcgtctgaacctggctttgggtatcttctttttagtgaacctttgcctgggagtagcaggaactttctggatgcagacccgttcacgccgtgaagaggtgggcattatgctttctttcggcggtactccttcacacatcacccgcctgctgttatacgagggttggatactgaccacattgggtacgttgaccggctgcttactctatttgcaatacgcattgagggacggactttatactacctgtaacagtgcggaagaggcaatgcctgcttactggatcaaccacttcggcctgcattttacggcagttactctgatcgtatatctcttgctgctgattgtagtttccatcggaatctggatgccggcacataaacttagccgtatcagtccggtagatgcgctgcgtgacgaatga

SEQ ID NO: 2671 - DNA, 1284 bp, B.fragilis
aaagagcttatgattaagcaatactttaagcagtcacttgttcttcttcagcagaataagttgctgagtgttattgccattattggtacggcactggccattgccatgataatgtgcattgtacttatctatcaggcaagaacagccaactatgaaccggagataaatcgcgaccgtaccttatcgatcgagatgacgattgctcagaaaattgatgataaaggatggaatatggggaatcagttatcactgcgtaccattaaagaatgtttctatccaatgactacggcggaagcggtgagcgccgtgcactacagcatgacgtctttggcggctactcccgatggaacccgggaagtgaagtgtgcggtcagttatacggatgataatttttggcgtgtatttggtttccgctttctgcatggtaaaccttacgggcaggaatttgtgtccggcgagaagaaactggtagtgacccgctcgttggctcgtcgtctgtttggcatcgacaatgcggtgggacgtatcatttcattaggatttgtcgattataccgtctgcggagtagtggccgatgtgtcggtattggccgaggctgcttatgccgaggcttgggctccttatacggcattgccggattatgaacgtagtgtcagcgagggtctgcaaggaggatattcatgttatatcctggtacccaagggggccgatccggatgtagttcgaaccgaggcacaacagaatgtagaccgtatgaacgccaatcagaaagaactgaaattgctgcttggaggtgcgcccgacacccgcctgatgtctttggcccgtgataatccgtttgatgatccggatacatcgcggttggttctgatttatatcgtagtgattaccattctgttgttggtgcctgccattaacctgagcggtatcacactttcgcgtatgcgccggcggatggaagagatcggtgtgcgacgtgctttcggtgccactcgtggagaacttctccggcaggtgctcgccgagaatctggttgttacattgatgggaggtgtattgggactgattttgtcgtacatagccgtgctgtgtatgcgtgactggttgctcaatacttctatgtcggggtattatggagtggacactcaggtatccgcaggtatggtcattcaaccgtttgtctttgtttgtgcgttattgttctgcttgttgatgaatctgctgagtgcgggaattccagccattcgtgtatcgcgcaccaacattgtcaatgccattaaatag

SEQ ID NO: 2672 - DNA, 675 bp, B.fragilis
actaaagttatgattacattaacctctctttctaaaatctatcgtacaaacgagattgaaacagtagcccttgagaatgtcaacctgaaagttgatcgtggtgaattccttagcattatgggaccttccggttgtggcaaatcgactttactgaacattatgggtttgcttgatgcccctaccgcagggacaatagagataaacggtacacatacagagggtatgaaagataaagagctggccgctttccgtaataaaacgcttggttttgtattccagtccttccatctgataaattcacttaacgtaatggataatgtggaacttcccttgttgtatcgccacatagcttcttccgaacgtcgtaaactggcacaagaggttcttgagaaggtcggtttgagtcatcgcatgcgtcattttccgacacagctttccggcggtcagtgccagcgcgttgccattgcccgtgccattatcggtaatcctgagatcatccttgccgacgaacctaccggtaacctggactctaaaatgggtgccgaggtgatggaattgcttcatcgcctgaataaagaagacggacgcaccatcgtaatggtaactcacaatgaggaacaggccggacagacttcacgtaccgtccggtttttcgacggacgtcaggtacagtaa

SEQ ID NO: 2673 - DNA, 1206 bp, B.fragilis
atagaagaaatcatgataaaacatttattgaaacagatatgggcccagcgctctgtcaacgcctggttgtggtttgaactgatgattgtctcagtctgcctgttctatgtaatggactatctgtacgtacccggaagattgtatgcccctccgctcggttttgataccgagcacgtttatcgggtaaaactagcttcgatacctcccggaggaaaggaatataaacccggtgatactgatagcttgaagatagaacaatggttctccatcctttcgcgcctcagggcttatccgggagtagaggccgtatcgctgagtattggttcgcatccttacaatcaaaacagttccagcggttcaagggggatagataccacttgggtacacggatatgtgtataatgtatcacccgattatttccgggtattccgcatcactgacaagcagggaaaaaccgagtcacttgtacaggcggctaatcaggaaaacacatggatcatttctgccgaaaccgaacgtgagttttccgctaagggaaccgatgcactgggtaaaggagtgaagaattggggagagacagaaccgacacataccattcgcggtatatgcaataccatccgctttgatgatttttatccgctttaccctacttatatcgaatgtcattcggaggctgctttgttagggaggagggggaataatgcggagttttgtgtgcgtgtccgtccggatgcggatggtgtggactttccgtcccgtttccgtaaagatatgaaggtacagcttcgggtcggtaatttttatcttctggatattacctcttttgacgatcttcttgagaactattaccgcagcaacgggaagataaatgatgtgaaaacccggattgccgctttaggcttcttcttgctgaacattctgatgggagtgatcggtacattttggatacggacacagcaacggcgttcggagatgggacttcggctggctttgggatctacccgtgcgaacctcagaagtttgctgatcggtgaaggggttttattattaatactggccacggtgccggctgctgtcataagtctgaatcttgcctttatggatttgctgaccgatacgatgccggttgttaccgtcacccgtttcctgattgtgcaggctatgacgtttgtgtcgatagttgtcatgatcgtcatcgggatttga

SEQ ID NO: 2674 - DNA, 648 bp, B.fragilis
agtcataaggtcggtacttatgtcgtttacttcaaggttcgtcagaaagaagatatgccgaaactttatgcggaagtcaacgaactggtgcgtaaatacaatacttcccagaaagagtatacagtagatatctttcatcaaccggatccgtattggcagacatggttcagagagggcaatacgaacgagattgactgggcatcggtcattaaactgtatggaggggcgcttttggcgttgttgctggtgcctgccatcaacctgagtggcatgatatccagccgtatggacgatcgcctggcggaaatggggatacgaaaagcgtttggagccaaccggaaacaattgttgaaccaggtgttatgggagaatctgcttcttacctgtatcggtggattgatgggacttattgtttcgtggggactgcttgtgctggggcgcaattgggtgtttagtctgtttgacaaatatccgacagtcatatccgacggagtcgatgtggctatcaatccgcaaatgctgttcagtcctttgatgttttgcgtaacgtttgctttttgtttgatactgaacctgctttccgcatggtggcccacatggcgttcgttacacaaagatattattgattcactaaacgaaaagaaataa

SEQ ID NO: 2675 - DNA, 246 bp, B.fragilis
tgtaaagcctcaaaacaaaaagacaaaaaattcttctcaggaaagaggtgctcattattaatattaaataatgctcacctatatattatgaatggaataaaagtggggtatagttctcacggaacttggaaaaaagtgataaatcggcttttatataacttcgaaccttctgattcgtcctttttctttattatttcacctgtacgggtagtcgtattggtccgggaagctgattatgttaaatga

SEQ ID NO: 2676 - DNA, 402 bp, B.fragilis
tcctttcactccatcatgaagaatacattctgcgttttagcctgttttttcattacaatcttttgccaggcgcaatcggttgaagaacattattattttaagaacctgagtatccgaaacggtttgtcacagaatacggttaatgcgattctgcaggatcggaaggggttcatgtggcttggtaccaaagatggcttgaacaggtatgacggattgtcttttcgtaagtttaagcatgatgctgctaatccacgcagcattggaacagttttatcacttcgctttacgaagatttcaatggtaaacatttggtcggtactgatgcaggagtatatatttactatcctgagaaggaggcttttgaggaattcgattgccagagcttggagaagacaaggatag

SEQ ID NO: 2677 - DNA, 384 bp, B.fragilis
gaagcaagatttattataagtcttctgatgtggaaagaattattgcggatagtgaaacacaaaatcaatcactcaaacaagccacgccttatgaaaagaactaaagaaaattatccgtctttcaacctgttttccattgttggcacatgggaaagcattaatctgaatcctacggttatcatctaccggaacgacaacgattatcttctctctattatctatgtatcggaaaccacaaaacaggcttcacctgccacttatgaaatacagaaagaaggtagtctgtattttatagctcctgctcctaaacgggtttatatagattatgatccagtgaaagatgtgcttaatctttcatcacttggtgactatctgcgaaactaa

SEQ ID NO: 2678 - DNA, 324 bp, B.fragilis
agtgatatgtctacaattgaattgacagaatgggaattggctatcagggagcaactaatcaaagcggcttctgagggcaaaacattgtattattccgacttagtgaaagaaaaagatgtttctcttgtacgcagcctggggacagtattagaaaggattactcgatacgatatagagaacaagcaaccgatcttagcatctattgctgtgctcaactccacaggcttacctagtgagggattctttgagttatgcgatacgttggatattagtgctcgtttgagtgatttgcagcaaagctgctttgagtattggaagcaatga

SEQ ID NO: 2679 - DNA, 612 bp, B.fragilis
aacattcagtctccaacaaaaaaatatatggataaatttagttatgcaattggtctcggaatcggccagaatttgttaggaatgggtgctaaaggcatcgcagtagatgactttgctcaagctataaaagatgtgctcgaaggaaatcagacagccatcagccatcaggaggctcgagaaatcgtaaacaagtatttcgaagagctggaaaccaaaatgaatgcagcgaacatcgaacaaggaaaagcattcctcgaagaaaacaaaaaaagaccgaacgttgttaccctgccaagtggactacaatacgaagtaatcactgaaggtacaggcaagaaagcacaggctaccgaccaggtaaaatgccactacgaaggtaccctgattgacggaaccctgttcgacagctctatcaaacgtggacagcctgccgtattcggtgtaaaccaagtaatcccgggatgggtagaggctttgcaactgatgccggaaggttcaaaatggaaacttttcatcccttctgaactggcttacggcgcacagggagccggtgaaatgatccctcctcacagcacactcgtgttcgaagtagaattaatcgaagtattataa

SEQ ID NO: 2680 - DNA, 1500 bp, B.fragilis
ttaaaaaagtcgatagcttttgccctactactcagaatgttctatctttgcaccactttatattttaaacaatttacatttatgtccacagaattattctctaccctgccctacaaagtggcagacatcacgcttgccgacttcggtcgcaaggaaatcgacttggcagaaaaagagatgcccggccttatggctcttcgcgaaaaatatggagaatccaaaccattgaaaggtgcccgtatcatgggatcactgcacatgactatccagactgccgtcctgatcgaaacactggtagccctgggagctgaagtgcgttggtgctcttgcaatatatattcaactcaagatcatgctgcagcagctatcgcagcttcaggtgttgccgtatttgcctggaaaggagaaacattggcagattattggtggtgtaccttgcaggccctgaactttgaggggggcaaaggaccgacagtgattgtcgacgatggcggggatgccactatgatgatccatgtaggttacgaagcagaaaacaatgctgctgtattggacaaagaagtacatgccgaagacgaaatagaattgaatgctatactgaaaaaagtgctggcagaagacaaagaacgctggcaccgggtagcagctgaagtgcgcggagtttcggaagagacaacgaccggcgtgcatcgcctataccagatgcaggaagaaggcaagttgttgttccctgccttcaacgtaaacgactcggttaccaaatccaaattcgacaacctgtatggttgccgcgaatcattggcagacggcatcaaacgtgccacagacgtaatgattgccggcaaagtagttgtggtatgcggttatggcgatgtaggtaaaggctgttcacactctatgcgttcctacggagcccgggtgctggttacagaggtcgatcctatctgtgcactgcaggctgccatggaaggttttgaagtagtaacaatggaagacgcctgcaaagaaggtaacatctttgttactactaccggtaatatcgatatcatccgtatcgatcacatggaacaaatgaaagatcaggctatcgtttgcaacatcggccattttgacaatgaaatccaggtagatgcactgaaacattatccgggtatcaaacgtgtcaatatcaagccacaggtagaccgctattatttccctgacggtcacagtatcattctgttggcagacggtcggttggtaaacctgggatgtgccacaggacacccgtcattcgtaatgagtaattcattcaccaatcagacattggcccaaatcgagttgttcaacaagaaatacgatatcaatgtatatcgtttgcctaaacatctggatgaagaagtagcccgcctacaccttgaaaaaattggtgtgaagctgaccaagttgactccggagcaggctgcctacatcggtgtgtctgttgacggtccttacaaagcggatcattacagatattaa

SEQ ID NO: 2681 - DNA, 363 bp, B.fragilis
aaaatatttcctgcaattcattgtgggataaaagataatgcctatctttgcacgctcaaagaaacattttatagatcaataattttattaattatgtatttagacgctgctaaaaagcaagaaatcttcagtaagtacggaaagtctaacactgatactggctcagctgaggcccagatagctttgttttcataccgtattactcacctgactgagcacatgaagctcaacagaaaagattatagtacagaaagagctttgactatgttggtaggtaaacgtcgtgctttgctcgactacctgaaagcaaaagatatcaccagatatcgtgatatcatcaaagagctcggcttgcgtaagtaa

SEQ ID NO: 2682 - DNA, 1599 bp, B.fragilis
aaatctgtgttatctgtggtgaagttaaaaccaaatgaactcgaaacaaacccaagaatgaatcaaaaaattatttatagtagtgcattacttgtcggattaggcagcccgcaagcatttgcccataaagaaaaggcccatacccctcaaaaaccgaatatcatctttattatgtgtgatgatatggggtatggagatctgggttgctatggacagccatacatcagcacccctaatattgacaacatggcccgtgaaggcatgcgctttacgcaagcctatgccggaagtccggtgagtgcaccttcgcgcgcatcgttgatgaccggacaacataccggacattgcgaagtgcgtggtaataaagagtattggactcaggcgtctacagtgatgtatggcgataataaagaattttcagttgtcggacaacatccctatgatccggaacatgtcattctgcccgaaataatgaaagataacggatatacaaccggtatgtttggtaaatgggcggggggatacgaaggctcggcgtccactccggataaaagaggaatcgatgaatattacggatatatctgtcaatttcaggcacatctctattatcccaattttctgaatcgttatagtccgtcgttgggtgatacaggtgttgtacgtgttgtgatggaagagaatatcaaatatccgatgtacggtccagattatcataaacgtactcaatactcagctgatctgattcatcagaaagcgatggaatggatcgagaaacaggatggtgaacaacctttcttcggaatctttacctataccttgccgcatgcagagttagtgcaaccggaagactctattttgaatcattataagacacagtttgctgatgacaaagcttttggtggtcaaaaaggatccagatataacgccattacccatgtgcatgcacagtttgcgggtatgatcacccgtttggactattatgtgggcgaagttctgaagaagttggaagagaaaggatttgatgagaatacgattgtcatctttaccagtgataatgggccccatgaggaaggcggagccgatcctactttcttcgggcgtgacggaaagttacgtggcttgaagcgccagtgttacgagggaggtatccgtgttccgtttattgtccgttggcccggtcaggttgctgccggaacagtgaatgatcatcaatgtgctttctacgatgtcatgcctaccttgtgtgatttgacaggcgtgaagaacttcacgaaaaaatatgtgaataagaaaaaggaagcggattattttgatggtatctcttttgctccgaccatactgggtaaaaagaaccagaaaaaacatgattttctctattgggagtttaatgaaacgaaccagatcggtgtacgtatgggagactggaaaatggttgtcaagaaaggtactcctttcctttataatctggcgacagatatccatgaagatcataatgtagctgccgaaaatcctgatattgtgaagaaaatggttgggattatccatcagcaacatacggaaaatccaaatttcaaggtaacattacctcctactatgtaa

SEQ ID NO: 2683 - DNA, 183 bp, B.fragilis
tcaacatctacaccctttaacggactattccgtcagtccgcggcgttgtcactcctccgtctccacatcactcctacaggtagtacaggaatattaacctgttctgccatcggcctcaccgttcggctgagccttaggacccgactaaccctgatccgattagcgttgatcaggaaaccttag

SEQ ID NO: 2684 - DNA, 1359 bp, B.fragilis
ttttatttcacatttaattataagattatgagtagtaatagtacaaatatagacccagcaattctcactagtattttaggagaaaaaagagcaagtgaaaaatatgctaaactaggcattaaatataatccattccccaggtctggtaccactaacataaatgggaatgatatatacaatagattcatgattcctattgatccagttgtattaggacagttaaatatgtttatttccaattcactagcaaataatgagatagacaatactgacaaatttataagtgcaacagtattgggtaattatgggagtggaaaaactcagcttctaatgtatactcgatttctattaaatatgattgctacaagctctgattatgaggcaactccatatgtgatatatatagataaccccggtgttagtttattggaatttatagggaatataattgccagaatcggagaggaaaatcttagaaaatatttatggaataacatcattaatgttattgacaatgagtatgagtataaaaatatactattgccatatgtaaataatacaattcttttgtttgatacagaaaacaaagacccttttgctgcagaaaacagagttagctacaaacaattcctcactgtctttactcaaaacatcacaacaacagataaaagaaaaaaatttgatttagaattcaggaatctactacttaaagtattagattactacactaaagattctgtggtttcgtattatttttacgaattcatttcaggagattatggcgttaataaaacttgggaagccttaacaagtggctccttgaaacagctaaaaggcaaggaagcacgtgttattaaatatattgtaaaattagtaaaagagcaaggatttagcgacttcttcatacttgttgatgaatttgaagatataacagaaggacgtctcactaaatctcaaatagataattatgtatacaatctgcgtaccttactagacgaacaaagagaatggtgcctaatgttcacaatgactccattagctttgaaaaagcttaggagtgtttctcctcctctcgctgatagaatttcatctagagaaatatggttgcaagatttaaataccgaacaagccatctctattgtcaaaaactatatgacaattgtagaacacgactccttgctgccttttacagaagatggtatagcatatcttgtagacattgttgatggaaatattagacgctttctaaaaatgtgctttaggctaatcgaagaagccgctctaacattcacctcaccagataacaagattaacaaagcattcatagaaagtcaaaatttattagaacaggaatcataa

SEQ ID NO: 2685 - DNA, 342 bp, B.fragilis
ccgcataccacaactactttgccggcaatcattacgtctgtggcacgtttgatgccgtctgccaatgattcgcggcaaccatacaggttgtcgaatttggatttggtaaccgagtcgtttacgttgaaggcagggaacaacaacttgccttcttcctgcatctggtataggcgatgcacgccggtcgttgtctcttccgaaactccgcgcacttcagctgctacccggtgccagcgttctttgtcttctgccagcacttttttcagtatagcattcaattctatttcgtcttcggcatgtacttctttgtccaatacagcagcattgttttctgcttcgtaa

SEQ ID NO: 2686 - DNA, 237 bp, B.fragilis
gtgcgctcaaccagtgtaccttttaagtcgagcatcatcacagaattcttctttaccacagtttctgtatccgatgacgaaatgattccgacaagcgttacgactccgataatgaataaaacaatgcccgataacacgatgccggtcactgtagcaagcgtaaatttaaagaaatctttcattgtacatattgtttttatgccagctcttttaaagctaacaaagataaataattga

SEQ ID NO: 2687 - DNA, 990 bp, B.fragilis
atatatagaaccatgcacatagattttgcaccaccatcaaaaggtacatacaacaatgcaggtagcagccgtcaattagcttcatacatggaacatgaagacttggaacggatggaaaaaggaatctataccgatggctttttcaatttggtagatgataatatctataaatcaatggttataaaagatatagatagtaatatcgggcaactcttaaaaacggatgctaagttttatgccactcacgtcagcccatcggaaaaggaactccgagcaatgggtagtacagagaaggaacaagccgaagcaatgaaacgctatattcgtgaagtgtttattcctgaatatgccaaaaattttaacaaagagctatccgcctcggatataaagttttacggaaaaattcattttgatcgtaaccgttcagataacggactgaatatgcactgccatttgattatcagtcggaaagaccaagccaacaagaaaaagctatctccgcttaccaatcacaagaacaccaagaacggagtaataaaaggtggcttcgcccgtgtgaatctgttccaacaagcggaacaaggctttgataaattgtttggctacgaccgccaacaatcagaatcgtttgactatcacaacacgatgaaaaacggttctatatcggaacagactaaactacaagagcaagatattcaatccagtgacagaaaagcaggaatcaatcaaggtagcaatcaagaaaacttgctttctatcaatcttgtaaacaagagaataaacaatcaggcttctagtatagatacacatattgtcatcaaacagaaagacaatgcttatagcacttcatctttcaatcaagaaactaatcaaatattcggttcattcatttcttccgcagcgcaagatattagatcatcatccaatcatgaagaccaaacactaaagtctaagaagaagaaaaagaaagaaaggataaacaaactttag

SEQ ID NO: 2688 - DNA, 195 bp, B.fragilis
ctgcagatgacatgcttgttcgatacaacatcaaagaactactggaccagcttccctaacggcttttcttcttcatataacagccccatactctgcattgaattcaacgaagagtatggggttattattcaaatcatccatcttatttataaagaattcctcagaaagtcgttatctttgcacgttcccaagtag

SEQ ID NO: 2689 - DNA, 2049 bp, B.fragilis
aatgaaaagacccttatgaaaatgattttaaagacaatggtgtgtctggcagtagctttttccggaactgcaggggcagctaattattctccggaaaagtcacaagcttctttggcacttaaagtcccggggaatccggctgtggaatatccgcttactctcagtaaactatcggatagttatttcgattatgagtggaaagcaaaagagaaaataccggtaactatctttcagcagatatcaactgtggatgataaacagcaggtaacggtggttctgacggctatggaagatgtgtacttcaattttgaagagcgaatcagaacggattttcgtcatgatgattgccagttttatttgccaggtttctggtatcgtcgtaatttacgttcacctaaagaggctccatcgtttcatacttccgatagctgggtagtgcgtgaagatagattgagcacgcctttgaccggtatttttgatgaaaaacaaaagaaatacatgactgtggtccgccgggcagaatatattcaggacgctttgagtactcataaggaaggtgaggtgattctttcgggaactacttcactcggtttcaccggatttgaaaatctggatggaacggctgctttggcatttggttttccgtataaagaggctccaaaaacctatattcgtaaacttacacttgcaccttcagtcactgctttccaactattaaagaaaggagagagtatttcactaacctgggaaattcatgaaggaaaaggggaggattttgccgagtttgtaagtcatacttgggaatattgctatgatacttttcaaccgaaacctgtggaaacggattatactcctgattatactaaagagattcttagccatttttttattgagagttttgtaggtgatcgtcctctgaactataattcaggggtacatatgcgtactgatgattgccaaaatacaggttcggcagaggttggttttgtgggacgagttttgctgaacgcatttaatgcctgggaatatggctggaagaataatcgggctgatttaaaagagaatgcagcgaaagtctttgatacttatttggtgaatgggttttctcctgcaggttttttcaaagagttcgttgactaccgtaccggttatgaggagacggtatttagcattcggcgtcagtccgaaggtatttatgctatatttcattatctggattttgagaaaagaaacggacgtaaacatcctgagtgggaagcgaaggtacgtaaaatgcttgatgtattcctgcagttgcaaaatccggaaggaagttttccccgtaaatttaaggatgatctttctattgtagataagagtggcggaagtacaccatcggctactctgcctttagtgatggggtataaatatttcaaggataaacgttatctggaaagtgctaaacggaccgccgaatatctggagaaagaattaatctctaaatcggattatttttcgtctactcttgatgcaaactgtgaggataaagaggcctctttatatgcggctacagctacttattatttagctttggtaagtcagggcaaagaacgtgaacactatacgggattgacaaaaaaagcagcttattttgctttgtcatggtattatttgtgggatgtaccttttgcgcccggacagatgttgggagatattgggctcaagacgcgcggatggggcaatgtatctgtggaaaacaatcacatcgatgtgtttatctttgaatttgcttctatactaaattggctttccaaagagtatagcgaacctcgtttctcacagtttgccgaagtaatcagtacttcaatgcgtcagttactcccttatgaagggcatctgtgtggagtggctaagtgcggatattatcctgaggtagtgcaacataccaattgggattatggcaaaaacgggaaaggatattataatgatatatttgctccgggttggacagtagcttctttatgggaactattttcaccgggacgtgcagaacagttttttctgatataa

SEQ ID NO: 2690 - DNA, 972 bp, B.fragilis
ataaggtatttcaagatgaaaactgatttcatacaaatagccagttatgcttccaaagctccttcgggacataacacacagccttggaagtttcatattacggacagtactattacggttctccccaacttaaatgtagcgttacctgtcgttgatagaaacaatcgtgagttatttattagcttaggctgtgctgttgaaaacttatgcatcgctgccagctattttggttacactacccatataatagaatgcagtatagaagcgattattcttgaattaacgaaaaatgacctcacaattgaagatcccctattccatcaaattgagaaacgacagacaaaccgcaatatctataatggcaataaaatatcaaatggaattctacaacaacttcaatccattccgaaagaaaatggtattcaattctactttactgaaataaatacgccatttgcaaatacaataacccaatacataatgaaaggaaatgaaattcaaatggctgatattgctttcaagaatgaattgctttcgtggatgaggtttaataaaaaacaagttgaggctacacataacgggctaagttatttggttttcggaaatccaccacttcctagaatattagcacgtcccatagttagcttattcttaaaacctaatgcgcaaaacaaatcggatagaaagaaaatagattcttcctcgcattttgttgtatgcaccacacaacgagatacaatcgaagagtggattaacttggggcgaacgctccaacgctttctgttaaaagtaactgagatcgggattgcttatgcttttttgaatcagccgtgcgaagttgcggcattagcttttgacttacgagagaaattacctgtcaataaggaacacccaacattaataatgagaattggttatgcaaagcaaatcccttattctccccgtaaaaagattgaaacattactagtctaa

SEQ ID NO: 2691 - DNA, 786 bp, B.fragilis
atttgtaaggccttctttcacgtttcttttgagaggtggggagtgaggccggtttacttaaaaataaaagctagtatgaaaaatctggttgtattgtcaggcgccgggatgagcgctgagagtggcatcagtacctttcgtgatgcaggaggattgtgggatcgttatccggtagaacaagtagccactcccgaaggttatgcacgcgaccccgaactggtgacccatttctataatgaacgccgcaagcagttgctggaagtggaaccgaatcgcgggcatgaactgctggccgaactggagaaagatttccgggtaacgattgtgacccaaaacattgacaacttgcacgaacgggccggtagcaggcatattattcatttgcatggagagttgacaaaggtctgctcaagccgcgacccaaacaatccgcattacattaaagaactgaaacccgaagaatttgaagtgaagataggtgaccttgccggagatggttcgcaactccgcccgtttattgtctggttcggtgagtccgtaccggagatagagacggctatcgattgggtggagaaagctgatgtttttgttatcatcggtacgtccatgaatgtgtatccggcggcggggctgcttaactacgttccccgaaacgcggaaatctatctgattgatccgaagccggtggatgtacatagctcccgtccgatacatgtcattcagaagggtgcatcggaaggagtagctgagttgcgggagagacttcttaccacaaaccatgcgtga

SEQ ID NO: 2692 - DNA, 789 bp, B.fragilis
aagtacctttactgtatgaataaaatgaatgtagccattatagaagatgaaattccggcagcccgtttgctacattccatggtatccggacttcgccctcaatgggagcttactctgataccagggagtgtagacgaagccgttgcctggtttgacgagcatccgcatcccgatctgatctttctcgatatacatctggcagatggcaatgcttttgatttcctctctgccgcacacccttcttccgtcataattttcactacggcgtatgatcagtacgccattcgtgcatttacggtcaatagtatcgattacatacttaagccgatagacgaaaaacgcctgtcggatgcaatcactaaatatgagagcttgctgaccaatgctgttcccaggccggaagattacttaggtactctgtttgaggcacttcaatacaaagagaaacgttaccgtacccgttttcttatttccggagtagatcgtttctggtcgttacaagtggcagatattgcctatttttattccgagaacaaagtaacgtttgctgttacccgcaaaggtcaggaacacattctagatttgtctttaaacaaactgatggaacaactcgatccggagcgtttctttcgcgccaaccgccaggttcttgtctgcattgatgccattgaccatgccgagcctttctttaacggaaagatagtggtaactgtgcgccctccttataaacagaaaattacgataagcgaggagaaactttcagcttttaaactatggctgaatcattga

SEQ ID NO: 2693 - DNA, 1062 bp, B.fragilis
atacttccttatcataaaataagatatatgagaacagagatagcaaccttaggtgaattcggactgatcaagcatctcaccgaaggaattaaattagaaaatgaatcaagcaaatatggagtaggcgacgatgcagccgtcctctcctatcctgccgacaagcaagtgttggtgactaccgacctcttgatggaaggtgtacatttcgacctaacctacacgccgttaaagcatttgggatacaaatctgctgtggttaacttctccgacatctatgcgatgaatggaacgcccaaacagattacagcttcacttgctctctccaaacgcttcagtgtggaagatatggatgaattttactccggactccgtctggcatgccaacaatataaagtcgatattgtaggtggtgacaccacctcttctttgacagggtttgccatcagtatcacttgtattggtgaagccgacaaagataaagtagtttaccgtaatggcgccaaagataccgacttgatctgtgtcagtggcgacttaggtgccgcctatatggggctgcaactgttagaacgcgaaaaagcagtctttaaaggcgaacaggatgctcagccggatttctccggaaaagagtatttgttggaacgacagctcaaaccggaagcccgcaaagacattattgagaaactgtccgccgcaaacatcgttccgacttctatgatggatatctctgacggactttcttcggagctattgcatatatgtactcaaagtaaagcaggttgccgtgtctacgaagagcatatccctatcgattatcaaactgcagttatggcagaagagttcaatatgaacctcaccacctgtgccatgaacggtggtgaagattatgaacttcttttcactgttcccattgccgatcacgaaaaagtatcggaaatggaaggtgtccgcctgatcggacatattacaaagcccgaattaggctgcgcactgatcacacgcgatggtcaggaattcgagttaaaagctcagggatggaatcccctacaggaaaataaataa

SEQ ID NO: 2694 - DNA, 1323 bp, B.fragilis
aaagctaattacgaaggtggatatcgaattaatattcttatctttgcatatattaaaaagataaaaatggattttttacattcagaaataggatcagccaaggacaacttttatagccctgttcataattggtacaaatttaccgcagggttctcatacaaatttgtcgaagcaatattagaaggagaaaaaaactcccagaatattgtatttgagccttttgcaggatgtggtactactttagtgtcatcacaaaaatgtggggtaaaggccattggaaatgaaggacaagaatttatgttagatataataaaggctaaattatattggaacatagataagacagaatgtattaactctctaaactacattgattcatacatcaaagaacatctaactaattttagtatggaagaggtacatccactgcttagtactctgtatgacaatgaaacactcaaagtattatatttaacccgtgatagccttgatcatatatccaatgataaaattaggctctttttaaaattagcattaagccaaactatgcataaggtaggcttatatccgatagcagtaccatatatttcaagaactaaacgtatggccaacagcggacatgcatttgcaagatttcaatcaatagtattacagatgttagaagatataggaccacttcaaaacatagagcaaacatcagaaatatatcttcatgactcaagatttgaaaatccgaatattggtgattctatatgtaactattgtataacttctccaccctatcttaataatttagattatggagaagtttcaaaagttcacactcatttttttggtcttacagaaaactggaatgatatcacacagaaagtaagaaaaaatctagtcacaggagcaacaacacattatagagatatcgactttgacataaacatctttaaagaaaacgatttttcaaaagaaaatcaacttgtttttgatgaactttttaccagctatattcaaattatggaaatagcaaaaacaagaaatggaaaaaaaagtttcaatatacttatgatgcactacttcgaagatatgtattatgtcttaaaagagatgagaagagtattaaaaaagggatctaaagcatatcttattttaggagattctgcaccatatggtatttatattcccactacagaattgttgggaaggattgcttacagtgtggggtttaataaatatcatatttataaaataaggactagaggtacaaaatggaagagtctcaaatatagacataatattgaattatcagaaaacgtacttgtattggaatag

SEQ ID NO: 2695 - DNA, 504 bp, B.fragilis
acgcgaattctatatatgaaaaagaaaaacgaacaatggctacgatacagtaatcgggcgctttcaggattacttatgttgtttggatttgtgtcttgtgacaatggaggtggagatatacctgtagaatatgggatgccttctgctaaatatcgggtgaagggcaaagtgattgatgcggatacgcaggaacctgtaccgggtatagaagtggtcaccggagctgtgcatacgggcgatggcaaagaatggctcagttatccggatacgttgatcactgataaagatggagcttttgctactgaaaggacggagtttccatctaaaaaatatcgttttatcgttcgcgatgtggatggtgatgccaatggtacttattctaaggatagtgtcgaggtagaagccggtggatttacaggtggcagccattggtaccgtggagaaacaagtattgataaaacaattgaaatcaagaaggagacagcaaaagacaatgaaaaataa

SEQ ID NO: 2696 - DNA, 339 bp, B.fragilis
agcaaaatgtatatagacaacgaaaactttgagaaatggatggagaagctatctaagaaactcacagaaatagggaaagacttaaaatccctaatcaataccgataaagtattagatgataatgaaaagatactcgataatcaggatttagcctttcttctgaaagtatctttccgaactcttcaacgttatagagtaagtgggctactaccattctttaccatcggaaagaaaacttattatcgtgctggtgatatccggtctttcgttcgtgaacgtgctgatttccaagcctacaaacagtttgaaaaagccaatcaattagagaatcagccttga

SEQ ID NO: 2697 - DNA, 699 bp, B.fragilis
aaaaaagatttatctttgtgcttagaaatactaagcattacaagaaaaaccatgaatatgaacaaaaaaataatgcaaaagggttggctttatgagtatgaggttggagaagaatatcgaaggaattataattgcgagcttactgatgtgcgttatgtgttgggcgaacaattcgatatggacaagcagagtgcgctgatttgcataggtatcaatcccagtatggcaatgcccaacttccttgacccgactttaaagagggtacaggagtatgcaaaaaggagtggcgaatacggggcatggtatatgttgaatgtttatccccaaagagcaaccaaccctaataatatggatacagatgataattataacatggagatacatttgcgcaatcttgtagccataaaaaaaatgttatctaccattgataatgcagatgtgtggtgcgcatggggagcaaccataagtgatcccaaacggacatacctgtctgatctgttattcgggaatgaaaataagaatatacagggtataatcggcttattcaatgggaattatcattttaaagcatacggagctaccactaaaggttatcccaagcaccctcttttaataggaaaaggagccaaattgaaaactctaaatgaagtggaactaaaagaattatcagatagaattactaatataatcaagaaataa

SEQ ID NO: 2698 - DNA, 543 bp, B.fragilis
caaagcattcatagaaagtcaaaatttattagaacaggaatcataatggaatcttggagtcaaacaccaataaaagattttaaagtatcattttttcttgatacaaacatcttgtgttatctagttgatagtacatatccaaatctaaataaatttattaattatttaggtaacaatcctttttctgatgtcatatcatctgattatgttttgttagaattcattggaataaggaaaagagaacactatttgagagctgtattaaaaaaaggagagcaagatggacaaagcgtaaatctaagttcacttttgaaatttcataatcaatactctgccccagaggtggattttattagtattataccacaaataaaagaaagtgtagatcacgatgaagaagaaataacaactcaatataatattgattttaattgcaaatttcatatagacttatttgaacctacaaaaaacatttgtttagtatccctaaaatccgcaactatcatccaatacacgattaagggtagatttatgagtcgttag

SEQ ID NO: 2699 - DNA, 1842 bp, B.fragilis
atttcaactcaattatttatctttgttagctttaaaagagctggcataaaaacaatatgtacaatgaaagatttctttaaatttacgcttgctacagtgaccggcatcgtgttatcgggcattgttttattcattatcggagtcgtaacgcttgtcggaatcatttcgtcatcggatacagaaactgtggtaaagaagaattctgtgatgatgctcgacttaaaaggtacactggttgagcgcactcaggagagtttagaaggtttactgggtaaatttaccggtgaaacagccgatacatacggactggacgatatactggcttcaatcaagaaagctaaagaaaatgataacatcaagggcatttatatacaagcctcatggctgaatgcttcgtacgcttcgctacaggcgatacgtaaagcattggatgactttaaggagagtggcaaatttatcgtagcatatagcgacaattatacgcaaggactttattatctttcgagtgttgccgacaaggtgatgctcaaccccaaaggcatgatcgaatggcgcggactcgcttcagcacctattttctataaagatctattacagaaactgggaattgagatgcaggtattcaaggtaggtacttacaagtcggcagtggagcctttcaccgccacagagatgtctccagccaaccggaagcaggttacagctttcatcggttctatctggaatcaaatattggatggtgtttccgcttcacgtaaaataggaaaagattcactgaatatgtatgctgaccgcatgctgatgttctatccgtcagacgaaagcgtaaaatgcagactggccgacacgctgatttatcaaaatgacgtacgcgactatttgaaaacacttgtaaaaatcgacgaggacgatcgcctgcccatcttaggacttgaagagatggttaacattaaaaagaatgttcctaaagacaagagcgggaatattctggctgtttattatgcttccggtgagataaccgattatgccggatcagcagcgtctgatgaaggtattataggtagcaaaatgattcgtgacctgcgtaaactgaaagaagatgacgatgtaaaagctgttgtattacgcgtaaactctccgggaggaagtgcttttgcgtccgaacagatctggcatgccgtaaaagagctgaaggctaagaaaccggtcatcgtctcgatgggcgactatgccgcatccggtggatattatatctcttgtgctgccgacagtatcatagccgagccaaccactctgacgggttctattggaatcttcggcatgattccgaacgttaaaggattaaccgaaaaaatcggattgacatatgacgtagtaaaaaccaatcaattctcagacttcggcaatctgatgcgcccggtaaacagcgatgaaagagctttgctacagatgatgatcggccaaggatatgatttatttgtaagtcgttgtgccgaaggacgccatatgtctaaagataaaattgagaaaatagctgaaggacgtgtatggaccggagagatggctaaaaaaatcggattggtagacgaattgggtggaataggtaaggcactggaaatagctgcacaaaaagccgatttaaaaggatacaccattatatcctatcctgccaaaaaggatattctgtctacgttgcttgatgtccaccccggtaattatgtagaatcccaagtgctgaaaagtcaactgggagactattataaagatttcagcctgctgaaaaatataaaagaacgcgccatgattcaagcacgcgttccgtttgaactgaatgtgaaatag

SEQ ID NO: 2700 - DNA, 3537 bp, B.fragilis
tcgtataatcaaaaaatgaaagacatgagactatgttttagcgtctgtaacaggcgttttctgacaggcgtaattatgtttatgctcctgtatcctatgtccgtttttgccgtgcaaggacagatagccgtgcaaggaaaagcaatgagcattaaacaggctattcaagttattgagaagaacagtaaatatacgttcttctacaaggcggccgatttgagcaatgcaaagatccgtgacatccattgtgaaggttccatagaggaagtgctgaatgttttgtttaaagatagcggtatcagctatgttatcaaagacaatgaggttattctgaagagtaccccggtagtggttgcaacgccacaacagagtaataagatcgttgtgaaaggcaatatcagggatactttgggtgaatcggtcattggagctaccattatggagaaaaataatgctcaaaatggttctatcagtgatataaatggagatttctccttgtcggtaagtccgggtgctgttattgttatctcttacattggttatgtaacgcaagaattgaaagccatagcgggggcccctctgaaagtagtactgaaggatgattcccgtactttggatgaagtggtggtagttggtttcggttcacaaaagaaagcgaacctgacgggggccgtttcatctattaaaatggacgaaattattggcgatcgtcccattatgacggcttctgatgcattgcaaggtacagttccgggactgctggtttctaatagtggaaatgctccgggtagcggaaagtcattccagttgcgtggtgcctattcggtgggtatcaagaatagcgacggatcttatggtgccaatgtcgctccccttatcttgattgataacgtagaggggagtctcgatatgttgaatccggaagatattgagaccgtaactgtattgaaagatgccgcttcggcagctatttatggtgcacgtgcagccggcggtgttgtcttagtgactaccaagcgtccgaaagaagctacggcctttcgtctgaattataataataattttggttttgctactgcaaccaatctgcctaaacaggcatctttgatggattatctgcaggcttatcaggacgggggatattctgatgcttattggtcgtatggttcacccagcgtttcaaagtggaaagaatacctcacacagtataggcaggatccttcatctatcaaaactgtaggtgacggtattttcgcagatacggatggagctttgtattatttgaatgagcatgatccctataagaattttatggagaccagcttccagatgaaccacaatctttctgtatccggtggtacggataaattgcgttatcgtatgtcggcgggatatgtatcgacggacggtgtgctgatcaccgataaagacacctatgagcgcttgaacatcaattcctatatttctgctgatataaccaaatggtttacccaggagttgactatgagttatgcacgtaccaatcagtcgcaacctaattccggtttgggaagtatgtttggcagtaatcaggtttcttatcagccggaaggtaatatgccttcggatgtttgttctacaatttctcaggatttgcctttcaacacaccgcgcaaccaggtattgttagcaaataaatggaaaaagtcgtatgataatccgcgtgttttcgtgaaatctattctgaaaccgttcaaaggttttgaggcagtattcgagtatacatttgacaagaacatgtatgattataatttctataccggaaaaactcagtatacagatattcagggaggtaataacatctggaatgcagcaaaagattatttgcagaaagagaagcaatttaccgactacaatgctttcaatatttacggaacatacaagtttgatctcaacaaagaccatcatttcagtgtaatggccggtttcaaccaggagtccaagtatacagaaggtgtaaatgtattgtcttataatcaggctgttgttgaagtaccggcattgggttcgggtacaggtgacctgaaagcgacagacagttataatgaatactctgttcgaggaggatttttccgggtcaattacaactatatggataagtatttgctggaagtgaacggtcgttacgatggttcatccaagttcccgaaagattcccgttttggtttcttcccatctgtatctttgggttggaacgtagctcaggaaaagtttatggaagttacgcgcaattatattgacggtctgaagattcgggcatcttacggtgtgatcggtaaccagaatgtagtgaactatgcatacttcccaactatgagcgttagcaataaatacaacggttggctgtctggaggtgattatgtaactgctatcaactctttaccgaatctggtaagtacaagctttacttgggaaaaagtggccactacggatatcggactcgacttgaatatgttcggtaatcgtatgaatgttgtgttcgactggtatcagcgtgatacaaaaggaatgttggctccgggtatgcagcttcctgctgtggtaggtgcaagttctcctttccagaatacagccgatatgcgtactcgtggttgggaactggcagtgaactggagagaccgtatcggtaagttcaactatcgtgtcggattcaatctttctgatagctattctgaaattactaagtacgacgataatgctgcttctaagctgctgagtaatttttatccgggacagagactgggagaaatctggggatatgaagtggacggattctatacggtagatgattttgtagatactaatagttggaaacttaaagatggagtggcctctattaaaggtgtcagtccacgtcctggtgacttgaagttcaaaaatctccgtgatgatgacaaaagtacaaatcagattgatagcggagacggtacattagataatcccggcgaccagaaagtaataggcaatagcttgcctaaatatctgtatggtattactctcggtgctaattataagggtttcgacttgaatattatgatgcagggaaccggccagcgtgatgcatggattgccaataacctggtattcccgatgtatatttattcagtaaacgatatcaaataccaaccgctgtttgatggtttgactgactattggaggccggtagatgcagccaatggagattacactgccgtaaatccgaatgccaaatatccgcgtatgtatggacaaaatcctacagtcggctccaattacggacgtaagacagataaatatttatctaatgccgcttacttccgcatcaagaacgttactttgtcgtataccgttcctaaaacatggatatcccgaatcggcttaaatcagttaaagggttttgtcagtgtagaaaatctggcaactttctcttcattaccttcaggtatcgatcccgaaactctgagctggaactatccggcattccgtaccgtttcgtttggtatcaactttacattataa

SEQ ID NO: 2701 - DNA, 1971 bp, B.fragilis
acgcataatcaagaattaaaaatgaaaaagatatatctatcattggctattttagccggaatcggactggccggatgtaatgacagctttctggagcatgcgcctgtcaccagtctgacagaaaataatgcttttagatcttatgataactttaagtcgtttgcatggccttgttatgagatattcaaggataataatatagccaataccattaacggaaccggacaaggttcctgctatgcaggtgatatgaatgccggatacttggaaagccgtgccaatgagtcgggcaatgactatgctttcggaagagttcagagtgtagcttcgggcaatggttggggcttttccggcacattccgtcgtgccaatattttgcttgctaacatcgataagtcggaaatgaccgatgccgaaaaggaccattggcgtgcagtagggtattttttccattcatactggtacatggagcttatcaatcgttttggggcggtgccttgggttaatacggcccttaacgaaaattctcctgaggcttacggtccccgtgttgaccgcgaaattgtggccgattccgtattgaaccgtttgaaatgggctgaagcgaatattggagattttgagaagcaagatggtgcaaataccattaatcgcgattgtattcgtgcggctatctcacgatttgcgttgcgtgaagccacttggcgcaaatatcacggaatagacggagctcagaagttctttgacgaatgtattcgggtgtcccgtctgttgatgaatgattaccctactctttattacggaacagacggtcagcccgcagccggatatggagagatgtggacaacagaagatttgggcaaagtgccgggtgtcatcttgtatatggagtttgttcaagacatcaagatggccaattttagtgcattggaacatatggatagccacaatgtagagatgaatcagcatactgttgacctttatctgtgtaaagatggcaagccgattgctacttctgcaaattatcatggagataaaactccctatgctactttccgtgaccgtgatccgcgtttatatcacgtagtaatgccaccgtataaagtgaaagcaaaggtgaagacgaaagaagatcccagaacatgggattataccgatgatccggcagatcgtgaatatatcgatattatgggtcctaacgaatcctgtgataatcccggtattggtatgaaacgccttcccggacagaactggagtgcttcattggtaccttcttcaccaaactttatggggggtatcggagctacaggttttgtgagaagccgctcgggatattatttctggaagaattggagcaactgggaaacgaaccgtaacggaggtgtcactctgaacacatcggataagcctatctttaagatcgaagaggttttattgaattatgccgaagccatgtgtgagaccggacagttcactcaggcagtggccgacgaatctattaataagttgcgtagacgcgccggtgtggccgatatgaaggttgccgatattgatgatagttttgatccgaaccgtggacgctattatccgaaaggaaatgaacaaggtgttctggtagatcctgttttatgggaagtgcgccgtgaacgtattgtcgagctaatgggtgaaggcttcggattctacgatatccgccgttggagaatggcgccctggttccttaaccgccagtttaaaggaatgtggatgacgaaagataagttcagacatggtgcccagttcttattgaatgaaacgaccggtggaccggaccctgccgacggagccatgacagaaggatatatttatttacaaccggaccctatcaaagcaggtgaaggctggcaggagagatattatctttatgaggttcctactcaagaaattatcttgaatccggcacttgcacctaacaatccggggtgggaataa

SEQ ID NO: 2702 - DNA, 288 bp, B.fragilis
ctgcaaagtcagcggaggcagcatacaactagtatagccggaagctatacaacagttacaactaatgcaatctcccaaacgaactttatgcagaaagagataagattgcaagaattccagttcttccgtcaacgttaccaatgttttatcctgacattgcaaaacataacggtatacactggacaaatgcttggtgaaatgaacagcattacccgggttatattctatttcagcaatcagcgtattgagactattaaacagaaaatggggattcagttgactttgtaa

SEQ ID NO: 2703 - DNA, 201 bp, B.fragilis
aagaataaccacatagtattaatgctgctgaaggctgttttaaaaaacgacctaattggtctgataatgctaagaatggcattttccgactttggtcatattttaagtgagaaggatatattaaatatgaagattcatctgtatcatttttatatgcatcagaacgaaaaacgtctttattttctttttgaaaccaattaa

SEQ ID NO: 2704 - DNA, 189 bp, B.fragilis
cgtattgaccaaaactattacttggcacaaaatctctttttgtcatcattgttattatttttaatagttattagatatatctgctcttatggcttctacttggcactaggaaaaggggttctagcacccgttatccgaggtctttccccttttcagtgccgaagtgctcaagtgctgattcctttttag

SEQ ID NO: 2705 - DNA, 1128 bp, B.fragilis
aggatgaaacagctatatttatttatattaatagttttttgctgcatgggttgtcagcgaaatacattgcgaggtcctattcctactattattatgcatccggatagttgcctgaaaagcttagatatctctgttatgatgaaggattcgatagaagtaatcaaattggagacaacagacagttgtcttattggctttattaacaagatttcatttactgacaagcatatattagtctcggatgcacgtgtaagtcagaagatatatctgtttgataaagggggcaagtttattcgttatattagcaataagggaaccggtcctggtgaatacagtgtaattggagattttacgataaaaggggattctgtatttatccaggattattatcagaataagtatgttatatatgatatggtagctaatgaaattaaagatgatataccctataagactcaccattccggagtggttgcacttgataattatctttattttatatctaactattttacctctccaataggtgattataattgctggcgatatgatttaagtacgcgaaaaacagaaggctatttgccttttacggtagatcatattgccaatcagccggcttggacaataaatcatccttgtgggcagatagataaattaaagtcttttgcttattatcgatcgaatgataccatatatcagattgataaattaacagtctcaccccaatgcgtcattcacttccctaacagtggggaccggacatcttctacagaaggaggacatatttccggaattgttcatttgcaacaatctgttggatatatattaggaacttacacagaaggaaaagggcttagatattttttgatagataagcgcaattatagttctcagatgggaaaactgttgcgttttaataatttagacagaaaatctataaacaatgaattttttatagaggataactatttgattttttgggatactatgcaaagtttgaagttatggaggaggtattttgataaagctgaatttactaatccggctgacaaacaaagaatacagtctatcattgatttatctcaagatgatgataatccagtcatatttagatgtcgggtgaaataa

SEQ ID NO: 2706 - DNA, 1332 bp, B.fragilis
atgattatgcaagatttaaaagaaactaatctgtttccaataaaaacattgcccgagatttttagaacaatatctgagtctttgtttttatcctttggttatcccttgtcttatacagcgatggcgataatcgcagcggtagcgacggcagtaggtacaactgttaagcttcagtttaaacaggggtttgaaatattcgggaacatatattgttactttatttccgatccaggtacctgtaagtctcatcctatttcatgggcttttcgtcctattgacaagcgacaccagtctatgttaaggggatataggaaagcttatgaagcttatctactcaaaacctctgggaataaaaacaaaaatgtggtaaaagagcctgtgtttgaagcttttattgttaaagactttacgcccgaatctcttcttatgcagttgtgtcgaagcccgaagggggtggttgctattatagatgaattgattggaatgttcaaaaatgcgaaccgctataatagttctgctttttccgaatttttaaatgaagtatttagcaatataactatttacaaaactagaatagggtctgaaccattgcattgcttaattccttaccttacagttattggaacgactcaaccatcgatgttatccgaaatatattcgaatgataaatcaaaaaatggaggaatggctcgctttattccaattttcccaaaggatctttctattccaatttggtcggataaagagcatgatgtggaaattgaacgagtatattctgaaatgatcgacaaactgcttgatatcgaagttaaattgaatgaagagggtgatcccacgcctcgtacaattgagtttacagcggaggctaaagaaaagataattgattggcaacggcattatgcagaaaaaatagaaagtgaagatagaggacaaacctatcaagatgctaaaacgaaacttcctatctatctccttaaattttctctgttaaatcagatgatgcgaatgattgctggcgagtctaacgctgatgccgttgatataacctctgttaataatgcaattgcccaaatcgaatatatagatggtgagatattgaaagttcatgattttgtttattcaaggaatattcttctgaaaatgacagagcaacaacgtaaagtctatgctcttctacctaatagcttttgtattagtgatgtatatgatctagtgatggccaaggctgattttactaaagatcaattaaaaaagttcgtaagagtaagagactatttcgtccgagctagtaaaggtcattatgtgaaaaaatacgaagatttgagtgactaa

SEQ ID NO: 2707 - DNA, 3756 bp, B.fragilis
tccacgcagcattggaacagttttatcacttcgctttacgaagatttcaatggtaaacatttggtcggtactgatgcaggagtatatatttactatcctgagaaggaggcttttgaggaattcgattgccagagcttggagaagacaaggatagaacgttctgtttcaatgattgcaggggataagcaaggcagggtttggatagctgtggaggctcagggaatgttctgttacgatgctcgtcaaaaactacttcgcaattatccgttaagtgagatttcttccaatatcaaatgttttactttcgatagcggtggaactctttggctcggattttatggtgatggtctttattactccaaagataatctggcaactgtgcatccttatggatcgccagaagatggtaaaagagaatttgaaggaggagtaatcaccaaaatagttcaaggaaactataattgtttgtatattggttctgtgaaggaaggtgtgagtgagttgaatctgacttcggggcaagtgcgtaacctgttggctatcgatgagagtggtgaatctattttttgtcgtgatctgctgccatattctgataatgaattgtggatagggactgagtccgggatttatatttataatttgcgtacagcgcaattcattcatttacgtgcttctctttatgactcttattctttgtcagacaatgctatctatgctttatataaagatcgtgaagaagggctctggatcggttcttatttcggaggagtggattattatcccagacaatatacctattttgcaaaatattatcctaagaatatagcaaatagtctgcatggtaagcgggtacgtgaattctgtcgggcggatgacggtactttgtggataggaacggaagacggcggattaaatcactttaatccgaaaacgaaagaattccacttttttgagccaagtgccggatttactaatatccatggtttgtgcatggatggcagtcatttgtgggtgggaacattctctaaaggacttcgggtgattgatacacggacgggagtggttctgaggacgtatacggaaggtcatactccacattcgttgaacgataatagcattttctctatttgtcggacttctgccggagaaatttatctgggtacactgtttggtttactgcgttacaaccgtactcaggatagttttgactgcattccggagttgaatggtaagtttgtttatgatattaaagaagattcttatggaaatctttggttggcaacttatgccaatggagcttattgttatgacgtaagtgcacgaagatggaaaaactatgtatttgatgccgaggatgaaaggagtctgccatatgataaagtgctgagtgtttttgaggactcgtatcgccagatatggctaactacacaaggtgggggattttgtctatttcatcctgatacggaaacatttacacgctatgggctgaaagatggacttcccaatgatgtggtttaccagattgtggaagatgatgatcgttttttgtggcttactacaaataatgggttggtccgttttgatcccaaaaccatggaaatgaaagtattctctactgctaatggcttaccgaccaaccagtttaattaccgttcgggatttaaagatgaggctggtaacatttatttgggtagtattaacggatttgtagcattcgatccccgaactttcgctgaaaacaggcaggtgccggcagtagctattactgatttcttgctgtttaataaagaggtgtcggttggagaaaccgattcacccttgaagagcagtattacgttttctgacaaagtggtactcactgccgatcaaaattctttttcttttcgtatcgctgctctaagttatcaggctccaaggatgaataaactgatgtataagcttgagggctttgacgaaggctggttgacaataggagaaagccctttggtgacttattccaatttaggctatggcgattatgtgtttaaagtaaaggcctctaatagtgacggagtgtggaatgaacaggagacttcacttcatctttctattcttcctccattctacttgtccggatgggcatattgtttctatgtattatttttcatggggtgtctggtctgtgtcatcttctactttaaaagacggaattatcggaagcaacatcgccaaatggaaatgcttgaacaagagaaagaacgggaagtctatcatgctaagattaatttctttaccaacgttgctcacgaaatacgaactccgctgaccctgattaaaggtcctttggaaaatattatcctgaaaaaggaagtggattcggaaacgaaagaggatttgtatatcatgaagcagaatacggagcgtttgttgaatcttaccaatcagttgttggattttcgaaagacagaaacacggggattccggttgaactttactgaatgtgacgttgttgcagtgcttcgtgaaacctatctccgttttacttctttggccaagcaaaaaggattggattttatattagaacttccacaggagtgctttatggcggatgttaatcaggaagctttgacaaaaataatcagtaacttgctgaataatggagtgaaatatgcctctacttatctccggatttctttggaaacagacgaaaaagtatttcacatacgaacttttaatgatggggagatgattcctgatacaatgaaagaggagatttttaaacctttcgtacggttggataaagaagatgaagtaactaccggaacaggtatcgggttggccctatcacgttctttggcagaattacatcaaggtagtctgatgatggaaaagggtgaagaggtgaattgcttttgcttgaccttgccggtgaatcaagattctacaattactctctcggctgaaaacgtatcacaggttgaggagaactcttgtggatgggaacaggaagaaaccgatacgaaagaaaagaaaccgatgattctagtggtagaagataatccggatatgttagcttttatcaggaagcaacttacaacggagtattcggttctaactgctatgaatggaattgaagcacttgctgttttagataatcattatgttaatctggtggtgagtgatgtaatgatgcctcagatggatggttttgaactgtgtaaaactattaagtcagatttgagttatagtcatattcccgttgtactgctaactgccaagactaatattcaatcgaaaatcgaaggattggaactgggggctgatgcttatattgaaaagcctttctctgtggaatatctgctcgcaaatatttccagcctgattcataatcgtgaaaagttacgtcagacttttgcgaagtcaccctttgtggcagccaatacgatggctttgaccaaagccgatgaagagtttatatggaagttgaatgatattattcaggctaatctgcataatccggagttcagcatggaagatatggcagatgcattgaagatgagtcgatccagcttctatcgaaaaattaaaggtgtattggacttaagcccgaatgagtacctccgtttggaacgcttaaagcaagcggcacaattgctgaaagagggcaagagtcgcgtcaatgaaatttgttatacagtgggatttaattcgccttcttatttctctaaatgtttcttgaaacaattcggggtacttccaaaggactttatagggtaa

SEQ ID NO: 2708 - DNA, 258 bp, B.fragilis
cacagagttaaagcttgttctttggatgtgaataagaagttctttaaatgcaaaagacttgttatttgcgcacaaaaacctgacaacctgcaaaagacgttaacaatgttaattgaagaaaggtataaggatgaagataccggttcagacggtgtaaactcactttcgaaacttgagctatcttattcagccggtgtctgttttttcttattaaagcaagcaaaaaggacaattatcaacttggaaataaagaaataa

SEQ ID NO: 2709 - DNA, 303 bp, B.fragilis
ccaatattcctcactgctgcctcccgtaggagtttggaccgtgtctcagttccaatgtgggggaccttcctctcagaacccctatccatcgaaggcttggtgagccgttacctcaccaacaacctaatggaacgcatccccatcctttaccggaatcctttaataatcaaaccatgcggaataattatcccatcgggtattaatctttctttcgaaaggctatccccgagtaaagggcaggttggatacgtgttactcacccgtgcgccggtcgccagcaaagaaagcaagctttcttcctga

SEQ ID NO: 2710 - DNA, 1704 bp, B.fragilis
tttatacctaaaatgatcaagaagttgtatttgcctttacttatggcattggttgttgcattgtcatcatgtagcaacaaaatgggtgcactgtcatctgattacttcactacgactcctcaggtactggaagctgtaggtggtaaagttcctgtgactatcaacggaaagttccctgaaaagtatttcaaaaagaacgcagttgttgaagtaactccggttctgaaatgggagggtggacaagttaaaggacagcctgccgtattccagggtgaaaaagtagaaggtaacgaccagactatctcttacaagatgggtggtaattacacgatgaaaactacattcgactacgttcctgaaatggcaaaatctgaactttaccttgagttcaacgcaaaagtcggaaagaaaacaatcgctatccctgctgtaaaaatcgcagacggtgtgatctctacttctgaattgattaacaacactttgagcagtgctaatccggctttgggtgacgacgctttccaacgtatcatcaaagaagcacacaacgctaacattatgttccttatccaacaggctaacatccgctcaagcgaattgaagactgctaaggaattcaacaaagaagttgctaatgtaaacgatgctgaaaacaagaagatcagcaatatcgaaatttctgcttacgcttctcccgatggtggtgtgaagttgaatacagggttggctgaaaaccgtgaaggtaacacaaccaaactgatcaacaaagacctgaagaaagctaaaattgaagttccggttgatgctaaatatactgcacaggactgggaaggtttccaagaactggtttctaaatcaaacattcaggataaagaattgatccttcgcgttttgtctatgtatcaggatcctgaacaaagagaaactgaaattaagaacatctcttctgtttacaaaactttggctgacgaaattttgccgcaattgcgtcgttctcgtttgactttgaactatgaaatcatcggtaagtctgacgaagaaatcgctaatctggctgcaacagatccgaaacagttgaacgtagaggaaattctgtacgctgctacactgactaacgacccggctaagaaagctgacatctatactaaagcttctcagcagttcccgaatgactatcgtgcattcaacaacttgggtaaactggcttatcaggcaggtgatctggacaaagctcaatcatacgtgaagaaagcagaaagcattaaatctgcacctgaagtaaacatgaacttaggtctgatcgctcttgctaaaggtgacaaagctgctgctgaatcttacttaggcaaggctgccggtgcaaaagaactgaacgaaacactgggtaacctgtacgtagctcagggacaatacgaaagagcagttaacgcatttggtgatactaaaacaaacagtgctgctttggcacagatccttgctaaggactacaacaaagctaaaaacacattggccggtatcgcaactccggatgcttacacagactacctgatggctgttttgggtgcaagaactaacaacacttctatgctgacaagcagcttgaagagtgctgtagctaaaaacccggctctggctaagaaagctgctacagatcttgagttcgctaaatattatacgaatgcagatttcatgagcatcgtaaaataa

SEQ ID NO: 2711 - DNA, 741 bp, B.fragilis
caatttaataaaactaatatgaataaaatgggattgacattgatttatttatggcttgtcagcctttgttcctgccaacaggaattgattgagtatgagaaaggagatgtaaaagtccacatcgaacagggtgaacaatggttgcatgattttcctttgttcttaggtattaacaagaagaacccacctcaaattgctatctggctggaagatacacaagggaattatctttcaacagtttatgtaactcacaagattgcgacccaatcatggcaagcatcgggaggaaaccgacggaaagaagctctgcctcattggtgttattcacgcgggataaaatacgatgatgaactttatttgcccacaaagaaagaaccattaacagatggcatatcaggggcaaccccacatggaagttttgatatcaaattaagtccgacaacagcactaaagaaatttgtggtaaaaatagaaatcaatcactctaccgatttcaatgaagcctttcccaaattagccaaagaaggagaaaccaactattctggtggtaaagaaggaagtggacaaccagcgattgtatatactgccaatgtcgatttattatcaggagaaaaatcatttgaagcaaatttgatcgggcatagtagtccagatggaagttcgggagagattaatgaagatacatccgggcttacaacagctttacacattgtaaaacgcataactgtaacgatccaatga

SEQ ID NO: 2712 - DNA, 1233 bp, B.fragilis
acctacaataatcttaatatgatgacacataatattattagacatttaaaatctttgagacaaactttatctcaagataaaaaaccaattggatttttcatctcagctggctgtcccttatctatagaaataactcctcctgagaattggcctttgattccagacatgaagaaactttccgaatatgttacatcaattctaaaatcaagtgatacaacaaaattaagtacttatgacagacttattagtgagcttgaaaaaacgaataaaagcaaagaaaatcttgaagatattcttagctttattcgctctttaaaagatgtagcacaaggagggggaactgttagaggactaactgaaacagaattggaagatttagaaactaatatatgtaaattaatagtaggaaaaatacgagtcaatctgcccaataaaaataccccatatcacaaattggccaaatggataagctctattgatagagaaaaacccatagaactctttactacaaattatgatttgcttatggaacaagcattagaggatgtaggtgtaccctattttgatggatttgtaggctctcgacaatcattttttgatttaagaacagttgaagaagatctagcaccgagacattggactagactttggaagattcatggttctattaattggtttcaaaaagaaaataaagacgtttttcgttctgatgcatataaaaatgatacagatgaatcttcatatttaatatatccttctcacttaaaatatgaccaaagtcggaaaatgccattcttagcattatcagaccaattaggtcgttttttaaaacagccttcagcagcattaatactatgtggttattctttcaatgacgagcacattaatgatactatagttaatgctattaaatctaacccaactgctatagtaatagctttaatgtttggaaatatggaagatggtagtatagaacgctatccaaaaggagttgaactcgcattaaaaagacacaatataagcttctggactaatgatgaagctattattggaactaatcgagggcaatggatagtcttagataaagatgtagatgatcctctaatacaattagtagaagtaaattcttctactaacaataaaactattaaatttggagactttaaagttttctccacttttttgacttcattaattgggtaccaagaagaagaaaataaaaatgacaagtaa

SEQ ID NO: 2713 - DNA, 1308 bp, B.fragilis
tcaagaaataaaagtatgaaaatgaagtatttgttggctgcgtgtacagccttttttctcgtgtcttgcagcaatgatgatgaaccgcaaccatcaccacagtatggtgatattgtagggctgaacatcaaagatgccaagtatatctatacaagtggtagcaatactcgctcttcctctgcggaatatcggcagataaaaaaagacggtagggacatggagttatcgtggattgacagcaagggtgatacgattaaaataagtggtaatcctaaaatatggaatatcaataaaaagtatttgatgataaacacaggtgtgcctataaactatcagccaaaatatgatgaagatggagataggcttcctgatagtacccctctgggaggatattcttatcttattgacaaaacaacagaagctatttatgatttagctgaagggttaaacggagaaaatgcggtaaccgacaataaaggaaatatttatgctgtggataactcaacgggagcagttcttttcaagattcacacgcaagatgctgctaatttgaaattagagttatatgcaaaagcatccacttcacacaaaaccccttttgttgtgaataataaaggaatttgtttctatgattatcggtatatccgtccatcttatggtacgcaacaatttattatctccaactttatttccgggacagaatacggaaatgctttcgtctcgcatgataatgaagatatgtatattacggctattaatagttctttagaagagggaaaatctaatctgattgtcagtaaattaaaagaaaacaaagagatacagagtgaagttatggcggaattgtcatttgatggtatttggcagtcgcaaatgtccgacggcatacaggtgaaatggaatgaccgtaggggaacaatgcttattcacttgtatcgttacaatgaatcaacctatgaatatctgctggctacaaagacattgacaaagataccagttaatttaggcggattctttaccaaagattattctacttatataacaaccaatgctttatatgctcaaaagtctgtaaataagctggatattatcgcactggaagattacagtactaagacattagacttatcaggtaaaggcattgatttccgctctatttatacaatggagggttctgatttgctatattttgcaggatttcaatatagtacgagccaatctgttatcggaacaattgatatagatggtaatattgaaatatctgaatcaacacctaatcctatcaccaatatcatacagataaactaa

SEQ ID NO: 2714 - DNA, 264 bp, B.fragilis
cattctgtcaaaatgtattttgagattcctcagaatcaattctttgtgccctggaaacaagaagagagtaaaaaacgcaggaatacccttttccaggaagtcagagagtcggaaaatacagtgaaatgctaccataaagacaagataccaagggcatttactcttaggaagaaacctggaaatctcataaacattcggaataacacttttaaaaagagtcctccaaactctgttctagaagaaaaagcagttctttttccctaa

SEQ ID NO: 2715 - DNA, 186 bp, B.fragilis
atcaatgtcaatcccattttattcatattagttttattaaattgttattttattattgttactaatcgggaacatggcaagcaaaaaaatattagactagtaatgtttcaatctttttacggggagaataagggatttgctttgcataaccaattctcattattaatgttgggtgttccttattga

SEQ ID NO: 2716 - DNA, 1902 bp, B.fragilis
ttgggtaccaagaagaagaaaataaaaatgacaagtaaagcaacatatataggggatgttcaaaatgtgaatgggacaacagttagtgtcactttctctccaaattgtatttctggcttaacttatgtaaatggcgaaggatacaagattggtcaagtgggttctttcgttaaaatacctttgggatatactgatttatttggtatagtatctcaaattggggctaatgcagttccagaagctcaaatagaaagtcagcctcatgggaatagatggataaccattcaattaataggagaaggacaaagaagtggagggtttgagcgaggaatttctcaatatccaactattggagatgaggttcaccttgtatcagaatctgatttaaaacatatttatggtaacattgacaaaacaaaccttgtaaatatagggcatattgctggagcagaatctattcctgctttgattgatattaataaattaataacaagacactctgcgattgtgggatcaacaggctcagggaaatcaacaacagttgcaggacttcttgatgctctatctaacaataacaaatacccagcgtctcgtatactaatttttgacattcatggagaatacagtaaaacttttaaagactctgctaatatatacaaaataaacccagaagaaacgagtgagcctaatattaaatcattagacattccctactgggcaatgagtttcgatgaattaatatctttgactttgggcgatattgatgaaaaagaaaaggctccaattggtgaacttattattgaattaaaaaagaaaacatttacagattcacctgacaaatacccagatattgatattaatcgaataactgtagacacccctttgccttttagtttaaagcgattatggttatatctttatcgccttgtttattctactcataatacacagagtacaggacaacgattttgttctattaccgagaattttgacattaggaatacaacagaagcattcaaattagatagcgaagataccccactacagcttggtaatgcagaggatataattcctcctcactatcttccacaacaagcttcaagaatttaccaaagttcttctacgctaaatataaggagacctatttctttattaacctccaaattacgggatcccagatatgattttgtttttaatcctgggtcatggacggttgatttagaaggaaacattgaacaagatttagattctttgttcaagatgtggattggagaaaagaacatctcaattttagatttgtctggtattcccaataatatacttaataccataattggcattttacttagaattatatatgatgctatattttggtccagaaaactaccccaaggaggcaaagaaagaccccttttattagtaatggaagaagcacacaattatttaaatgataattttaaaggagttgcctctagtattgttcaaaggatcgtaaaagaaggtcgaaagtatgggattggagcaatgattgttagtcaaagaccatctgaaattaattctactattctttctcaatgtggaaccataatatctcttaggctttctaacgctacagatagaggtcatgttaccggaactgtaaccgatagtttagagggcttaatgaatatgctacctattttacgcacaggggaagctatagtcgtcggcgagagtgtcaaactccccatgcgagcacaaatatcagccccatctaaagaaaggagaccagacagccaagatcctattgtcgtttcagaaaatgaaaatgataaaattggttggagaaatgagacttcaataagtgacaatgattatacgaaaatgataaaagcttggagaaaacaagaccctaatgtttaa

SEQ ID NO: 2717 - DNA, 858 bp, B.fragilis
aaatattacaaaatcaacaagataattttaaccaacacattattggctatgttagagaaaatacaagaaacggcagccttcctgaaaggaaagatgcacacaagtcctgaaacagcaatcattctgggaaccggacttggcagtctggcaaacgaaattaccgaaaagtatgaaataaagtacgaagatatccccaactttcctgtgtctaccgtagaagggcacagcggtaagcttattttcggtaaattgggtaataaagagattatggcaatgcagggacgcttccattactacgaaggttactctatgaaagaagtgactttcccggtacgcgtgatgcgtgaactgggtatcaaaacattatttgtgtccaatgccagtggcggcaccaatcctgaattcgaaatcggtgatctgatgattatcactgatcatatcaactatttccccgaacatccgttacgtggtaaaaacatcccgtacggcccccgtttcccggatatgagcgaggcatacgataaggaactgatccgcaaggcagatgtcattgcagcagaaaaaggcattaaagtacagcacggaatatacatcggtacacagggacccacattcgaaacacctgcagaatacaaactgttccatatcttaggagctgatgcggtaggaatgtctactgtccccgaagtgattgtagccaaccactgcggcatcaaagttttcggcatttccgtcgtaacagatcttggggtagaaggaaagattgtagaagtatcacacgaagaagttcagaaagcagccgatgctgcccaaccgaagatgaccaccatcatgcgcgaactgataaaccgtgcatag

SEQ ID NO: 2718 - DNA, 1923 bp, B.fragilis
gtgactataaacgtattctctctatggattcggcattgggccgttgtacaattcaagaaagatgatgtagcctacgaacgcgattacttcatgtcctatcctgccaacgtgatggcaatccgcttcaaagccgaccggccgggcaagcagaaccttactttcagttactcccccaatccggtatcgacaggaagcatgtcggcagacggtgccaacggcctcgcatacactgcccacctcgacaataacggcatgcaatatgtagtgcgcattcatgccattgccaaaggcggaacactatcgaacgcaaatggaaaaatcaccgtaaaagacgctgacgaagcagtattccttgtcactgcggataccgattataagatcaatttcgacccggacttcaaagaccctaaagcatatgtgggagtaaatcctgccgaaaccacccgtcaatggatggacaatgccgtagccatgggatatgatgtactcttcaaacagcattacgacgactacgccgctctgttcaaccgggtaaaactacaactgaacccggacgcacaaagcgccaacctgcccaccggcaaacgcttgcaaaactaccggaaaggacaaccggacttttatctggaagaactctattatcagttcggacgttatctgctcatagccagctcaagaccgggtaacatgcctgccaacctgcaaggcatctggcacaacaacgtagacggtccgtggagagtggactaccataacaacatcaacatacagatgaactactggccggcttgctcgaccaacctctacgaatgtacattgccgctgatcgactttatccgtacgctggtaaaaccgggacagaaaacagcgcaggcttacttcggaacaagaggatggacagcatcgatctcagccaatatctttggattcaccacgccgcttgaaagtgaagagatggcctggaacttcaatccaatggcaggcccctggttggcaacgcatgtctgggagtattatgattacacccgcgacaagaaattcctgaaagagaccggatacgacctgatcaaaagcagcgcccagtttgccacagactttttatggcgcaaaccggatggaacttacaccgcagctccgtctacctcacccgaacacggaccgattgacgaaggaaccactttcgttcacgccgtaatccgcgaaattctgcaggatgccatcgaagcaagcaaagtgctcggagtggacagcaaggaacgtaaacaatggcaagaagtgctgacacatctggctccctacaaagtgggccgctacggtcagctgatggaatggtcgaaagacatcgatgacccgaaagacgagcaccgccacgtcaaccacctcttcggactgcacccgggacatacgctctcacccatcaccacacccgaccttgccaaagctgccagagtggtacttgagcatcgcggcgacggagcaaccggatggagtatgggatggaaacttaaccaatgggcacgtctgcaagacggtaaccacgcctacaaacttttcggtaatctgctgaaaaacggtacactggacaatctgtgggatactcacccgcctttccagatcgacggaaactttggaggtaccgccggtatcacagagatgctgctgcaaagtcacatgggcttcatccaactattgcccgcacttccggatgcctggaaagacggaagcatcagtggaatctgcgccaaagggaactttgaggtagacttgtcatggaaaaacggacagcttgcagaagcaaccatcttctcaaaagcaggcgaaccttgtacggtgagatacggagataaaactctctctttcaaaacaagtaaaggaaaagtttataaattggctttagatgcagaccgactggtcatcaaataa

SEQ ID NO: 2719 - DNA, 2067 bp, B.fragilis
ataacaataaatacacgcaatatatcaatggaaaagaactttaaaagaactaccgtcacatcggcactgccgtatgcgaacggccccgtccatatcggccatttggccggtgtatatgtaccggcagacatctatgtccgctatctgcgactgaaaaaagaagatgtacttttcatcggaggttccgacgaacatggggtacccatcaccatccgtgccaaaaaggaaggtatcactccgcaggatgtagtagaccgctatcacttcctgattaagaaatcattcgaagaattcggtatctcgtttgacgtatacagccgtacatcatccaaaacacaccacgaactggcttcagacttcttcaagaagctatacgaaaaaggagagtttatcgaaaaaacttcggaacaatattatgatgaagaagcacaccagtttctggccgaccgctacatcaccggtgaatgtcctcactgtcattcggaaggtgcctatggtgaccaatgcgaaaagtgcggaacttcactgtcgcccactgacctgattaatccgaaaagtgccatcagcggaagcaaaccggtcatgaaagaaaccaaacactggtatctgccacttgacaaacatgaaacatggctgcgccagtggatattggaagaacacaaagaatggcgtccaaacgtgtacggacagtgcaaaagctggctcgatatgggtttgcagccgcgtgcggtcagccgtgacctcgactgggggattcctgttccggtagagggtgctgaaggtaaagttctctacgtatggttcgatgcaccaatcggttacatatccaatacaaaagaactgcttcccgattcatgggaaacctggtggaaagatcccgaaacccgtctggttcactttatcggaaaagataatatcgtatttcactgcatcgtatttccggctatgctgaaagctgaaggcagctatatcttgccggataatgtaccgagcaacgaatttctgaatctggaaggagacaaaatatccacttcacgcaactgggcagtgtggttacacgagtatctggaagacttccccgggaaacaggacgtattgcgttatgtattgacagccaatgcacccgaaaccaaggacaacgactttacctggaaagacttccaggcacgcaataacaacgaattggtagcggtctacggtaactttgtgaaccgtgcgatggtattgacacagaagtacttcgaaggtaaagtacccgctgcgggcgaacttacagattatgacaaagagacactgaaagaattctccgatgttaaagccgaagtagaaaagctgctcaatgtattcaagttccgtgatgcacagaaagaagccatgaatctggctcgtatcggaaataaatacctggccgatacagaaccctggaaactggcaaagacggatatggaacgtgtaggtactatcctgaatatatctctgcaactggtagccaacctggctatcgctttcgaaccattccttccgttcagttcggaacgcttacgccagatgctgaacatggatagcttcgactgggcagaactgggacggaacgacctgcttcctgccggacatcaactgaataagccggaattattgttcgaaaagatagaagatgccacaattgaagcacaagtacaaaagttgctcgatacaaagaaagcaaacgaagaggctaattacaaagccaaaccgatccgcgccaatatcgaatttgacgacttcatgaaactcgatattcgcgtaggtactgttctcgaatgtcagaaagtgcctaaggccgacaaattattgcagtttaaaatagacgacggactggaaacacgcaccatcgtcagcggcattgcacaacattacaaaccggaagagctagtaggcaagcaagtttgcttcatcgccaatctggctccacgaaagctgaaaggtatcgtcagcgaaggtatgatcctgagtgccgaaaataatgacggcagcctggccgttgttatgcccggacgggaagtgaagccgggaagtgaagtgaaataa

SEQ ID NO: 2720 - DNA, 204 bp, B.fragilis
agcatatccctgttgaaggcagaattggtatttgtgatggtacggaaggggcatgtaaaagttggccatgcacagaagtctggttataaccaaatagaggatgaaacagctatatttatttatattaatagttttttgctgcatgggttgtcagcgaaatacattgcgaggtcctattcctactattattatgcatccggatag

SEQ ID NO: 2721 - DNA, 195 bp, B.fragilis
cctccaacaaagttggatgacattccttcagaatgccgggttgtcccattcggaaatcttcggatcaaaggtcatttgcacctacccgaagcttatcgcagcttatcacgtccttcatcgcctccgagagccaaggcatccgccatgcgcccttatttactttcttttatcgccagattcatctccttttcttaa

SEQ ID NO: 2722 - DNA, 189 bp, B.fragilis; identical to SEQ ID NO: 1577

SEQ ID NO: 2723 - DNA, 345 bp, B.fragilis
attgcgcaaaattataaaaaaaagaaaaatatgaaagctaaattctcaatgattggtgtattgctaattagcctgtttacggtagttaatattgttaagagtaatcaaaaaaacaagagaatagaagacattatgttagttaatgttgagagtctcgcctttccggaaagtggaataggtagtgatatgagaatagcaactaaacatgtgtgttatcttaataatgaagtctttgatgaaagcacgggtaggttagagcatatccctgttgaaggcagaattggtatttgtgatggtacggaaggggcatgtaaaagttggccatgcacagaagtctggttataa

SEQ ID NO: 2724 - DNA, 2049 bp, B.fragilis
cttctaaaaaacaccaagattatgaaaattaaaatgaaatatatcgtggcgcaggcttgcctcgtagcgggagcatccatagctctgacttcgtgcaacgactttctggacagagagccgctggatcaggtcactccgcaagagtatttccagactgcagaccacctggcagcatataccatttcaaaatacaactctatgttctcaacacatagcggatggaatgccggtacggtaaacaatgatggcggtacagacaacatggtagtgggtggttataactctacctactatgaaaaaggaatctggaaagtaccttcaaacaatgacaactggtccaacggattgtcactggcccgttattgcaactactttttcgaacaggtgctgcctaaatatgaagccggaaaaatttcgggggcagaagatgatctcaaacactacatcggtgaaatgtatttcatgcgtgccttgatatattacaaccagctacgtaaatacggagattatcctatcatcactgaggtacttccggatgatgaagcgatactgattgaaaagagtgtacgtcagccacgcaataaagtggcccgcttcattctcgaagatctcgacaaagccatcgggttaatgaaaaaccaaggcttcatgaacaacaatcgcctgaacaagcaatgtgcattgctgatcaaatcacgtgtggcattatacgaagctacatttgagaaatatcatcagggaacaggccgcgtgccgggtgacgaaacatggccgggaaagagcgtacatccgaatttctcacttgatgtaacagccgaaatcaacttcttcctcgaccagtgtatggatgcagcctcacaagtagcggacgctatcacactgactgaaaacacaggggtattcaatccgctcagcgacagcgaatattccggttggaatccttactttgaaatgttctctgccgaagacatgagtggttattccgaagttcttttctggaaagattatcttcgttcgggaagtatcaacatcagccacggtgctcccaactatatttattcaggtggaaacaatggaatgttgagaagctatgtacagactttcctgatggagaacggattgccctggtatgccagcaacagcggatttaaaggtgacagcagaattcaggaagaaaaggaaggacgtgaccagcgcctgcaacttttcttattcggtgagaaagacaaacaggctccgagagccgatggtgacggcactatgcccgagttcggcgaacctgctctctttgaattgcaggaagtcagagacttgacgggatatcgcatccgcaagtgcctgacttataagaaagaccagatcatctccggttccgaccagtcgaccacaggatgcatcatctatcgtggtgtggaagcttaccttaactatctggaggcatattacctgagaaacggtaaggtcgacggaaaagcagcccaatactggaccgctatccgcaaacgtggtggagtggacacagactacgaaaagaccatccgcaatacggatatgagcaaggaagtagactgggcaaaatactccggttctacattggtagacgcaactttattcaatatccgccgcgaacgtcgttgcgaattcatcggcgagggtatgcgttgggacgacctgatgcgttggagagctatggatcagttgctcacaaccaaatatattccggaaggattcaacttctgggatgaagcttatgatgactatgtggcaatgaagaatgacaaaggcgagcccaaatacaaaattgtatcagacggtagctcaacggccaatatgtcagccaaagaattgggtaaatatgtacgtccgtactcaatcgtcaaagcaaacaacgctgtatttgacggttatacattcgctaaggcatactacttgtatccggtaccgatacggcaaatggagcttttgtctccggaccgttcagtcaacaattctgtgctttaccagaatccatactggccaagcaaaacaagcgaacctgctatcgaataa

SEQ ID NO: 2725 - DNA, 966 bp, B.fragilis
catacgtgtttattaaaaattttatctttttggggcttgtgtggctatttttttgtatatttagcctcgggtttcgtggcttgtgtaaaatgcttgttgcttatgagggctatatttatttttgtatgtatcctgctttttgtatcttgtcaaaattctgataaatctcggattgctcatatgattgatgagtgggatggaaaggaaattatttatcctgatgatttggtatttactactatgggagaagatacggtaaaatggtttcttaaagatagccgatatacaatagtgacttatgccgattccattggttgtatggggtgtaaacttaagttgcccgcttggaaagactttatttcttaccttgattctgtatcggatcatacggtaaaagttatattcattcttcatcctcgagataaaaaagagatggttcatcttttggagtataatgatttttcgtatcctgtgtgtcttgatataaaaggctctttcgataaaataaataaaatcccatccaatttggcttttcaaacttttctacttgataatagaaataaagtgattgctatcggaaacccgattcataatcctaatgtgaggactctgtatttaaacttgattttatctgatagtatatgtgaaagtcgagatttgattcagacgaaaataagcttacccgaaacgattgatatgggagtcttcgattggagtgaagaaaaagaagcaatgttgattataaaaaatcttggagtggtttccttgacggttgaaaatatagttacttcttgtggctgtacttcggtagaatatagtcggaggcctgtctctctgaaagatagcttggtgattaaaataaagtataaagctgaatctccgggatattttaataaagatattgctatttattgtaatgtcccgtcatctcctgtttatgtgaaattatcagggaaagctcaataa

SEQ ID NO: 2726 - DNA, 1050 bp, B.fragilis
attatcagaaaacgtacttgtattggaataggtatggacgaaataagtattatacaatcgaatcatataccactatctttccttacggggaaagacgcttattctctgtacaataaaggttggggatattcattcgtctattcactacaagaagtacgtgatatttatttagcaatacaaaagtataaatatatcaatctaggtcaatttacggatgaatacgttattcctcatattccgaatgttggagtagcttggaataaaaggcgtgttttagaaatactaaatgctttagtcaattttggtttactcactcctcaatatgaattaacaaatacagtgcacctatttgaagattatcaaatagggaaacccatagatgacaatgataacaaaatatttagacgtatatttttttcctaccatcgttttagagatttttcctctctatatttacctattgataataattactcaaatatagaagaggtattactcaataattcaatgccattatttagtttcggtagtgaaaggaaatacactgattcattttttaaaacgttcaaagataatcctgatatatattatataccagaatataataaagataatgagaaaaatagtggttgtaagatgttttgggatgttttcatttcttggggagttcaattgaaagttatggaaaaattcaattcgtcaatttttaactataaattatctaatggaaaaactttttcatgtagttatttcttgtcttcagacaacttattgatgccttcactaattgattttataaaaaacaattatcctgaaagaaaaaatatagatttatccttgcttatttttactctttgcactatatttagaaaatcgctctcttctactaaagattatattatagaagagtacaagcgaaacaaagaatatatcagcctagttaggacttccgaggtttttatcaaatcgggaaaatttgcggaaaatagcactgtgatatatcctaaatataaagatagttttatttcacatttaattataagattatga

SEQ ID NO: 2727 - DNA, 1074 bp, B.fragilis
agaatgagaaagatagggcttctatttattaccatattttgcttacttgcatgcaaaaacaacagttccaggatcagtttggaaggcgagatcaagggattgactaatgacacactctacctgtatgggacagatgctttgtacgatcgtatagatacgatttatgcagagaaaggcaagttcagctacaacctcaatatcgattctacagtaattgacacactgactacagccgtactcctgataaacggtcatgtagagtatcctgtttttttggataaaggaaatcaaattacgatcaaaggaaatattgatgatctcagctatctggacataaatggcaatgaaccaaatacgagtttgagcctttttatgaaagaacaaagaggcttaggcagtgcatcagacaaaatgatgcaggagaaggccgaaacatttatccgccaacacaactcttcattggcaagtgtttatctgctggataaatactttgtacagactccgcaaccagactatatcaaaataaaagaaataactgaggctatgacaggtgcactcctcgaccgcccgtatatcgagaatatcagcgactacatcgatcaattggaaaaagtgactgtcgggaaatctgctccttactttagtttacccaatgaaaaaggcgagaaattatcacgttctgccgagagattcagaaatagatatctcctgcttaatttctgggcttcatggtgtgatccgcaacctgaaaccaatgcagaattaaaaagactgaataaggaatataagaaaaacaaaaatttcgtaatgttgggaatatcactcgacatagatagagaagcatgggaaacagccattaagaaggatactttgagctgggatcaagtatgtgattttacaggacttagttcggaaacagccaaacaatatgccatactgacgcttcctactaatatactgctctctcccaccggcaaaattctagcaagagatatccagggagaagcgcttaccgataagctgaaagaattactaaaaacggaagagaaaaaaccagggaaatctatccgctaa

SEQ ID NO: 2728 - DNA, 297 bp, B.fragilis
attgtcggaaaatcaagttgctcttcggtagcatccaggctgaacatcaggtcgaagaccatctcgtgtacttcgtccggacgacagttcggtttgtctaccttattaataacaacaatcggtttcaatccgatttccaaagctttctgcagcacaaagcgcgtttgcggcatcgggccttcaaaagcatcaaccaacagaatgcatccgtcggccatgttgagcacacgctctacttcgccaccgaagtcgctgtgtcccggagtatcaataatattaatcttagttccgttgtaa

SEQ ID NO: 2729 - DNA, 318 bp, B.fragilis
aaagatatgaaacaggaatatctaatagaacttgtcaattgtagtacggaagatagtattatgctacaagtaaatgaaacagatacatctgttaaagccatgaaatcatggataatgcagcaagaaacaatacaaccatgtaagaagcaccatcttcacatcatagggaataaaacttgtgacttggaattggaggatgtatatactctctgtaaaatcatacaggctgttgttgcagaaccactctcttgggatattattgaaagggtgctaagtgaaaaagatagcaatcttgtggcaagcctgttgctctattaa

SEQ ID NO: 2730 - DNA, 558 bp, B.fragilis
cgcttaatgaacgaaaaagaagcaattattaaactaaagacctgcaatgataaagccgcctttgcattcctctatcgctcttattgggctaaggtttacaattttacgcgactttacatcacctctgcggtcgatgtggaagaaatcgttcaagaagtttttattaaaatttgggagaatcgggaagctttggatgaagaacaaaattttgccggatacttatttatcacgatgcgcaaccttgttttcaaccgttcccgtaagaatctgaatgaacccttctaccaactatcagtgatagaagctgtcgaagaatcatacgatatagaagaagaattggacgcagccaatctgcgcacacatatctcagcactgatctcaatgctgcctccccggcagcaggaagtgtttcgtttaagcagggatgaggaactttcttatcgcgaaattgcagaaagactacaaatatcagaaagaacagtggaacaccacatctccgatgccctaaagtttctacgaaaaaacatcaaactctatttactgttcctttcattataa

SEQ ID NO: 2731 - DNA, 630 bp, B.fragilis
gaaataatgaaacttaattatcttttaattctgattatatgtgtactattactctgttttaatttatatatatttaaacagaatagtgcttctgatagaatgcaggatactattatacgattagcttatgaagattctataaaagaaagcagtcatcgaattgagcgggaaattagaaactatgagttgaggactaatggaaaagtaatgaatcctttattcgaggtttttgatactaatggggataaaagaaccctctcaaagattattgatggaaataagttcgtgttacgttactctgaattaaactgtaatacttgtgtaaataagcaaatagaattattgaatctgtatgttgactcaataggtgttgatcatattatattgcttacaaattatgatagtaatttctatatgaagcagtttaaaagaatttcaaaaataaaatatccaatatttaatataggtgctaatctgaatgaatgtattccggatatagagcggccttatttttttataattgattctaattttagaataaatagcgtatatgttcctcaaatagatgaaagtaacgtaacaaaaacatattttcaccggattttacaatattattttgatattccttaa

SEQ ID NO: 2732 - DNA, 876 bp, B.fragilis
agcaaaatgaaaaaagtaagtattttggctgctgtagccatggcaacaggcttggcttcatgcacagctcaggctcctaaagccactctgaaaacagatgtagattcattgtcatacgctattggcatcagccagactcaaggtctgaaagactatctgtcacagcgcatggagatggatacaacatacatggcagatttcctgaaaggtgtgaacgacgctgccaataaaacaagcaaaaaggatcaggcttatctgctcggcttgcagatcggatcacaaatggcaggtcctcaggctatcaaaggcatgaaccaccagttatttgctgatgattcaactatgactgttaacaagggcgatattcttgcaggcgtatttgcaggcgtactcaataaagatatgaagatgcgtcccgaagaagctcaggtattgattcagaaaatgatggaaagcatcaaaggaaaagctgccgaaaagaaatatgctgataacaaagctgccggtgagaagttccttgctgagaataaaactaaagaaggagtaaaaaccactgcaagcggattacagtacaaggtgattactgaaggtaaaggtgaaattcctaacgatacttgcaaagtgaaagtaaactacagaggtaaactgatcgacggaacagaattcgaaagcacttacgaacgtaaggaaccgttcgtgactaacgtcggcggagttatcaaaggttggactgaagccctgaaaatgatgcctgtcggttcaaaatgggaactttatatcccgcaggaactggcttatggctcaagagacatgggacagatcaaaccgttctctacactgatattcgaaatagaattgctggatattgagaaataa

SEQ ID NO: 2733 - DNA, 1515 bp, B.fragilis
agaaaaatgaaaattaaaatcttattttttatttgcattgtattatcatcaattgatataactaatgcacagaacatcgtaactaagaagacttattgggattggggaaattcccgtttacatgaaatctttactgtcattgcgggtactggtacaaggcatggatcttataaagagtatgacaagaatgggatgttactaatttctgcaaactacaatcatggagctttgcatgggctatgtgttggatattttggaacacctcaaaattatatttccaagtccactaattatctaaatggagagaaaaatggagtcgaaaagaattataatctaggaagtagcgggcattatttgatagaagaatgtgtttataaaaaggatgaaatgatagaaaaaacgtcctattatactgatgtcaaatataaagggcgtaaaaaaagccatgccaaattggtcgatgataaacaattcaatacaaattggtatcaaaatgggcaaatagaatatgaaggagtgcttcaagtgacacccgggaactatggtaatgtaacaacgccaattcagtataccagatatagtgaggctggtgctctaatggaaaaactaaatgataatattatctcattctatgcggaagatggcaaaactatcacacaaaaagagaatcttagtaccgatgtaatagagtattatgataatggtactttgactaaatcaataaagattctaaaagaagatggagatgaatattatgaggtgtctttatataaaaataacagtatatattccaagaaagtggtagaccgaaacgggaatgatgcggaactaatcaaaaaggaaaaacaattagcacttcaatatgattccttgtataataggttgaaagaaatgcttcactcaaatgtttctatgaatataacaaaaatggtatttgccaatccagatagggtgtattgcagaaaaggacagtatgagagtagtggaaaattttcagctttggaagctataatcagaacacatgaaaaagaattagatgatgttgtccgtcagcgtaatgaatatacagaaagaggatttaagagaaacgatggaaaatattataaatcagtagagcaaataaaagaatatattgacaaaatcagtcaaaattttatgcagaaatatgacactctttctgttatgaagaaaatagctgaacaaataaatgacgacctatattatatagaatgttcttatacatactatacaggacaacaaggatataaagataatgtaccaggaaagcataagaatgcttacaaggcatatatttctactactgaatatttaacttcaaatatggaaggcaaaaatctgagtgaaacgttgacaatgcttcaacaatatgcaactattagttctaaaatgagaaagtggtataatatgaaaattactcctatcgagaaattattcaagaaaacggaaattcccgaaactcaattgaatatttttatgaataatgatgtagaataa

SEQ ID NO: 2734 - DNA, 1401 bp, B.fragilis
ttcctgatgaagcattttaccggcatattatttttacttcttctctgtttctcttgcaccccggtacatgatgcgccattggagcaggctctcacattggcgggagacaatcggaaggaacttcaacaagtattagggcattacgaaggtgattcgttgaaacataaagctgcctgctttttgattgaaaatatgattggtaaaggaactatccgttatttgcttcgggagagtgatagttgttatatacgacaagaacccgagccggacttaacgtgtataacagccgactatttgatagaaaacatagatctggcttttgaagtctggcaaaagtatccttggtgcaaacaattatcttttagagagttttgtcggaatatattgccttatcggttaaaacaggagcctttggaccgatggcgttcttactattatacacgttataaaatgacggtcgactcgttggcacgagcaggggctaccatgagagagattgttttcttctttaactcacggcatggaaagaaatatcttcatgatgctgccaaaataccgggggacttctctatcgagttgatagaaaagctgggagggggcacctgtgatcatctggcgttgaatgctgtacagttgatgcgtgctgtcggtatccccctgaatcttgatattcttccataccatggcaaagtgaatggaggacatgcttataacagctttaccgatgaaaatggaaaatttttctatttttctccttatgagcgcgaaccggaacggaatcaatggattgctcctttgatacagcgtgtctgctatgaacgtcagccagagccgaaaatagggcgtaaccgttggaatgcacaattggtcaatcgtttactgaaagaggtaactgccgaatattatttgtccgacagtgtccggttacctgtacatacatcggatacggtggcttatatagctacttttaaccgtggagctttcaaagtagtgtcgcagggaagagtagaaagcaacagtgtgctgcatcgtgtgttaccttacggattactttattttcagatggcggataagaaaggaaagttggttccgacagggagtccgtttgtgatgactccggatagcattcacttcattactccgatccggcagaccactgtgctgaatggtattcttacgtatgatgtaaagcgggttttagagttgggtgatgaagcatatactttgtattattggaaagacggctggcaaccggttaaagaagtgacttctaaagattctcgtacgctcgactttggagaggtacctgtccggtctttgtttcttgtatgtggaaatacttatatggggcgtatgcagcgtcctttcttgttggaggatggaaagccggtgtattattga

SEQ ID NO: 2735 - DNA, 360 bp, B.fragilis
acctataagaatatgaataataagaatatctttactcagaattgcgtcaaatattcactgaagaatgcaacgcaagagttctccttgatacgtctgcgtatgacaattgggggagtacgttttagctattgcctaccagtagaatacaaaatcaaatcctcattttgggataaggaggcaggaaaagccatagaagatgccaaaaggaataccgagttgaagggcaatcccatgctgcaagtcgcattgcgtaacatcaataaggagattgaaaaaacgaccaacaccttaattaaacaaaagccgggatataaccccgacagccagcctgataaaagacgagttgataaaggcacttaa

SEQ ID NO: 2736 - DNA, 1113 bp, B.fragilis
aacattaaccttaaaacaaacattatgagaaaagcacttctaaccgttatttcctttacattgtgtctgtacatcacctcctgtagccaatcatccaaaccagaaaaagctagaacaatagaaacaattgcaacggatgcacaacagacattatcttttaatcacgaacctttatccattgacccaatcggcataggcgatattattgtcaccgatacatttctaatattagctctaaataaagaggagaatatgctgcatgtatacaaccttccccatctgcaatttcttggaagttttcagaaaataggaaacggaccggatgaagttatactccctagtgcttttacacaatggtttaacaaggacgggcagatacaacttgtaatgagatcctatcaaaaattcacaggtttattaaatatatccaagtctttgatagaaaataaggctatttatgataacaaatatacctataatgctcccaaaggaaagaatagttttcaacagtccagcgtttcatatcttttaggagattccatatttctcataaacaggagtatcataatgcgtccacaagacaatcaaaatgatttttttgaagtttacgattacaaaaacgacagcatcctgcgcagtttctacgcctccaatttccccaaggagttgctagaacatcacggaagagatcaagctttccaaaaagatattgcaatcagcaatgattgcaagaagatggtcattgcatacagattcctcaatatgataagtatagtaaatattgaaaaggaggaaattaataacctattcactgatggaaataaattaaattgggaacaggtaatagaaggcactcccaaaccttattataccaaagtacactgcaataatgcatatatctgggccatggcaatagagggggaagacccttcaacattccgctctcgcctggatatctttgactggaaaggcaattatctatgtaaagcccatctggacaaatgggtttcctctttcagcatagacgaaagaaaccaaaccatgtatgctgtaactgcagatgacatgcttgttcgatacaacatcaaagaactactggaccagcttccctaa

SEQ ID NO: 2737 - DNA, 1068 bp, B.fragilis
atagtttatgataattacccgaaatatgatagctttgttcgcatgaaatggaatgtcctgttatatggtctgttattctcgggattaggtatcttttcctatctcctgcttgtcaactatacggagctgactcctaaagtagcggatgttctctattcaaagggagcattcgtcttctttattaccgctttcaatgtgcttggttattctacgcttcggatcagttcgtggataaacactcagtatgcactcaatatccgccatcgttggaagataatagttatttatgttgccgttatcttgttattcctgttgttgaactatagcctgctgattgctgctaagctattggcaggcattgacaacctatttactttctccaatggaggctggcgtatcctgatcgtggtatggctcgtagagcttgtcattgtaggcttattattggcaaatcgttccattcagaataacctgaaactgcaacaggaggccgcaaaactgcaaacagagaacgacactgcacgttatgcggctttacaaagtcaactgaatccccattttctgtttaatagtctcaatacgctgattgctgaaatagaatataacccgggtaatgctgttcatttcaccaagcatttgtccagtgtataccgttatgttttgcaatgtcaggataaaacattggtaacgttgacggaagaactggaattcttgcaatcttatctctttctgcataaagttcgtttgggagattgcattagttgtaactgttgtatagcttccggctatactagttgtatgctgcctccgctgactttgcagttactggcagagaatgtcatcaatcataattctattactctcagcaagcctatgaagatagatattcggttagaggaaggatatcttgcggtgagtaaccccatacagcctaaaaaaagtcatgaatcgccgggtgtagggctgaagaacctgtccaatcgttgccagttgatgctcggcaaagagataattgtccacaacgatgaaaaagtatttatcgtaaaagtacctttactgtatgaataa

SEQ ID NO: 2738 - DNA, 1143 bp, B.fragilis
aggcttaatgagtgccgattcaaaaggcacttatctaaacgcaaatatcaaaaagggcggatacagatattcaaaactgtaaatacaatattttatacttcaatgaatactatcaaaatagaccaacaattaaaacgtatacaaataaaagaatttgagattgaaaatgaaatcgttttcaatttcttcaatagaatttctgcctcagaaagagatgacaaactggtacaagctatttatatcggaatcttggctttaatggaggatcgtttttcttcttttctatcaaaaacctcaaatgaattaggtgcggagttagaaagtttaaagatgatttttgatatgaaaaaagaagtattctataagtcatcaataaaaggtattttggcagaaaatgatattgctgaatttttaattgaccattttaaagataagaagatttcagatgaagtatttttgactggaaatatagctggtaaactatcaaaaaataaaactggtgatattgtctgttgtattgaaggaaaagaggaacagaaaatagtcatagaatgcaaatttgacaaaagtatcagacttggagatattgaatctaaagatatttttacccgaaaaactgatacagcatggagccaattgttagaggctcaggtaaatagagaagcacaagttggaattattgtattagacatatctttggtagataattctgttttcaaaaaatatgaaaatattggatatatacctaatgttgggttcatcgctattattgactcccaaaaaggagactattcaaatctttctattgcctattttcttgcacgagatattattttgaattctcacaaagtagaatttaacaaagatatattaacaattattgttggccgaattattaaagatatcaatgagataaaaacaataaaatcttgtgttattaataatattgaaaataacaaaataatattaaggcaattagaaaaaagtatgctgttaatggaatttaatcaagaatacttaattaagtttcttaaagatggaactttgacaaaagaagatttattagaattttatcaaggagaaactattaaagaacggtataagatcatagagaaagagattgataatgaatttagttcttag

SEQ ID NO: 2739 - DNA, 1155 bp, B.fragilis
actgaatgtgaaatagcaaactgcatggaagaaaactctatcaagatacataaatggctatatccggcttcatggttatatggagcaggagtagcattacgaaataaactctttgactgggggaaacttcagtcaaagagttttaatgttcctattatttgtatcgggaacatcgcagtgggcggtacgggtaaaacgccgcacacagagtatctgataaagttgcttcatgatgaattccaagtggctgtattaagccggggatacaagcgccataccaaaggattcgtactatcaacagcagaaagtgacgcccgcagtattggcgacgagccttatcaaatacaatcgaaattctccgatatccgggtagcagttgacgaagaccgctgccatggcatcgaaaggttactcacacttaaagagcctccggtcgaagttatcttgttggacgatgcgtttcaacatcgatacgtgaaagcaggactaaatattcttctgacagattatcaccgtctgttctgcgatgacaccttgatgcctgcgggacgcttgcgggagtctgcacaaggcaaaaatcgggcacagatagtcatcgtaaccaaatgtccgccggatatcaaacctattgattacaatattattacgaaaaggttgaatctgttcccctaccagcagttatatttctcgtctttccgatacggaaacctgcgggcagtctttcccgattgtgccactgtacaagagagaaaattatcctctttacagacagaggaacagatactgctaattaccggcattgcatctcccgatacgatcatccgtgaattggaaatacatacacggaacatcgacttactcgcttttagtgatcatcataatttcagccagcgagacttggcgcaaataaaagagagattcggtaaattaagaaaagggcaacgcctgattgtcacaaccgaaaaagacgcgacacgcctgatatgtcatcaggagctggatgaagggctgaaaccatttatttatgccctacccattgaagtagaaatattacaaaatcaacaagataattttaaccaacacattattggctatgttagagaaaatacaagaaacggcagccttcctgaaaggaaagatgcacacaagtcctga

SEQ ID NO: 2740 - DNA, 3264 bp, B.fragilis
tgtatgacagaaaaaactaacctgtttccgaacctaatccggtttcgagaaacaaatcgcctgaaaatggcaatcgctgcttctatcatgctatggtgtgctacacctcagcaagcggcagccgatacttacgaaaaacacgaaatcgcctccgtacagcagcagaaagtgaaaacaacaggtacggtactggaccagaacggagaagccatgatcggcgtatccgtcaaagtgaaagacaatgccactatgggtaccatcactgacctggagggaaaattctctatcgatgcacccaaaggcgctacactcgagatctcctacattggctataaaaccgttacagtcaaagcagaaggtacagctctccacattacgatgaaagaagacgccgaggtactggatgaagttgttatcgtgggttatggttcacaaaagaaggtgaacgtaaccggtgctgtcggtatggtaaactccgaagtactcgaagcccgtccggtacaaaatgtatcacaggcattgcagggtgtagtaccgggtctgaacctctcggtgggtaactccggcggtgcactggatagctcaatgagtatcaatatccgtggtgccggtaccattggcgacggctccggatcttctcctcttattttgatcgatggcatcgaaggtgacctgaactcggttaacccgaacgatatcgaaaatgtatccgtactgaaggatgcagcctctgcttctatctatggtgcccgtgccgcattcggtgtaatcctcgttacaaccaagagtggtaagagcggcaaagcaaaagtcagctataacggtaacgtacgtttctccgatgcgctttgtgttccggaaatgatggactcttatcaattcgcactctactttaaccgtgcagccgaaaatgccggtgactcaggcccattcagccaagaagcgctcgaccgtattcttgcctaccaagccggaaccctgaaagagacaatgaccatgaacgaacaaacccgtaaatggcaggcttatggcggtgctaatgccaacaccgactggttcaaagaattctataatgactgggttccgtcacaagagcacagcctgagcatcagtggaggttcggagaaaacgcagtataccatcagcggaagcttcctcgatcagaacggtctgcttcgccatggtagcgataatttccaacgctatacgatgaacggtaaaatcacaagccagattgctgactggttcactgtcacttactcaaccaaatggacacgcgaagactttgaccgtccatcctatctgacaggtctcttcttccataacatcgcccgtcgctggccgaccaatcctgcttacgacccgaacggacatccggtagacggcatggaaatcgaacagttggaaaacggtggaaaacagatcaaccagaaagacctgaacacgcaacagctacagttcattttcgaacccatcaaaaactggagaatcaacgtggaaggtagtttacgcacaacgaacacaaacgaacattgggatgtattgccggtatatgcatacaacgcagataacgaaccgtacctgatttcatggaacggcggcgcactcggcctctctcaggtaaacgagtattcatataaagaaaactactacacgaccaacatctactcggactactttaaacagtttgacagcggacactacttcaaagttatggccggtttcaacagtgagctttataaaacccgttatgtccaggctcaaaagagcacactgatttcaagttcggtgcctaccatcaacacagccaccgaagacccgaaagcatggggaggatatgcccacaatgccgtagccggtttcttcggacgtatcaactacaattataaagaccgatacatggtggaagctaacggacgttacgacggttcatcacgttttataggtgacaaacgctggggattcttcccttcattctctgccggatggaacgttgcacaagaaccattctttgaaagaatcgccgaaaaatgcagtatcggtacattgaaacttcgcgcttcttggggacaattaggtaatacagataccaaagacgcatggtatcctttctatcagactatgccgacaggctccaactatggttggttgctgaacggagcattacccaactatgccaacaatccgggcattgtcagcatgaagaaaacatgggaaaccatcgaaacatgggatgtcggtttggactggggattgtttaacaaccgcttgaccggttcgttcgactacttcgttcgttatacttacgatatgatcggtccggctcccgaattagcagcatctctgggtacaggagtgccaaagatcaataatgcggatatgaagtcctacggttttgaacttgaactgggttggagagaccgtatccgggatttctcttatggcgtgaaattcgttctgtctgattctcagcagaaaatcctgaaatatccgaatgaagactacaacatcggtacttattacagaggccagaaactcaataacatctggggatacaagacaatcggtatcgcacaaagccaggaagaaatggacgcccatctggcaaaagtagaccaatcggccttgggtagtaaatggggagcaggcgacatcatgtatgccgacctcgacggtgatggcaagatcagcacaggaagcaataagttgggagatacaggtgaccgcgttatcttgggtaacagtacaccgcgctttaactacggtctgactatcgatgcaagttggaaaggaatcgacttccgcgcattcttccagggcatcggtaaacgtgactattggctgcagggcccgtacttctggggatcaaccggtcttggacaatggcaggctgccggcttcaaggaacattgggatttctggcgtccggaaggtgaccctctgggagcaaacaccaatgcttactacccacgtgtagcaagaaacggcggtaagaatacgaatgtacagagccgttatttgcagaatgcagcttattgccgtctgaaaaatatccagataggctatactttgcctaaaacatggacagaaaaagcaggtatgtcgtctgtacgtgtctatgtatccggagacaacctgcttactttctctgatatcacaggcatcttcgacccggaagcaatcggaagtacatatgatgcgaacaacggtaaactgtatccgttgcagagagtcatttcagtcggtttaaatgttaacttctaa

SEQ ID NO: 2741 - DNA, 1917 bp, B.fragilis
gcgtgcaaagataggcattatcttttatcccacaatgaattgcaggaaatattttctatagtatcccttttttctaatccaatttttgtacctttgtcgccaaataataggtattatatgcaaaatattcgaaacattgcaattattgcccatgttgaccatgggaaaacgactctcgtcgataaaatgcttttagccggaaacttgtttcgcggcaaccaaacaagcggagaattaattctggataacaacgacttggagcgtgaacgagggataacgatcctctctaaaaacgtttctatcaattacaacggaactaagattaatattattgatactccgggacacagcgacttcggtggcgaagtagagcgtgtgctcaacatggccgacggatgcattctgttggttgatgcttttgaaggcccgatgccgcaaacgcgctttgtgctgcagaaagctttggaaatcggattgaaaccgattgttgttattaataaggtagacaaaccgaactgtcgtccggacgaagtacacgagatggtcttcgacctgatgttcagcctggatgctaccgaagagcaacttgattttccgacaatctatggttcggccaagaataactggatgagtacggactggaaagagcagacggacagtattgtgcctttgctggattgtattgtagagaacattcctgctccagagcaattggagggtactcctcagatgctgatcacttcacttgactactcttcatatacaggccgtattgctgtagggcgtgttcatcgtggtacactgaaagaaggtatgaacgtgtctttggctaagcgtgacggcagcattgtgaaatctaagattaaagaggttcatgtattcgaaggactgggtcgtgtgaagacgactgaggtctcttcgggagatatttgcgctttggtaggtattgacggattcgagatcggagatacgatctgtgattatgaaaatccggaagcattgccacctattgctatcgatgaaccgactatgagtatgctgtttgccatcaacgactctccgttctatggtaaagatggtaaatttgtaacttcacgtcatatccatgatcgcctgaccaaggaattggataagaatctggctttgcgcgtacgtaagagcgaagaagacggtaaatgggttgtatcaggccgtggtgtgcttcacctttctgtcttgatcgaaaccatgcgtcgcgaaggttacgagttacaggtcggacagccgcaagtaatctataaagaaatagatggagtaaaatgtgaaccgattgaggagcttacgattaacgtacctgaagaatattcaagtaagatcatcgatatggtaacccgccgtaaaggtgagatgactatgatggagaataccggtgaacgcatcaaccttgaatttgatatgccttcgcgtggtatcatcggtcttcgtacgaatgttctgacggcttcggcaggtgaggctatcatggcacaccgctttaaggaatatcagccgttcaaaggagacatagaacgtcgtaccaatggttcgattatcgctatggagagtggtactgcatttgcttatgctatcgacaaattgcaggatcgtggtaaattctttattttccctcaggaagaggtgtatgcaggtcaggtagtgggtgagcatgctcacgaaaaagatttggttgtaaatgtgactaagtcgaagaagttgactaatatgcgtgcttccggttctgacgagaaagcccgtttgattcctcctgtacagttctctcttgaagaggccttggaatacattaaggaagacgaatatgtagaagttactccgaaagcaatgcgtatgcgtaaggttattctggatgaaactgaacgtaaacgcgccaataagagctaa

SEQ ID NO: 2742 - DNA, 1308 bp, B.fragilis
gataaaagagaaatgatgatgaagaaaataaatagatggcttatctttttgctgtgtgtgccgacagttgcttttgctcagcaaaatagtttgctgcaaaagtacaggtcgatggctttagattataaccatgacttgaaagctgcggacaaaaatatagctgcaagtatcgaattggagaaagcggcacagaaggatctacgccctaaactgtcgggagaggcgaattttcagtataccggtaatcctcttcaattgaatatcgacttgccttcgatgcagactccgttggcttttgaaggaagaaatatgaaatacggtgcttccctctctttgttacaaccggtttatacgggtgggcggttattggaaagtatccggatggctaaacatcagcaaagtctggcaatacatcaggcagattatttccgttccgcagtatcctatcagacggatatgcaatattggaacactgttgcgcgtgcagaaatagtccgtgtaactacggaatatcgcaattcggttgccaccttctcccaaagcatacgggagcgggtggaagcaggattggttgatccacaggacttgctgatggcggaggtaaaactgaatgaagcggaataccaactgttgcaagcaaaaagaaatctggaaacaggacgtatggcactaaattctctgattggcgtggaacttcatgctccgactgaaatagaagatacgatttctgccgttagggcggataaagatctgtggggtgagggtgaaatagatcgtccggaacttaagatggcctatgcccggattaaaatagcagaaagttcgaaaaaattaacggatgctaagtataagccacagttttatataggtgtagatggaagctattctgctcccggttatgatttccgttccgatttggatcccaattatgccatttatgccaaagtatccgttcccttgtttgagtggggaaaaagacgtgatgaaaagcgagcctcttctttcaaagtaggaatggctactgattatttgaatcaggtcaccgatcaggtgaaactggaagtggagacagcccgtgtttcattgtcgcagactatggaacaggtgcgcctcaccgaaggctcactgagtaaagccttcgaaaatgagcgtatggcattggagcggtatactgaagggaaggcctctgtaatagaggtgattgaggcccaaacgtaccggcaagcttcccaactgaaccatgtacaggcaaaagtctcggcacaaggggcttattcggaattgatcagagctttgaataaatattaa

SEQ ID NO: 2743 - DNA, 1077 bp, B.fragilis
gactgtatggaagaaaatgaagacatgtgtccattgagtggaaacgagatatccaactctatggaagcgaagcaagatacggattctctgtttgatcgaacttcggaatgtgatctaagtattgaagagtatcttcactttttaagaaacgcattgcatattgttgatttatctatgcgtatgaaggttagccaacaagatatagatgagttctttatagaattctatcttaaacatgaaaattcatataaaagatcagagggctttgctgcaaagttaatatttggctctattctgcctattttcgcaaactcaatttttattgatatcaataaagcaaaagagtgggaacgaaattgcgaaattgacattgaaaaatatggtatggctagtggaaacggatacgcccaagagtattatgacaaaaataaaataatcgaatataagtataaatcattgctaaagattttttctgatcctgaaatatatgcagagctaagaaagcagacccttgaacctatagaattactattaaaaaagaacaaaaatatgaattttgaaaaagataaagtatcgtcaaagaaggatactacattgtgttctattttactagaaaatagtgttgatgtcataggtaagattaataaacgacattcaaaactaagtgcagagttaataggtattcttacactatgtgagaatgaagttaagctgttttcaagtttaggcaaaaaaccacaggtggataattataattcactaacagcaagagagagggttattcttacagcttgtaggttatataatgaagggtttcgaggtttgcccgaatctcgtattgcaagagttattgcaatggaatacgggggagcagaagaaactttccgaaaaatactaaaacaattaaataatgataattttaactgtgctaagttgaaaactttaaaggacttgacagaagtcttgaaaaaagaagcaaatgaatccaacgttagaattgcgaatgaaaaatataaaaaaataactgaatttaggataggatcactacgggaactgatgagaaaaacaaaggagtag

SEQ ID NO: 2744 - DNA, 1179 bp, B.fragilis
aagccggtggatttacaggtggcagccattggtaccgtggagaaacaagtattgataaaacaattgaaatcaagaaggagacagcaaaagacaatgaaaaataattctggacgattgtcacttcgcaaacgcctggggttggaaatagccttaaagataagaaataacctcagggaattgcatccgttgcgtcaacttttctgggaatgtacattacagtgtaacttggcttgtaagcattgtggcagtgattgtcgaaaaatgtcggagcagaaggatatgcctgcaacggattttcttcaagtcgtagattcgattacgccgcacgtcaatcctaatgaggttaatatcatcataaccggaggtgaaccgctgatgcgggatgatcttgaagaggtggggatggctctttatcgcaaaggttatccatgggggattgtgtccaatgggttgtatttgacccgcgaacggctagatagtctgatggctgccggcctgcatgctgttacgatcagtctggatggatttgcggaggaacataactggttgcgtggcaatccggatagttatgaaaaagcgttggaagctatcaagatgttagtgcatgaaccggaactgacatgggatgtcgtgacttgtgtcaatcggaaaaactactcttatctggaagagctgaaagcctatctgtacactataggagtacgtaattggcgtatttttactatttttccggtagggcgtgcagccaatcatccggaattccagctaacagacgaggagtttaccggagtcctggaattcattaagaaggtacggaaagaggggcgtgtccacttgagttatggttgtgaaggttttctcggtaaatatgaaagtgaagtacgtgatcatttttattcctgtaatgcaggtatcagtgtagcttctgttctggcagatggttcgatctcgtcgtgtcccagcattcgcagtaatttccatcagggcaatatttatgaagatgattttatggaagtgtgggaaaaacgttttcaggtatttcgtaatcgtgagtgggcccgtaagggagagtgtgctgattgtagctttttccgttattgtgagggcaatggtatgcatttgcacaatgacaatggagacctcttgttttgtcatcagaaaaggattgtagaactttaa

SEQ ID NO: 2745 - DNA, 1491 bp, B.fragilis
acactttcggagtgtccatccccaacttccaaagaacaacaatgggctgtggcccgtccacaattttctggatcgggaaccagcatgcaggtattcactggcaaatcaggggaagcacatacagccggtccgctattgaatctgcaccgtccggcctatccggaaagctggttcaacgggggtaaaggcggattcgccatacggaaagaagccgacggagtgatagctgtggcatacagcggagagcgcatgctcgaagcgggcagttccattacatttcattttgccatgatcatcactccggtgaaaatgctggatatgaagagccagtttacagaccgctattaccacaatggccccaaacccacaccttcacaagcagacatcgaagcaggagtacgcatcatcaatgtccatcaaggcaatgactacaatccgtttatcaactaccccttcctgacggtagacaaaatgaaagagttcaccaaagagtggcatgcccggggatgtaaaataaagatatactatacgctgcgcgaactgagtaatgccaccgccgaaatatgggccatccgcagcctgggaaacgaaatcctgagaggcggaaacggcgagggattcccatggtgccgcgagcacttcgtgacgaactacacaccgcaatggtacgaacactttgacaatgctgacaagcagggtatcactgccgatgcatctatcctgacagccgaaggagactcccgatggtacaactattatatagaaggattgcgctggatggtgcagaacatggacatcgacggtatctatctggacgacgtttccttcgaccgccgtatcctgaaacgaatgcgccgggctatggaaagcgttaagccgggatgcctcatcgatttacactcgaatacgggattctcaaggggacccgccaatcaatatacggagtttttcccgtatgtagataagctgtggttcggcgaaagcttcctttatgataaaatgacaccggccaactggctagtcgagtcatcgggcattcctttcggactgagtggcgacatgctgtacagaggtgggaacgcatggttggggatgcaatatggaatgaccgtccgttatccatggtacaccgaaggagtcaactgcgatccgcgccaggtatggaagatatgggattcattcggcattgcggaagccaccatgctcgggttctgggaagaacatccggctgtaagcacatcggacgaagctgtcaaagtcactgtctatcgcaaaccggagaaagtactgctgtctttaggtaattattcggatgaagtgaaaaccgtaaaactgaatatagactggaaacagatcggcctgaacccacaaaaggcaaagctgacaacacccgaaataccggacatgcaacaggcgcatgaatggaatgtagacacaccgatagtgacagccccccggaaaggttggataatttatcttacctccgagtaa

SEQ ID NO: 2746 - DNA, 183 bp, B.fragilis
gcgcatggtttcagggactatttcactcttctattcgaagtgcttttcacctttccttcacagtactggttcgctatcggtctctcgggagtatttagccttaccggatggtcccggctgattcacgcagaattcctcgtgctccgcgctactcaggataccactacgcttcggttaccttag

SEQ ID NO: 2747 - DNA, 732 bp, B.fragilis
attcagcattggcttgatagcaaaaaactttctaccactgcaaatttaccaagcagattatttgcatgtttccgacaagtaacatacatttgttcccgaatagtaacaatgtgtaaaatgaaaggaaaaagcataacaggagaaagagatcgggaagctaccgaaaagcggttgctagatactatcggtaaaatgattgccgaagatggcttcgagaaaatcggcattaacgctatagctacccaatcaggtgtttcaaagatattgatataccgctatttcggttcggtagagggacttatggctgcttacatacggcaacatgatttttggatcaatttccctcttgaatatcccagccgtgaaaaactccctgcattcgtgaaaaggatgtttcaaggacagattgagcaattaaggaataatcctactttgaaaaggctttatcgctgggaattatcttgtaataatgatatgattgtaaagctaagagagcaacgggaaaaagtaggaatagaccttgtaaagaaagtaagcgaactaacaggacatccccaaaaggaaattgcagcaatagcctctatgctgacagcatcaattacttatctggtaatgctggaagatttttgtccggtttacaatggcattcctctgaatgagaattcaggatgggaacagataaacgaaggaattgaaattttaataaataaggtatttcaagatgaaaactga

SEQ ID NO: 2748 - DNA, 321 bp, B.fragilis
ctaaagcattgttgtatgaataaaaaggaattaataagcaccatcgcagaaaaagcgggactgaataaaagtgaatcccgaaagttgctcaatgtaataattggcattgtcattgaagaaatgaaaaaagatggaaaactgcttcttatgggattcggtacattttcggtgaaacgaaagccagcaaggaaagggatgaatcccagtacatttgtgcctatcgagatacctgctaaaaaagttgtaattttcaaacccagtgattgtctaaattctttgctgaaaaagaaaaggggaagaaagcgaatcgtcagaaattga

SEQ ID NO: 2749 - DNA, 381 bp, B.fragilis
cgggtgtcctgtggcacatcccaggtttaccaaccgaccgtctgccaacagaatgatactgtgaccgtcagggaaataatagcggtctacctgtggcttgatattgacacgtttgatacccggataatgtttcagtgcatctacctggatttcattgtcaaaatggccgatgttgcaaacgatagcctgatctttcatttgttccatgtgatcgatacggatgatatcgatattaccggtagtagtaacaaagatgttaccttctttgcaggcgtcttccattgttactacttcaaaaccttccatggcagcctgcagtgcacagataggatcgacctctgtaaccagcacccgggctccgtaggaacgcatagagtgtga

SEQ ID NO: 2750 - DNA, 1260 bp, B.fragilis
aaagatagatgctttgttgaagtgaacctccccttctacatagcccggcgatatcttttctcaaagaaaaagcacaatgccatcaatatcatttctgctatttctgtgtgtggagtggcattggctacgatggcgatggtgtgtacactttccgtattcaacggttttcaggatacagtggccgatctgtttactgtatttgatccggaactgaaagtgacgattgccgaagggaaagtttttgatgcacaggaccctcgtattcaagctatccggcagatgccggaagtagatgtgctgactgaaacacttgaagagaatgcgatggtacaatataaggaccgccagacgatggctgtcataaagggagtacaaaacaattttgagcagttgactgcgatagatagtatcctttatggtgcaggtgagtttttgctgaatgattctattgttgattacggggtgatgggaatagagcttgtctctacattggggactggaatcagatttgttgatccgttgcagatatatattcctaaaaggagcggaaaggttaatatggcgaatccggctgcttcctttaatatggattatttgtattcgcccggtgttgtgtttgtggtcaatcagcagaaatatgacggacagtatattcttacttcgttggattttgcccgacgtttgcttgactatactaccgaagtgtctgcaatagaactaaagttaaaacccggctctgatctttccttcgtcaaagcaaagattaagaaagaactgggagatgattttgttattcgtaaccgctacgaacaacaggaagatgtatttcgtatcatggagatagagaaactggtttcatatttgtttctcacttttatcttagtgattgcctgttttaatgtgataggttcgttgtcgatgcttattctggataaaaaggaagatgtggatacgcttcgcaagcttggagctaacgatcggttggtttcgcgtattttcctttttgaaggatgtatgatttccttttatggagccataatcggaattgtactcggattgctgttgtgctgggttcagatgacgtacgggattatttcattgggtggaggtagtgctgcaggaaattttgtagttgatgcttatccggtcagtgtacatttgtgggatgtcatcgtgatatttattaccgtttttgctgtcggattcttgtccgtctggtatccggtaaggtatctaagtaaacgtttactaaaaatgtag

SEQ ID NO: 2751 - DNA, 195 bp, B.fragilis
atctctccgtgtcagtatgtcatacggcctcattgtgtgttaacgtatgatatttggctgtacagccaaggacggaaagtgatgaaaggtaggttaagggatgatggaatgttggacgatatattcgtttattcaaggattttggttaaatttgtaaggccttctttcacgtttcttttgagaggtggggagtga

SEQ ID NO: 2752 - DNA, 315 bp, B.fragilis
ccgatggagtggttgaatgaatatcacctgtcagggctgctcattggtatttgcacgttcctgattatcggcttattccaccccgttgtggtaaaagctgaatattactggggaacgaaatgctggtggattttcctgatattaggtatcgcgggagtagctgcttcgttgagcacagacaatatactcgtttcgtctttattgggcgtattcgctttctcttctttctggaccatcaaagaagtctttgagcaagaagagagggtgaaaaaaggttggtttcctaagaatcctaaacgaacatacaagttctga

SEQ ID NO: 2753 - DNA, 1461 bp, B.fragilis
attatgttgctgaaacagactaaaatcgtagcttccatctcagacagacgttgcgatgtagattttataaaagagttgtttgatgcagggatgaatgtggttcgtatgaacacagcccacgccagtcgtgaaggttttgaggcgttgattgccaatgtgcgtgccgtatccaatcgcattgccatccttatggataccaagggaccggaagtgcgtaccactgccaatgcggaccccatactttatcagatcggtgagaaagttaaaatcgtaggagatcccgatcgtgagactacccgtgaatgcattgccgtttcatatccgaattttgtgcatgacctgaatgtaggggggactattttgatagatgatggtgaccttgaattgcgagttattgataaaacaaccgaatacttactttgtgaagtccagaacgaggcaactttggggagccgtaagagtgtaaacgttccgggtgttcgtatcaatctcccctctttaaccgagaaagatcgtaataacatcctttatgccatagagaaagatatcgatttcattgctcattcttttgtgcgtaaccgccaggatgtgcttgatatccgtggaatactggacgctcacaatagtgatatccgcattattgccaagatcgaaaatcaggaaggtgtcgataacattgatgagatcctggaagttgccgatggagtaatggtagctcgtggtgacttgggtattgaagtaccgcaggaacgtattccgggaattcagcgtatgttgatacgcaaatgtatccttgccaaaaaaccggtaatcgtggcaacacaaatgttgcatacgatgattaataatccacgtccgactcgtgcggaagtaaccgatattgccaatgcaatctattaccgtacagacgctttgatgttgagtggtgagactgcctatggcaaatatcctgtagaggccgtaaaaacgatgactaagattgctgcacaggctgagaaggacaagttggaggagaatgacattcgcattcctttggacgaaaacagtaatgatgttacagctttccttgctaaacaagctgtaaaagcaactactaagctaaagatacgtgccatcattacggatagctatcaggggcgtactgcacgcaatttagcagctttccgtggtaaatatccggtacttgcaatttgttataaggagaagactatgcgtcaccttgcactttcttatggtgtggaagcgatttatatgcctgaacttgccaacgggcaggagtactattttgcagctctgcgccgtttgttgaaagaaggacgtttgcatccaactgatatggtgggttatctgagtagcggtaaagccggaacgcagacttctttcctcgaaatcaatgtcgtggaagatgctttgaagcatgccggtgatagtgtgttgcctaatagcaaccgttatttataa

SEQ ID NO: 2754 - DNA, 1212 bp, B.fragilis
ttatttatgcttatgaaaacaagaatgatctatcacagtttggcaatctgttgtctattgcctgcttttgcttttacaaccggtgaaaacgacccatttatcaaatcgcctactgttgccaaactaacaaatacccctaacggtccgctaatcagttgcgatctgaaggcactaaaagatactgtaaacttcccattgagccagttaacagaagaattacagattgtaaaattagacaatcgggacgaagcacttattggcggctggatacgaacaaccgtcggagaaaaatatattttagtgagcaataacaaacaaactccttataaactattcgaccggacaggtaaatttatcaccaatatcggatcttatggacaaggcccgaatgaatatctaaacacttatgccgaacaactggacgaagccaataatcgcatctatatcctaccctggcaaagcagcaagatattggtattcgacttgaaaggtaatgcattggatcctatccccctgtgcctgagagttcctaaaggaaaattccgggtaaacacagctaagtcagaagtcacagtcacagtcctgccattccctaaatggccggcagtagtctggacacaagatttaaagggtaaacgtaaaaactttgtagcaccgggaagccttgccatgccacaagacttcagtaacgaagtgtcaatggggaataacacagctgcctacgatgtgatgttaatgaaaatcatgccacaaccaagtgtagataccctctaccattataatgccgccagcaacaaactggaaggacgtttcaccgtcaagtatccttcaaatgataaaatcccctggcatgcatattatgaaatccctaaatatttcatcggtgatgtctctttcccaatacaaatagacgaaagtacattctccggctctaaaccggcttattacatggttgacaaaaaaacattgcatggcaattatgtgcggctttacaacgattttatcagtaccccgagtcagacgatctatccttcgttcaacaatggatattatgtcactaatatggagcctatggcattgaaagagatactagagaaagaagtaaacaaaaaaggactgaccgcagataaaaagaaaaaggtacagaacttgatcaagacgttaaatgacaatgacaataatattgtaatgttcgccaaactgaaacaataa

SEQ ID NO: 2755 - DNA, 585 bp, B.fragilis
agatacatccgggcttacaacagctttacacattgtaaaacgcataactgtaacgatccaatgaaaaagattattctactaattatagcaagctatactgttgcaatggcgacagcccaaaagaaagaacacttcacttttgcaacaagtgtaggaacaggtattgacatgagcgagccagcagctactcctttttcattacaggttctgggttattatgccatcaacaaacggttctctgtcggtgtcgggacaggattatctatttatgagaaagttctgatcccgttatttgccgatgcaaaatttttaatcataaaacctagaaagttcactccttatatagaatgtggcgttggatatagttttgcaccgaataaaaatgctaatggaggtttttatctgaatccgtctgctggggtagaatattctatttgtaaaagtaagaagttattcttggctttaggatatgaatcccagaaacttgaacgactgaaaacgcaaaagcaatcattgtttacagccgagtttacagagaagctaagccataatgctatttcaataaagattggattcatgttttaa

SEQ ID NO: 2756 - DNA, 231 bp, B.fragilis
gcatttacccggaaagaagtaagcattttcctaaaatgtccttatgttccggaaatatctcctattgttgtccggaatatctcctattgctatccgaaacgggtcttggcggaagaatttttcctcccgttgaccattgcagacaaagcgttgtacactgacagaaaagcaggaaggagaccggaaaaggaaccatttaccggcagaaccgtcattccaccttcaaagtaa

SEQ ID NO: 2757 - DNA, 1545 bp, B.fragilis
aaacacgtgctaataaaagtattcggagcggctgtacaaggcattgaagcaaccctcattacaatagaagtcaacagttcacgaggatgcatgttctacatggtaggtcttcctgattcagccgttaaagaaagccatcagcgcattctgtctgccttacaagtgaccggctacaaaatgccaaccagcaatatagtcattaatatggctccggcagatattcgcaaagagggttcatcctatgatctccccctggccattggcatgcttgcagctggcgaaacaatctcatgccagaagctatcacgttacatgatgatgggtgaattaagtcttgacggaactatccaacccatcaaaggagccttacctatagccatcaaagcacgcgaagagggatttgacggattaatcgtaccttcacaaaatgcacgggaagcggcggtagtcaataatctgtcagtatatggagtaaataatatacaggaagtaattgagttcatcaatggtaaacgtgaactgacaccaaccatagtcaatacccgtgaagaattttatgcgtgtcagagtgattttgaatacgattttgcagatgtaaaaggccaagagaacgttaaacgggcacttgaggtagcggcggcaggaggacacaatttaattatggtaggagcccccggaagtggtaaatcaatgatggccaaaagattaccttccatactcccccccttatccttgggagaaagccttgaaacaaccaaaatacattcggtcgctggtaaattaggacgcaattcctctctgatatctcagcggcctttcagggccccgcatcacaccatctcacaagtagcgatggtaggaggaggcagtttcccacaaccgggagagatcagcctagcacataacggggtactcttcctggatgaactcccggaatttaatcgtagcgtgctcgaagtattgcgtcaaccccttgaagaccggcgtataaccatttcacgagtgaaaagcactattgactatccggccagcttcatgttggtagcctccatgaatccgtgtccttgtggctactacaatcacccgacaaaaccatgtgtctgcaatccgggacaagtacaaaaatacctgaataaaatatccggccccctgctggaccgaatagatatccaaattgaaatagttcccgtaccatttgaaaagatttcagaccggcaacagggagaatccagcgctgccattcgccaaagggtaatcaaagcccgccagaaacaggaagaaagattttccggctatccgggaacttattgtaatgcccagatgaccagcaagcaactttcttcttttgcacaacctgacacgaaagggctattactgctaaagaatgccatggaacgcctgaatctttcagcccgtgcctatgatcgtatcttaaaagtatcccgcacaatagctgatttggaagaaagcgaacaaatacaacccagccatttggcagaggcaatcagttatcggaatttagatcgggaaaattgggccgggtaa

SEQ ID NO: 2758 - DNA, 1215 bp, B.fragilis
ggagatatacgtatgaaaaaggttgtttttttaggattaggctatatcggacttcctactgctgccgtggccgccggacatggttatgaagttgtaggtgtggatgttaatccttcggtagtagaaaccatcaatcagggtaaaatacatattgtggagccggaactggatcagattgtaaaagaggtggtgcgaacaggtaatctccgtgccgtttcgaaacctgagcaggcagatgctttttttgtggtagtgcctacccctttcaaacaaaaccaccgtgcagatatcacctatgtggaatcggctacccgctccgtaattccttatctgagagaaggaaacctgtttgttatcgagtccacttcaccggtatttacgaccgaacgtatggctgaagttatttataaagagcgcccggaactgaaagacaaaatatacatagcctattgtcccgaacgtgtattgccgggtaatacgctttatgaactggttcataacgatcgggtgatcggtggcgtcaatcctgagtcaaccgctaaagccatagagttttattctgcctttgtacagggtaaactccacccgacgaatgctcgtacggcagaaatgtgtaagttgaccgagaactcttcgcgcgactctcagattgcgtttgccaacgaattgtccatgatttgtgacaaagcgggtatcaacgtctgggaactgatagaattggctaacaaacatccgcgtgtgaacatcctgcaacccggctgcggagtgggaggacactgtatagccgtagatccctggtttattgtttcggactatcccgaacaggcacaaatcatcaaacgtgcccgtgagacgaacgattataaagctgattggtgtgccaacaaagtaatggaagcttgtcagcaatttgtcgagaagaacgatcgtgaaccggtagtggcttgcatgggacttgcctttaaacccaatattgatgatttgcgtgaatctcctgctaaatatattgcttcccgcattgtatctgagtcgcgtgcagaggtgttgattgtagaacccaatgtcgcttcacatgccagttttcatctgactgactatcgggaggcttatcagaaagcggatatcgtggtatggctggtacgtcacactccgtttgtggagttgccccgtgaagaaagtaaattggagttggacttctgcggagtaagaaagtag

SEQ ID NO: 2759 - DNA, 1140 bp, B.fragilis
tcccttacgcttatgaaaaagccttcatcaacccttgctcccgccctggcctcactggacatcttgcgcggtttcgaccttttcttgttggtcttcttccagccggtattgtggacattggcacatcagctcaacctcccatggctgaacagtattcttttccagttcgatcatgaagtatgggaagggttccgtttctgggatctggtaatgcctcttttcctcttcatgacaggagcctccatgccgttctcgttctccaagtttaaagacaatccggacaaaggccccgtttaccgcaaaatcatcaaacgcttcatccttctgttcatcttcggaatgattgtacagggcaatctgctgggcctcgacccgaaacatctgtatttatactccaacacccttcaagccattgccacaggctatctgattgccgccatcatacagttgcattgcaacttccgctggcagctgatggtcacagccctgctattactgatctactggataccgatgaccttcctgggcgacttcactccggaaggaaactttgccgagaaggtggacaggctggtactggggcatttccgcgacggagtgttctggaatgaagacggcagttggagcttctctgctcactacaactacacctggatctggagcagcctcactttcggggctaccgtgatgctgggagcttttgccggaaagataatgaaagcaggtaaggataatcgccggaaagtggtacagaccttgctgataatcggcatatccctgatagccttctcgctgatatggagcctgcaaatgcccatcatcaaacggttgtggacaagcagcatgacgcttttttccggcggactttgcttcctgctgatgggtgccttctactaccggatagactacaaaggacacagccgcgggctgaactggttgaaaatatacggcatgaactccattacggcttatatcttgggagaggtcattaacttccgttgcatagcagcatccgtcagttacggactggagcaatacttgggtggttattatcaggtgtggttaagctttgccaactatctgattgtattccttatcttacggatcatgtacaggcagaagatattcctgaagatctga

SEQ ID NO: 2760 - DNA, 669 bp, B.fragilis
tcatttaatagctctactactatgaccgatcttaccattctcatcgcagtcatcgcattggcgttatggccaattgtattcctgatatcgcgtatcctgcacgagcggaacaaacgtgcgaagccatcgggtgacactgcctctgccgaaacggaagaagtgacagaggaaatgactacctccgcactgatcatgagcatccttcaacagctcggttgccaaccggaagtgaatgaagaaaatcatatcagcttcaagtatcagggagacgatttccttgtcgcagccgaagacggtctccggttaatcattgtatggaatccttggtgggcgtccatcagtatcgacaatcaggcattaccctatctgaaagaaattatcaatgcagtcaatatgaactcattagtgactactgtctatgcgctggacgaggatgaaaaaacatttggtatccacagtaaatgccatatgctcttcgctcccgaagaagaggagccggaaaaaagtttcaccgacctgctggacagttttttcactacccacaatactattaaagaaaacctgaaacaattgggtaacggaatgccggatatggaaaagaaagaacgagtaagaatcaaaggatttgctgcctacaaggacaacagcacggaactgaaaggggaataa

SEQ ID NO: 2761 - DNA, 264 bp, B.fragilis
tacaagaacaggccaaaggttaagacacatttgcagaaacacttgaataacgataagttccgtgagaacttaatcacctttggacaaacaaatttaataaacaaatcagcatggttcagaaaggagcaagaaaagaatgacatacatacagtaacctctaataattatgcttatgaagtagaaaaaacgaatcctttacaaaccttattccggaaacaaaataaaatccggaatcctaaaacaaactatcaaattaatgtttaa

SEQ ID NO: 2762 - DNA, 267 bp, B.fragilis
tccctcccaagagctcatatcgacggaggggtttggcacctcgatgtcggctcgtcacatcctggggctggagaaggtcccaagggttgggctgttcgcccattaaagtggcacgcgagctgggttcagaacgtcgtgagacagttcggtctctatctatcgtgggcgtatgaaatttgcgtggctctgacactagtacgagaggaccgtgttggactgacctctggtttaccggttgtgccgccaggtgcattgccgggtatctaa

SEQ ID NO: 2763 - DNA, 690 bp, B.fragilis
cgtgttacaagaatacgctgtaatgacatctgtaataaccattttctttttaatggttattatcagggatttatctattcatatttctataaaaaagtaattaccatgccaaacaacagtcggaaaacgatattcactaccatttccatagacaaggaaacggcaactttagtaggaaagatatgcaaacgttattcactgaaaaagagtgaagttgtaaagttggcattcggatatatagataaggcacatatcaatccatccgaagcccctgaatcagtaaaatcggaactggcgaaaataaataaaaggcaggatgatattatccggttcatccgtcattacgaggaaaaacaactgaatccaatgatacgggtaacaaattctatcgctttgcgtttcgatgccatcggcaaaactttggaaactctcattctctcacaactggaagccaatcaggagagacaaacagccgtacttaaaaagttaagtgaacagttttgtaatcacgctgatgtgataaacaaccagtctaaacagattaatgcactttaccagatacatcaacgggattataaaaagttgcttcatctaatacaactctattcagagttatcaacttgtggcgtgatggacggcaaacggaaagagaacctaaaagcggaaatcgtcaatttgataaatatatag

SEQ ID NO: 2764 - DNA, 333 bp, B.fragilis
accattaaaagtaaaagtatggaggtagtaaccattgaaaaaagaacattcttgtatatctgcgagaggttcacggagtttgctaaacgaacagaaagtttgtgcaatactcatactcaggaagtcgaaaactggctggatagtcaggaagtgtgcctgttgttaggttttagtaaacgaacgctgcaatattatcgaagtagtgggcgactggcttattctcaaataggaagcaagatttattataagtcttctgatgtggaaagaattattgcggatagtgaaacacaaaatcaatcactcaaacaagccacgccttatgaaaagaactaa

SEQ ID NO: 2765 - DNA, 1041 bp, B.fragilis
ttaaacaaaagccgggatataaccccgacagccagcctgataaaagacgagttgataaaggcacttaagaataagaaggaagaagaaaaaccgatatttcccgactttatatcttatattgactattacatggatttatgcaaacaaggtaagattctgaatgtggatggtacaaaattgtcctctgcaactctggctacctataaatccacaagaaatattctaaagaaatatgcagcagcccgtaatgtaacaatacgaatcgaggaagtagattctgagtttcgtaatgacttcataaatttcctgtatgatacaaaacaccataatggtgaatacaaactgaactcaatcggtaaatttataaagacgattaaggttttcatgcgccatgcgttcgacaacaatgttacctctaacaatagtgtgtttaaaaaagactttgttccattgaaggaagaagcaaacacgatctatcttacagaaagcgagttggaagcattatacaatcttgatttgccgtccaatcaggcagaggtaagagattgctttctgatttcatgttacaccggattgagatactctgatatatccagactggatgtgaagcatatcaatgtggaaaagaacacgataacgatagtcacatataaaacacgtaatcaagtaatcattcctatacatcgaattgtaagggggatattaaaacgctatggaaacaggccgccgaagccccaatgtaaccaatcaacaaatcggatgctcaaaaagctatgcgaacaagctggcattacggaaataatatcctatacagaaactgttggaggagcacataaggaatgcacagcccgtaaatgtgataaggtgacaacccataccgcccgaaggagtttcgcaaccaatgcttacaaacggaatgtccctacgctagcgataatggcaatcacagggcataagactgaaacctcattcatgaagtatattcgtataagtaaagaggagaatgcccaattgctacaaacgcatgaattttttgtatga

SEQ ID NO: 2766 - DNA, 183 bp, B.fragilis
ttatgggaaagggaaaggtcggggaaggaaagggacacattattatattatataggggaaatttataggggagagggaaaaggggatttgccgagaaagggggaaggagaagtgtttgcgggaggaaaagggatgtttcgaggaagaatatcgcggaaggaattggggttgggagagagataa

SEQ ID NO: 2767 - DNA, 315 bp, B.fragilis
gttatgagaagtacaaaatggatggtaggtattattctatttgcttgtgtattgactctaataggcgttacaaaaagtgtaagggctaaaaatcaattaggaaaattgacatttctgggcgttgagagtttagctgatggtgaaggaggagggagtgactatcgagaggcgactcctcatgattgtaattattctaaggatgtattccttgaaggtgcggaccatatcataaatgtaacggttcctggcaaaaaaggaatttgtgatggtactaatggtacatgcaatagctggccgtgtagagaggtaaaataa

SEQ ID NO: 2768 - DNA, 216 bp, B.fragilis
ttcattcttgggtttgtttcgagttcatttggttttaacttcaccacagataacacagattttcacagattaataatttattttattgataacaagattagaagttctgtgaaaatctgtgttatctgtggtgaaacaggttcattgctattccgtttcaattattcccaccccggattgttaggtgcaagtgccggattcaagataatttcttga

SEQ ID NO: 2769 - DNA, 1113 bp, B.fragilis
ttttggggcggctcatgcgtggaagatgtaacgtccaaactgatgcgccatctctggtatcatcctccccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 2770 - DNA, 336 bp, B.fragilis
tgtccggcaggaagcaggtcgttccgtcccagttctgcccagtcgaagctatccatgttcagcatctggcgtaagcgttccgaactgaacggaaggaatggttcgaaagcgatagccaggttggctaccagttgcagagatatattcaggatagtacctacacgttccatatccgtctttgccagtttccagggttctgtatcggccaggtatttatttccgatacgagccagattcatggcttctttctgtgcatcacggaacttgaatacattgagcagcttttctacttcggctttaacatcggagaattctttcagtgtctctttgtcataa

SEQ ID NO: 2771 - DNA, 225 bp, B.fragilis
aatatatttattatggaaagagaacctgtagtatcttctaatattgcttcaattgggtatgacgaaaacaataacatccttgaagttgagttcaataacggaaacgtttatgagtattatgatgttcctctgcatgagtatgaaggcttaatgagtgccgattcaaaaggcacttatctaaacgcaaatatcaaaaagggcggatacagatattcaaaactgtaa

SEQ ID NO: 2772 - DNA, 207 bp, B.fragilis
gggaaatttataggggagagggaaaaggggatttgccgagaaagggggaaggagaagtgtttgcgggaggaaaagggatgtttcgaggaagaatatcgcggaaggaattggggttgggagagagataaactgaaaaacaggtggggaattgacgggagttggacgggaaatcagacgaggactgaacgggaattgaatgaaaattga

SEQ ID NO: 2773 - DNA, 1614 bp, B.fragilis
tgtgatgctatatacaacaaaacagatttaaatagactcaaatccatgggacattacgagcataaaacgaaagaggaactactggaaattgtatgtaaattggaaaagaaggtggaaggcctctcttccgaactcgactctctgaaaaaagggcgattccgtgaacggtacagtactcggattctagatgcattgcctgatatgctgactgtttttgaccataatgcgaacattgtggagttggcttcatctcctacaacaaatcatgtggaaggtaccacctccgatagtattattaattcaaatgtaaaagatattgttcccgaagaagcgtatgaaagtgttcgtcacaacatggataaagtcatccataccggtaagagttcgacagctgaacattcattaatgctggacggggtactccatcattatgaaaatcgtatttttccgctggatgatcagtatttgttatgtatgtgtcgcgatgtctcgcaggagactgagatggctaagatcaatgagacccagcgaagtgagattgtacgtctcaattcgttgatgaatgacattttgaacaatattcccgtctatttatttgtgaaggataccggaaatgattttcgttatctttattggaataaagcttttgccgagcattccggaatctctgtccagagggctgtcggtagtacggatgcagatatattcccggacaagaaagatgccgaacatttccgggaagacgatttgaaggtgatgaagttgggacgtattgaatatctggagaattatacaactatgagcggtgaggtccgtacggtcactacaatgaaaacagttgtcccttcgggaggtcagcatccttatattatcggagtatcgtgggatgtaaccgaaatcaagaagacggaaaaggagcttatagctgcccggattaaggcagaagaggccgaccggatgaaatcttcgtttttggctaatatgagccacgaaatccgtactcctctgaatgcgattgtaggtttttccaaactgattattgaagcggacaatgagtgtgaaaagcgacagtatgccgatattgtggaacacaactcgactgttctgttgaatctctttaatgatattcttgatctttcggcacttgaagccggttccttggagctttcttatcacccggtgaggctgaaagatatctgtttacagttatatgaattgcatgtgaaatcggttaagccggaagttcggcttgtgctggacgaggtagattcgcaactttgcatacaaggagactgggaacgtatttctcaggttttggttaatctgattaccaatgccattaaatttacttctgtcggagaaattcattttggatttcagaagaaggcggatatggtacagttttacatgtctgatacggggaaaggtattccggcagaaagggtggccaccatctttcagcgtttcggaaaaatagatgattttgtgcaagggacaggattgggactgactatctgccggatgcttgtcgaaaagatgggcgggcgtatctgggtacgttccaaacagggagaaggaactgttttctattttactctgcctatggcaaaatag

SEQ ID NO: 2774 - DNA, 441 bp, B.fragilis
aagagctatatcagtgcgagcagggggaaaaatgcgcttaaaaattcttatctgcataaagtgctagctattatcaatgtagaattggaactattaagtctaaaaattaagcatcctgaatcatttgtttcacctatctcaccaacatccgaatcagatctatacgtaatccctaagtcaaaggacttggggattattggtattgctgaaatagtaatagggttatcttttttaggcgaagtagttggaaaagacggaaagcccgtcccattagttcgtttagctcacggttttgaagtccttttcaatttaaaatttggaagtatatacgataaactggatgctatttttatgcgtaaaccattcaatctgaccaaaacattagatgctttaaagagtgcaattaacaaagaagcccgtaaacgagctaataaacattag

SEQ ID NO: 2775 - DNA, 2079 bp, B.fragilis
tcgtataatatgcaatctatgattacaactcagttactccgtccccagagcattgtcgtagtgggggcttcgaacaatacacataagccgggcggcgctattctgaagaatctgattaacggtggttatcagggagaacttcgggctgtcaatcccaaagaaacagaagtgcagggagtgccttcctttgccgatgcaaaggagttacccgatacagatcttgctattcttgctattcctgcagttctttgtccggaggtggtggaaacactggccgcagagaagcagacgcgggctttcataattctttcggccggatttggagaagaaacgcaggaaggcgctttattggaagagcgcattcttgaaactgttaataaatatggagcgtcattaattggcccgaattgcatcggattaatgaatacctggcatcacagtgtgtttacgcaacccattcccaatctgaatccccatggagtagatctaatttccagttctggcgctactgcggtgtttattcttgaatcggcagtgacaaaaggacttcagtttaattctgtgtggtcggtgggtaatgctaagcaaataggtgtagaagatgtattacaatatatggacgaaaattttgatgtccggaaagactccaagatcaagttgatttatatagaaagcatcaagaatccggatcgtctgctgttccatgcctcttcattgattcgtaagggttgtaaaatcgcggctattaaagcagggagttcggagagcggaagtcgcgctgcatcatctcatacgggagctatagccagttctgattcagctgtggaagctttgtttcgtaaagccggtatagtgcgatgctattcgcggggtgaattgacaaccgtcggttgtatttttactttgcctgagttaaaaggaaagaatttcgctattgtcactcatgctggtggaccgggggtgatgctgactgatgctctttcgaaaggtggactcaatgtacctaaactggagggtccggtcgctgaagagttgaagagcaagctttttcccggggcttccgtaggcaatccgattgatattttggcaaccggaacccccgagcacttaagtattgccattgattattgtgaagaaaagttcgaaaacatagatgcgattctcgccatattcggcacaccgggattagtgactatgtttgagacttatgaggtattgcatcaaaagatgctgacttgtaaaaagccacttttcccggttcttccttctgtgcgtacggccggtgaagaggttgccttttttttagagaaaggtcatgtcaactttgctgatgaagtgatgttgggaactgctttgtcacgtatcataaatgctccaaaacctgctgttccggaaattgaactttttggtgtagatgtaccccgcattcgtaggattattgattctattccgcagaacggctatatcgaaccccattatgttcaggcgttgcttcattctgccggtattccggtagtcgaagaatttgtatcgggtaataaagacgaagtacttgctttcgcgcgacgctgtggatttccggtggtggccaaggttgtggggccggttcataaatcggatgtaggaggagtggtactcaatattaaaggtgaacagcatttggcgtttgagtttgaccgcatgatgcagatacctgaggcacgtgctatcatggtgcagcctatgctgaagggaacggagatgtttatcggggctaaatatgaagaaaagttcgggcacgtggtgctctgtggactgggtggcatctttgtggaagttttgaaagatgtttcgtccggtttggctcctttatcttatgaagaggcttattcgatgattcattccctcagggcctataaaataatacagggaactcgtgggcaaaaaggagtaaacgaggataaatttgcagaaattattgtacgcttatccacgctgcttcgttttgcgacagaaatcaaagaaatggatataaatccgttgctggcaacagaaaaggaggttgttgccgttgatgcccgtattcgcatagaaaaataa

SEQ ID NO: 2776 - DNA, 849 bp, B.fragilis
gaaaaagatatgaagaaattaggtatattcaagtataaatatgtcggcgagaatgttatacaatccggtttcacagtgctggataagattacgtatggatggaaaaatggtgagttaattgtaattggtgggcgtccggcaatgggaaaaactgcatttgggttatctttggtaaggaatattgctattattgatagaattcctactgcgtactttagtcttgagatgtcttctgttcaatttatgaataggtttttattaaacttaagtggtattgaaagattccagtctaaaccatataataagaaagaacaagcgatattggatgatgcagaaaaagtaatagatgatgctcctatctttttagatgatactccttcgttgtccgtgcaggaacttcgcacgagagcatttcgtcttgtacgagaatatcaggtaaagctaataataattgactatctccaattgatgaatgccagtggtatggtctttaacaatcggaaggaagaaatcagtacgataactcgttcgctcaaagcgttggctatggaattgaacattcctatcattgctttctctcagttgaatcgtggagtagaaagccgtgaaggtattgagggaaaacgtcctcaattaagagatcttcgagaatccggaaatattgagcaagatgcggatatggtttgctttctccatcgaccggaatattacaaaatataccaagacgacaaaggaaatgacttacacggaatggcagaaattatagtctccaaaaatcgtaatggaaagacgggagatgccctattaaagttttctggtcaatttttgcgttttgagaatccaacttaa

SEQ ID NO: 2777 - DNA, 783 bp, B.fragilis
caggaagatatgcatagccaccccagtcccaaattctccgtgatcacagtgacctacaatgccgaaaaggtattggaagatactgtgcaaagcgtaatttcgcagacctatcatcatgtagagtatatcatcatcgacggtgcatcgaaagacgggactttagagattgtcaaccgataccgcgaccgcatcaaccaattggtgagcgaaccggacaaaggactttatgacgcaatgaacaaaggaatcgccctggcaacgggcgactatctctgctttctgaatgccggagacagtttccacgaagacgacactttgcaaaagatagttcactccatcaatggaaatgagttgcccgacatactgtatggcgaaacagccttagtggatgccgagaggcatttcctccgtatgcgtcggttatcggcaccggagacactgaactggaaaagtttcaagcagggaatgcttgtgtgccatcaggcttttttcccccgccatacacttatcgagccttatgatctgcaatatcgtttctcggcggatttcgattggtgtatccgcatcatgaaaaaagcacgtacttttcacaatactcaccttatcctgattgattatctggcagaaggcatgacgacacaaaatcataaggcatcgcttttggaacgattccgcatcatgacccgccactatggcctgctaagtaccctcgcatatcacgcatggtttgtggtaagaagtctctcccgcaactcagctactccttccgatgcacccttctga

SEQ ID NO: 2778 - DNA, 1143 bp, B.fragilis
tctgatcgtataatgaaaaagatattacttgttttcggtacccgtcctgaggccattaagatggccccgttggtgaaagccttgcaaagagatactgaacactttgaaacgaaagtgtgtgtgacggcacaacatcgtcagatgttggaccaggtacttgaagtgttcgacatcattcctgactacgatctgaatattatggcacccaaccaggacttgtacgacatcaccactaaagttcttctgggcctgcgcgatgtgctgaaagatttctgtccggatacggtgctggtacacggagataccactacgtcgatggccgcttcactggctgcattctatcggcaggttgccgtgggacatgttgaggccggtttgcgtacctatgatatgctgtctccctggccggaagagatgaatcgtcaggtgaccgaccgtatttgtacctactattttgctcctaccgggaaatcgaaacagaatctgttacaggaaaacatcgatgcaaagaagatatttgttaccggtaatacggttatcgatgctttgttgatggctgttgacattatttcgaagaagccgggaatcaaagaaaagttgcatcaggaacttcgtgacaaaggttacgaagtgggacaacgtgaatatattctggttaccgggcatcgtcgtgagaactttggggaaggatttttacatatttgtaaagcgattagagaattagctgcgttgcatcccgagatggatattgtatatccggtacatctgaacccgaatgtacagaaacccgtatacgaacttctgtcaggagtagacaatgtatatcttatttcgccgttggattatctgccgtttatttacgctatgcagcactccactttgctgctgaccgatagcggtggagtacaagaggaggctccttcacttggcaagccggtgttggtgatgcgaaataccacggaacgtccggaagcagtagaggcgggaactgtaaaactggtggggacggatgctgaggcgattgtcagtaatgtgactgagctgctccgtaataaggagttataccgtcgtatgtccgaaacacataatccttatggtgacgggcatgcttgtgaacgcatcctgtcggtattaacccgttaa

SEQ ID NO: 2779 - DNA, 3045 bp, B.fragilis
gacaaactcattatgaagctggtgaagtattttttgcagaaaagagccgtcactattttattattggtgttggtgctggcaggaggtctgttttcttattttaaaatgggaaagctggaggatgctccctttactatcaaacaagcattggtactgacttcctatccgggggcttctcccgcagaggtgcagtcgcaagtaactgatattttagaggaagccatacagtcgctaggagaactttattatctgaaaaccgagaatcgtgccgggctttctaagatcacggtttatgtgaaaaaagagatccgtgccgaagagatgcagcaattatgggataaactacgtcggaaagtaaatgatgtacaagataaattgcctgccggggctggaacttctatcgtaaatgatgactttggagatgtactcggtgtattttacggactgaccggtgatgggcatacatatagggaactggaagaccaggctaaatttataaagaatgaattattaaaagttaaggatgtagcgaaaattgagatttatggtgtacaaacaccgacaattgatgtcttgatcagtccttctgttatggcacaaagtggagttacgactgcggatatgatgcgagctttcgaaacccagaataaaatggtcgatgccggtggtatcaatgccggcaccaatcgcatccgtatagaatctaccggtaatttctattcgctggatgatattcgtgatctgaccattgtttcgcgtaccggagagcatttccgtctggccgatattgcacagatagaggaaggatatcagactcctccggctaatcaaatgcgcataaatggtagtccggcagttgggatcgccatttctaccgtacctacaggaaatgtagtggacatggctgaagatattaaaatgcgtatcggtgaattgtcgcaatcgatgcctgatggctacgaactgatttctatctacgatcagggctatgaatcggcggtagcaaatcagggatttatcctgaacctgatcatatcagttattactgttgttgcgattctgctgttctttatcggattcaaaaatgggctcttgataggtagcgggctggtgttctccatttttgctactctaattgttatgatggcatgtgatattgcccttcaacggatgtcgcttgctgcaattatcattgctatgggaatgttggttgacaacgccattgtcgtgtccgattctgctctgattaatatggaacggggaatgcgtaaacgggttgctatcatgcgtgcatgttcgtctactgctttacctttattggcggcaacggttattgctattctcacgttccttccgatttactattcaccccatatcacaggtgagctgttgtcctcactggtggtagtgatcggtgtttcgttaatgttcagttgggtatttgcgttaacgcagactccgttcttcattcaggagtttgtaagacgtccccgtcctgaagagctgaaagcatctctgtttgatggaaaatattatcatcttttcaggaaattattgcgttgggtacttcggcatcgcacgatgactatagcttcgttggttgttctgttgttgctttcggcatggagtttcaaatttattccgaaggtttttgtgcccgctctggataagcaatactttactgtcgatatgtggctgcctgagggaacaacaatcggggagacggaccggatagccggtgaaatatccgattatatccgtactcatgaagagaccgaaatggtttcgtcttatatcggccgtactccgcctcgctattatctttcaaatatatctttcggtcctcaatccaactatgcccagttgctagtgaaatgtaaaagttccaaagagtcgcgggcactgaatgctctgttgcaggattccattcgtttgaaatatccggaaccgctgattaaggtgaataagttcgaattaagcccgctgacggaagccatgatagaagcccgctttctggggcccgatccggctgttctagactctttggcaggtgaggcgatcgagattatgcgtcgtaacccaaaagtcgcagatgcacgtaatgaatggggaaatatgtcgatggtgatgcggccggtttatgatcccgtgaaggcaggtgctctcggtataaccaaatcacagatgatggagtctgtgaaatcgatcagcgacggaaccagggtaggtgtttatcgcaatgatgagaaaaaggttcctgtactattgaagtcggaaggagctaacattacggatgcccgttctttaggtaatttctctgtatggaacggtgagcattcggcacctttgtcgcaagtgaccgaacgaatcgagacgacatgggagtggcctcagatgcgtacttataaccgtcaattgtctatggctgccatgtgtggagtaaaatccgggtataccatggcagaagtgcatggggaaattcgtagagagattgaagcgatgaagttacccgaaggttatactttcttttgggactcacaatacaaagatcagagagaggcgatgcaggcaatcggtaaattctttccgctggcttttctggtactggtcgttattctggttgccttgtttggtaactttcgcgatccggtcattattctatgtgttcttccgctgtccattatcggagtggctgtcggtatgctcttgacgggatttgatttcggattcttcccgattgccggttggttgggattattgggtatggttattaagaatgtgattgtactgttggacgaaatagatgtgcaacgccgggaaggagtcgttccttatacggccgtgatcgaatctacggtttcaagaacccgtccggtactgatggcagccacaaccaccatactggggatggtccccttactgtttgacatagcatttggcgggatggcggctactatcattttcgggttgacattcgctaccttgctgactttgtttgttactccggcattatatgcaatattttataagataaaagagaaatga

SEQ ID NO: 2780 - DNA, 369 bp, B.fragilis
catggcaccataatttacatttcctttgtaccattgatttatagatgcatcgtaaatcgtggtttcaatagtaatttaaaaaaaatgaaaaacgaaggaattatacttattaaaggaacagagttgcaggatcttatcaataaggctgtagcactggcatttgagaatgtatgcttagcggataggcgaaaggcaaaaacggctgagaaattgctatcacgtaatgaggcatcgaaggctctgaaaatatcgctctccagcctaaaccgcagagtaaatgatggaagcataaagtgctacaaaatcggagcccggagtttttttaaagaaagtgagttagaaaatttattaacctttttaaataaatga

SEQ ID NO: 2781 - DNA, 642 bp, B.fragilis
cacccaaacatgaagaaactttattcacttctcctcaccgccctgtttgccttgccggcggcgcatgtccatgccaccgactacacgcaagggctctccatctggttcgacacaccgaatacactacaaggcagagccatctggtatggcagccgccccgatctctggaaaggagaaagcaaaccggagagcgcaggagacactgcccggaaccccgatgccaactgggagtcgcaatcattgcccattggaaacggaagcatcggagccaacatcatgggctcgatagaagcggaacgcatcacctttaacgagaaaactctctggagaggaggacctaatacttcgagaggagccgatgcctactggaatgtaaacaaacagtcggcacatgtactgaaagaaatacgccaggcctttaccgacggagaccagaaaaaggccgaaatgctgacacgcaagaactttaacagcgaagtgccttatgagtcgaaccgagaaaaacctttccgttttggtaacttcaccacaatgggagagctttatatagaaaccggactcagtacagtgaacatgagtgactataaacgtattctctctatggattcggcattgggccgttgtacaattcaagaaagatga

SEQ ID NO: 2782 - DNA, 1191 bp, B.fragilis
gtcatgaacatcctgatccaacaaaccaaagcatttcctcatcgtgccaatagcttttattggttctatgcgcaactgaccgaatggctgactgcacacggagtggacagtaagctttacttttcgtacctggaactggctgacagcgaatttgagaacggcctcctgttgcccgatcattattctcaattctatactccccgcaacatcgaagcaatctgtcgcttcattatcgacaaacagatagacgtgattctcgattactcccatgtcatccccggagatacacgcaaatattacctcgaaatcaaaaaaagaaatcccggaatcaaaatatgcacgatgatccacaactgtcccagccatacgacacagttaaaacaatacgagttatctacactccggttcaaagacgtgcatggacccaagaaactttttcagtggatgctaccacaactctacatcagcttattaaaaaaagtggtcagccatcaaaaccgttcggcatacgacacgctcgacgaagtggtactgctgtcacccgcttatatacccgaattcaagaaacttataggcaaaaaagacgcatggaagttatctgccatccctaatgccataaaacctgtgcatagtaacatcccgattgaggagaaggacaaagaaatcatctttgttggcagaatggcaaccgaaaaggcattacccaaattactaaagatatggggtatggttcaggataaactgccggactggaaactcacccttgtaggagatggtccccaattcggcacgtgccggcaaattattgccgagaaaaaattgaagcgggtctgcctgaccggccatcagatgtcgatcccctatatagaccgtgcccggattctttgtctgacttccgtcatagaaggactacccaccgtatttacagaagcaatgtcactgggggtgattcctatcggattcgattctttcaatgcgatctatgacatgatagatgacggcatagacggattcattattcccgacaacaattatgaacaatatgcagaaaccattctacggttggcacaaaatgacacactccgctgccagatagcctacaaagctcaaaagcggaaaaacagatatgacatagaacaggtaggaccactgtggatggaaactttccgtaaacatggattaattaaatag

SEQ ID NO: 2783 - DNA, 498 bp, B.fragilis
gcaacaagcattttacacaagccacgaaacccgaggctaaatatacaaaaaaatagccacacaagccccaaaaagataaaatttttaataaacacgtatgttaacactgttttttttaaaataagaagtaaatataaactatatttgcaaataataacctttaataaaaatagtatgaaacaaactttatccaaagctgtagtaactataattatagcatgcacagcattgtacgcctggaatcataagcaaccggttttaaccaatgtacagttacaaaatctggaagcaatagccgccggtgaagaaggggcatgtattagatggatagaacaaacgtgttactatagtttctcagaggaacatgataatgaaccacattatgagtgcaatggttcgagtggacaagcaggaatgacatcttgcggcgtaataaataataaaaagccaacatttggctatgtaaaaggcacttgtctaatatgcatagaacattaa

SEQ ID NO: 2784 - DNA, 1206 bp, B.fragilis
ttatgtggcattagtatagaaaacatgcaaaaatatctgttattcttattcttatttatttgcgcgagttgtattggttcaaaaaatggagttctagaacaaaacaaaatttttgacattatgatagatccggatcgtgttaccgatgatttggatttatcatgcatcttaactgattcgattgagattataaaattgaataccagtgatgaatgccttataggagaaattaaacaagtatcatttacagatcaatttatttttgtttctgatccttatgttagccaaaaaatattcatgtttgataaaaatggaaagtttgtaaaaaatataggtaggcaaggaggagggcctggagaatatagtataattagtaagtttactataaccggagattcgttactgattcaagattataatcttcataaatatttggtatatagtataaaagaagattgctttgtcagtgatattcgctatgaacctcatcatcattcgattgttgcatatccagatattctttactttgtgtctgggtattttcctgctgatgctgggtgttataatctctatcggtttgatcttagaaattcgagtatggagtcttatttacctttttctcaaaaaattgcggtaaatagaagtgcgtggtctattgaggagcaatgtagtcgagtttgtgagcggtcgtttgttttttatgcccttagtgatacaatctatcaagtaaataaagataaagctatccccgtatatacattaaatttttcaaaacgaagtatacctgatgattttaaagaaagtcatagcggagatgaaataatggatttagctttccaggaggggtatgtaagaggcccaattcatcttcaacattcagaccgatggatgttgggcacttatgttgatggtaaagagtataggtatatgttgattgataaaaaaacggggcaatatcaaatagggaagcaattgggagccagaaaagaaggtaatttgactattccacataattttttaattgaagataattattttatttcatggttacctgttaggctcctgaaattgtggaaaaatcattttagtcctaatacctttagagataaaggtagagtgggaaaatgggaaaggctaattgattctttggatatagatgataatccagtacttataaagtgtaaaataagaaataatgaaacttaa

SEQ ID NO: 2785 - DNA, 258 bp, B.fragilis
tactcattaattattaaacacttcatgcttatgaatgatttatcaaaaacgaggattatcatcttattgactgattcctcacaaaaagtaactgacacagaaatgcaagacgcttatgacgaatttatcaggtgcatagcaacaattggcaattcaaaagataactccaacatctttcggatgctgaatctcactcgtattgagatagcacccttaaaagagctatatcagtgcgagcagggggaaaaatgcgcttaa

SEQ ID NO: 2786 - DNA, 1020 bp, B.fragilis
gagaacacaatgaaggtcacgatatatccatactctatcaacaaaagtgatatacgcgttaatccgtatatcagcgacttcatccatgcactgcaacagaacggaatcacaattgccaatcccccgcacaagaatccgttattcagcctcatcccaagaaaagcagatagcgatgcttatatctttcattggccggagaatgtacccgactacaaatatggaatgttgcagactcttgctgctatctggcttcttttcaaaattaaatgccaccataagaagatcatctggttcttgcacaataagcagccccatgtgatgaaacaccgatggtcgaaaaagttattgatacatctgctcctccgcaaagccgatttgatagtgacacatgctacagaaggtatcaaagtggttcaggatcaatatccgaaggctgtagccaaaacggtattcttgcatcaccctactaaaaaccggatagaagagtacatcccccaaccaccggaaaccgacctgctgatctggggaaatatctcccgatacaaaggggtaccggaattcgtacgttttgctactcagcattcattaaaactgaagactaaaatcatcgggaaatgcagttcgcaggaactcctggaagaactacgcaaagaaagtaatgagatgatcagcatagaggaccgtagtattcctttcgaagagctaaaacaagagatccgcagatcacgtttcgtactggtaccttatgctgccgagtctatcttaagttccggcatactgatggactctctctcattcggagccaaagtcatcggaccggctgtaggctctttcagggactacgccgccgaacccttgcttaacgtatatactttccatacgttcgatgatatacaggaactcgttgacaaggcaaacgaagcaacagatatagccggttacaaccggttcctcaatgcacatagctggaacgaattcggcaaaaagtttcaaaatttacttcagaaaataatacagtaa

SEQ ID NO: 2787 - DNA, 288 bp, B.fragilis; identical to SEQ ID NO: 1578

SEQ ID NO: 2788 - DNA, 921 bp, B.fragilis
ctattaaaaataataacaatgatgacaaaaagagattttgtgccaagtaatagttttggtcaatacgtcagcccatatcgtagattggatgatcaaatagccatttttcatttcttatgtaagtttttccccgcagatttagttcaagaagtcttggtttggcttggtgtgatggcaacctatcggttttgttgcaatggaaaatttggagcattatttaaatttgtggattattcggatacgataaggagggtacaagaagtttgcttagacccagaaacaggtagaattttgcaaagcggggatgctagagctcaaattgccaatactcttcgtccgaatgccacttattcttgtatgcctgagggttataaagcttgtatgatagaaaaagagttgatgaactcaaaatccgaggtggtgtatgactgcaagccttgcttttttggacaagctcaatgctttgaacatgctagatatgacagaccttatggtattgttaaacatgtagtttctgcaatctttctgaatatctgtggatataaagataaaaatagtccagtttggcttgcaacaggaggtagtgaacttactggttgtgatctatcgaaggctgatattttaaagttctttcaatttaaagaaatgattttatttcctggggctgagctatatgatcaaagtaaggaaatagagcagcaaatacgccttatgggaatgaaggctagaacgagttattttatggaaaaggtagaatataaagataaacagcggggagatgatattagtaattacataatatctgagattaaccggggtgttcattacaaagaggcttatgagagtgccttagatcgaggggctttagctcttgattggggctcggcaatggtcgataacaacagaatgatgaaagaataa

SEQ ID NO: 2789 - DNA, 300 bp, B.fragilis
ccaatgaaaatatacatctcagggcagataacgggactggaagaggaaaaagccaaacgctattttgacaaagcggaagaaatactattggagaaaggttatggtccggtaaaccctatgagtgtcaatcctccaatggaaaataaatcatggaaagattacatgatagatgatttgaagcttctatttgattgtgaggcaatctatctcattgataattggcagtcttctaagggagcaagaatcgaatgctatatcgcaaaagagcttggaatgagaatattagaaaatatagaataa

SEQ ID NO: 2790 - DNA, 1725 bp, B.fragilis
atcgggaaaattgggccgggtaacgtcaagaataaaagcattatgaaaaagagctttcttattatactctgcttagctttactatcttgtgtgaccggatgtaaagattcaactcagactttactcaagaagtctgtagaaatggaaggtatttctacagacagtatgctattttatcttcaacaaatacagtcccccaatcacctgaatgacaaacaacgggcagaatactgctttcaattgtataaagccacattgtggaaaacccaaaagcccaaagattcactattaaaagtctgtatcccacttttcctacatgttggagatactgcccaatggttgcaagcccaactggaacaggccaatagtttcttctataaagatcagccggattctattttacattctgcccgggagcttcgggacaaaacaaagtatatgactcccacccaacaaagatattactataacatacaaaaattcacctatttcaatcaaaaaaagtatccagaagcactaaaattggctaataaggtgttggccctgaataacccttctaatgacactctttctttattttatgatcatcggacccaattggaaatattaagaaaaatgggaaagaccgatgaagtcatagaagggtattacaaaatgttggaatggtttgctccttccaaagaatatcattatctaacttacaccatagccgaagacatcgtaaactattatctaggacagcaagacttcgacaaggcactggaatctgtgcaaaacctccgcctgtatcgtcgcaatcgctatgatataccttactaccaattgatccgaggccaaatattccagtccctgcatcaattggactcggccggatattattataaacaggcagctacctcaacttcaccctatatcgccattgaggctacctcacgtttataccagctgacaaatgcgacccagcaaccggaacaggcatattatctggctaaaacagaagatatactatataaagacctcacatcaaacctcaaagcaaaagaaaccaccagaaaatataatgaagtaaagctccagaacgaactctatcaactacgccttacccaacaagaaaaagagctgtggatgatgggaatagcagttattttattacttatagctctactaatactctttttctatcatcaggaaaagaaaaaaagactagtatcggaacgaaggctacaagcagaacaggccggagaggaagctcgtcggctacaacatgaaaatgaactattacataaagaagccgaattaagtgcactgcgcgaaaaagagatcatcatgcgcaacaaagaaagcgagatgcgtgaagctttgttccgtcatatttctttctttcagaaacttccttctctccacatcgagaactctacagatgacaatccgaataggaagaaaattactgtaagcgatgcagaatggtgtgaagtgaagcaagcggtaaatgacgcatttaataattttgttgatcgtctgcaagaagattatccgcaactcaatgaaaaagatatctgcttttgttgcctggtaaagattaacgtgaacatacaagatctatcggatatctattgcgtcagcaaagcggccataaccaaacgcaaataccgaattaaaacagaaaagatgcatatttctgacgaaactctcagcctggatgccattcttcaaaacttcggatag

SEQ ID NO: 2791 - DNA, 963 bp, B.fragilis
aaaaaagaaatgaaattagaggaaaaaacaaaaaagaaggatgagcaagggctgattatcaaaaagtaccaacagtatctgaaactggaaaagtccttatccaaaaacacactggaggcttacttgacagacctggagaagttactaagttttctatcagccgaaggcgtggagatacttgaagtcagcctgacagatcttcaacgctttgctgccggattacatgatattggtatccacgcccgttcacaggcacgtatcatttcaggtattaaatcctttttccactttttgattatagctgattatatagaagccgatcccagcgaattgctggaaggtcccaaaatcggatttaaacttccggaagtactgaccgtagaagaaatagaccggattatttcgacaatagacctgagtaagaacgaagggcaacgaaatcgggcaatcctggaaacgctttacagctgtggattacgggtttccgagttaaccggactaaaactatcagacttgtactttgacgaaggtttcattaaagtagaaggaaagggcagcaagcaacgattagtccctatctctcccaaagcgatccaggaaataaagctttatttcttggatcgaaatcggatcaatataaaaaaagatcatgaagattatctgtttttaagcaggcgaggtacccatttatcacgaatcatgatctttcatctcatcaaagagctggccgatatggcgggaattaccaaaaatatcagtccgcacacattccgccactcctttgcgacacacttacttgaaggaggcgccaatctgcgggctatccaatgcatgttggggcatgagtctatttcgactaccgaaatctacacccacatcgaccgcaatatgttgcgaagtgaaatcatagaacatcatccacgcaacatcaaataccgacaagaaaaaaagccgtttcggtaa

SEQ ID NO: 2792 - DNA, 1254 bp, B.fragilis
ctggaacgaattcggcaaaaagtttcaaaatttacttcagaaaataatacagtaatgaaagtactctatacattcggcggcatgccccattatctgaatgccatgctcaacaaacttcataacaaaggagtggaaatcaccgttatcactcctcaaaaaggaaatgccactatcggtaaaggtgtaaaaatggtagagggaggaacatacaggcacctcaccgccattgagaagaaagcattctacggaaaaagctcctatccctccctaccggaaatagtacgtgaagagaaaccggatattctgataatgggatggccctatttcctgcaagtgttctttcaaccccgattgagaaaggctatgaaagagtgccggacacggttggttatccgtgaaattcccttccagacccctccctacgggaaaataaaagaatatttccatgaaaacccgatgtatgatgaaaacatgcggctggtcagtaccggaaccggcttttatcttaaacaatggctgacagcgaaaatacgtaaatactgctacgcacgcattaccggaacgttgaattactcgaccgctgcatacgatattcttccttcctacggagtgaagcaggagcaaatacatgtcacttacaactctacggacacagatgccttactgaaggagaaagaagccgtactcacctcgcccccgcttcttcctccttcctccaaaagagcgctacacatcggccgattagtgaaatggaaaagggtggatctgctgatcgatgcatttacaaaggttattgccagtcatccggacgcggaactggtagtggtaggcgatggaccggagctggataacctgaaaaaacaggcagccgacctgaatctgacagaacaggttcgattcatcggtgcagtatacagtcccaaagaactgggagcctatatgaatgaatcgactgtctatgtactcgcgggcatgggaggattatccatcaatgatgccatgacctacggactgcccgtggtttgttcggtatgcgacagcaccgaacgtgacctggtaacggacggagtgaacggacttttcttcaaagaaggcaatgccgacagcttgagcgacaagctcaacaaactgtttgcctctcccgaacgttgtgcctctatgggacgtgagtcggaacgaatcatccgcgagaaaatcaacattgaaacggtcagcgaacgttatttgcaagctttccgaacttttatgcagtaa

SEQ ID NO: 2793 - DNA, 525 bp, B.fragilis
accaaaagaattatggctaaagaaagtgtaaaaatcctgcaaggaaagctcgatgtaaaaagtttgattgatcagctgaatgctgcattatctgaagaatggttggcatactatcaatattgggtaggtgcattggtagtggaaggtgctatgcgcgctgatgtacaaggggaattcgaagaacatgctgaagaggagcgtcatcacgcacaattgattgctgaccgaatcatagaattggaaggagttccggtactcgatccgaaaaaatggtttgaactggctcgttgtaaatacgattctccaacagcattcgattctgtcagcctgttaaatcagaacgtctcttccgaacgttgcgctattctccgttatcaggagattgctaactttacaaacggtaaagactatactacatgcgacatcgcaaagcatattttagctgaagaagaagagcatgaacaagacctacaggattatctgactgacattgccagaatgaaagaatcgtttcttaagaaataa

SEQ ID NO: 2794 - DNA, 612 bp, B.fragilis
attataaccttttaccgggaaaatacattcaacattatggatacaagcaaaatcgtaggagaaaaaattaaatcactccgtgagaacaaaggaatctcaatagaagaacttgccgaacgctcaggattggccattgaacaaatagaacgtatcgaaaacaatattgacttgccttcattggctccacttatcaaaatagcccgcgtattgggtgtacgtctgggcactttcctcgacgaccaggacgaaacaggtccggtagtctcacgcaagatggaagctacagacacgatcagcttctcaaacaacgccatccattcgcgcaaacacatgcagtatcattcactgtccaagtcaaaagccgaccgccatatggagccgttcatcatcgatgtagcccctacacaagacagtgattttgtactttcttctcacgaaggagaagaattcatcatggtcatggaaggtgtcatggaaatcagttacggaaaaagcacttacctgctcgaagaaggtgacagtatctactatgattccatcgtcccccatcacgttcatgcttatgaaggacaagccgccaaaatcctggcagtaatctatacacccatttaa

SEQ ID NO: 2795 - DNA, 270 bp, B.fragilis
tgctttctgatgaattatgcaagcattttagtcaaaaaactgactctttcccgtatgtctcagaacttgtatgttcgtttaggattcttaggaaaccaaccttttttcaccctctcttcttgctcaaagacttctttgatggtccagaaagaagagaaagcgaatacgcccaataaagacgaaacgagtatattgtctgtgctcaacgaagcagctactcccgcgatacctaatatcaggaaaatccaccagcatttcgttccccagtaa

SEQ ID NO: 2796 - DNA, 1017 bp, B.fragilis
aagcctatgattgttatgaataattttttagtgtttgatacaataaagatcgtgacatgtggtacttatcttaaaatatccgataaatcagtctttacaaccgatgttgatttgttggatggaagaacaataaaatcagtaacatttaattctcagcggaatagaagcattgtcccatttgaattgtatatccacgccaatctattgtcgaataaaatgtgcattgagttctcttctaaaatactgtgggaagattatcctaaattaatatcttctgaaacatttgctcagtgtttgcggaatatagagaaaactggaatctgtacattggatattgaccgaatcatggaggattgctatgttaccaaattacatgtcactaaagatattgaattagagcttacgccagcgatattgaattgtctgaatctctgtacgggcaacttccggcgatataattgggaacggtataaaactgctatcctgttttccaaaaatgtaaaatcatcaaatagcaaagaagcaatcagcatctatgataaagggatagaaattgtacaaactaaaaataaaggattcttgggactggtagaaaacgcagataaaattgtggagtattttgctggaaaaacccgttttgaggttaaatatgaaaatatgagtaagataaaaaaagagctaggaatcaaggataccagtctgaaatcagtgtttggggtaaagaagaatatagtccttactcagtttgataaaatattcacggaaagaaccatttcaaccgatgtgagaatagaaacattttcggagtatgggatatggaatatcgtttgtaatcataatggggatcttaaagctattgaacaagagataaaagatttgggtatttatgccaaggggtcgagagccgttttggggaggacaatgaaaaagataaaagaaatagctcagatatggggtaatagggaaatgaaaacggatgtcgttcttgaaaaaataaggcttctgttaaggggataa

SEQ ID NO: 2797 - DNA, 1683 bp, B.fragilis
tcagcaatgatcgctctacacattactaaaaacatgcaactatacgaaagaacactcggacaatggcttgaacattgggccgaaacaacaccggacaaagaatatattgtatactccgaccgcaacttgcgcttcacctggaagcaattcaacaagcgggtagacgatatggcaaaaggattgattgccatcggagtggaaagaggtacccacgtcggaatctgggcagcaaacgtaccggactggcttaccttattatatgcctgcgcaaagataggtgcagtctacgtaacggtaaacaccaactataaacaagccgaactggaatacttgtgcgagaactcggatatgcatacgctctgcattgtcaacggcgaaaaagacagcgactttgtacagatgacctacaccatgcttccggaactgaaaacctgcgaacgaggacatctgaaaagcgagcgttttccttatatgaagaacgtaatctacgtaggacaggagaaacatcgcggaatgtacaacacacaggagatcctgttgctaggcgataacatagaagacaccgagctcaacgaactcaagtcgcaggtcgattgccacgatgtggtaaacatgcaatatacatcaggaacaaccggatttcccaaaggggttatgctgacacattacaatatcagcaataatggtttcctgaccggagaacacatgaaattcacgggcaatgataaactctgctgttgtgttccattgttccactgcttcggtgtagtgctggccaccatgaactgtctgactcatggttgtactcaagtgatggtggaacgttttgacccgctgatcgtattagcctctatccataaagagaaatgtacagcactttatggagtacccactatgtttattgccgaactgaaccatccgatgttcgatatgttcgatatgtcgagcctccgcaccggtatcatggccggctcactctgcccggtagaattgatgaagcaagtggaagagaaaatgtatatgaaggttaccagtgtatacggactgacagaagcagcccccggaatgactgctacacgcattgacgatccgtttgacgtacgttgtaacaccgtagggcgtgactttgaatttacggaggtaaaagtgctcaatcctgaaactggtgaagaatgcccggtcggcgtacagggggaaatgtgcaaccggggatataacaccatgaaaggatattacaagaatccacaagctacggctgaagtgatagacaaaaacaatttcctacactcaggagacttgggaatcaaggacgaagatgggaattatcgtatcacaggacgtatcaaagatatgatcatccgtggtggagagaatatctatccccgtgagatagaggaattcctctataagctcgacggagtgaaggacgtacaggtatcgggcatcccatctaaaaaatatggagaggcagtaggggctttcatcattttgcacgaaggagtaaccatgcaggcttcggacgtacaagacttctgccggaataaaatctcccgctacaaaattcctaaatacattttctttattgacgaatttcccatgaccgggagcggtaagatacaaaaattcaaactgaaggatttaggactgaagctctgtgaggagcaaggtatccagattatataa

SEQ ID NO: 2798 - DNA, 252 bp, B.fragilis
aagcaaaagatatcaccagatatcgtgatatcatcaaagagctcggcttgcgtaagtaatcacttactgcgaacaaaatttaaaagccgtttcctctctatggaggaaacggcttttattttttatctttctcccttgcttggatataaaatttcattaattttgcagcaaaacgaattaaattataaccttttaccgggaaaatacattcaacattatggatacaagcaaaatcgtaggagaaaaaattaa

SEQ ID NO: 2799 - DNA, 1047 bp, B.fragilis
gatatgaagataagtgtattattagctgctctcctgttgctattttcttgcacggataaagacagtaagcagagtcaggacttaattgtcaagacagcacaagcagtttcggcctctgggatcaagacaacggagttcccgtttatcgcacaaccttttcgtacctctgagctatcgtttcgtgtcggaggccctattgatcgtttggatgtatatgccggtaaccattacaaacaaggcagtattattgctgaaatagacccgcgtgatttccatattcgcaaagaacgggctgaagccatctatcaccaagctaaagctgaatttgaacggatagagaagctgtatgagaagaataatgtttcggcgagtacatatgaaaagactaaggcggattatactactgccaaaactgctttcgatacggcttccaatgaactgggagacactcgtctgacagctccttttgatggttatgtgggagaagtttatatagaaaaataccaggatgtgaagccagctcagcctgttatatcctttattgacataaatcggttgaagatagagatttatgttactcagaatattgcgtttgcctcacaccccacagatagtgtccggatctattttgatgcccagcccgataagtattataaggcacagattgtggaagtatcgaaggggacaacccgcaataatctttcttatttactaacggctgttttacctaataaagaagggaaattattggcgggtatgtcgggaaaagcaatctttgatgctcccggaacaacggatctgacaggtgtttccattccccaaacggcattatgttatcgtccctcggaaggtgaatatgtgtgggttattgatacgaatacccgacaagtgaatcgacggacagtgaaaaaaggaaatctgcttcccggtggctatgttaccataaccgaaggattgagggccagtgaaacggtagctacgagcggacttcgttttttatcggatggtatgaaagtggaaatctctactaagacaaactcattatga

SEQ ID NO: 2800 - DNA, 288 bp, B.fragilis
ccttaccggatggtcccggctgattcacgcagaattcctcgtgctccgcgctactcaggataccactacgcttcggttaccttagaataccgggctatcaccgtctatggcacgactttccagtcgtttcttctcaataactgtcttgcgagagcgtggtcctacaaccccacacatgccgtaacatgggtggtttgggctaatccccgttcgctcgccactactaggggaatcattatttattttcttttcctgcaggtactaagatgtttcagttccctgcgttag

SEQ ID NO: 2801 - DNA, 291 bp, B.fragilis
gacaagaacttacaaggctttttctttttgggagcccaagcgggtgcccactcggatattcttgcattactccctcatatacagcattttatatatcgattttgctattatttttgtcgtagaaataaactctatcagtatgcacctacgcagatgtatatcagttgcgtattgggctccgatggagccaccactacccaacaaagagagggggcaatagccttgctttactcgactcccaccttaatagagcaacaggcttgccacaagattgctatctttttcacttag

SEQ ID NO: 2802 - DNA, 432 bp, B.fragilis
caggattgtgttatgaggatacaaattattaatggtcccaatattaatcttttgggcaagcgtgaaccttctatatatggaagcgttacatttgaagagtatttggctgaacttcgtaaaaaatatcccgatgtggaactgggatatttccagtcgaatgttgaaggggaaatcatagatattattcagcaaaccggattcgatgtggatgggatcatattgaacgcaggagcttatacacacacttccattgctttgcaggacgctatccgctccgtaacctctcctgtaattgaagttcatatatccaatgttcatgcccgtgagcagttccgccatgtatctatgattgcttgtgcttgtaaaggtgttatttgtggatttggattgaactcatatcgtctggcactcgaagctttattagataaatag

SEQ ID NO: 2803 - DNA, 354 bp, B.fragilis
aataattacgtagaaaaatttatggaaacaacgagacaaaacaagatatcacgtctgttacagaaagaactcagtgagatttttctgttgcagactaaagctatgcccggtgtactggtatcagtaagtgctgtacgtatcagtcccgacatgagtatagctcgtgtatatcttagtatcttcccttctgaaaagagtgaagaaatggtaaagaatatcaataataatatgaagtccattcgtttcgaactcggtactcgtgttcgtcatcagttacgtatcattcctgaattgaagtttttcgtggatgattcgttggactacattgaaaagatagatgctttgttgaagtga

SEQ ID NO: 2804 - DNA, 1764 bp, B.fragilis
  unsure (1492): Identity of nucleotide sequences at the above locations are unknown.
cagatattttttataagtatgagactacatgtactatcactcacatgcctgctgcttacagtaggaggcacagggccggtcgcagcccaaaagccacaaaactatccgtacggtgttccttccgaaccctgggaggaatctttcggaaatcatcgggcggtactgcaaatagagaagccggcacaaatcgcgaacctcgacttccaatggcggcgtccggacaaagatgcaggacacagacgatttcttatcatccacgctgcaacgggagataccatccggaatatccgccggatagaggtgaacgacgaacactgccgtttgcagttcggtccggtggaacaaaaaggcacttactacttctactacctcccctaccaagtgcaaaagggatacggattctacagtggcggataccttccgaaagaaaacgaaccggatgcagcctggcaggctcaaggcgggtcaaccctgaaaagcactcgggccaaagtggtcagagtagagtcgcggcaggctttcgacagtttttacccgatggaagttgccgcaacggcccgggagaaagagaactacatcaaccggcacaaagcctccctctacctctttgccgaagatcgcaggttccccatccggatgcgcagcaacctccctaccaaatggctggcagacaaacagggaaaactgtttcggggagaagcagcccccaatgaatactatactttccagatcgggctttgggcagccgtgaaccaagcagacaagattgcttaccgggcttcttccctgaagtgcggccgggaaataataccggcaacagccattacctgttttaatgtcgaaggtaccgatccttacggaaaagcgttcaaaaaagaagtaaacgtccccaaaggagaggtacaggctctctggttcggaatagatatacccgacgggcagaaggaaggcatctatacaggcaccatcaccctcagcgatgccgacggagcacaaagctcgatccccttgagtatacggattgcgggaaaggcattgcccgacagaggtgacagtgaattatggagatgcagccgcctgagatggcttaactcgacattgggcatagccgatacacctaccgcaccctacacagccatgactgtgaatgagaaccgtatcggttgtctcgggcgtagcataacgatagacgaaggcacaggactgcccgcacaaatccgttcatggaacaacgacgtgctgagcagtcccatagagtttgtcatccaaaccgccggtggagtgaaaagcctgaaagctgtccccgaactgacggagcggacagaaggccatgtagcaggcaactggaaagccgaagacgaagatatgacagtcagctgcaaagcaatcatggagttcgacggatggataaactacatatataccatcaccccaaaaaagcagatacaagtgaaagacgtccgtctggtattgccggtcaggaatgaaatangaacttattttctgggcatggggcttccggggcaacctactcctcaacagtatgaccggaaatgggatgcccccgagaaaaccgtgaacactttcggagtgtccatccccaacttccaaagaacaacaatgggctgtggcccgtccacaattttctggatcgggaaccagcatgcaggtattcactggcaaatcaggggaagcacatacagccggtccgctattgaatctgcaccgtccggcctatccggaaagctggttcaacgggggtaa

SEQ ID NO: 2805 - DNA, 1377 bp, B.fragilis
ataactaaagtaagggtgtattcaggactctatgaaaggagaccggatacaccctttatttttactaacggtcaggagcggaaatataatatggcagaacagtcgctaaaagaaaaaacagccaaaggattattctggggtggattcagcaatggcatccagcaattactgaacctgctgttcggaattatcatcacccgtatgctggattcgacagactacggtatgattggtatgctggctatatttaccgccgtagccaactctatacaagagagcggatttacggccgctctggccaataaacagacgttccgtcatgaagactacaatgcggtgttctggttcagttttctaatgggtgcatcgctttacctgctgctctttttttgtgccccgtttatcgcagcattctataagactccacagcttattcctctatcccgcttccttttcctgggttttctgatttcaagttgcggaactgcccataatgcggtattatttaaaaaactaatggtgaaagaaaaagcgaaagcaaccattaccgcactattgtgttcaggcaccataggaattgtcatggcatacaatggaatggctttctgggggctggccgtacagcaaatcacctatattttcatcgctaatgcgctgttatggtacttttctccgtggcgtcctactttttcgttcaatttcaaacctatcagggagatgcttccgttcagcagtaaactgcttatcaccaatgtatttcattacatcaatgataacatattttctgttctgctggggcgcttttataccagtcaggatgtaggttactatactcaggccaacaaatggaccaatatgggcttctcactgatcagtaacatgatcaacggagtatctcagcctgtcctggtcgaaacctcttccgacgccatgcgacagaaaaatatatttcggaagatgttgcgcttcaccgcctttatctctttcccggccatgttcggactggcattgatagccaacgagttcatcgtaattgccgtcaccgccaaatggcaggcatgtgtacccatcatgcagattctttgcatctggggagcatttgtccccattacttatatgtactccaatctcctgatcagtaaaggaaagtcgaatctttttatgtggaataccattgcacagagcctggttcaactcacaatgcttctttgtactatctcacaaggcatactcgtcatggccgtgatttatacggttatcaacatcggttggctgctgatatggcattatttcgtaaacaagcagattcacatcaccctatgggaagtcatgaaagatatcactccgtacctactgatctccggaggagtcatatga

SEQ ID NO: 2806 - DNA, 1320 bp, B.fragilis
ctttgtacggtttctcaccgaaaaccactatttttgccaaaacatttcgatcgaatgagagttttaataatcaatacttccgaacgtttgggcggagcggccgtcgcagcaagccgcttgatggaatcgttgaaaaacaacggtatcaaagccaaaatgttggtgcgcgacaagcaaaccgaccagatcagcgtagtaggtctgcaacgtaactggtggcaagtatggaggtttgtgtgggaacgcattgtcatctggaaagccaaccgctttaagaagaacaatcttttcgcagtcgatatagccaatacaggcacagacattacaagcctgccggagtttcagcaggcagatgtcatccacctgcattgggtgaatcagggaatgttgtcactgaacgatatccggaagattctgaaatccggtaaaccggtagtgtggaccatgcacgatatgtggccctgtacaggtatctgccatcacgcccgtgagtgtaccaactaccatcaggagtgtaaccactgtccatacctgtatggagggggaagtaagaaagatctgtccaaccgtatcttccgtaaaaaacaacaactctacaaagaagcacccattaccttcatcacttgtagccaatggctgaagggacaagccgaaaagagtgctttgctgacaggagaaacagtaatcagtatacctaaccccattaacaccaatctatttaaacccagaaacaagaaagaggcacgcagcaaatgccatttaccccaaaacggaaaactgattcttttcggttcggccaaaatcacggataagcggaaaggcatcgattatctgattgaatcgtgtaaattactggctgcgaagcatcctgaactgaaagattctctaagtgtagtcgtttttggcaagcaatcggaacaactcaagccgttgcttccttttaaagtatatccactcaactacgtgagtaacgagcatgaactggttgatgtttacaatgcggtcgaccttttcgttactccctcactggaagagaacctgcccaataccatcatggaagctatggcatgcggagtgccttgtatcggcttcaatgtcggcggcatcccggaaatgatagaccatctgcacaacgggtatgtggcacaatacaaatcatccgaagattttgccaacggcatctattgggcactgaccgacccggattatccgtctctctcggaacaggccaaccgaaaagtaatcgccaactactcggaaggcattattgccaaaagatacattgatgtctacaataaaataacaggaagatatgcatag

SEQ ID NO: 2807 - DNA, 663 bp, B.fragilis
caaccgttatttataagagacgagatgaaagagaccgatcttttagacgaatatatcttgcagcatatcgatgaggaaggtgaatacctgaaatctctttatcgggatacgcatgttaaactcctgcgtcctcgtatggcttccggtcatctgcagggacgtatgttgaagatgtttgttcgtatgatacggcctcgccaaatattggaaatagggacttatagtggctattccgctctttgtctggccgaggggcttgaggagggcggaatgcttcacacattcgagattaatgatgaacaagaagactttacccgtccctggctcgaaaactcagcttatgctgataaaattaaattttatattggggatgctcttcggttaatacctgcattgggcattacgtttgatcttgcttttgtggatggtgacaaacgtaagtatattgaatattatgaaatgactcttgcacatctttctgtaggaggttatatcatagctgataacactttgtgggatggtcatgtgcttgaagaaccacatagcaatgatcaccagacgatcggaatcaaggctttcaatgagttggtggcacatgatgaacgggtagaaaaagtaattctgcctttacgtgacgggttgactataattcgtaaaaagtag

SEQ ID NO: 2808 - DNA, 252 bp, B.fragilis
caagttctattagatattcctgtttcatatctttttatcatcaagtcggataggtttatgtggtggaactacatgaaagttttaatgtttaacactttgaatccgaacaatctttttagacaaagaccatccggattcaacctacccatgattattttatatattaagttggattctcaaaacgcaaaaattgaccagaaaactttaatagggcatctcccgtctttccattacgatttttggagactataa

SEQ ID NO: 2809 - DNA, 306 bp, B.fragilis
tgccaggtattcattaatccgatgcaattcgggccaattaatgacgctccatatttattaacagtttcaagaatgcgctcttccaataaagcgccttcctgcgtttcttctccaaatccggccgaaagaattatgaaagcccgcgtctgcttctctgcggccagtgtttccaccacctccggacaaagaactgcaggaatagcaagaatagcaagatctgtatcgggtaactcctttgcatcggcaaaggaaggcactccctgcacttctgtttctttgggattgacagcccgaagttctccctga

SEQ ID NO: 2810 - DNA, 990 bp, B.fragilis
cttggatttttggaaagaaatataaagaatatgaagatttctaataaatatgataggcttgtccgcaaattgattgcaggtgagtcttcttcggaagaaatggaagagctggcacattggaatgttgtggagacgaaaatgaaaaaacaattcgatgcggcaaaaaatatagtggaaaatggtgctattgaaagaaggatctgggataagattgactccagatgccaggctcctgttgagcgtagtcagaaacttcaactcagatattggagggttgcactagctgcatgtattacggctttattgattatcggaggtggtattttcttttttgataaagggcatacagcttcacagcgtataactgagtatactgaagttgtttcttcaaatagccggttgtatatacttcccgacagttcaaaagtctggatacaggctgggagccgtcttcgtttttcacaggattttatgagtaaccgggaagtatggctggagggagtgtctacttttgaagtaactaagcgtaaaggccataattttaaagtatatatcgatcaggcatttgtcgaagtcaaagggacggtctttcgtgtgcagtctacctgtcaggatggtgcggaggtgactctttttagtggaaaggttgacttcaatgtgaaggcttcacagagaaaagttgaaatgaaacctttgcagcagattgtttttcatcccgaaaaagatgaagtgatattaaagaacataggtaatatcagttgggatgaagggcgttataaatttgtcgacatgcgcatggatgatttaatagaagctattcatgatatttaccacattccggtagaactcgataggaaagtagctcgcaatgacttgttcacgggttatatgcgctatgatgaccctgcctctaaagtcatcgaaaagatttgtattaatatgaatttgaaatttaaaaaagaaacacagaaaatcattatttataaataa

SEQ ID NO: 2811 - DNA, 273 bp, B.fragilis
atctttttttcatctttacaagttcaaaaacaatgttttatgaagtcagagattgatttatttgtaattaataagattaaagaaaaaaggaaagagctaaaagtgtctcagcgaggtatggctgagatactggattgttctgctggcttcataggacaagtcgaaagtgaaaactccgataccaaatatagtgtttatcaactttatctcattgccaaagatttcaactgctcaccagcagattttttccctcccttcaatatcaaagattag

SEQ ID NO: 2812 - DNA, 2499 bp, B.fragilis
atgaaaaaatttcttcctgacctgattgccattctggcatttatagttatctctttcatctatttcttccctgctatcaccgaagaccggattctcttccagcacgacaccgtggccggagccggagccggacaagaagccaaagaatattatgagagaacaggtgaacgtacccgctggaccaatgcactcttcggaggtatgcctacctaccagatgtccccgagttacgactctaccgagccgctgacatttgtacagaaagtatatcacctttttcttccgaactacgtatggctcacatttatcatgatgctcgggttctatatcctgctaagggcattcggcataccggcatggctcgcagggttaggaggaatcatttggggattttcgtcctatttcttcattctgatagctgccggacatatctggaaatttattactttagcctatattccacctacgatagcaggtatagtacttgcttaccgaaagaaatatctgttaggaggtattatcaccgctttattcatggctatgcagatattgtccaaccatgtgcagatgacttattatttcttgtttgttattcttttcatggtaggcgcattcttcgaagacgcctggcgaaaaaaagaactcccccaattcttcaaagctaccggcgtgctgattgttgcaggactgattggagtatccatcaacctctcaaacctataccacacttacgaatatagtaaagaaacgatgcgtggtaaaagtgaactgaaatatgaaggagctgccgccaaacagactagtagcggcctcaaccgcgattacatcactcaatggagttatggtatcggtgaaacattctccctgctggtccccaatgtcaaaggaggtgcttccgtaccgctgtcacgaagtgagaaagcaatggaaaaggctaatccgatgtatagcagcctctactcacagctaactcaatattttggcgatcagccgatgacaagtggtccggtctatgtaggcgcattcgtactaatgcttttcattttgggatgtttcattgtaaaaggtcctatgaaatgggcactgctgggagctaccatcttctctatcctactttcatggggtaaaaacttcatgggattgacagactttttcatcgattatatcccaatgtacaataagttccgggctgtatcctctattttggtaattgccgagtttactattcctttgctcgccatccttaccctgaaggaaatactcaccaagccggaattattgaaagagaaactgaaatacatctatatcagtttcggattaaccgggggattggcactgctctttgccattgcgccccgtctgttctttcctacctatattccagataacgaaatggcagctctgcaaaatgccctgcctgccgaccaactatcgcccattattgccaatcttgaggaaatgcgtgtacaccttttcacctctgatgcttggcgaagtttctttatcgtcaccatcggcaccctgcttttactggcctataacgccaaaaagctgaaagcaacctggactgttgccgctattgctctattatgcctgggagacatgtggagcgtaaataaacgttatctgtacgacgaacagtttatcccgaaatcagagcagactgctacattccggaaaacacagacagatgaactaatcctgcaagacccatcactggattatcgtgtactgaactttgcgggcaatacatttgaagaaaacaatacctcttattggcacaagagcgtaggcggttatcatgctgcaaagcttcgccgttatcaggaaatgatagaccatcacatcgctaaagaaatgcaggcagcctatcaggaagtagctacagccggtggacaaatggatagcgtaaacgctgctaagtttcctgtattgaatatgctgaatacgaaatactttatattccctgccggacagcaaggtcaaacagtccccattgagaacccatatactttcggaaatgcatggttcatagataaaatacaatacgtgaacaatgcaaacgaagaaatcgatgccatcgggcaagtcgacctgcaacaaaccgctatagtagactctaagtttaaagaggcactgaaaggagtgaacgaggggtacaaagactcactgtctacgattcgtttgaccagttatgaacctaaccaattagtatacgagacttcctcaccccaagacggtatagtggttttctccgaaatatattatccggggtggacggcaaccattgatggcaagcccgccgatattgcccgtgcagactacattttacgtgctatgaatgtcccggcaggtaaacacaccatcgaaatgcgttttgatccgcaaagcctgcatattacagaaggtattgcatacggagcgatggcgttattgctggtaggagtaataatcctgatatggatctatcgaaaaaaatatagtgaaaacagcaaataa

SEQ ID NO: 2813 - DNA, 489 bp, B.fragilis
caattggaatttacatttattattatggaaaaaatagacaaccttgacaggcagattctggagattatttctcagaacgcccgtatcccttttaaagacgtggcagcagaatgcggcgtttcacgtgcggccatccatcaacgcgtgcagagactgatcgatctgggagtcattgtaggctctggttatcacgtaaacccgaaatctctgggatatcgtacctgtacttatgtcggtatcaaactggaaaaaggatctatgtataaagctgtagtggccgaattacagaaaattcccgagatcgtagagtgccacttcacaaccggcccttacaccatgctgaccaaagtatatgcacgcgacaacgaacacttgatggacctactgaacaacaaaatgcaagagataccgggagtaaccgccaccgagaccctgatttctctggagcaaagcatcaagaaagaaattcctattcacgcagataagtaa

SEQ ID NO: 2814 - DNA, 1254 bp, B.fragilis
aatataaattcaaaatatatgaagcagctaattctttcgtgtatatttgtcttgggatttttctttcttccaattcttgtgagtggtgcagatgctcaagaaaattatctgtttagcatttccggtgagatagacggattaatgcccaatgatactctttctttctggaaaaccactcttccctataaaggagaggagggggaagtcgcttttaacgtaattgtaagtgaacccaataaattctgttactcaggtgaacagccacatactcaatgctatagtatgatatataaacccgtttcaggtgaatctcaagcaagttcacgacaggctctgatgattattgtggaagaaggggactatcacctaaagggagaaaccgactttatatactatagtgctatcagtggcggactgtacgatgatccttcgttgaaagaaatagtacacatggaagactctttggagatcatacggacaagatatcgaaagattgtcgatgaggcaagaaagaaaggtgatatggagaaggctaaggaatacgttgataagttcaatcgttttcatagtaatcatcaagaatcttacgctctcttacagcgaaagacaaaagaattggtagcaaacaatccatcatctacttgggtgatagtggaatatcttcaaaaagtttcatatgctgctccggaagaaatgaaatctgtgctgttgaacatggaccaagaggcccagaatagttattatggacagatatttaggcgggaggtggaggcaatagaaagactcgctcccggtaatgaagctcctttattctctgttactactactgacgggaaaaggattacttctgacgataccagaggtaaatatcttcttctatatcattggggactttgtcccggttctatttctgttgataagcgagtcactgtcttttatgaaaaatataaggatcatctttccgtagttggaataacggataatatggaaactatttgtgagctgaataaaaatgtgggagaagatgatgaggtattggggatgaaattgaaacctgttcttgaaaatatgctggcgcatccctggcctgaagtagaaagtacgggagataatcataaaattatagaagattttgcctttgcaggtctaccttactttgtttttatttcaccggatgggaaaattatctctcgtgactttcgtaaagcttttgacaaagcacaggaggtgatgaaatcggagtttgatgattga

SEQ ID NO: 2815 - DNA, 387 bp, B.fragilis
agatccatctccacatccacatacaggtcgtctccaagacgcttgaatacagagtcttcggctatcttgaaagtgatatacaggtctcctgcagggccaccgttgatgccttcgcctccgtatcccttcaacttaatcacctgtccgtcggctacaccggccggtatcgtaatacgaacctgtttgccattcacattcaacacctgtttgtgggtccgggccgcatcgcgaagagacaggtgcaattctgcattaaaatcttgtcctcggaagcctgcattgcctcgtccgcctcctcctctatgtccgaacatagattcaaagaagtccgagaatcctccggcatcaccacccgagaacccctctccatcggacgagtaccaataa

SEQ ID NO: 2816 - DNA, 1908 bp, B.fragilis
acgaccacaacgagccgcgttcgtacgatgacatcgggttacgtaaagaggactttgagatgttcggaaagatggggatacgttgaaaatgccgggctaacgtgcaatccggcaaggagcaggattcactacaggtttgatttcgggagataccttgggatagataagtgtcagcatctcgaaactttgcttcctttcggtacttttgttgtgttttgtgttgaaagtaggagaataatatctatatttactgtcgattcatcacaacatgcaattatgacaatccaactactattggtgacgggagtaacagactgtctgtggctttatgtattatccctgcttttgtttctgaccgtttgcttcctgctctatcagaacttcctgcttcgtaagtcggcttcggctgatgacgactatcgtcgtttcctgtttgatattttagataatctcccgtttcctatcatggtgaaagatattcaggaacaattcaagtatacctactggaataaagaatccgagttacagtcgggcatcagccgcaaagatgccgtcggcttctccgatgtcgatatctttggtgaagaaagggggaagcagtaccggaagatagatgaggatcttgtcagggccggaataccttataaggcggaagagaggtatgttactgctgacggaaaagtgcacgatacacttgtgatgaagtcgatcatatcttcgggtaaattgggtaaatggctgttggtggcccgttgggaaatcacccagctgaaaatgtacgaaagagaactgctggctgccaaagagcagttggaaggagccgtatgtaagcaaaaactggctttgagaagcattgatttcggattgatttatatcgaccggaactatctggtgcaatgggaagagaccggtaatattaaaaatctagtttccggacgccattatactcccggcactgtttgctaccggactacggggcagggaacccaaccgtgcgggaaatgtgcttttcgggaggctatcggtaccggtaagatcgtgagacacatcacccatgtggatcatgtggactttgagatcaccgccacccccgtttatgatgatacgggaaacgaaattatcggcggactgctacgctttgaagatattactgagaaactgaaagtagaacgtatgttgcaggaagccaaagagaaggccgaagagtccaatcggctgaagtcggcgttccttgccaatatgagccatgaaatacgtacgccgctcaatgccatcatcggtttctccgatctgatttgccagacggacgatgctgaagaaaaagaggagtatatccggattgtcacttcgaacaatgagcttttactgcaattgatagatgacattctcgacctgtcgaaaatagaagcggggacaatggatttctcttatgccccgacggatatcaatgaactgatggaagacatctgtttacagatgcagcagaagaatcaacgcccggaggtgcagatcatgtttactgaaaaagaacccggttgcgtaatcaataccgaccgtttgcgcttgtcacaggtcatcatgaatttgatgaacaatgcaatgaagttcacttccgaaggttccattactttgggctatcggctgaccaggcaaaaggacgaactttatttctttgtaaaggatacaggtatcggcatccctgccgatcaggcgggaaaggttttcgagcgttttgtcaaactgaatacttttatcaaaggtaccggactgggacttgccatctgccgggtgattatcgaacggttgggaggaacgatcggagtggagactcgggaaggaaagggttcctgcttctggttccgtcttcctgtcagagaggatatgctgctcgaaagccctgtccgttga

SEQ ID NO: 2817 - DNA, 234 bp, B.fragilis
ggaaggacaaccgatagaggacttgggcaatacacaagtcttttttgccttacatccctgaacgggttgttgaacgaggagaccatggtcaagttgaaagactggaactctttcttaagaaagaccctggtagaagtattgatggggagcaccccgttggcgcaaaattaccaaagggattcggtatttcgttgggaaggacccctgtattgccccgtttcaaagggacaccgc

SEQ ID NO: 2818 - DNA, 3201 bp, B.fragilis
aagaaccaaacaaaacctttattattaacccaaaacaaaattgttatgttaaaaatcactagacaagttactctgctcttgctcgccggtgcattaagcttcccagcttattcgtatgcaacgcaagcaacagaagtattggttcctgaagttactcaagagaaagtgacaggaacagttgaagatgcattgggtccggttattggtgccagtgtcatggtaaaaggcacgaccaatggtgtcattacggacttagaaggtaagttctcgctgaatgatgtgaaaaaaggagatattattgtaatatcttacatcggatacgttacacaagaaataccttatacaggaaaacctattcaagtgaaacttgccgaagacagcaaggctttggaagaagtagtggtagtcggttatgccaccgtaaaaaaagccaacctgaccggagcagtgtcggccgtagatggtaaagtgttggaagatcgcccgattgtcaacctcggacaaggtttgcaaggtgccattcctaacttaaatgtaaccaccagcggacggcccgggcaaggttcaagtttcaatatccgtggtactactgccatgagtggaagttcaccattggtattggttgacggtgtagaaatggacccgaacctgattaacccgcaagacgtgaaaagtgtttccgtattgaaagatgccgcgtctgcttccatctatggtgcacgtgcagcttatggtgtcgtattgattaccaccaaaggaggccgtaaagaccagccgacacaagtatcgttcgatgcatcggtttcattcaacgggcctactacccgcccaacatatatgaactccatgcaatatgctacctggatgaacactgcgcaacagaacaccgtgggacgcgactatttcgatgctgagtggatgcagcatatcgaagcctactataaagatccggtgaacaattctccggtatttatccattcggacccgagtatcagtaaaaacggcaccaaatacacgtatgccggcaatacaaactggatgaaagaattgtataaaaagaactatcccgtccagaagtataatgtcaatatcagcggaggtggaaagaaggcaacttactacacatccttaggatataccgaccagggatcactgattcgtttcggtaacgaacagttcaagaagttcaatgtgatgaacaacatcaattatgacgtgaacgactggttacacctctcgatgaagacaagttttaaccgcaccaaactgagaggactgaatcaggacaatgtacatggtgataactttatgggaggtgatacccgtcctatcatgccggtgaaacatccggacggcaactgggcaggacaaggtgactttaccaattttcctgctatccttgaagatggcggtagccggctcaccaacaagaatgacctttggaacacgatcacgatgaaactgaccccaatcaaaggaatgagcatcaacatggactacacgttcaattactacagtgaaaacaataaggttcacatgaagtcatttgacgaatatggagccaatggacaattcctgcaaacttttgcatggacgaatccgaattctgtgtcacaatcacaagccaacgatacatacaatgctttcaacttcttcggtgattacgaaaaaacattgggtaaacattacctgaaaggaatgatcggttataatcaggaaagcaaacatactaccggattcaatgccggacgcgaacagctgatctcaaacgatctgggatctttaagttatgctacaggagaccgctgggtaggcagcagtgataactcctgggctacacgaagcggtttcttccgcatcaactacggatatgacgagcgctatttactggaagtaaacggccgttacgacctctcttccaaatttcccaagcacgaccgtgccgtattcaacccttcgttctctgcagcctggagactctctaacgaaagttggttcaagagctggacaaacagtttcttcgacgaactgaaaatcagaggatcttatggtagcctaggcaaccaggcactcaacaatggctggtatgcttatctttctaactatagtacgggacagatcagctggatcatgggcagcaaccaaccgcagtatgtggttcccggcggcctcgtcagctcgtccatcacttgggaaaccgttacacagtgggacctgggacttgacttcaacttcctgaacagccgattgaaaggtgctttcgattactatcaaagacgtacgtccgatattcttgccgcaggtaaaattctaccgggcgttctgggtgcgaacgaacctcaggaaaatgcagccgagtcattgacaaagggttgggaatttgagatcagctggaatgatcagctggccaacggattccactatacagttgggttcaatctgtccgactatcaatcggaagttaccaagttcgataacgaatcgaaagaattgggcaactggtatgtaggtcagaaacagggtgagatctgggggtatgaaacctatggtttattccagtccgaacaggaaatagccggagcagccaatcaggacaaagtatcgggaggtatcaaactgatgcccggtgacatccgttttgtagaccgtaataacgacggcgttatcgactggggtgacaacaccgtagataatccgggtgataagaaaatcatcggcaacagcactccgcgctatcattacggcatcaacctgggagccgactggaaaggtttcgacctaggtatcttcttccagggagtgggcaaacgtgacctctatctaccgggaacttcattccgaagccactacggaagcgaatggcaagtaccttcagcctacaacaacgattactggacagaagaaaatacgggagcatatttcccccgtgcgcgtttcaatggtggttctgccatcaaccaagcccaaacacgctatatggtagatgcatcttactgccgactgaagtcagtcagcatcggttatacattgcctaaagtactgactcaaaaggcttctatcgaaaagatacgtatctatttcaccggtgaaaaccttttcactatttcagatacccccgacggactcgatccggaattggataacccatacacatatccgatgcaaagatcattatctgttggtttaagtctcacattctaa

SEQ ID NO: 2819 - DNA, 207 bp, B.fragilis
  unsure (1): Identity of nucleotide sequences at the above locations are unknown.
nccccaccgacgccgcgcgcgaaccaatctgtgaaggcgagtgctggatgtggcgggttgaccaatgacgggtacagccttatttcttctgacggactgcaacccggagacaaaatcgtatcttcaggagtacatcatatagaaaacggggaaaccgtaaaaactctgcctgaaatcactcacacaaatataggaggactgttataa

SEQ ID NO: 2820 - DNA, 621 bp, B.fragilis
aaggaaaccgcgaacagtttctcgtgttgcacaccagcgggtcacacttcaactatcggcaacgatatcctgcggaaggtgcgtttttccaactatgacagtcctgccgatcagaatttaaggtatcagcataatgtgattaatgcctatatcaattccatccgttataccgacgattttctgtcaaggctgatcgtcgtgctgcagcaacaggatgctgggtcggatatactttatacttcggatcatggagaagatatttgtgacgaccattgtcatctcttcgtgcatgcgtctcccgtgcattccaaatatcagttgcatgtaccgttcattgtatggacttcggacacctatcgggagaagtatcctgagcatatggacgctatacagaagaatcgtcacaaatctgttgtttcgaaccgggtggtgttccattcggtactcgatctggccggggtgaccaccacctatgtaaacgattcattatcggtggccagtccgtcctatacagagttcccccgtttttacctgaacgaccacaacgagccgcgttcgtacgatgacatcgggttacgtaaagaggactttgagatgttcggaaagatggggatacgttga

SEQ ID NO: 2821 - DNA, 201 bp, B.fragilis
attccttttctgattgatagaggggaatcgaaaattctctgcctgaaaccccagaccatgaacattccgaacacctcttatgaagtggatttcgaacggggtaaccccatttttttaaaagcccttagggcccggttacccttcggaaagctttgggatttgggtatccggatcaataaccggaccttccagccattttga

SEQ ID NO: 2822 - DNA, 849 bp, B.fragilis
atgtctgtttacaaaaatacctcctttgtcctacccctgcaaaagaagtcgaccaagaaggctcttttgacgataaagtcacctgcaaaggaaatagaatcaacaaacagagggattttatcagtaattatctatctttgcagcccgaaaaagatacctatcagcaatatgaagaaaatatggatacttgcagtcctgaccatctgttcggttgcaacacaggcacaagaagtttttatcaatgcagaccttgtcagcagctacatctggcgtggaatgaagaatggaaatgcttccgtacaacccactttgggtgtagagtggaaaggatggaccttatcagcatggggatcgacagaattcagaaatgaaaacaatgaaatagaccttacactggaatacgaatataaaaatctgcaactgtgtctcaacaactatttctatcaaagcgaaaacgagcctttcaaatactttcactatactccccgaactacgggacatacttttgaggcaggagccgtctacacagtcagtgaacgtttccctttatccataggctggtataccacctttgccggaaatgactatcgggaaaatgaggagcgtgcctggtccagttattgtgaattcagttacccattcacagtaaagggagtagacttggccgtcgaagcaggattcactccgtgggaaggagaatatgcagacaaactgaatgtagtcaatgtcggactttcggctaccaagaccttgaatatttcctccggatttactccggccatctttggcaaactgatagcaaacccttacgagaaccggttctacttcgttttcgggataagtttatag

SEQ ID NO: 2823 - DNA, 930 bp, B.fragilis
  unsure (63),(64),(65): Identity of nucleotide sequences at the above locations are unknown.
aaccttgcatatggtttaatttggaaccggtttttaattaagaacagaagaatgatagacacnnnaatgccttttcggagaattctgcttaccagtgatacgtttcaaatacttaaagagggacaaataatttcgacattcaataaatgtggtatcttctattgtcaacgcggcagtgtggaagtctctttggaaggttgccattatcatatcaaacccggggatgtttatatctatatggcttctaccttggtgcacttgttgcataagagtgaagatgccgaggggattatggttgaagtggacttttactatattctaccgattgtaaacaaagtgataaatgtggaaagccagctctttatgcggaaaaatccatgtgtctccttgtccggtgaacaatgtgcccattttgaatatttgctgaacaatctatgggataggataaatgcggaagactgccagaaggagaatgtccagtaccagcatctgaaactggaactgataaaatcgatgggacagactatctgctatgaaatcttaaacatgtattttaccaaccagcccttgcagcctttacaacaagggaaaaaagatgttgtctttcagaatttcatgctgtctctgttccgtttctatcgcaaggaacgtgacgtctctttttatgcaaggatgcagcatatcactccccgttatttctcggccatcatcaaggagaaaacaggagatagtgccttgcaatggatcgtacggatggtgataaccgaagcgaaacaattattggaggaatctgatctgagcataaaagagatagcggaccaactgaattttccgacacagtctttctttggcaaatattttaaacaatatgtgggagtttcgcccaaagaatatagaaacaatactgcgacaacgagaataaaacgctaa

SEQ ID NO: 2824 - DNA, 2265 bp, B.fragilis
aatcactcacacaaatataggaggactgttataatggatataagtaaatgggcattccataatcgtaacctgatttatttcctgatagccgtcctgatgttcggaggagcttattcctgctatcagatgagtaaactggaggatccggaaataaaggtaaaacttgccatggtggtcaccacatatcccggggcttcggcacatcaggtagagttggaggtgaccgatgtactggaaaagaacatccgcaccatgggaaatatagataatatagaaagttattcttataatgatctgtcacttatacagattgaacttctgagcaccgtgccggatgatgatgtggagcaatgctgggatatgctgcgtcgcaaagtcaatgatgcccgggcttcactgcccgaaggagtcagtgctcccattgtaaaagacgacttcgggaatgtgtacggtatgttttacgctttgaccggtgatggtttgtctgatcgtgagttgtcggactatgccgaactgattaagcgtgaagtcggcgaactggaaggggtagaccggatagatctgtatggaaagcgtccggagtgcatcaatatctctttgttgcaggatcgtatggcaaatttgggtgtaaagcctgctgaagttcttgctaccctgaacggtcaaaacaagactacctataccggctattatgacaatggtgacaatcggatccgtgtgactgtcaatgataaattcaagacggtagaagatataggcaaaatgcttattcaaggacatgatgacgaccaactgcgtctgagcgacatcgcacaaatagagaaaggctatgaagagccggtccgtaacgaaatgtactatgacggtgagcgtgcactgggcattctgattgccgctaccagtggttcggacatcgtgaaagtgggacatgccgtagaggccagactggctgaactcaaggccgaacgtctgcctgccggagtcgaatatcaaaaggtgttctaccaaccggagcatgtgggcgagtcattgggtacatttgtcatcaacctgatagagtcagtcatcatcgtagtgcttatcctgatgattgccatgggatttaagagtggggttatcataggcatcagcctggtggttactgttttcggttcattcttgtttctttattccgcaggaggaaccatgcaacgtgtatccctggctgcctttgtgctggctatggggatgctggtcgataatgccattgtcattatcgatgggatattggtagatctgaaagccgggaaagaccggatggaggcaatgaccgccatagggcggcagactgccatgccgttgctgggagctacactgatcgccatcatcgctttcttgccgatttatatgtcgccggatacggcaggtgtctatacgcgcgatctttttatcgtacttgccgtttctttgctgctcagctgggtgttggcgttggttcatgtaccgttgatggctaaccgtcgtctgcattttgccgtagaagcctatagtggtggcaaacgggtttacaaggggaagatttatgccgcattacgtacggcacttcgtttcggattggcacaccggtggagttttgtctttaccatggtcggtttgctggctctttctgtttttggctatcagtacatgcggcagggttttttccccgatatggtttacgatcagctctacatggaatataaactccccgaagggaacaactatacccgcgtagaacaggatctgaaagagatagaagcttacttgaaagggcgtaaggaaatcacccatgtcacagcttccatcggtggtactcccgggcggtacaatctggtgagaagtgtagctaacccgtcactctcttatggagaactgatcatcgacttcacctctcccgaggagttggtagacaatatggatgaaattcagcgctatctgtcggcaacttatccggatgcttacatcaaactgaagcgctataacctgatgttcaagaaataccccattgaagcacaatttctgggacccgatcctgctgttcttcaccaattggccgacagtgcacgcaacatcatgaagaatacccccgaagtatgtcttatcactaccgattgggagcctcaaatacctgtcctgaccattgaatatgaccaacctgccgcacgcgcactgggtttgagccgcagtgatgtcagtatgtctttattgactgcttgccgtggcattcctatcggatctttttattga

SEQ ID NO: 2825 - DNA, 231 bp, B.fragilis
tgcctaccacaagcaatgccagtgaaagtcgtccgagaaaatatcccggaagaggatgcgggccccgccagcgcatatcaagctcctgtttcggcaaaaggagcggtgacgaatgctccggaaatgtattgggaaactccctctccctatccggtaacacctttccttccggatagcggcggggttgcatcggcatcagattctgaaattgtttatgttgaggaggattga

SEQ ID NO: 2826 - DNA, 762 bp, B.fragilis
tgttttactaattattccgttattatgatcaaatgcattgctgttgatgacgagcccttggcgctcgagcaattgacgggctatatagcccgtgtccctttcctgcaactgatagcctcgtgccaggatgcattcagtgccatgcaggtgttgtcggaagaagaggtcgacctgatgtttgtcgatattcacatgcccgatctgaacgggctcgatctggtgcgttcgttagtggtgaagcccctgattgtgtttacaaccgcttatccggaatatgccgtcgagggtttcaaggtagatgcagtcgactatctgctgaagccatttgaatttcaggatctgctgaaagcagccgataaggcacgtcggcaatttgagtatcatttgcaagataacgggggagggacggaaactgatttattggaaaaggacggttcattgttcgttaagtccgaatataagattatccgcatcaatgtggcagacatttgctatatagaaggtatgagtgagtatgtacgcatctataccgatacggcggataagcccgtagtgactttgctgagtatgagaaagctggaagaacgcttaccacaggagatgttcatgagggtacatcggtcttatatcgtcaatcttcggaaaataaccgaagtttcccggttacgcatcattttcaataagaatatatatataccggtgggagataactataaggaaagatttacagaatatattaacaagatttgtgtcagcagttaa

SEQ ID NO: 2827 - DNA, 1707 bp, B.fragilis
gaaatggctaacttttatttagatactccggaactcaagcatcacttgaaccatccgttgatgaagagaattgttgagctgaaagagcgcaactatgctgataaagataaattcgactatgctccggtagacttcgaagacgcaatggacagctacgacaaagtgctggaaattgtaggagaaatctgtggtgacatcatcgctcccaatgcagaaggtgtcgatcatgaaggcccggtctgcgccgacaatcgtgtgacctatgccagcgggactacccgtaacctggatgcctgccgcaaagcagggctgatgggcatggctatgccccgccgctttggaggcttgaacttcccgatcactccgtacatcatggctgccgatatcgtgagccgcagtgatgccggtttcgagaacctgtggggattgcaggattgtgctgaaaccatttacgaatttgccaacgaagaacagaagcaacgttatatcacccgcgtatgccagggtgaaaccatgtcaatggacctgacggaaccggatgcaggttccgatctccagtctgtcatgttgaaagccacttacagtgaaaaagaccaatgctggtatctgaacggagtgaaacgcttcatcacaaacggtgatgccgatattcacctcgtactggcacgttcggaagaaggaacacacgacggacgcggtctttccatgttcatctacgacaagcgcaatggtggagtaaacgtacgccgtattgagaacaaaatgggtatcaaaggctctcctacctgcgagttggtatataaaaatgccaaggccgaactttgcggtgaccgcaaactgggtctgatcaaatatgtaatggcgttgatgaacggtgcccgcttgggtattgccgctcagtcggtaggattgtcacaggctgcttacaatgaagctctggcttatgccaaagatcgtaaacagttcggtaaggcaatcatcgaattccccgccgtggccgaaatactttctctgatgaaagccaaactggatgcttcccgttcactgttgtacgagacagcccgtttcgtagacgtttacaaagcactggacgacattgccaaggagcgcaaactgactccggaagaacgtgccgaacagaaaacattcgctaaactggctgacgccttcaccccgctgggcaaaggcatgggcagtgagtttgccaaccagaacgcttacgactgtattcagattcacggcggttcgggctttatgaaagattatgcctgcgaacgtatttaccgtgattcacgtatcacttccatttacgagggtaccactcagttgcaggttgtggccgccatccgttatgtaacgaccggcgcttacctggcccgtatccaggaatacgagaatatgccggtagctcccgaactggaaggcttacagaaccgtctgaaaagcatggcaagcaaatacgcggcttgtgtgactcaaatcacagaggcaaaagatcaggaactgctcgacttctgtgcacgccgcctcgtagaaatggcagctcacatcatcatgggtcacctgatggtacaggacgcttcaaagagcgatctgttctctgaatcggctcaagtatatgtacgctatgcagaagctgaagtagaaaaacatatcaactttatccgcaaattcgataaagacgatctggcttactacagaaagtaa

SEQ ID NO: 2828 - DNA, 246 bp, B.fragilis
tacattataaaatctatttctttaaaatcaattagtttggttatagttctgccaggaataatctgctttatgtcatttgatttgtacttaatgtgttgtaatataatgatctatggatttaagtctaatgtgaatcagggtttgttgcgtaagagagacgttataggcttattgaagaatgaagagataatttcgaataaaatattcaatatttttataaacgaagagctggatttattatattaa

SEQ ID NO: 2829 - DNA, 954 bp, B.fragilis
atatataaaaacatggcttatatagattattacaagattctcggagttgacaaaaatgcttctcaggatgatattaaaaaggctttccgtaaattggcccgtaaatatcatccggacctgaatcctaatgacccaagcgctaaggataagtttcaggagattaatgaagctaacgaagtattgagcgatccggagaaaaggaaaaagtacgacgaatacggcgaacattggaaacatgcggacgaattcgaagcgcagaagaaggcgcggcagcataccggtggaggcggaggaggattctccggctttggcggagacggcggttcttattggtactcgtccgatggagaggggttctcgggtggtgatgccggaggattctcggacttctttgaatctatgttcggacatagaggaggaggcggacgaggcaatgcaggcttccgaggacaagattttaatgcagaattgcacctgtctcttcgcgatgcggcccggacccacaaacaggtgttgaatgtgaatggcaaacaggttcgtattacgataccggccggtgtagccgacggacaggtgattaagttgaagggatacggaggcgaaggcatcaacggtggccctgcaggagacctgtatatcactttcaagatagccgaagactctgtattcaagcgtcttggagacgacctgtatgtggatgtggagatggatctttatactgccgtactgggtggtgagaaggtgatcgatacactggaaggtaaagtgaaactgaagataaagcccgaaacccagaatggaacgaaagtgcgcctgaaaggtaaaggttttcccgtttataaaaaagaaggacagtttggcgacttgatcatcacttattcagtcaagatacctaccaatctgacagataggcagaaagaactgttcagagagttacaacagagtatgaactaa

SEQ ID NO: 2830 - DNA, 1035 bp, B.fragilis
gaggagagaaaagatatgaataacttatttgtatattgcgaaatagaagacggcatcgtcgcagacgtaagcctcgaacttctgacaaaaggacgctcgttagccaatcagttgggttgccagctcgaagcagtcgttgccggaaccggacttaaagatattgaaaaacagatcctcccgtacggagtagacaaactccatgtcttcgacggtgaaggactctatccttatacttcactcccccacatttcaatcctggtcaatctgttcaaagaagaacaaccgcaaatctgcctgatgggtgcaaccgttatcggtcgtgatctcggtccgcgcgtatcctcagccctgaccagtggtctgacagccgactgtacatcattggaaataggcgatcacgaagataagaaagaaggcaaggtctacaagaacctgctttatcagattcgtcctgcattcggtggcaacatcgttgctaccattgtcaaccccgaacaccgtcctcaaatggcaaccgttcgcgaaggagtgatgaaaaaagccattctggcagcagactacaaaggtgaagtaatccatcatgatgtgaagaaatatgtagccgacaccgattacgtagtaaaagtcatcgaacgtcatgtagaaaaagcaaagaacaacctgaagggttctcccatcatcatcgccggtggttatggtgtaggttcgaaagaaaacttcaacttgctgtttgatcttgcaaaggtattaaacgcagaagtaggtgccagccgtgcagccgtagacgcaggtttcgttgagcacgaccgccagatcggacagaccggtgttacggtacgtcccaaactctatattgcctgcggtatctccggacagattcagcacatcgccggtatgcaggaaagcggtatcatcatctctatcaacaacgatccgtcagctccgatcaatacgattgcagactatgtaatcaacggaaccatcgaagaagttgtaccgaagatgattaagtattataaacaaaacagtaagtaa

SEQ ID NO: 2831 - DNA, 1887 bp, B.fragilis
catatcatgaaaataaacaaactactgtatgccggagctgccctgaccctacttggcgcctgcgctccagctgtgaaagctcccgaagccatcttacccgttcccgaagagaaacaagtagactggcagaaaatggaaacgtatgctttcgttcactttggtctgaacaccttcaacgaccgggaatggggatacggcgattcggaaccgaaaacgttcaatccaaccaaactggactgtgaacaatgggtgaaaacgtttgtcgaatcaggcatgaagggtgtgatcctcaccgccaagcatcatgacggtttctgcctgtggcccacccaattgacggagtattgcatccgcaatactccttataaagacggaaaaggggacatcgtcggcgagctggctgccgcttgtaagaaatatggcatcaagttcgctgtttacctctctccatgggacaggcaccaggccaattacggcacaccggaatacgtagattacttccataaacaactgactgaattgatgaccaactacggtgaagtattcgaagtatggtttgacggggccaacggaggtgacggatggtatggcggagccaaagacagccgtactattgatcgtaagacctactacaattatccgcgaatttacgaaatactggacaagcttcagccacaagctatcgtcttctccgacggaggtcccggttgccgttgggtgggtaatgaaaacggatttgccggagccaccaactggtcattcctgcgtgcaggtgaagtgtatccgggttatccgaaatatcgcgaactgcaatacggacatgccgacggcaaccaatgggtaccggcagaatgtgacgtctccatccgtccgggatggttctatcatccggaagaagacgaccgggtaaaaaccgtagagcaattaacggacctttattaccggagcgtgggacacaacgccaccctcctgcttaacttccccgttgaccgcgacggtctgatccacccgatcgattcggccaatgcagtaaacttccacaagaatgtacaaaagcagttggcacacaatctgtttgccggcatccgtcccaaagcctcggatgaacgaggaggacaattctctgccaaagccgcaacagacgaaagctgggatacttactgggctaccaatgacggtgtgactgccgcagatatagagttcgactttccgaaaacagagaaggtcaaccgtatgatgatccaggaatatatcccgttgggacaacgtgtcaaatcgttcatcgtggaatatgataaagacgggaaatggcttccggtcaaactcaatgaagagactaccaccgtgggctacaaacgtttattgcgctttgaaaccgtttcgaccgataaactccgcatacgtttcactgatgcacgtgcctgcctttgtatcaataatatagaggcctattatgcaggtgaaacagccgacacattcaccgtggaagcaaaagaactgaaaagttatccgtttacacttgtcggagtgcccgaagaagaaactaaaaaatgcatggataaagacaagaacaccactgcttttgtcgagggagatgcattggtgatcgatctgggagaagaacgtaccatcacctctttccattatctaccggatcagagtgaatacaacaaaggattgatttcctcttatgaactatctgtgggtaccgaagcaaatgcggtaaaccggatagtagcccaaggagaattctcaaatattaaaaacaatccgattctacagtccgtctacttcactccggtgaaagcacgatacctctctctgaaaccgaccaaaatggtaactgaaggagaaactatgggatttgcagaaataggaatccaataa

SEQ ID NO: 2832 - DNA, 213 bp, B.fragilis
ggatatacacttacaggcaaccgaaatccctgtattgccctatacaatctgttcatctgtgataaacttccggcacatgctcaaaaagagcttcaccaacctaacatccggtcattaactgctgacacaaatcttgttaatatattctgtaaatctttccttatagttatctcccaccggtatatatatattcttattgaaaatgatgcgtaa

SEQ ID NO: 2833 - DNA, 189 bp, B.fragilis
gtaaaacattgcaagactaagacaacaacaggtcttaaagtctctttcaccacagatgaacagatttataaggatatacacttacaggcaaccgaaatccctgtattgccctatacaatctgttcatctgtgataaacttccggcacatgctcaaaaagagcttcaccaacctaacatccggtcattaa

SEQ ID NO: 2834 - DNA, 1308 bp, B.fragilis
aaacaatactgcgacaacgagaataaaacgctaaaatatagcagtaaagatagacgttcatttccatatttggggatattcagctatctttgtcgcataaatattaataaaaacgacataataatgaaaaagacaatcctcctggccgctttaggcctgatcagtctgagtgcattgggccaagacaaaccacaagaagaaggcttcgttttcactactgtgaaagaaaacccgattacatccattaagaatcagaaccgttcgagcacttgctggagcttctcaagcctcggttttctcgaatcggaattgctccgcacaggaaagggtgaatacgatctttctgaaatgttcgttgtacaccacacgatggttgaccgcgctgttaactacgttcgctatcatggcgacagttctttctctccgggaggaagtttctatgatatcatgttctgtatgaagaactacggacttgtaccgcaggatgctatgccgggaatcatgtatggtgactcactgcctgttcacaacgaactggatgcaacagcaggagcctatgttaatgctattgccaaaggtaatctgaagaaactgactccggtatggaagaagggcctttgcgctatttatgatacttacctgggacaatgcccggaaaagttcacttacaaaggcaaagagtatactccgatgacttttgcacagtctttgggactgaatccggacgactatgtatctctgacttcgtacacacatcacccgttctactctcagtttgccatcgaaatccaggacaactggcgtaacggattgtcatacaacctgccgctcgacgaatttatggctgtaatggataacgccgtaaagaacggatatacatttgcatggggtagcgacgtgagcgaagaaggatttacccgtgacggtatcgctgtagttccggatgcagccaaaggtgccgaactgacaggatcggacatggcacgctggacaggaatgactgctgccgacaaacgcaaagagttgacttcaaaaccattgccggaaatgaaaatcactcaggaaatgcgtcagacagctttcgataattgggaaacaactgatgaccatggaatgattatctatggtatcgctaaagaccagaacggcaaagaatactttatggttaagaactcttggggtacaaacaacaagtacaaaggtacttggtatgcttctaaagcttttgttgcttacaagactatgaatattctggttcataaagatgcccttcccaaggatatcgcaaagaaactgggaattaagtaa

SEQ ID NO: 2835 - DNA, 189 bp, B.fragilis
gctgggaagcttaatgcaccggcgagcaagagcagagtaacttgtctagtgatttttaacataacaattttgttttgggttaataataaaggttttgtttggttcttttacattcttcctttcttgttgattatcctttcttatttctttaaaaatggattagttctggcagaacttggtgaaatgtaa

SEQ ID NO: 2836 - DNA, 753 bp, B.fragilis
  unsure (719),(720): Identity of nucleotide sequences at the above locations are unknown.
aagccgctcaggacattagtctttcttttcggggtaagtggcactatcaataaaatatacgtgaaagacggggcgcaggtacgagcggggcagctcctggccgaattggatccgactgactatcaggtacaactggacgctacggaagctgaataccgtcaggtaaaggccgaagcggaaagggtcatggctctctataaagagaacggaaccacacccaatgccaatgacaaggctgtctatggactgaaacaaatcacagccaaatataaacatcatcaagatcagttggcatatacccgcctttatgctcctttcagcggatatgtacaaaaacgtttgttcgaagcccatgagaccataggagccggcatgcctgtcatctcgatggtaagtgcaggtgcacccgaggtggaaatcaacttgccggcagctgaatatatccggcgtaaccggttcaaccgctatcactgtacattcgatatttatccgggagaaacctacccgttacaactgatcagtgtcactcctaaagcaaatgctaatcagttgtataccatgcgacttcagctaatacccggaaaacaggctgttccttctcccggaatgaatgccatggtgactatcttttgcgatacagatcgctccggtacgttatccgtccctaccagtgccatcttgcagaaagacggaaagtcgtatgtctttatctacaatgnnccccaccgacgccgcgcgcgaaccaatctgtga

SEQ ID NO: 2837 - DNA, 972 bp, B.fragilis
atttgcaggctgatagttaaccggatagtgaatagcaagaaccttactactgactactggctgctaacttgtagaaatactaatactaaaattaataacatgagtttgaaaattgttgtattggcaaaacaagttcccgacacacgaaacgttgggaaagatgccatgaaagccgacggaactattaaccgtgcggcactccctgccatcttcaaccccgaagacctgaatgctctagaacaggctctccgactgaaagatgctcacccaggctctaccgttaccatcctgaccatgggaccgggacgtgcagctgacattattcgtgaaggacttttccgtggtgccgataacggttatttgctgacagaccgtgcttttgccggtgctgatacgctggctacttcgtacgctctggcaacagccatcaagaaaataggtgaatatgacatcatcatcggcggtcgtcaggctatcgatggagatacggcacaggtaggaccgcaggttgcagaaaagctgggactgactcagattacgtatgcggaagagatcctgaaagtaggtgacggaagcatcaccgtaaaacgccacatcgacggcggtgtggaaacagtagaaggacccttgcccatcgttatcactgtcaacggaagtgcagctccctgccgcccgcgcaatgctaaactggttcagaagtacaaacacgccaaaaccattaccgagaagcaacagggtaacttggactacaccgatctgtacgacacccgtgactacttgaatctggtggaatggagcgtagcagacgtaaacggtgatctgaaacaatgcggcctcagcggttcgccgacaaaggtaaaagcgatccagaacatcgtgttccaagcgaaagagagtaaaaccatcagcggcagcgaccgtgaagtggaagaactgattgttgaactgttggagaaccacactattggataa

SEQ ID NO: 2838 - DNA, 4047 bp, B.fragilis
tctattaaaagaaaaacaattatgcggaaaatcacattaggtctgatactatgcagcatggttacgctctgctttgccggtcaacgacctttagagggatttaagtatgcctcggaaaaagccccggtgggcaatgaatgggaatcaccggagaacattgcactcaacaaagaacaaccacgagcctggttcttttccttccaggatgtggaaagcgcacgcaaagtgttaccggagaacagtaaatactggttgtcactgaatggtgactggaaatttaattgggcacccgatccggattctcgccccaaagatttttatcagactactttcgatgtttcgggctgggacaacattcccgtcccttcaagttggaatatctatggtatccagaaagacggtagcctgaaatacggagtacctatctatgtgaaccaacctgtcattttcatgcacaaagtgaaagtagacgactggcgcggaggtgtgatgcgtactcctcccactaactggactacttataaataccgtaacgaagtgggttcctaccgtcgcgacttcgacatcccccaagattgggacggtcgtgaagtatttatcaacttcgacggtgtggactctttcttctacctctggatcaacggccagtacgtaggtttctcaaaaaactcacgcaatacggccagtttcaacatcaccccctatctgcaaaaaggaaagaacaccgttgctgccgaagtataccgcagttcagacggctcgttcctcgaagcacaggatatgttccgcttaccgggtatcttccgtaccgtagctctctactctactccgaaagtacaggtacgtgacctcgtggtaatccccgacctggacgagacatacaccaacggttcgttggccatcagcgccgacatccgcaactttggcaagaaagcagccaaaggataccaaatggcgtatacactatatgctaataaactgtactcggatgaaaacactccggttgccaatgccgttgcttcggccactgtgaatctggtgaacccgaacgaaaccgtagaagcggaaaaagcgatcatgaacgtacagtcccccaacaaatggtcggctgaattcccccacctctacacactcgttgcagaactgaaagacaagaaaggcaaaacaatagaaaccgtttcgactaccgtaggtttccgcaaagtggaaatcaaagatactcctgcttctgctgacgaattcggactggcaggccgctattactacgtaaacggcaaaaccgtaaaactgaaaggtgtcaaccgccacgaatcaaatccggctgtgggacatgccatcacccgtgaaatgatggagaaagaggttatgctgatgaaacgtgccaacatcaatcacgtacgtaactctcactatccggacgatccgtactggtactatctgtgcaacaaatacggactctacctggaagatgaagccaacatcgaatctcacgagtattattacggagccgcttccctgtctcatccggtggaatggaaaaacgcccatgtagcccgtgtgatggaaatggttcatgccaacgtaaacaatccttcgattgtcatctggtcattaggcaacgaagccggaccgggaaagaacttcgtagcagcttacgatgcactgaaagcattcgacctctcacgccctgttcagtatgaacgtaacaacgatatcgtcgatatgggttccaaccagtatccttccatcggctggatgcgcggtgctgtgaaaggcaactatgacatcaaatatccgttccacgtttcggaatatgctcactctatgggtaacgcctgcggtaacctggtggactactgggaagctatcgaatcgaccaacttcttctgcggcggcgcaatctgggactgggtagaccaatcgatgtacaactatgacaagaaaaccggtgaacgctacctggcttatggcggtgatttcggcgatactccgaacgacggtcaattcgttatgaacggtatcgtattcggcgatctggaaccgaaacctcagtattatgaagtgaaaaaggtataccagcacatcgacgtgaaggctatcgatgtagaaaaaggccggtttgaagtgttcaacaagtattacttcaagaacctttcggactatgatgtgaaatggtcactctacgaaaacggcaaagaagcacaatcgggcctattgagcataggcgaagtagctccgcgtacccgtacacagatcactgttccttatcagttcagtaagctgaaagccgattcggaatatttcgtgaagattcaattcctgctgaaagacaacatgccttgggctgacaagaacttcgcacaagcagaagaacagatacttgtgaaagaggctaccgcacgtccttctatcgccaccgtagcagccgagggcgacaaaccggaagtgatgatgactaaagcgagcgatatcattaccatcaaaggcaatggttacacagctcagttcgatatcaagacaggtactatctacagtctgacatacggaaacgagaaggtgattactgacggcaacggtccgaagctggatgcgctccgtgctttcaccaataacgataactggttctattcacagtggtttgataatggtttgcacaacctgaagcattcagctaccgggttcaatatgactaccaaagaagatggtacagtcgtattgtcattcacagtacagtctcaggctcctaatgcagccaagattctgggtggaacaagctcgggcaagaacaagattgaggaactgacagacaagaagttcggcagcagtgacttcaagtttactaccaaccaggtatggacagtctacaaagacggttctatcgaactggaagcaagcatcacctccaatcagccgagtctcgtattgcctcgtctgggatacatggtacgtgtgcctcagcaatatgccaactttacttactacggacgcggtcctatcgacaactacgccgaccgtaaagtaggacagttcatcgagcaacataagaatacggttgccggagagttcgtcaacttccccaaaccgcaagatatgggtaatcacgaagacgtacgctggtgtgccctgaccaacaatgcaggcaacggtgccgtgtttatagctaccgaccgtttgtcgacttcagctctgccttactctgcactcgacctgattctggcttcacatccgtatcagttaccgaaagccggtgatacttatcttcacctggatgcagccgtaaccggcctgggtggtaacagctgcggtcaaggcggcccgttggagcaagaccgtgtcttcgccagccatcacaacacaggtttcattatccgccccgcaggtaaagacctgactgtaacagccaatgtagctcccgccggagagatgccgttgtccataacccgcaaccgtgccggtgtggtatctgtatcatcacagaaaaaagacgccgttatcctttatacagtagataagagtaaatccaaaacttataccgaaccgatcgcactacgcaatggcggtacggtgactgcctggttcaaagatgcacctttcatcaaggcaagcatgacattcgacaagatcgaaagcatccagacagaagtaatctacgcaagtagcgaagaatcggacggaggcgaagccaagaacctgacagacggtgatccgaataccatctggcacaccatgttctctgtaacggtggctaaacacccgcattgggtagacctggatgccggcgaagtgaaaacaatcaaaggtttcacttacctgccccgtcaggacagcagcaacggtaatgtgaaagactacaccatccacgtaagtatggacggtaaagaatggggtgaacctatcctgaaaggtactttcgcaagagacctgaaagagaagaaagtaatgttcgataaacctgtgaaagcccgttatatccgcttcaccgccttgagcgaacaacgcggacaagactatgcttcgggtgccgaactgactatcctggctgaataa

SEQ ID NO: 2839 - DNA, 234 bp, B.fragilis
gaggtgttcggaatgttcatggtctggggtttcaggcagagaattttcgattcccctctatcaatcagaaaaggaatttattacccgctttcaaaggaagcaggtttcaaaaccagctgtctctctcccaataagtgtacaaacaactctattatctacttttttgcaagagaagccgatcgctgtgtcttcatcaaggaagattcgttgactcccggtcagaatctttggtaa

SEQ ID NO: 2840 - DNA, 1221 bp, B.fragilis
gacaaaggaggtatttttgtaaacagacattcaagacgaactttttggagtatgaaacaaattaataaacagaagttactggagcagatggtttatctcgtcatttggctgacggttatctctgtgccgttggtgggtgattatctgtttgcttccattagcccggtacatacgtttagttggcagaccatacggatggcatggttgctgactctgcctttcattctgcttttcgtagtcaataactattttctggctccccggctgttacttcggaaacggtattgggcttatgcactttcattagcaggagtcgtgactctgctttttattttgtatccttctatcaatcctcctcaacataaacaatttcagaatctgatgccgatgcaaccccgccgctatccggaaggaaaggtgttaccggatagggagagggagtttcccaatacatttccggagcattcgtcaccgctccttttgccgaaacaggagcttgatatgcgctggcggggcccgcatcctcttccgggatattttctcggacgactttcactggcattgcttgtggtaggcattaatgtggctatcaaactcttgttcaagtcgatgcgtgatgaagaagcattgaaagagttggaacaccagcatttgcaatcggaattgcagtatctgaagtatcagataaatccgcatttttttatgaatacccttaataacatacatgcgttggtcgatatggatgccggcaaggcaaaacgtactattgtcgaactttccaaactgatgcgttatgtgctttatgaagccagcaaccggacgattttgctttcacgcgagatacagtttttggacaattatattgccttgatgaaattgaggtataccgggagagtccggatcgaatgctgtatgcccgatgaggtgccggaggtgcaaattcctcctttgctttttatctcttttgtcgagaatgccttcaaacatggagtaagttatcaggaagagtcgtttatccgggtttttatgtctgtcgaggatggcagacttgtctttcgttgttcgaacagcaaccacgggcgatctgtggaacaacaccacggcatcgggttggagaatatccgcaagcggctgaggctgctattcggacaagattatactttatctatcaacgaacgtgacgatagttttaatgttttactaattattccgttattatga

SEQ ID NO: 2841 - DNA, 321 bp, B.fragilis
aagagcactatgcagaccgaattaataattgtcagtgaatactgtcacaaatgtcatattgagccttcatttatcgacctgttagaggaaggtggcttgattgaggtacgcaccgagggaggcgagcactatctgcttgcgtcgcaacttccggatgtggaacgatacagccgtatgtattatgacctgtccatcaatatggaaggtatcgatgccattcatcatttgctggaaaggatggaaatcatgcgaagggaaatcagttcgctccggaaccagcttattgtctttaagagagaaggcattatggaggattggtga

SEQ ID NO: 2842 - DNA, 1764 bp, B.fragilis
cccatacacatatccgatgcaaagatcattatctgttggtttaagtctcacattctaaatacaaagcatcttatgaaaatcaaatatctattctacatcggagtggcaacactcgccctatcgggttgtaatgacggtttcctggaaagagccccggaagcgatcaatgacaaaaccttctggaataccacaggagacttagaaacgtatgccaatcaattctacagttatctgcccggaggtgtaacctcgatagcagacggtgaaagtgacaatcaggtgcccaacagtattcctcagttcttctggaatcagttgagcacccctgcggaagcagctagttggtgtaattggagtaaaggcggatggcaaccgatccggctagtcaactatttcctgactcactatcagaccgtaagcggtaaggagtcggaaatcaaccagtatgtagcagaagtccgcttctttaaggcaatgcaatatgccggactgatgagaacattcggtgatatcccctggttggataaagatctgggtacaggcgacacggatattctttacggtccgaaactaaaacgttatgaagtgatggataaaatcattgaagagtttgattttgccatccaatggttgcccgaaaaaccggctaccggacgtatagggaaagatgtagcacgccaactgaaagccagaacttgcctgcacgaaggtacatactataagtatcataccgaattgggatgggcagacaaagctgaccgcctgctgaaaatggctgctgatgaaacagatgcaatcatggcaaccggtaaatacgaaatctataacaccggacatccggaaaaagactattatgacgtatttgtgatggaagacaaaacgaatctgaaagaggccattctcccggtcacctatctggatggtaaaagaaaacatggcatgagccgtacgctggcagaagcaaacacaggtttctcaaaagattttgtagaaagctatctgtgcctaaatggtaaacccattacaggaaacgaccagtataaaggggataccaatatgaaggatgaaacgaccgaccgcgatccgcgcctgaagcaaaccattctgacttgggactttccgacacgagtaactgtagccaccaatgacagtacatacatcgagaaagaagaagacttcatttcacaatattgcctgaccggatataaatccatcaaatacttcataccgacagacaaagctttcgaagcaaacaataatacttatgacggcattgcctatcgctatgcagaaaccttgctgataaacgcagaggctaaagccgagctgggaacgattacgcaagcggatctgaacaaaaccatcaacgtattgcgtgaccgggcgggcatgccgcacctgacactggaagttggtttcaccgatcccaactggccggcatggggatacagcctgactccgctgttacaagagattcgccgcgaacgccgtatcgagctggccggagagggattccgttgggacgacctggcccgttggaaagccggtgcaatctgtaacaacgtgaagacatacatcggaaaacgtgagccttataaagaaggccaatacgcgattgtatatcctgcttataccaatgataactactcttatgaagccggcaagagccgcacctggaatgacagactctacttgcgtccgataccgaccggggaacttcagagaaatgataaccttctcccgcaaaatccgggatgggaataa

SEQ ID NO: 2843 - DNA, 189 bp, B.fragilis
cagccagtagtcagtagtaaggttcttgctattcactatccggttaactatcagcctgcaaatttaagcaaacgcttggttctgacaagaaatctatctgaaaaatgcacaagtttaaggattctgagcaacttgtcggactcttacgatcatgaatacagggttatcgtcaactttcagatcttttaa

SEQ ID NO: 2844 - DNA, 201 bp, B.fragilis
atgggatttgctcccatgaataacccaaagatagccatcgccgtatatgttgagaatggtggttttggcgcagtctacggagtaccgatcggagcattgatgatggaacaatatttaaaagggaaactctctccggagaatgagatacgtgcagaagaatatagtaatagagtgattatgtatggaaacgaggagcgttag

SEQ ID NO: 2845 - DNA, 1314 bp, B.fragilis
ttatgtatggaaacgaggagcgttagtttatggaaaacattggattgggtaacgatcgtcatttacctgctccttataatcggtggatggtttagtgtgtgcggtgccagttatgattatggtgatcgtgactttctggacttttcaacacgtgccggtaggcagtttgtgtggattatctgttcctttgggcttggttttatactcttgatgcttgaagaacgaatgtacgatatgtttgcatacctgatatatataggtatgattcttctgttaatcgtaaccatttttattgcacccgatacgaaaggttcccgttcgtggttaatattaggtccggtcagtctgcagccggcggagtttgcaaaatttgccacagctttggctctggcaaagtttatgaatgcctattcatttaatatcaagaagtggaagtgctttttacccttggtagcttttattttacttccgatgttgctgattattttgcagaaagaaaccggttcggcattggtctatcttgccttcttcttggtgctatatcgcgagggtatgcctggagtagttttgttttcgggagtatgtgctgtagtctattttgtggtcggtattcgtttcgatcaggtatttatagccgatacgcctacgcctatcggagagtttgccgtgttgttgatgatacttttatttgccggttccatggtttgggtgtataggaaaaagtgggaacctgtacggaatatgataggcggtagtttgcttgtgctgctgatcgcttatctcgtttctgagtatctctctccattcaatttggtttgggtggagtgggggctttgtgtggtgaccataggttatctactttacttatctttgagcgaacggcaacgtgcctatcttttgatcggattgtttgctttgggttctatcggttttctttattcaagtgattatgtgttcgacaacattcttgaacctcatcagcagattcgtttaaaagtggtgttggggatggaagaggacttggccggacccggttccaaccttaaccaatcaaagattgcaattggttccggagggttgacgggaaaaggttttctgaatgggacacaaaccaggctgaaatatgggcccaaacaaaataccgatttctttttctggactgggggtgaagaacaggggtttgtggttcgggaccccttttttgtttttttgggagtgatactccgttttatagcgaccgaaaacgggaaaatttttttttgggggggggttatggtttttcgggtgaggacaattccctgccccattggttaa

SEQ ID NO: 2846 - DNA, 1041 bp, B.fragilis
tttatactgacggccccttcagctatgaggtgcaatacaggtccgctgaaggatctgatgattgatggtattattggtggagtaggaggagttatcgtctttttgcctaatatcctgatattatatttttgtatttctttgatggaggattcgggctatatggctcgtgcagcttttattatggataagatcatgcacaagatggggttgcatggcaagtcgttcattcctttgattatgggtttcggttgtaatgtacctgctattatggcttcgcgtactattgaaaaccgaaagagccgtttgattaccatgcttgttaatccattgatgtcatgtagtgcccgtttgcctatctatttgttattggtcggtgcttttttcccaaagaatggtagcttggtcctattggctatttatgctatcggcattgcattggcagttatcatggcgcgtctgttcagtcgttttctggtcaaaggggatgatactccgtttgtgatggagctccctccttatcgcatgccgaccatgaaatccatcttccgccatacatgggagaaaggtgcgcaataccttaaaaagatgggaggaatcatcatgattgcttctatcattatctggttcttggggtattatcccgatcacgatgcttatcctacccaggcagaacagcaggaaaattcttatattggtcaaatcggtcaggcagtggagcctgtgctcaaaccgttgggcttcgactggaagctgagtatcggtttgctctccggtgtcggtgccaaagaattggtggtaagtacacttggcgtactctatacaaatgatgccgatgccgatgtagtcagtttggccgaacgaattccgattacaccgcttgcggcatttagctatatgctgtttgtgttaatctacttcccgtgcattgccacgttggtagccatcaagcaggaatccggtagttggaagtgggctatcttcacggcaggatataccacggcgttggcatggcttgtttcatttgccgtctatcagatatga

SEQ ID NO: 2847 - DNA, 285 bp, B.fragilis
  unsure (156): Identity of nucleotide sequences at the above locations are unknown.
ttggaagtgggctatcttcacggcaggatataccacggcgttggcatggcttgtttcatttgccgtctatcagatatgaggaatgtttttatgaattggcaggaatgggtagtcgggctactgattgtattgtgcgtaacccgtattctttatggnatttatcttttttttcgtcgtgtgaaggaaaatgataacccttgtgcgagttgtgcaagtggctgtgaattaaaggatatgatggaaaagaaccagaaagaatgttcgttcaagaaaaagattacatag

SEQ ID NO: 2848 - DNA, 2493 bp, B.fragilis
tatattaaatctatctgttatttatatatttgcgtttataaatacggaataactatgaatagacataaattagccttttctttgatcggtattttcatcgttcaattatcttacgccggatattttaagcacataggtagagaagaaggtctttcgcaatcgtccgttatggctatctatcaagataagctgggtagaatgtggtttggtacacgtgaaggagtcaacatctacaatagtaataagatggccgtttataaggcatggatacaaaacggaaatcgaccggatcagaaaatcttgatagggaatgaggttagtgccattacagggagtcaaaacggagatgtgtttctgatcgttgaccatgctttactgaaatacgatattcgtaaagagactttcgaacgtctacgtcaaggatctgtctatgctctaacatctcatgccggtgagatatggtgtgccggacacgactctattttccgatacaacccccaaaacaatcaattagactttcaattaaaaacaggtatatcatccatcaactatctgacgataaatggcaacaggttttatatcggtgccaaagaaggtctatataccacggaaaacaaagggagggttcaatgcctgatccctaaagtagatgtttatcgtatttttcaaagctcctgtcaggaactttgggtaggctgccgtacacaagggctataccgtatcaaccggaacggacgaatcaaccgcattccttatgacccctcatcaccaaacggcatttccagcgaacaaatacgtgaatttgtagaagatcagcaaggaaacatctggttcgggaccttcgacggtttacaaaaatatgatccaagcacccaaacctacagcctcatcaagcaagaacaacgcccgggaggactcagccattcttctatattttcactctatcaggatgtacaaggcactatctggataggtagttattatggaggagtcaactactttaacccggataacaacgcattcaattactacacttataatcccgatcgtagcgactgtctcaactacccgttcgccggggctatgaccgaggacaaagatcaccacctatggatatgcaccgatggtggtggattggcatgcttagaccgacaagcgggacatttcaccacttacactgccggaggccccaactcactgccccacaataatctgaaaagtatttgttacgaccctaaaagagactgcttatatatcggtacacatatgggagggctctcccggttcgaccgcaagaccggacgtttttacaactacctcaatcattccacaaaaggcctcaaagagcccaatgatgttatcttccaagtatctttctataacgaccagttaatcgtttccgctcgtaacggagttttttccatgaatcccgatacaaatgaattccgcttgctttatgacggatattactatcaaactttcaccattgatcccaaaggttttctctggttgtcggcaggtactaacttatatagtataaatctgaaacaccctgaagaagtcaaatcattcagtctgcctgcatccattggacagttcggcatcagcaagattttgaaaggtaacaatcaatatctttatatcgccactttaggttcaggacttttttgttataacgaacaaactcagacctgcatcaactatactcccgagcagaaccaattactcagtaattattgctataatcttctacagacttcgacagacaacatactcatcacaagtgatcggggtatcacactgtttaatccaaccaccgaatcattccgttccattgaactggataacggactgtccctttcatccatcattaatggttgtggtgtatggatgtgtagtgaccatactatatttatcggaggtacaggagggcttagttcttttctggaaaaagacctgaacaaagaatatcccaaacctaagctctatttttcaagtttatccgtcaacaacgcacggataagtccggatgacaaaagtcgtatactgacagaagggctcccttttgtccgggaaataaatctaaatgccacccaaaataacctgactgttgagtttgcttcttccaactatgtggatatactgaataatacttggtatgagtatcagttagaaggttttgacaagcaatggtcactcacctcacaaacaagcctgaaatacaccaatctggatcctggagactacgtgttacacgtacggcaaaaaggcaactccctgaaaatgcgcaaagcacaagagatcttattacaaatacatatcaataccccatggtaccttacttggtgggcatggctcagttacatcactatcagcatttcagtgacctattttatctggcgcgaaaaaagttccagaagaactttggcgatattacggcaaagcctctcttctcttacctatcatcagattctttttaatccagctatttaa

SEQ ID NO: 2849 - DNA, 744 bp, B.fragilis
atgataaaatcaatacttatcgctttatgcacagttctcctctgctggaatagcattccggcagaggcacagacgccacaggattcagtacgcttcatcggatatcttcccgtccgacacaccgaccccacgaaatggataacccggtatcaaagtgaaatagaccgataccaaacagaaaaccaaatgctgaaggatacctcctgtgacgtactctttctaggcagttcttccattaacttgtgggataatatctatcgggacatggctccgctaaagattctccggcgttcgtacggaggtgccgcgctccgggatatgctctacaattatgatgtaatcgcccggggatatcacccccgcagtattgtgatttacgtagaaaatgacctcgcaggcactcccgaggacctgactgtaggcgagacattcgacttcttccgcttgctgaccaatcgcctgcaacgggactatccggatattccgatatttattctctcctataagccttcactcgcacgcaaagagatgattccgaagcatgaaatcataaatgctttgcttcaggaatatgcttcgaagagagggggactcacttatattgacgtagcctcctgtctgtacgacaacaatggaaagctaagaaaagacatcttcaaacaggacggattgcacatgaatcagaacggttacgatctgtggactgctatcctgaaaccgaaaatactggaaagcatccgataa

SEQ ID NO: 2850 - DNA, 570 bp, B.fragilis
aaggcatcgaactgcacctccgctatcagggtggagaagcgggtccgttattttgggcacaatactctttcctcggactcgatcccgtgggggctgaaagacgagtattgtccgagctattttaacgaaatgcgaaatctcacactggtaaaccgtgaatactgcattcgcaacccgaagcactacaaaggctacggaccagactgttggggactgaccgccagttattccgtggacggatatgctgctcatggaccattggaacgtgacgaccggggagtcatctctcccactgccgctctctcttctattgtctacacaccggatcagtcactgcaagtaatgcatcacctgtacgaaatgggagacaaagtattcggtccttacggattctatgacgctttcagcgaaactgccgattggtatccgaagcgatatctggccatcgaccaaggcccgatagccgtaatgatagaaaactaccggacaggactattgtggaaactcttcatgagccatcccgatgtacaaaacggactaaaaaaactgggattcaatgtaaagaaataa

SEQ ID NO: 2851 - DNA, 1680 bp, B.fragilis
ctaagtagaagttccagaagaactttggcgatgtcgctggagaaagaacgtattgaaaaggaacatattgaagagatgaaccaagctaaactacgattctttaccaatgtgagccatgagtttcgcactcctttaactcttattataagtcaggtagagcttatgttacaaaagaatacgatacctccatctttgcataatagtattttcaggataaggaagcatgcccaacaaatgaaacttctaatttcagaattgcttgactttcggaaattcgatcagaactatatccaattaaaactatcggaacaaagtctgaatacatttttagaagaagtctatctttctttttctgcttatgcctctcagaagtccatttcttaccatctgaagctgttggagcaggatatatctatttggatagatgactggcaaatgcgaaaagttttgtttaatttgctttcgaacgcatttaaacatgttccggataaaggagaaataagcatattaacctctaccacaccggatcaggttgttattgcagttaaggattccgggaatggcattagtaaagaagaacaggaacggatatttgatcgtttttatcaggcggacaatcggaataaagcgattcatgttggcactggtatcggacttgcattaacgaaaagtatcattcagctacatcatggtacaattgaggtagaaagtgagttaaatgaaggaagctgttttattgtgaagttacctaaaacccgtgattgttttgaaaaggatactgaagtcgtttttctggaatctccggaaaaggaacctatggtacaagagaataccataccggatgagaattttatgaaaaaggatgattctacattcgaaactcccttgatagatgaacgggaagggaaacggaaagtattattggtagaagataatgtggagcttttgcaggtactcaaagaaatattttcatcactttatcaggtggtgacggctgctaatggcgaggagggactgaaacaggcttttgcagaagttcccgatttgatagtgagtgatgttatgatgccggtaatgacaggaacggagatgtgtctgaaaataaagaataacataaacctgtgtcacattccggttgtgttgttgacagcacttgacactgtagatcaaaatatagaagggctacgccgtggagcagacgattatatcaccaagcctttcaatgcaaaaatcttaataacccgttgcaataatttgattcgtaaccgcttgttgatgcaaagccgttttgccaaagatcagattttagaaatcaacctgttggcagctaatccaatagataaaggtttcttggatagagtgattaaggtggtagataaacatattgataatgaggattttgatattggtatgttatgtcaggaacttggaatggggcgaacattgttgcacaccaaatttaaagcattgacagggatgacacccaatgaatttattctaaatcaccggttgaaaatagcatcgctgatgttaaagaacgaaccttatttacaggtagcagaaatatccgatagattaggtttcggttctccacgctatttcagccgttgttttaaaaatcaatataacgttactccgatggaatatcgcaaaggagctaaacaggaaaatcttaaatga

SEQ ID NO: 2852 - DNA, 3027 bp, B.fragilis
agtattatgagaaaaagcaaattacatttgctacccttatcttctaaaagggtacttgtaagtacatcgttaataatgcttttaagcggtagcgcttgggctgtttcttcacaagagacagttgaaaacggagatgcgatcacagcagtcccccaacagcgcagaacggttaaaggtattgtaaaagatgcaaatggagaaccgattatcggagccaacgtcattgtgaaaggtaataaaactattggcgtcatcacaaacctgaacggagaatttagtctcgaagtaccgtccaacgcaacactgcaaatctcttacatcggctatcttaataaagaagtcaaagtaagtggcaaccaggtgtctttcaacatccaattggaagaagacagcaaaacactcgatgaggtagtagtagttggatatggcacacagaaaaaggccaatttaacaggtgccgtatcttccgttgattttgaagaacaaactaaatcacgccccattacgacagtatcttcggcattagccggtctaagtccgggacttcaagccagttcaggctcggcaatgccgggagaagataacacaaccttacgggtacgtggtaacggcacaatgaataatgcctcacctttgattatcatagatggtatggaaggttcattgaatgctattaaccctcaggacatagaaaatatctctattctaaaagatgcagcttcctgtgctatttatggtgcccgtgctgccaatggagtcatcttagtcacaacaaaaagcggtgatcgagacaaaatacaggtaaactatagtggacgcatctctttcaacagcccgacacgcatgatcgaaacgatgagtaactatgcggattatatggaattaatgaacgaatcttgcgaaaatgttggctccggtactctttttgaccaaaagtatatcgatttatggagagagaaatcaaaagatcccaatggagtaaatgaaaacggtgttcctaattacatcgcatacccaaataccaactggctgaaagaattatactcaggaggtatgatacacgaacataacctttcagtctcaggaggatctaacaaaattcgtttcctattgtcagcccgctatcaggataatgaaggtattgtagacaatacagccaacaagacctattctgtacgtgccaatattgaagccaatccaactcaatggttgactttaggtacgcgtacttatgcttcacaaatggatcgtgaagtgggtgactttagcaatgccaatactttcctccgacaatctacagccggtacttatcccgaatggaacggaagtttcggctacccggaatgtccggacgaacgtgcaacagccaataacccactatataaactggcacggaatgatggcttcaaacgctacaaccgtttcaacacgaccctatttagcaaggtcaagttctttaaagatttaagctgggatttcaatttcaattacaaccgttacatctacgaaacccgccaatggggggtacctgcttatcagacacgtttcagtgacggggtaattgtcgatggtatcactcctccttctcaattaagcacaagtttcggttatgagtccaattactcttatacattggaaaacctgttaaactaccatcatacatttgctcagaaacacgatgtatccgcgctgttaggctatcaggaattctataagaattactatactgtagatgccgcaaagaaaggtttgatcgacgaatcactgaaccagtttgatgaagcaaccgaaatgacaagtaccaaaggtgcaacccaggattatgccacacgttctgtatttggacgcgtgaactatgcatataattcccggtatttatttgaggcaaatttccgttatgacggctcctcacgtttccacaaagatcatcgttggggattcttcccttccttatcaggtgcatggcgcatctcagaagaaagcttcatggaaaatacccgtacctggctggataacctgaaagtccgtgcatcctggggtaaattaggtaactctgaaattggtaactacgaatacatgtgggtatacagtaccaccaacgcagtatttggaaatgccttaaattctgcattgtatatgggtgccatcgccaatagcttactgaaatgggaatctaccacctctgtcaactttggtattgatgttaatttattaaagaaccgtctgagcataagtgccgacctgtatcaaaagaaaactgacggtatcttataccgcccgactattccttatgtattcggaacaatgactgccccccgtcagaacctcgccaaagtgagcaataagggagtcgagttatcactgggatggcgtgataacataggaggggtaagctactccattaacggcaacttctcatacaacaaaagcaatatcgatgcctataacggcacttatgaaagaacatgggtagaagatccgaataacaaactgaccggtggtaaatgggaagataatatcggaaaagtgtccagtggtggcacaacacccattgttgaaggccgcatgatgaacgaatactatttacggaacgtttatcatggcaatggctcttactacaatgcggatggcagcgtaaaccctcaaggaggacctaagaccggtatgatccgtacagaaaaagatatggcatgggtgaaagatatgatcgcagccggatatgaatttcaaccggggaaaacggttgctaaaaacaagatctggtatggtgaatacatctatgccgactccaaatataatggagtatatggcgatgataatgactatactttccaaaaaacttccaataagcctaaatacaattttcgttttcaggccttctgccgcatggaaagaattcgaccttctctatggtatggcaggaacttgccggatttaacatattttggggggccaccacaggatacaacgccgaatctactgaaatggggtaggcctttcgcaccaccggttgctggagaatattaa

SEQ ID NO: 2853 - DNA, 936 bp, B.fragilis
ctgaaattcgtacgacctcgccccttccagccccgtggtgaagaccacaacagcaagctcctcttcgtcctcttcgctctttttctttttgtagcatgcaagccaaaagaaaagccctcgcccgccacatcgctgacagatgacgctctgatggataccgtccagcgacgaaccttcaactacttctgggatgctgccgaacctaacagcggactggcacgcgagcgctatcacatggatggcgaatacccggcaggggggccggagattgttacctcaggaggcagcggcttcggcattatggctatcctggccggtattgatcggggatacgtcagccgggaagaaggcttacagcgtatggagaaaatagtcggttttctggagaaagccgaccgctttaaaggtgcatatccgcattggtggaacggagagacaggacatgtacagcctttcggacaaaaggataacggaggcgacctggtagagacagccttcctgatgcaaggtctgctggccgtacaccaatattatgcagaaggctcggcggaagaaaaaaaacttgccggacgtatagacaagttgtggcgggaagtggactggaactggtaccgccatggcggacagaatgtgctttattggcattggagtcccgaatatggctgggaaatgaatttcccggtacatggctacaatgaatgtctgattatgtatatccttgccgctgcttctcctacccatggagtaccggcagcagtctatcatgaaagatgggcacaaaacggagccatcgtttcaccccacaaggtagaaggcatcgaactgcacctccgctatcagggtggagaagcgggtccgttattttgggcacaatactctttcctcggactcgatcccgtgggggctgaaagacgagtattgtccgagctattttaa

SEQ ID NO: 2854 - DNA, 273 bp, B.fragilis
tacatcgatccgtgtactgtccgtacggaagatttttacaacttcgatcttataatcggtatggatgatcggaacatggacgatctgaaggagaaagcaccctctccggcagagtggaaaaagatccaccggatgacggaatactgcacccgcatccctgccgatcacgtgcccgacccttattatggaggtgcggagggctttgaatacgtgctcgacatacttgaggatgcttgtgccggactccttacttctttaactcaggatagctga

SEQ ID NO: 2855 - DNA, 339 bp, B.fragilis
ctgggagatccatgcggcacgttggtgcatgcggatttttatatctttatatttcgactgacccatagcgtgatatacagccttctttgcctttgcctctgcaacatttgccgcttttacacggcggaaggagtgatgctccatccgattaacgacgccggcctggaaagggagttagtgatcgattcaaccggtatattggcttatcaccaggtggaactgaccgatagccgcatgcatgcccatgccgtcctcagaggatatgagctgatacatcgatccgtgtactgtccgtacggaagatttttacaacttcgatcttataatcggtatggatga

SEQ ID NO: 2856 - DNA, 204 bp, B.fragilis
ctccctttccaggccggcgtcgttaatcggatggagcatcactccttccgccgtgtaaaagcggcaaatgttgcagaggcaaaggcaaagaaggctgtatatcacgctatgggtcagtcgaaatataaagatataaaaatccgcatgcaccaacgtgccgcatggatctcccagctacgcgtttctgcatgcggtatcatataa

SEQ ID NO: 2857 - DNA, 192 bp, B.fragilis
tccgtctgtttgacctgcatcgttgcagcaagtcgggtgcaaaaattgattataaaaaaggtatctggttcaatcatacttacattcaacagaaatctgacaaaaaaaatgcccgaactgtttgtaccggtgctgaaagagcatggagtaaaaagttccttttcaaaaagtggtgaccgggggtgggtttga

SEQ ID NO: 2858 - DNA, 1485 bp, B.fragilis
cccgacctgaatggattgaactattctctctccgaatttaaaaactctaagggagatgtacttccggccgatgcattcagcggaggttttgtccgctatgtgatgaccgacgaattgaataaagacggacgtggcggctgtggttatcgtcccgatcactccatttacgactctctgttggttgccgatccgattgaccacttgctgacttcgatgcctatggaagctaaaagcactcaggccatctggatcaattgccaggttccccagactgtgtcaccgggagtctatcgtggtacggtcgaggtgaaagacggagataaccgtctgtctaccttgaagatggatatcaaagtctcttcacgcgtgttgcctgccccgtctcagtgggctttccacctcgatttgtggcagagtccgtttgccgtggcacgttattatcaggttccgctctggagtcaggcacacatagatgccatgcgtcctgtgatgaagatgctggcggatgccggacagaagattattacggcttccatcatgcataaaccttggaacggacagacttatgactactttgaatcgatggtcacctggacaaagaaagtgaacggcacttgggctttcgattatgatgtgttcgacaagtgggtagagatgatgatgagcgtgggcatcgacaagcagatcaattgctactcgatggttccgtggaagttgtctttccaatatttcgatcaggctacaaacagtatgcagtatgtgaaaaccgctccgggcgaaaaagcttacgaagagatgtgggtggctatgttgaagtcattctctaaacatttacgtgagaaaagttggttcgatatttgtaccattgccatggacgaacgcccgatggaggttatgcagaagacattgcaggtgatccgcaaagccgatcctgagtttaaagtatcgctggcgggtaacttccacaaagaactggaagcggatatctacgactattgtattcctatcggagcttcttatccggcggaggtattggcacgtcgtgcacaaaacaatcttcctactacctattatacgtgctgtacggaagctttcccgaatacctttaccttctccgatcctgccgaggctgcctggatgagttattattctgccaaagatcatcttgacggctatctgcgttgggcttataatagttggccgaaagagccactgctcgattcacgttttgaggcctgggccggtggagacacttatctggtttatccgggagcacgctcttccattcgtttcgagaaattgatcgagggtgttcaggctcacgaaaagataacgatccttcgcaaggaatttacggataagaaaaacaagaccggatttaagaagctggaaaaaatgctctccacatttaacttgagagacttccctgaagttccggctgccgaaacagtgaataaggcgaacaaaatactgaattcgttgtag

SEQ ID NO: 2859 - DNA, 1179 bp, B.fragilis
ttttgccacgatttacctatactaacgcaaattatggcagaaagaaaagtaagagttcgttttgctccgagcccaacaggagcattgcatataggtggtgtgcgtaccgctttgtataattatctgtttgcccgccagcatgggggagatttgattttccgtatcgaggatacggattccaaccgtttcgttccgggtgcggaagaatatattctggagtctttcaaatggttaggaatacagtttgatgaaggtgtaagcttcggaggagaatacggaccgtaccgccagtcggaacgtcgtgaaatatacaagaagtatgtacaagtgttacttgataacggaaaggcctacatcgctttcgatactccggaagaactgtatgtcaagcgtgctgaaatggcttatttgcattatgatgcgtctacccgtgtgggaatgcgcaattcgatgacgctcccgaaagaagaagtggaagcgctgatcgctgacggaaaacaatatgtggtacgtttcaaaatagaaccgaacgaggatatccatgtgaacgacttgattcgtggcgaagtggttatcaattcgtctatccttgatgataaagttttatataaatcggccgacgaactgcctacttatcacctggccaatatcgtagatgaccatttaatggaggtgtcacacgtgattcgtggtgaagagtggctgccttccgctccgctgcacgtgctgctgtatcgtgcattcggctgggaagatactatgccggcttttgcccacttgcctttgctgctgaaaccggaaggcaatggaaaactgagtaaacgtgacggtgatcgtttgggattccctgtattccctcttgagtggcatgacccgaagagcggtgagatttcttccggttatcgtgaatcaggttatctgcccgaggctgttatcaatttccttgctctgctgggatggaatccgggtaacgaccaggaagtgatgtctatggacgagctgatccgtctgtttgacctgcatcgttgcagcaagtcgggtgcaaaaattgattataaaaaaggtatctggttcaatcatacttacattcaacagaaatctgacaaaaaaaatgcccgaactgtttgtaccggtgctgaaagagcatggagtaaaaagttccttttcaaaaagtggtga

SEQ ID NO: 2860 - DNA, 2115 bp, B.fragilis
  unsure (1399): Identity of nucleotide sequences at the above locations are unknown.
acctttttttccacactattgtttttttttgtacttttcgcaaaaaattcaagggttatggaacactggaagaagaaaaatagtttctcatacaaagatttgttatataaagcgctgattttcgtcggtactgtggcgttcattgtttacttcctgccccgtgacgggaagtttaactatcagtttgacattaacaaaccatggaagtatggccagttaatggcaactttcgattttccgatctacaaagacgaagcggtagtaaaacgggaacaagacagtcttctggcttctttccagccttactttgaactggacaaagaagtggagaagagtgcccttgccaaactgaaagagaattatcatgcccatctgaaaggcatattgccttcgacggactacatccgatacatcgagagaggcctaaaagccatctatcaatcgggagtcgtatcgacagaagagatgcggaccctcctccacgacagcatcttttctgtcatggtgattgaagataagttggccaaccaacggacgaccgacggcatctataccgtaaagagagcctacgagaatcttatatcgggtgataccgcccattataacagagacatcctgcggcaatgtgcactcaacgactacattacccccaatctcatttacgattctgtgcgtacggagacagcccggaaagaattgctcgacaactactcctgggcaaacggagtagtacaaagcggccagaaaatcattgaccgtggagagatagtcaacaaacaaacctataacatcctggaatctttgcgcaaggaatctatcaagcgaagcgaatccatcggacagaagcgactgatcttgggcggacaaatcttgtttgtcggcatattgatactctgctttatgctttacctggaactgttccgcaaagattattatgaacgcaaaggcagcttatcgttgctcttcgccctgatcgtgttctattgtgtcatcacggcgcttatggtgacaaacaatatattcaatgtgtacatcctgccctatgccatgctcccgattattatccgggtcttcctcgattcgcgtacggcattcctgacacatgtcatcaccatactgatctgctccatcaccctgaggtatcctcacgaatttatcctgacacaaatagccgccggcctggtagctatcttcagcttgagagaactgtcacaacgttcgcagttgttccgcacggcccttctggtcatactgacgtatgcagctatctatttcgcttttgagctgatcagtgaaaacgatctttcgaagctgaacgtaagtatgtatatctacttcattattaacggtgtactattgcttttcgcttatcctctgctattcctgcttgagaagactnttggcttcacgtcgaatgttacgcttgtagaattatcgaacatcaacaatgatctgttgaaaaaaatgtccgaaactgggccgggtaccttccaacactccatgcaagtggccaatctggctgctgaagctgcgatacgtatcggagccaaaaggcagttggtacgtaccggagcgttgtatcatgacatcggcaaaatggaaaatccggctttctttaccgaaaaccagtccggagtgaacccccataagaatttaagttatgaacagagtgcccaggtggttatcagccatgtgacggacggattaaaactggccgacaagcataatctgcctaaagtgatcaaggactttatcagtactcaccacgggcgcggaaagaccaagttcttctacatatcctggaaaaacgaacatccgggcgaagaaccgaacgaagaagttttcacgtatccgggtcccaatccgttctcgaaagagacagccatactgatgatggcagactccgtagaagccgcctcacgcagcttgccggagtataccgaagagagcatcagtaatctggtagataagattatcgattcgcaagtacaagaggggtatttcaaagaatgcccgatcacattcaaagacatcgcgacgataaaagctgtattcaaagaaaagctgaaaacgatttatcacacacgcatcagctatcctgagttaaagaagtaa

SEQ ID NO: 2861 - DNA, 324 bp, B.fragilis
tcgttaattccctctttatttaccgaacattcctgtgcctgcagcgttcctatatcaaaacaatataaatcaagcattatgaattttatctggtacattttgataggtatccttgccggttattttgccggtaagataatgcgtggaggaggattcggccttttggtcaatctcttattagggattataggcggtgtgctgggcggttgggtgtttgcccttctgggactggcagcaaccggaattatcggtagtctgattacttcggttgtcggcgcgatcttatttctctggatagcctccttcttcagccgctcccgatga

SEQ ID NO: 2862 - DNA, 552 bp, B.fragilis
gtaaattccccggagggggagttgaagacgtcaagaaatagacaaccaagaacaaaaacattatttttcgaacaaatgagaaaagcaaaaccaaaaaaacgcgttatccttccggatcccgtgttcaatgaccagaaggtttctaaatttgtaaaccatctgatgtatgatggaaagaagaacacttcttatgaaatcttttacgctgcactggaaacagtaaaagcaaaacttcctaacgaagaaaaaactgctcttgaaatctggaagaaagcgttagataacgtaactcctcaagttgaagtaaaatcacgccgtgtgggtggtgcaactttccaggttcctaccgaaattcgcccggatcgtaaagaatcaatctcaatgaagaacctgattctgttcgctcgcaagagaggtggtaaatctatggctgataaattggctgctgaaatcatggatgcattcaatgaacaaggcggtgctttcaaacgtaaagaagatatgcacagaatggctgaagctaaccgtgcatttgctcatttcagattctaa

SEQ ID NO: 2863 - DNA, 486 bp, B.fragilis
aaaagcaatttaaaatatcggacgaaggaatctgtttgttgcccatgctccttagagcgctctgtcggcttactaaaaaaacagctgttactactggaagaaatctattccaattactcctcgtccacagaaggggaaatcatcacacaatctcaccggacggtgaatgcaaaaaggatcccgatttctttttcgtatgaaggaggcatcacactcgacacggaaacattacactatagcagcccaagtgagaagtttgcaacaacttggaaaaatatattatttcacaccatttctatcagaataattatcggactccataaaagtaatatggaaccgtccgagtggagagaaatcattcaccagaacacatatcagaaatttcaccgcaaacatagaaggcgattgccattatcattccgtgaacggtatacacaatacaaaaacaaggcttccgacgcattcaaccaagacgctccaaagtaa

SEQ ID NO: 2864 - DNA, 444 bp, B.fragilis
ttcaccggtctgaggatgaataatatcgtgtacggatacacgtccgaggatacgttcgtacagagtagcaataacttcgtcattgttcttgaggtcagtacaaaccagtccgcgaagcgtaccgcagtcttcttcattaataatcacatcatgcgaaacgtcaaccagacgacgagtcaagtatcccgcatcggcagtcttcaaagcagtatccgccaaacctttacgggcaccgtgagtagagataaagtactccaacacagaaagtccctctttaaagttagacaagataggattctcgatgatctgaccaccttcagcacctgccttctgcggttttgccatcaaaccacgcataccggagagctgacggatctgctctttagaaccacgggcaccggaatcaagcatcatgtacacagagttgaaaccctgatcatctga

SEQ ID NO: 2865 - DNA, 504 bp, B.fragilis
agaaccgcacaacatcggaactacagccatctgaacagttgcattgcgaagagctctcaatacttcttcttctgtaatagtagaaggatcatcaaagtatttttccatcaacgcatcatcaaattcagctactttttcaagcattttatctctccattcgttggcttcgtcaacgagattagcaggaatttcttctatggtatagtcagcacccattgtttcatcgtgccagtagatagctttcattttgatcagatcaaccaatcctttgaagttttcttctgcaccgataggaataacaaccggacacggatttgcacccaaaacagccttcatctggcgaacaacttcaaagaagtcagcacccgaacggtccattttgttaacgtaagcgatacgcggtacgttatatttgtcagcctgacgccatacagtttccgactgaggttctacaccacctacagcacagtaagcagcaacagcaccatcaaggatacgaagtga

SEQ ID NO: 2866 - DNA, 420 bp, B.fragilis
attaaaaaacaatttaaaatgcctacaattcagcaattagtaagaaaaggacgcgaagtgctggtcgagaaaagtaaatctccggccttggattcttgtcctcaaagacgtggcgtttgcgtgagagtatatactactactccgaaaaagccgaactctgcaatgcgtaaagtagctcgtgtgcgtttgactaaccagaaagaggtgaactcttacattccgggagaaggacacaacttgcaggagcactcaatcgtactggttcgcggtggtcgtgtgaaagaccttccgggtgtacgttaccacatcgttcgcggtactcttgatacagcaggtgtagccggacgtactcagagacgttctaaatacggagctaagcgtccgaaaccgggacaagcagcaccggctaagaagaaataa

SEQ ID NO: 2867 - DNA, 273 bp, B.fragilis
cacttggtaaaagagattatctttgtccaaaagaaaatcttaaggcctatgaaaaatattaattacagtataaaaaagcaatttaaaatatcggacgaaggaatctgtttgttgcccatgctccttagagcgctctgtcggcttactaaaaaaacagctgttactactggaagaaatctattccaattactcctcgtccacagaaggggaaatcatcacacaatctcaccggacggtgaatgcaaaaaggatcccgatttctttttcgtatga

SEQ ID NO: 2868 - DNA, 2130 bp, B.fragilis
aggaaaaagaaaatggcaaagaatgatttacatttgactcgtaatatcggtatcatggctcacatcgatgccggaaagacaacaacttctgaacgtatcctgttctacaccggattgactcacaaaatcggagaggtacacgatggtgctgcaacaatggactggatggagcaagagcaggaacgtggtattactatcacttctgccgctacaactactcgttggaagtatgctggtgatacttataaaatcaacctgattgacactccgggacacgtggactttactgctgaggtagaacgttcacttcgtatccttgatggtgctgttgctgcttactgtgctgtaggtggtgtagaacctcagtcggaaactgtatggcgtcaggctgacaaatataacgtaccgcgtatcgcttacgttaacaaaatggaccgttcgggtgctgacttctttgaagttgttcgccagatgaaggctgttttgggtgcaaatccgtgtccggttgttattcctatcggtgcagaagaaaacttcaaaggattggttgatctgatcaaaatgaaagctatctactggcacgatgaaacaatgggtgctgactataccatagaagaaattcctgctaatctcgttgacgaagccaacgaatggagagataaaatgcttgaaaaagtagctgaatttgatgatgcgttgatggaaaaatactttgatgatccttctactattacagaagaagaagtattgagagctcttcgcaatgcaactgttcagatggctgtagttccgatgttgtgcggttcttcattcaagaataagggcgtacagactttgcttgactatgtttgtgctttcttgccttctccgttggatgctgaaaacgtagttggtacaaaccctgataccggtgccgaagaagatcgtaaaccgagcgaagacgataaaacttcagctttggcatttaagatcgctactgacccgtatgtaggacgtttgactttcttccgtgtatactctggtaagattgaagccggttcttatatctacaactctcgttcaggtaagaaagaacgtgtttctcgtctgttccagatgcactcaaacaaacagaatccggtagaagtgattggtgccggtgatattggtgccggtgtaggtttcaaggatattcacactggtgatacactgtgtgacgaaacagctccgatcgttcttgagtcaatggacttcccggaaccggtaatcggtattgctgtggaaccgaaaactcagaaggatatggacaaactgtctaacggtttggctaaactggctgaagaagacccgacattcacagtgaaaactgacgaacagacaggtcagacagttatttccggtatgggtgagcttcacttggatatcattatcgaccgtctgaaacgtgaattcaaagtagaatgtaaccagggtaaacctcaggttaactacaaagaggctatcactaagacagttaacttgcgtgaggtttataagaaacaatctggtggtcgtggtaagttcgctgatattattgtgaacatcggcccggttgatgaagactttactcaaggtggtctgcagttcgttgatgaagtgaagggtggtaacattcctaaggaattcattccttcagttcagaaaggtttccagactgcaatgaagaatggtgtgctggctggctatccgctggattcattgaaagtgactttggtcgatggttcattccacccgggtgactctgaccagttgtctttcgaaatctgtgctatccaggcatataagaatgcttgtgctaaggcaggtcctgtattgatggagcctatcatgaagctggaagtcgttactccggaagaaaacatgggtgacgttatcggtgacttgaacaaacgccgtggccaggttgaaggtatggagtcaagccgttcaggagcccgtatcgtaaaagcaatggttccgttggcagaaatgttcggttacgtaaccgcgttgcgtactatcacttctggtcgtgccacttcatcaatggtatactctcatcacgctcaggtttctagctctattgctaaagcggtattggaagaagtaaaaggacgtgctgatttactctaa

SEQ ID NO: 2869 - DNA, 318 bp, B.fragilis
ttaaaagaactaatgagtcagaaaattagaattaaactgaaatcttacgaccacaacttggttgacaaatcagctgagaagatcgttagaacagtgaaggctaccggtgctattgttagcggaccgattccccttccgacgcacaagcgtatctttacagtaaaccgctctactttcgttaacaagaaatcaagagagcagtttgaactttcttcattcaagagactgatcgatatctatagctcaacagctaagactgtagatgctctgatgaagttagagttgccgagtggtgtagaagtagaaattaaagtgtag

SEQ ID NO: 2870 - DNA, 264 bp, B.fragilis
tttatgggaagtggaaatgcaaaattcctggtaggacttggaatcggttctgccatcggtgcgctggtttatcatttttcgcgcacggcgaaagctaaaaaactgaaaaatgatgtgttcaatgctcttcatgaaatagaggctgatgccgaactggcagtagtcgaagcaaaagacaaagccgtgaaggctggtgccaaagtagccggaaaagtagctgataaagcgactgaggtgaaagaaaaattgacacctaactcttga

SEQ ID NO: 2871 - DNA, 1149 bp, B.fragilis
atcaattatatcatggaattaaaaaagaaagagaatataggttggattgacctgttaagggtactcgcctgtttctttgttgttttctcgcatagttgcgatgcatttatcggccaatttgatgccaatcgggaatcgttcttaacaggagtgtttttgggaagcctgatgcgcccgtgtgttcccatttttgttatgatgaccggggtattgctattacccgtacaaaccgacatggcagcgttctataagaaaaggataggacgcctgatccctccaatgattttctggtcactggtcttgcctgttttgtatttcatatatctgaactatatcaatcccgatactcaaaatccactgatctcgatgccagatcacagtcttgaagctttatggttcaaactatatacatttatatttaatttcaattttgacacagtcccgttgtggtatctttatatgttgattgggttatatttgataatgcctattatcagcggttggttggaaaaagtttcaaagaaggaactaaaattattcttaggcatttggggaatcagcctgattgctccatatgtaaaaatgttcgctccagcactaggctatcagggcaattacgggaatatgggtctatggggagtatgtgactggaatgactatggtaccttttattatttctccggttttatcggatatcttctgctagcttattatctcacaaaatatccactgaaatggagttggaagaaactattgagtattaccatcccaatgtttctgacaggatacctgatcacatcttatgggtacgtcatcacacaaaattacttcccgggaaattatgcttatctggaaattgtatggtactttgcaggtatcaacgtatttatgatgaccttcccggtttttgtaatcgtacagaagataaaggtaccttcaaaccacaggttatcacacatggcatcactcgcattcggcatttatctgagccattatgtatttgtattcattgcttacgatttactggatacagagttgctgccatatactgtacgaattatttgtatggcctgtattgtattcctgacatgttacgccatcgtttggctaatgtcaaaaagcaaattgaccaatcgcttcatccggtaa

SEQ ID NO: 2872 - DNA, 4314 bp, B.fragilis
ttaattagcatattatataattataaaagtatggcttttagaaaagaaaataagatcaagagcaatttctcgaaaatctctatcggtttggcttctccggaagaaatccttgagaattcgagtggtgaagtattaaagcctgaaaccatcaactatcgtacatacaaacctgagcgtgacggtttgttctgcgagcgtatcttcggcccgatcaaagactacgaatgccattgcggtaaatataaacgcatccgttataaaggtattgtctgtgaccgttgtggtgtagaagttactgaaaagaaagtacgtcgcgaacgtatgggacatatccagcttgtcgtgcctgtagctcacatctggtatttccgttcgctgcctaataagatcggttatttgttgggactccccaccaagaaactcgattctatcatttactacgaacgctatgttgtcattcagccgggtgtgaaagctgaagacggtatcgccgaatttgatctgttgtcagaagaagaatacttggatattcttgatactcttcctaaagataatcagtatctggaagatacagaccccaacaagtttattgctaaaatgggagccgaagcgatctatgatctgcttgcccgtctcgatcttgatgcattatcctatgagttgcgtcaccgtgccggaaatgatgcttcgcaacagcgtaagaatgaggctttgaagcgtcttcaggtggtagaatcattccgtgcatcacgtggacggaataaacctgaatggatgattgtacgtattgtaccggtaattccgcccgaacttcgtccgttggttccgttggatggagggcgtttcgctacatccgatttgaacgatctttatcgtcgtgtgattatccgtaacaatcgtttgaaacgattgattgagattaaggctcccgaggtgattctccgtaacgagaaacgtatgcttcaggaatctgtcgattcactgtttgataattcacgtaaatccagtgcagttaagactgatgccaaccgcccgttgaagtctttgtctgacagcctgaaaggtaagcaaggacgtttccgtcaaaacttgctgggtaaacgcgttgactattcggcccgttcggtaattgttgttggcccggagttgagaatgcatgaatgtggtattcctaaactgatggctgccgaactgtacaagccgttcattatccgtaagttgatcgagcgaggtatcgtaaagactgtgaagtctgctaagaagatcgtggaccgtaaggagccggtgatctgggatattcttgaacacgtaatgaaaggtcatccagtattgttgaaccgtgctccgacacttcaccgtttgggtattcaggctttccagcctaagatgatcgaaggtaaagctatccaattgcatccgttggcatgtacagcgttcaatgccgactttgatggtgaccagatggctgttcacttgcctttgagcaatgaggcagtacttgaagcacaaatgttgatgctggcttctcacaatattctgaatcctgcaaatggtgctcctattaccgttccttcacaggatatggtgcttggtttgtactatatcaccaaactccgtaaaggcgccaaaggtgagggactcacattctatggacccgaagaagcgttgatagcttacaatgaaggcaaagtagatattcacgctccggtgaaggttatcgtaaaagaccttgacgaaaatggaaatatcgttgatgtaatgcgtgagacttcagtaggtcgtgtgattgtgaacgaaattgttccgcctgaagtcggatacatcaatactattatttcaaagaaatcattgcgtgacattattagtgctgtaatcaaagcttgtggtgttgctcggactgctgacttccttgatggaattaaaaatttaggctacaagatggcctttcagggtgggctgtcattcaacttgggtgatatcattatcccgaaagagaaagagacactcgttcagagaggttatgaagaggtagagcaggtgatcagtaactataatatgggtttcatcaccaataatgaacgttacaaccaggtaattgatatctggacacatgtaaactctgaattgtctaatatcttgatgaagactatttcttcagatgatcagggtttcaactctgtgtacatgatgcttgattccggtgcccgtggttctaaagagcagatccgtcagctctccggtatgcgtggtttgatggcaaaaccgcagaaggcaggtgctgaaggtggtcagatcatcgagaatcctatcttgtctaactttaaagagggactttctgtgttggagtactttatctctactcacggtgcccgtaaaggtttggcggatactgctttgaagactgccgatgcgggatacttgactcgtcgtctggttgacgtttcgcatgatgtgattattaatgaagaagactgcggtacgcttcgcggactggtttgtactgacctcaagaacaatgacgaagttattgctactctgtacgaacgtatcctcggacgtgtatccgtacacgatattattcatcctcagaccggtgaattactggttgccggtggtgaagaaattacagaagatatcgccaagaagattcaggaatctccgattgaaagcgttgagattcgttcggtattgacttgcgaatcgaagaagggtgtttgtgcgaagtgctacggtcgtaacctggctacgaaccatatggttcagaaaggtgaggctgtcggtgtaatcgctgcccagtctatcggtgaaccgggtacacagttgacattgcgtacattccatgctggtggtacggctgccaacattgcggccaatgcaagtattgttgctaaaaataatgcccgtttggaatttgaagaactccgtacggtagatattgtggacgaaactggtgaggctgccaaagtggtagtaggtcgtttggctgaggttcgtttcattgatgtcaatacaggcattgtactttctacccataacgttccttacggttctacactttatgtagccgatggtgaagtggtagaaaaaggtaaactgattgcgaaatgggatccattcaacgctgttatcataaccgaagctaccggtaagattgagtttgagggtgtcattgaaaatgttacttataagattgaatcggatgaagcgaccggacttcgagaaattattattattgagtctaaagataagactaaagtaccttcggctcacatcctgaccgaagacggtgatcttatccgtacatataatttacctgtaggtggacacgtagtgatcgaaaacggccaaaaggtgaaagcaggtgaggtaatcgttaagattccgcgtgctgtgggtaaggctggtgatattaccggtggtcttccccgtgttactgagttgtttgaagcacgtaacccgtcgaatcctgccgtcgtatccgaaatcgatggagaggttactatggggaaagtgaaacgcggtaatcgcgaaatcatcgttacatctaagaccggtgaagtgaagaaataccttgttccgctgtctaagcagattctggtacaggagaatgactacgttcgtgcaggtactccattgtccgatggtgctacgactccggctgatattttggctattaaaggtcctacggctgtacaggaatacatcgtgaatgaagttcaggacgtatatcgtttacagggtgtgaagatcaatgataagcattttgagatcattgttcgccagatgatgcgtaaagtgactattgacgaaccgggcgatacacgcttccttgaacagcaggtagtggacaaactcgagttcatggaagagaacgaccgcatttggggtaagaaagtggttgtagatgccggagattctgaaaacctgaaagccggtcagattgtcacagcccgcaagttgcgtgacgaaaacagtatgctgaaacgccgtgaccttaaaccggttgaggtgcgtgatgctgttgctgcaacttctacccagattcttcagggtattactcgtgccgcattgcaaacttcaagcttcatgtctgccgcttctttccaggagacaactaaggtactgaatgaggctgctatcaatggtaagatagataagttggaaggtatgaaggagaatgtaatttgcggtcatctgattccggccggtacaggtcttcgcgagtttgacaagatcattgtaggttctaaagaagaatacgatcgtattctggctaataagaagacagtgcttgactataatgaagtagaataa

SEQ ID NO: 2873 - DNA, 333 bp, B.fragilis
aatcaatcaataataaaagatatggaaaatcaaaatcccgataatcaattacaaatagaattaaaagaggaagtggctcaaggaacctatgcgaatctggctatcattacacattcaagttcggagtttgtactcgactttgtgcgtgtattgcccgggttgccaaaagcaggggtacagtcgcgtgtgattcttgctcccgaacatgccaaacgtttgcaaagggcgcttgaagaaaatatagctaaatatgaacgtgcattcggtcctatccgattgcaggaagacggagtggatactcctcctatattagatataaaaggagaagcctga

SEQ ID NO: 2874 - DNA, 378 bp, B.fragilis
tatttaaaaattagtgaaatgccaggattattaggaaaaaaaatcggaatgacatccgttttcagtgccgatggtaagaatgtaccatgcactgttatcgaagcaggtccttgtgttgttactcaggtaaagaccgtagagaaagatggctatgcagccgttcagttgggtttccaggacaaaaaggaaaaacatacaactaaaccgttgatgggtcacttcaaaaaggctggagtaacaccgaagagacacttggccgagttcaaggaatttgaaaacgagttaaatctgggtgatactgttacagtagaactgttcgacggcgcagactatgtagacgttgttggacttctaaaggtaaaggctttcagggtgtag

SEQ ID NO: 2875 - DNA, 195 bp, B.fragilis
ctccataccttcaacctggccacggcgtttgttcaagtcaccgataacgtcacccatgttttcttccggagtaacgacttccagcttcatgataggctccatcaatacaggacctgccttagcacaagcattcttatatgcctggatagcacagatttcgaaagacaactggtcagagtcacccgggtggaatga

SEQ ID NO: 2876 - DNA, 831 bp, B.fragilis
ttcgtgagcttgatcctgaactttatcaagaagtacaaagaacttgatgctgaactgaagcgtaaaaagttcgctatcacaattggtgatgaactgcctgcaggtatcattcagatggcgaaagtatatattgctaaaaaacgtaagattggtgtaggtgataagatggccggacgtcacggtaataaaggtattgtgtcacgtgttgttcgtcaagaagacatgccgttccttgaagatggaactccggtagacattgtattgaacccgttgggtgtgccttctcgtatgaatatcggtcagatttttgaggctgttctcggacgtgccggaaagaatttgggtgtgaagttcgctacgccgatttttgacggtgcaactttggatgacttgaacgagtggacagacaaagctggtctaccacgctattgcaaaacttatctttgtgatggtggtacaggcgaacgctttgaccaaccagcaaccgtaggtgttacctatatgttgaaactcggtcacatggttgaagacaagatgcacgcacgttctatcggaccatactcattgattactcagcaacctcttggtggtaaagctcagtttggtggtcagcgtttcggagagatggaggtttgggcactcgaaggtttcggtgcatcgcatattctccaggagattctgacaatcaagtcggacgacgttgttggacgttctaaggcttacgaagccattgtaaagggcgaacccatgccacagccgggtattccggaatctctgaacgtgttgttgcacgaattaagaggattgggcctgagcatcaatttggaataa

SEQ ID NO: 2877 - DNA, 429 bp, B.fragilis
aggaatgaattccttaggaatgttaccacccttcacttcatcaacgaactgcagaccaccttgagtaaagtcttcatcaaccgggccgatgttcacaataatatcagcgaacttaccacgaccaccagattgtttcttataaacctcacgcaagttaactgtcttagtgatagcctctttgtagttaacctgaggtttaccctggttacattctactttgaattcacgtttcagacggtcgataatgatatccaagtgaagctcacccataccggaaataactgtctgacctgtctgttcgtcagttttcactgtgaatgtcgggtcttcttcagccagtttagccaaaccgttagacagtttgtccatatccttctgagttttcggttccacagcaataccgattaccggttccgggaagtccattga

SEQ ID NO: 2878 - DNA, 288 bp, B.fragilis
atcaggtcgtctatcactaaagaagttttagggtcgagtccggagttcggttcatcgcaaaagagatactgcgggttcagtgcaatggcccgtgcaatggctacacgcttctgcatacctccactgatttcgccgggaaatttatctttagcttccgtgaggttgacacggtcgaggcagaacatagcccgtttggtttgttcgcgcaaggtgtcggtgccgaacatgttgagcggaaacataacattatccaaaacagacatggagtcgaacaacgccgcgctttga

SEQ ID NO: 2879 - DNA, 399 bp, B.fragilis
caaagattgttaaaatgcttaaatttgtttggtatggcaaagataaaaacagaaaaacagtacaaggcagcttgttcaagaattgaagaactgcttaaggtggttagtaatgatactccaaccgatgataaaaacttcctcgaattggacttgatttccgatttggtcgcagactatgaagaggagcatttccctatagaagctccttctttggtggatgttattaagcttcgtatgtatgaaatgggacttacccaaacaaaactgtcagaattgttaaatgtaagtccttcccggattagcgaatacctttcaggaaagtgtgaaccaaccttgaaagttgctcgtgaaataagccggaagctaaatattgatgctaatatagtgttgggggtataa

SEQ ID NO: 2880 - DNA, 1488 bp, B.fragilis
acgcatagccctatgtcatttattgctgataagattgtaatggacggattgacttatgatgatgtattgttgatccccgcttattctgaagttttaccgcgcactgtcgatctctcgacaaagttttcaagaaacattgagttaaagattccgtttgtaactgctgccatggatacggttaccgaagctaagatggccattgccattgcgcgtgagggaggaatcggtgtgattcataagaatatgtccattaaagaacaggctaagcaagtggctaccgtgaaacgtgccgagaacggtatgatttatgatcctgtcactattaagcaaggatctaccgtacgcgatgccctcgcattgatggccgaatataaaatcggtggtattccggtagtggatgacaatagatatttagtcggtattgtaacaaatcgtgaccttcgtttcgagcgtaacatggataagcgtatcgacgaggtgatgacaaaagaaaatctggtgactaccaatcagtcaaccgacctggaagcggcttcacagattttgcagtaccataagattgagaaattaccggtagtcgacaaagaaggaaagttgatcggactggtgacttacaaagatattacaaaggccaaggataaacccatggcttgcaaagactcgaaaggccgcctgcgtgttgctgccggtgtgggtgtgacggctgatacattcgaccgtatgcaggcattggtagatgccggtgccgatgccatcgtgatcgatacggcccacggacattcaaagggagtgatcgacacgctgcgcgaagctaaaaagcgctatcccgacattgatatcgtagttggtaatattgctacgggggatgcagccaaagctttggtggaagccggagccgacggtgtgaaggtaggtatcggtccgggttccatttgtacgacacgtgttgtcgccggagtgggcgtacctcagctctcggctgtttatgatgttgcgaaagctttgaaaggaacgggcattcctttgatcgccgatggcggactccgttattcgggcgatgtggtgaaagccctggctgccggaggatatagcgttatgattggttcattggttgccggaacagaagaaagtccgggtgaaacgattattttcaatggccgtaagtttaagtcataccgtggtatgggctcgctcgaagcaatggaaaatggttcaaaagaccgttatttccagagtggcgagatggacgtaaagaaactggttcctgaaggaattgccgcccgcgtgccctataaaggaactttgtatgaagtgatttaccaattgaccggtggtctgcgtgccggtatgggatattgtggtgctcccgacatcgagaaactgcatgatgccaagtttacccgcatcaccaatgccggggttatggagagccatccgcacgatgtgacgattacgagtgagtcgcctaattacagccgtccggagtaa

SEQ ID NO: 2881 - DNA, 2367 bp, B.fragilis
aaccgggctttaataaaaaaagatatggatagacgggactattatgtggagtattatgaggtgctggatagggtgctgtctgactacgtgaatcagttgcgggaaaagagggaacattggctgaaaatggggaggcatgatgtgggcgtgcctttgatcaatttactattctggcagttcacatggcatagagaggagtacgaccggttacgtaaagaaggaaagagctgtggggaagcattgggtagcgtaaaggagatactggcagataagcaggtggaagaatgggagcgacaggaagaggaatacaaaatctacgaccatgaatggtatgaagcactggcaccttatggcgggcagttggtgatctatatttataatgcccgtcaattggtttatctgactccgttgattgaacgtctggaagaaccggtgttgctcttgtcggaatatgagattccggatgaaacggagttgccggactttgtaacggccattactcttgaatttaccaaaacagctccattggttaatccattcctgaaagagtggttccctttgatttttcaatatgcgaatacatttgatatattgatgaggatcttgcaacctaaaggattgatttttctggaaggctgccattaccagcagttattgcttgccaccatagggcgtgattatggagtaccgaccttgtgtattcagcagggatggccgtcattgatgcacacagctttcaggaggatgccttaccggtactatctgatgtggggggaaggtttccggactttgtgggagaagcataatccgttgccggactttgtcccgacgggttatatgtatcaggtggaaccacgtaatgagacgaaaaaggagtgtgttacttttttcttgcagggacctttttttctgagtgacaaaaggtatcttcaagagatgatccgtctgatagggacggttgccgtggaatttcccgcccggcggtttctggtgcgtgaacatcccgagttcaggataggtgaggaggtacgcatggaatgggagcagattcccaatatagaaatggtaacggatggaaagctggcagaggtatttgcccgcacacgggtaggggtggcacactattcttcttctttgatggagggagtggcacacggtgctgtcccgttggtgtacgatccgactgagggatcgcggtattctccggatgtggaagccgaggggctggggatgatagcgaaaacgaaagaggagttgaccggcggtttgtcccggattttggggaattatgaagattttaaacagaggatagagaaggaacaacctctgtggcttcaggcaacaggagaagaaactctccggaatatggtagggtttattaaagaaaaaatgcctcctgttactttgaaggagatttatgtggttgatacggatacgttgacacgcgaacggcccgtcggggtgtcgggggtattacgctgtaagaattgtgaggattttttggagatgtgcattgattcgtgtatcgatggattggatgagttgatagctgtctatcatgattgtacggatcgtacgccggagattctcaggcagaaggcagcacaatatccggataaaatcagggtctttgagtatcggccgtctgtatatccgatcgatctggatgaggaggagttggagaaggcaaagctgttgccgcccgactctatccatacgttggcaggctattgcaactatgcattgtcgaaagcaagctatcggtacgcagtgaagatcgatgccgatcaggtttattttacggatcggctgaaacatatctgtgatgcttaccgttctgataaaaaagtgcggttcaacgtggcagaatgtatctcttacaacctgtatcgggcttatgtggactctttcaaccgtatagagatgcgaccgttcaggtggctggaacgaattgcgttgtggacacatgcgtcgtatgcttcttatctggagaagatgatcatccggtataaagtgcctgtctcgatgtcgggcattaacttgttccggaaagaccgggagtggatggtagggttggggcaggaacatccggagcctgatagcaaagagatactccctccgttcaatggcgtacgtgatactttcttttttgaggtgtctgcggaccggatattcaggtatgtgacggaaacgaagccggatggccgtcatcggggggtggaggtgatgcgttgtccgaatgaaatattggatgtcggcttttgttggtttcatttgcgtgccctgatgaaggagcatgaagagggctatcggcagtcttaccggaaacatccggaggtcttcacgacggtgcaagagatatcttga

SEQ ID NO: 2882 - DNA, 183 bp, B.fragilis; identical to SEQ ID NO: 2683

SEQ ID NO: 2883 - DNA, 207 bp, B.fragilis
acttatgctacaaaactacaggttccgaaaatgaaaagcaaatttgaagatggacaatatctcaatatatatcacataaaatcagcaacttacatcaactcctttttatttgatggacaaactggtttgactacccgtccgacagaagccatatcaggaactccaagttcaattttaagtctctgtttacgtttactcaaagcttga

SEQ ID NO: 2884 - DNA, 264 bp, B.fragilis
aattttgtgaccatgaaaaaacttagtaagattaaattgaccaatctttctcaggaagatttggcggatcgtgaaatgaatgcacttcgtggaggacataattgtggatgtgcatgttcgtctacttctaaggcaacgaatcattcatcgaatgaagatcgtgatttacattctccagaaggtaatgtcatttgcacttgggtaggaggagcagggtctgatatctcagtatacggtggaagcaaagctcccggtatgccttaa

SEQ ID NO: 2885 - DNA, 270 bp, B.fragilis
aattttgtgaccatgaaaaaacttagtaagattaaattgaccaatctttctcaggaagatttggcggatcgtgaaatgaatgcgcttcgcggggggcatacttgtggatgtgcttgtattaaaggagcagaatttaaagctactaactatagtgctaatgtagctgatgataagtattctcctgaaggtaatattatttgtaactgggtagggggcagtggttctgatatggccgtttatggcggaagtaaagttcctggcatgccttag

SEQ ID NO: 2886 - DNA, 780 bp, B.fragilis
ccgcaaaggacagactcctttggtagaggtcgatggaaactttttgtacaaagaagaccttcagggccggtgctccccgccggtttgtcaaaagatgacagtcttcttttcgccgagcactacgtccgtagctgggtagaagatgttttgttgttcaatcaggcgcaaagcaatattcccgataacggagaaatcgataagttggtcgagaattaccggaaagcattgatcatgcatacttatcagcaagaactaatcagccagaaattgtcgggcgagatccccgaacaagaaatagcagactattacgaaaagaacaaagaactgtttaagctggaccgtccattgatgaaaggtctgtttatcaaagttcctctgaccgctccccaactgggcaacgtgcgtaagtggtacaaaacggagactcaggatgccgttgagcatttggaaaagtatagtttgcaaaacgcagtgaagtatgagtatttttatgataaatgggtgcgggtggccgatgtgctggatatgatcccgttgaaagcggaatcccctgaagcctatatggataaaaaccggcatattgaactgaaagatacggcattttactattttctgaatatcagtgatttccgtgtggcgggcgaacaggaaccttatgaatttgctcagccgaaagtcaaggatatgcttgtcaacatcaagcgggttgactttatgaaacaagtgaaagacgatctgtacgagcgtgcagtaaaaagaaagaagattataaattattaa

SEQ ID NO: 2887 - DNA, 309 bp, B.fragilis
tatgaaatagctatgggaatgttcaatgtacgaaagccgcgtggatttaatcatcaatatatctatgtggacgagaggaaagaaaaactggcaaaaatggaagaagatgccaagcgtgatctgggaatattgcccgagaaagaattttctcccgaagatattcgcgggaagtttatcgaaggtaccacacacctgaagcgtcgtaaagagagcggacgtaaacccgcccatttgggagtaattctggctatcattgccctgcttatttttctgtggcattatttgcagaccggcagttggtctttctaa

SEQ ID NO: 2888 - DNA, 588 bp, B.fragilis
aaaagagaagctttgggaaagtttgataaatacaaaattgatttgaaaggaatgcaagcagactcatgcaaatatgagtttctacttgacaatctttttttcgctcatattgatggccctgaagttcagaaaggtaaagtcaatgtagagttgaccgttaaaaagacctctcgtgcttttgagttgagtttccggactgaaggtatcgtatgggtaccatgtgaccgttgtctggatgaaatggaacaaccggttacttcttctgataagttgatggtaaaatttggccatgaatatgctgaggagggagataacctgattgtgatccctgaagaagaaggggagatcaatgtagcttggtttatgtatgagtttatagctttggctattccgatgaagcatgtacatgccccgggcaagtgtaataaagctgtgaccagtaagctgaataaacacctgagaacaagtggtgatgacgatgctgaagaatcttttggcgctggtgaggatatcgttgtggaagatgaagcggaggaacagattgatccgcgctggaatgaattaaaaaaaatattagataataattaa

SEQ ID NO: 2889 - DNA, 1296 bp, B.fragilis; identical to SEQ ID NO: 845

SEQ ID NO: 2890 - DNA, 192 bp, B.fragilis
aagaaaatggcacatcctaagagaagacaatcaaaaacaagaactgcaaagagaagaactcatgataaagcagtagctcctacattggctatttgcccgaactgcggtgaatggcatgtttaccatacagtatgcggcgcttgcggatactatagaggtaagctggcaattgaaaaagaagctgctgtataa

SEQ ID NO: 2891 - DNA, 2187 bp, B.fragilis
attaagatggcagggaagattaatttgacagaccaactgaaaaagtatttcggatttgataatttcaaggggaaccaggagccgatcatccagaatttgcttgatggtaatgatacctttgtgctgatgcctaccggcggtggaaaatctctgtgctatcagttgccttctttattaatggaaggtacggccattgttatttctccgttgattgccctgatgaagaatcaggtcgatgcgatgcgcaacttcagtgaagaagatggtgtggctcatttcattaactcttctttgaataagggtgcgattgatcaggtgcggtctgacattcttgccggaaaaacaaaattgctatacgttgctcccgaatcgttgacgaaggaagaaaacgtagaatttctgcggtcagtaaagatctcgttctatgctgtcgacgaagcgcattgtatttccgaatggggacacgacttccgcccggaatatcgcaggatacgtccgattattaatgaaataggaaaagcgcctcttattgcgttgaccgcaacggccacgccgaaggtgcagcacgatattcagaagaacttgggaatggtggatgcacacgtcttcaagtcttcgttcaaccgtccgaatctgtattacgaggtacgtcctaaaactcagaatgtagataaggacatcataaagttcatcaagaacaatccggaaaagtcgggcatcatttattgcctgagccggaagaaggtagaagagcttgctgagatacttcaagccaacgggattaacgcccgtgcttaccatgcaggtatggattcggcaacgcgaacgcagaatcaggatgatttcctgatggaaaagatcgacgtaattgtagctactatcgcatttggaatggggattgataaacccgatgtgcgatacgtcatccactatgatataccaaagagcctggaagggtattaccaggaaacgggccgcgccggcagagacggcggagaaggccagtgcattaccttttatacaaacaaagacttgcagaaactcgagaagtttatgcaaggcaaacctgtggcagaacaagaaattggcaagcagcttctgttggaaactgctgcgtatgctgaatcttccgtttgtcgccgtaagacattactacattacttcggcgaagagtacacggaagaaaattgtggaaattgtgacaactgtttaaaccctaaaaaacaagtggaggctcaagaattattgtgtgctgtgatcgaaacaatcatagcggtaaaagaaaactttaaggcagattatattattgatgtcctgcagggacgcgaaacgtccgaagttcaggcgcacttacatgaagatctggaagtgttcggatcaggaatgggagaagaagacaaaacctggaatgccgtgatccgtcaggcactgatagccggttatctgagcaaggatgtcgaaaattacggattactgaaagtgaccgatgccggaaagaaattccttaaacatcctaagtcgttcaagataaccgaagacaatgactttgaggaagtagaagaagaaacaccggcaagaggcggaggttcctgtgcggtcgatccggttctctattccatgctgaaggatctccggaagaaactatcgaaaaaactggaagtgcctccttatgtgattttccaggatccgtctctcgaagcgatggctaccatctatccggtgacgctggaggagcttcagaacattcccggtgtaggcgccggaaaagccaaacgttacggcgaagagttctgcaagctgataaagaggcattgtgaagaaaacgagattgaacgtccggaagatttgcgggtacgcacggtggccaataaatcgaagatgaaagtggccatcattcaagccatcgaccgtaaagtagccctggatgatattgcgctttccaagggtattgagttcagcgaattgctcgatgaagtggaggcaatcgtttattcgggtactaagttgaatattgattacttcctggatgagattatggacgaagaccacatgctcgacatctatgattatttcaaggagtcgacaacagataagattgacgatgcgctcgacgaactcggtgacgaatttaccgaagaagaagttcgtctggttcgtatcaagtttatctccgaaatggctaattaa

SEQ ID NO: 2892 - DNA, 1197 bp, B.fragilis
aacctattttatatgaaggcaagacactttttctacccgtttctatctcttttttcggttgcaatgtttgcttcctgctcttcatctgtacccaagtctccggaacagcgagtggagtataatgaagatttcttttctattgccgtatcggatgtgaaagataccattaaggtgtatatcgaagatttggtagactctttggttattctccccttggataatgataaaaaggcactgtgtgctccattaacagtgtatataaccgaacaacatattggcctgaccccctctgaaagaggaggtacctataagctgttttcccgagacgggagcttcttatgtaatgtaggaggctttggacaggggccgggcgaatacactgctttgctgtatcaccaaattgacgaaaaggcaaagcgcatttatctgaatacttttgaagcttcccaaattatggtttatgattttaagggtcaatatttgcatgatattcctttagcttctattttgcataaaggcagttttaaagtagatagtgagcataagatgatttactgctttgatgttcctgccggacaaagcccatttgtttggaaacaggattttgagggaaatattaaggggaaaatacattcttatccatacacgctaaagcccgattttgggaatgatgttcagaccatgtttaatacagaagctttttatacaagtgtttctgcaggatttgagcagttggaaggtatgaatgataccttgtatcattattatccggaaaccgacgtattgacaccggtcttttatgccgattttggtaaagaagggcatcaacatcgttatctgaacaccccgttgaactattatgttggcttatcgtcgggctacacaaatgatagggggccctttacaaccttagattatacagtaatcaaagtcgataagaaaacccacgaagcgtcttatataaaacttttttccagaggctatggtgggctttcattagatttatattatgcccagtttagattcggatacttttatctctggatggagcctattgaattgaaagagcagctatcgcagatattgaaactttccgaaatggatactgcgatgaggggtaaagttgaaaagctttataatggattgtcggaaaatggcaatagtgttcttctttttggtaggttaaaacaaaaatga

SEQ ID NO: 2893 - DNA, 1275 bp, B.fragilis
cctataaattatcgtcctatgaagttagattatatcgcattgtttttggtattgttttttcttgctgcttgtggcagcaagtcttcttctccggatatgatggatgataacgctctaccgactgaggaaacctttaaagaaattgatcttgctaacaacctggaagattgcggcaagcctttattgctgagtgacatcgtgaaagatgtggagtatgtgaagctggaaacgcaggataatatattagtcggtgatataaagcagctaaagcggacggagcaatatatctttatttattcacgtcgacagaatcacattatgatgtttgataagtccgggaagtttatccgtaggataggacgtgtagggcaaggtcccggagagatgtccaatatacagtcttttacgaccaatgataatagagttttcatttatcctttgagccgtagtagcagttttatgatttatgatacacaaaacaatgactttataaaggaggtttctttgaagtatcctgtgtcggttaatgataagattgatataatggataattgtctgatctattatcccggtatcatttattttccgggtaataaagaaggcttcatcagcgcttgtgtcattaatacagatgggcaaatagtaagagaacaagttccagaaatgcctgttgaggcaaaaaagattgatatggcaatcgatccggacatttcatggaattatcaagggaaaagtaatatttactcacttataaatgatactatctatgggattacctgtgattctatttttcctcgttatcatttgtctttgggaaagtacaagctacctcccgaaaaatataacttttgcaataatttggatttaggagattttattctgattaaaagtgtctgcgaaacgaaagactatcttctctttagttattggtttaattgtaaaatgtggttcagccgttatgataaaaataaagataaaatagattcttgggagcaggtgccttttgaggttcgctattggatgatacgcgatgctcccggtgtcacaaatgatattgatggtacacaatcgtttagaggaaataataatatgaaagatgtgggtgaaaactgtttttgtttcgtcatcacaccggataatttggatcaggtaaggcgcaacgtcgctgaagctaaggttaagttccctgagaagcaggccgaactgctgaagcttcttgatgaaatgggagaggatgataatccgattattgctttctataaattgaaagactga

SEQ ID NO: 2894 - DNA, 939 bp, B.fragilis
aacgcatcctatttcgattcgatgcgtttttttgtctcaatcaataaatggaagacgatgcataaagctggttttgtaaatatagtaggaaatcccaatgtgggtaaatcgacactgatgaatgtgttggtaggcgaacgtatctcgattgctacgtttaaggcgcagactactcgtcaccggattatgggtatctataatacggatgatatgcagattgttttttcggatactccgggggtattgaaacctaattataagttacaggaatctatgctgaacttctctacttcagcattggctgatgcagatgtcttgctttatgtgacggacgtgattgaaactcctgataagaataacgaatttattcagaaagtacgtcagcagtcggcacctattttgttgttgattaataaaatagacctgactgatcaggaaaagcttgtgaaactggtagaagagtggaaagagttgcttccgcaagcagaaattattccgatttcggcagctacgaagtttaatgtagactatgtgatgaagcggattaaagacctcttgcctgattcccctccttattttgataaggatcaatggactgataagccggctcgtttttttgtcaacgagataatccgtgaaaagatcttgttgtattatgataaggagattccctattcggtagaagtagtagtggaggaatttaaggaagatgcaaagaagatacatattcatgctgtgatttatgtagaacgtgattctcagaaaggcattattattggaaaacagggtaaggccctgaagaaggtggctactgaggcgcgacgcgatctggaacgtttttttggaaaaactgttttcctggaaacgtatgtgaaagtagacaaagattggcgcagttcagataaggagttgcggaattttggctatcagttagattaa

SEQ ID NO: 2895 - DNA, 1272 bp, B.fragilis
tatagggaatatagaagaagaagtatcctggaaatatggattaaagatgatagctttatgaaacatatttatttaatagggaatggaagccgtgccgctcagtatggagttgggacttatattcggcaaatgcttgaatttttcaggcagacttcttctgtgagattaactattgttgaactgaactcggaggtaaaagaggtgacggaagagtgtgataattcgggaaaagtgtgctatttgaaaattcctgctcaaaagagtgagggaagaaaaggagatgttgcgcattgttatcggaatatagcttatttgcttgcgctgcatttcttgaaggatgagcaaaacgtgttgcatctgaattatttgcatcatgcccctttagcagactggctgaagaagataggagtggaattctatttacttgtgactattcattatttggattggtgtttcatgttaaagggaaatactcgattgtttcgttcgattattcataaggaagagcagtcgaatgagtggggcaagaaaatacggaatagttatgagcgagacaaacgattgtttcagcattcggataaagtgatatgtttgagccaatatactcagaatttgctgcgtgaagactatggagtggaaaaagaaaaactggttgtggtttataacggcttaaaggatgaagcgattaaactgagtaaggaggagcgtttggaaaagagatctgcattaggatttagggagacggataagattattctttttgtagggcgcttagatcggattaaaggagttcaatatttgattgaagcttttcggcaagtcatcagaaagaatccgaatagtcggttagtgattgttggggatggtgattatgataaatatctgaaacaatgtgctggtatatggtcttatgtcgttcttacagggaaggtagagaaagaggtgctgtatactttttatcagatagctgatgttggagttttgccttcttttcatgagcaatgtagctatgtagccattgaaatgctaatgcatggactgcctttaataggaacaggctctaccggtttaaaagaaatggtagaagggatgcattgtttaccattgaaagaagaagatgatagtgtagatctacctattgatttattggtgcagtggttaatcgaagatcaagagcatctacggtcggagaagtataggaggcgatttgaggaacgatatactttacggaagatgtcagagaatatgttttctatctatttgaatttgtaa

SEQ ID NO: 2896 - DNA, 1488 bp, B.fragilis
atacatagatatatgaaaaatgatattgcattttctactccgtttcatgcttatgtttattcgtttcggcataaggaatatttgcctcttcatccgatcttgaaaaggatttatacggttgtggaagaaaagaaaaatattgaggaagatgaagaactgaaatgttatcctaaagagcagatacttcactatttacaaaaatataaatttctgaaggaaaacgaatttattggtgaaaaagtgaagacggagtttggagagatcactgaaactatggtccgaagagaagttgagaacctgacagttcttactttcgaggttacagaacgttgtaatcttcgttgccgctattgtgcttttggtgatttatattatggatacgatgagcggaaaggtgagaatttagattttccaaaggcaaaacaaatacttgattttttatttggcatttgggagaaaatacctcacttatcagttgctcgcactcttactgttggtttttatggtggtgaaccacttatgaatatggatctgataaagcagattgtttcttatattgacgaacataaacctgaaggtatgaaatttgcatataatatgacaaccaatgccatgttattgcgtgtatatcaagattttttggttgagcataagtttcatcttttggttagtttggatggtactgaagctgatgactgccatcgggtaacagtgaatggtaaaagttcgtttgcacaagttttcgagcaaataaagaatttacaattttgttatcctgagtactttaaaaagtatgtaagctttaacagtgtaattcattctgaaagcaatattgaaagaattgtggatttttttcgggcggaatttgataaacagacttctctgtcagagttgaacaattccagtatcgcccaagaagggaaatatgccgaaatgagaaaaagtgtttttcaaagtattgctctttctcctcgtaggaaggaaatagatcagcagttgatgtataatgcaccggatatttctactgtgacttactttttgcatcatttatcgaatgaggtcttcagagattatcgatcgatgttttatgggaaaaggaattttaaattattgcctacggggacttgcataccttttaatcgtaaaatgtatgtaacggtacatgggaaaatattagtttgtgagcgtattgatcatgactttgctgttgggcatgtgactgatgaaggtgtggaactgaattttgcccatgttgctgagaatcacagaaaatattgttctaagcttttgtcacagtgtaaacaatgttatatgcaggaatcttgttctcagtgtatgtattataccaatgtgttggcagataaagttgtttgccggaattttaaaaaccgagaaatgtttgccggatatttagcgatgaatgtagattatttggagcataatcgttgggcatattcaaaagtgatgaaagagatttttattttttag

SEQ ID NO: 2897 - DNA, 1242 bp, B.fragilis
aatctatttcatatgaaggcaagacactttttctacccgcttctctttcttttttcggttgcaatgtttgcttcctgctcttcatatgtacccaaagagggggatataatagaagattccgcctttcgttctgttgatttgcgtataatagagaaagcagaagggacagtgatgtctttgagtgatttagtggagtcatatgaagtcattaaattagagaatagggatgaggcacttattaaaacctatccatttgggatctttgcatcagataattatatcttgctgaatccagacgctatatctcctattaagttgtttacgcgtaaaggtcaatacgtggcggatattggtggtataggacagggccctggagagtacaaaacgatacatttctgtatgatagatgaaaaacaaaaacgtatttacttaggtccgggaagagcaaataaaatacttacttatgacctgaaggggaattatctgtcagatgaagctatccatttcaaggaaatagtacataagccttgtatttggatggatcatgataaaaagcatgtaactgtagtggggttgccattttctgagaatgagaactccaattttgaaattagtaacaatgtgtgctgggtgcaaaatagggagggtgatatcgtgcatcggatttctgcaaatcattacggtttaattggagattacagtaatggcttagtggcatgtcggaatgtggatgcgatttctttttctatttttgaagaccccatgttgcgtactcgccctgatactttgtatcactatgatgcagtaaagaatataataactccacgctttacaatagatcatgttgtttctgaaaatcaaagtgcttgtactgttttatatgaaacttcaaggagttattgggcacgtgttacattatatcctaatgatatttcttcaaattcttctcctgtccgtctgactacatttaatgtttgcgtttcgaaaaaggatggtagtgtgaagcgtattgatcgttttacaaatgactttttgggactttcttatcctttcttgactatgcgcaacggttatgtctgtatctcttatgatcctcttgagctgatggatgctttagataaagttcttacccaaactgatttaaagcctgaaatacgtaagcgagccactggtttgagaaatagtttgcacgaaaatgataatgacattcttatgattgggaaacttaaatccaactattag

SEQ ID NO: 2898 - DNA, 237 bp, B.fragilis
agaatagaacagacctattctttttccggaaaagtatatatctatccggtggatcatttaataattttatcgcaaataccttgtcggttattacagcatattgtttctttaataagaaacccgccattgatgtggactttgtcaatgacgggcagtttagattattctaagattgtatcgaatcacgttaatattattatttcattcaatcaccttgaacctcatttctatcaataa

SEQ ID NO: 2899 - DNA, 267 bp, B.fragilis
tcactgatgcaacgaattattgtattatcttcgtaccttaaattaagtataattcagttgacaatgcgaaaaacgggccttctggtaatctctctcctattctgtgcgtcgtgtgccgacaagcatgaccgcaaaggacagactcctttggtagaggtcgatggaaactttttgtacaaagaagaccttcagggccggtgctccccgccggtttgtcaaaagatgacagtcttcttttcgccgagcactacgtccgtagctgggtag

SEQ ID NO: 2900 - DNA, 645 bp, B.fragilis
caacgccagcaggaggatacgtctatggttggttcactattaattgggaataagcatttcttggttagggagttagttcaggcaggacgttctacgtcctgcctcggactcaccaacggaaaaatggggattgccattgctcttttccgctatggtcgcctttccggtgagttagcttatgaagaagttgccagtgagttgctcgatgatgtttgccagaacttgaactattcaatgccgatctcctttaatgatggattatgcgggatcggttggggtattgaatatctgatacagcatggctatgtagatgccgatggcgatgagatattgagagatattgatctgtatctgataaggtgtattcatatttatggattgtcaggcctctcgttgcgaaatggaattgttggattggggcgctacatcttaatccggatcactccaaccttcttatttggtgatactttttccagtgctttgctgaaagagtattttatctatttgatagattggctggaagaggaattgaagcgtgtagatgagcctgttgatgatttgcttgattttttatttgacctatatcctacagggttttatcagaccaaagtttctgacttgataaaatattgtatgaataaataa

SEQ ID NO: 2901 - DNA, 252 bp, B.fragilis; identical to SEQ ID NO: 860

SEQ ID NO: 2902 - DNA, 1716 bp, B.fragilis
cttcagtttaacaatggcacaaacttccttaccatctttaggattaaccattgtgaaagctttggaaatctcaccgatattcattttatccaccactttagcaatctcctgcggcaaatcctgcatttcgaatttagcggtctggttctgcgggttctgcatcagaccgtggctgttgcgcgtatctttgtcctgagacaaagcagaagcagcctgatcaaaggtaaacttatcgctacggatatcgttggcaatagagtcgagacgcgcattggcttcatccaactccttatccgacactttgggcttcaacaggatatgacgggtgttgatacggtcgccacgtttttcgatcaactggatgatatggaaaccatactcagactctacgattttagagatcttcttggtatcctgcaagttgaaagcgacattggcgtattcgggaaccatctgccctttacccataaaaccggtttcaccacctttgatagcagagccgcgatcttcggaatacagcagggcaagcgtagagaaatcactttcacccttattgatacggtcggtgtattcacgcaagcgtctttttacatcttcaatttcggcaacaggtattttaggctgctgcgtaataatctgtacttctacctgggtggggacgtaaggaatactgtcctggggaagctccttaaagtaacggcgtacttccgccggagtcactttgatatcacctaccagtttctgctgcatcctttgtacaatcaatccgtcacgggcattctcgcgcatggcttcacgaatctgtgtagaggtcttattaaactctgcttccattctttctctgctacccaaagcctgaatataattactgatctgatagtcgacacgctgtatgacttctgcctcgggcacttcaatactgtcgagcacagcctggtgcatataaagtttctgtacggccaactcttcgggaatcacacaataaggatcaccatcaaacttacgcccttcatacaaagcggccagtcgtgcttcttccacatcggacttcaggatagcttcgtcgccaatgacccaaaccacttcgtcaatcacattgtcctgtgcataggatgccacgttagcaaccagtgccagggcaaacataacaacaaacttaaagttcacaaacttcttcattctgtgtatttaataatttataatcttctttctttttactgcacgctcgtacagatcgtctttcacttgtttcataaagtcaacccgcttgatgttgacaagcatatccttgactttcggctgagcaaattcataaggttcctgttcgcccgccacacggaaatcactgatattcagaaaatagtaaaatgccgtatctttcagttcaatatgccggtttttatccatataggcttcaggggattccgctttcaacgggatcatatccagcacatcggccacccgcacccatttatcataaaaatactcatacttcactgcgttttgcaaactatacttttccaaatgctcaacggcatcctgagtctccgttttgtaccacttacgcacgttgcccagttggggagcggtcagaggaactttgataaacagacctttcatcaatggacggtccagcttaaacagttctttgttcttttcgtaatagtctgctatttcttgttcggggatctcgcccgacaatttctggctgattag

SEQ ID NO: 2903 - DNA, 228 bp, B.fragilis
tttaataataaaaggattaaagaaacagagagtttacaaaagcgtctttgcgccggaagtaaaaaccttgtaattgaaatcgagaaactaatcgatcatctttccgcagcaaagaaacgcataaaaaccggaattgcaataactttttctctttttttgtatacgaaacctatgaattttagcgatttggaacgttttcggggtgaaaatagaaaatatggattgtaa

SEQ ID NO: 2904 - DNA, 1377 bp, B.fragilis
attagtataaatgaaagtaagtcatctatttgttgggatatttgggctttatgcacaaatctgccgcaggtcggagtgaagttggagaaggaggagaaagctgttcatgcaaattctatcagagaaatattttatacatttttaaacagatttataatgaaaaacctatatttgattttagtgcttagtgcgttggtggcctgtaccggtagttctcaaaaagagaagccggcatgtgtaaatactcctgtcgagccgttcaccggattgcctgtttttgatttgcaggggcaataccccgagaaagaaatcattcttcaggatatcgcagatgtaagatatgtcgtgttggaaaccggcgatagttcattggtcggtacccgtaccatccttatgacggacagcttacttgttaccgtaaacaagaaaagtgatgttatcttttttgataagtcagggaaatatcttcattcttttaatcatacaggcatgagcggagaagaatatggggatgttgtcagcggttattgtatagatgaaaaagcccgggagatattcatctatgacgggttacaaagcagaattcaggtgtatggttatggcggcgcatacaggcgcacgcttaaactgccgcaaaaccgcatgtttgcttcttcgatatttgagtatgatgaaaatttcctgtttggcgaagattatcgccttgtcgactatcagattgggaagtatcctgttaataaaacgccttattacaaaatttccaagaaagacgggaaattaacgtcggttcccatcacggtcaaggggagaataagggatggactttatacggtaggagacggtgagtctggcggctatgtaagtttatccatgtctcccgtagcccgtttgggttcggatattttgattgccgattattctttggatacggcgtatgtatatcgtgatgaccatttgattccattgactgtccgccggaaccatacaagcgaaaacaatattccgattttagcgacggttgatgtgatgaccggccgttatttgctttggtacacgatagtaaaggatatagatgtgaagaacaaccgtgtttctgatccggtatcttatttgtatgacaggttcactaatgaatattgccgggtcgatctggtaaacagggatggtgtgtccgctaccaatgttccggcattccagatgcgattgtccgccaattatcatgtagtgcctgaaaactatgccatacaatgttatccggccgagaagcttatcgaacttaacgggcaaggaaagttgaaaggagagttgaaagagattgcttcaaaattgaatgacgaagataatccggtgttgcttatcgctaaatttaaggaataa

SEQ ID NO: 2905 - DNA, 795 bp, B.fragilis
ataaataaaaagactatgaagtactccgaacaaataacaattggcatccctgtgcggatagatagtccggcaagaatgagaaatcttcaggtcttacttcgtcatttgtctttgtcgggaataaaaatacatgtatgggaagccggtgatgtaagaagtgaattgtccggctttgccagtaataaagacacctatacttacgaaagagatgaaagtttggtttatcataaaacattgtatgtcaatcgattgctaaaggccgcttctacacctgttgttgcaatctgggatgctgatatactactccctttatcgcaaatagaggcttctgtacttgcgattattgagcaaggctatttgttaagcattccgtatgacggagtcgtgaaaatgctttcggaggctcagagtgaggcgtttgaatattccgggcaaggatgcgactatctgacaatgttcgccgctacatacgcccgtttgatgagacgcccttcgtgtggtggagtatttgttgttgatcgggagaagtatttgcattggggaggagataacgaacgttttgtcagttggggaccggaagatgccgaacgtatccggcgaatagagatattgggatatcctgtgcattgggtaaaagagggccctttatatcatttatggcatcctcgaggagaaaactccgggtacgctacagaggagttggcgtttcaaaaccggatggagtttataaaagtgtgtagcatggagcgtaacgaattgcgtgaatatataaaatcctggaaaaacaatgggtaa

SEQ ID NO: 2906 - DNA, 612 bp, B.fragilis
aatcctggaaaaacaatgggtaaagtggacgaagcattattaaaacgaatagccgatcaccagatgttgcatgggagtttccgcagagatctgggagtactgaatggcaaaatgggaattgtattgttctttttccattatgcccgttatacggggcgtgtactttatgaggactttgccggggaaatgctggaggaagtaattcaggaacttcacagcgatttgccgattcgtttttccgatggtttatgtgggattggctggggggttgagtacctgattcagaatgcttttatagcaggggattcagatgagatattggaagatttagatcaaaaaataatggaatgggatcctcggagagctacagatctttcatttgagtcggggttagagggagtcgcttgttatgcctcttcccgtttaaaatctactgtccggaatcggatgccttttgatcaagtctacctaagcgaattggaaatggctgttcagcaaaagggactgaggatgaggttagaattggacgatgtatttgtgagagtgattgatatagggaatatagaagaagaagtatcctggaaatatggattaaagatgatagctttatga

SEQ ID NO: 2907 - DNA, 1317 bp, B.fragilis
actatgggaaatttagttgcaatcgtaggacgacccaatgtgggcaagtctaccttatttaatcgtttgacgaagacccgtcaggcaattgtgaacgatgaagcgggtactacccgtgataggcagtatggtaaatccgaatggttaggacgggagttttctgttgttgataccggtggatgggtggtgaactctgacgatatattcgaagaggaaatacgcaagcaggtattgatggcagtggacgaggcggacgtaattctgtttgtagtggatgtgacaaacggagtgacagatttggatatgcaggtagccgctatattgcgtcgggccaagagtccggttattatggtagccaataagactgataaccatgagctacgatacaatgctcctgagttttatcggttaggactgggcgatccgtattgtatttctgcgattagtggtagtggtacgggtgatctgatggatttgattgttagtaaattcaagaaagaatctgatgagattctggatgaagatatcccacgttttgcagtggtaggacgtcccaatgccggaaagtcatctatcgtgaatgcttttatcggtgaagaacgtaacattgttacggaaatagccggaacaacccgtgactcaatttatactcgttacaataagttcggtttcgatttctacttggtagatacagccggtattcgtaaaaagaataaagtgaacgaggatctggagtactactctgtagttcgttccattcgtgctatcgagggagccgatgtatgtattttgatggtggatgcgacccgtggtatagaaagtcaagacttgaatatcttttcgttgattcagaaaaactcgaaaggcttggtggtagtcgtcaacaaatgggatcttgtagaaaacaagactgataaagtcatgaagactttcgaagaagccattcgttcacgttttgctccttttgttgattttcctatagtatttgcgtcggcattgacaaagcagagaatcctcaaagtgcttgaagaagcacgcaaggtttatgagaatcgaatgattaaaatccctacagcccgcttgaatgaagagatgcttccgttgatcgaggcttatccgcctcctgcaactaagggaaaatacatcaaaattaaatatgtcactcagttgcctaatacgcaagtaccttcgtttgtctttttcgccaatctgccgcagtatgtgaaagagccttatagaaggttcctggaaaacaagatgcgtgaaaagtgggatttgagtggaactcccattaatatttatatcagacagaagtaa

SEQ ID NO: 2908 - DNA, 1560 bp, B.fragilis
aatgatatgaagaagattctggttggaacactgacctgtttgtttggggcgattgccggccatgcccagcaagatccggtattgatgcggattaatgggcaggatattacccgttcggagtttgagcgtttctgccaccggaataaaccttcgggaatagccgggaaggagactctgaaacgctgtgccgatctttttgtcgatatgaagttgaagttgtctgcagcgcaaaaggccggattggatactgtttctgattttcgtacagagatggagaattatcatcgagccttatccaggtcctatcttaccgattctgctaccgatgaggcctacgcaaagaaactctacgatcagatgaaaacccgctctgctgccggcgaagttaaggttatgcgtattttccgttatcttccgcagactgccttaccccatcatttgcgggaggcacagatcttgatggattcactctatcatgtcttggagactcatcccgatattgactttaggacactggtaaacaagtactcggatgataagaaagagttttggatgggttggttgcagacttcgcaggagtttgaagaagtagccttctctttaaaagatggagagtattcaaagccgttttttacacccaagggtatacagattatcaaggtgacaggcaggcgggaaattcctccattcgaacagatacgcggagaattgattcataaactctcccgtcgcccgggtacggataaagaaattgagttatgggtgaacaagttgaagagtacctgtcaatatactccggacaaggccgggatggaagagttgcttgcctcgggcaggacttcccgcactctttttacgctggacggaaaaagctttaccgggaaagactttgaacggtttgccgatgcccatcccatggggataaaacgacaattgaatgcctttgttgtgaaatcaattcttgattacgaaaacaatcgccttgaacagaaatatcctgatttccgactggccttgcaacagcgccgtgacgatctgcttttagccgctataacccgtcgcgaatcgcgtcaggtcagtctgtccgattctgttgcgctgaaagccttttttaaggaacaccggaccgattacaattgggattcgccccgttacaggggtgccgtattgcatggaacccataaaaagactctgaaaagtgcacgtaaattcttgaagaaacttcccgaggaagagtggaaagacgccatccgcctgacgtttaatactcctgcttcgccagccactatccggatagaacaaggaacttttgccgaaggtgacaatgtttttgttgataagttagtgtttaaaaaaggagatttcgaacccttaaagtcctatccttttactgttgttctaggtgagaaaaagaaagggccggagtcctaccatgagatcattccccaattgatccgggattatcagaatcatctggatgcactttggacagaacgtctcagagcttctgctaaggttgaaattaaccaagaggttttaaaaacggttaataatcactga

SEQ ID NO: 2909 - DNA, 1884 bp, B.fragilis
agacagatgaaatcatcttatatctgctgcgtattgttatttgttttgtttttggtaagttgtaccgatgggcgttctgaggggcaagtagcccgtttgttacgtcaggccgaaatgtgtatggaggaatgtcccgatagtgctttagtgtatcttcatcaaataccggatccggaaaagttgacgggagaaaaccaagctgattattgcctactgttgacccaggcaatggataagaatgatttaccgttgagctcggattcgttgatacaaatagctgttggctattattcaaatggaaaagataggctaaaaaagggtaaagcgtcattctatttaggaagggttaaatcttcaaggggcatgttagaggatgcacagaaatattttttagaagctctctctatattggatgtaacagacaatcttaaatatcaggcattagtgcgcaatcatttggggcaactatatatgaatttagacttgtaccaagatgctttaataatgaatagtcaatcggtctccttatttcaacaattaactgatacagccaatcttgtgtatgcagagcgtgatatgggacggatttatttattagagggtaggcaagatagtgcttctctttattatcagcaggctatcaacgatgctctcagttattttaaatcggatatatacaaggatattgtttctgagtggggacagatttcaatgtatttagagatgtctccttcagcagaacaaatgcttttgtcaaatttggaatcagacttagtcttagataaaaccccagtatgtcttagccttggaatttattatttgtctaataaactctattctaaagcagaaggatatttgttgaaagcagctgcttcttcgcgaccatatacccgtgtttctgcatataaatatttggggcatcttgaaacacgaaatttagatttgatttattgggatcaatatgaacaagctcttgattctttggagcgacagaatttagcttatgcagtgaaagagattcaggaaaaatataataatgctgcgttgcaagcccacacttttaaattggaaaatgaaagacttcattccaccatatcttacttatcggtaattctgttattattgagtataacctcggttatctatgtgttctatatgaaagaaaggcgtagaagacagattgaaaaggaggaattcaatagaaatatgaaggcgcatgaacaagagcgagcaaggttattggcagagttgagtgactctaaattgcatgtagagaaacttgaacaattaaagagcgaacagaaacagagctctttggaggtgcaagaaaagacaaatgcacttttggaacaggaaaaagaacattcctgcaaaattagtcaacaattggaagagctgaaaaagaaatggaaaaatcaattgtctataaatattgatttgagagctcgaaataaggatttgtcttataagataaagtcattaaaagattctgatatggagaatactcctggcttatatgcatcaattaatttgttggtcagaatattaacatgtgatctttcagaaattaaaactttaaaagtggacgattgggaaggattgttccaatgtattgatttgctctatggtaattctttgagaaaatttatagatcagtaccaaaagcaacatgatgaagagttggatagaagagtggttgccatttgttattttgaatatatcaaagtgaagcatgctcgtcaagctgctattttgagagtttcagctcaagctttgagtaaacgtaaacagagacttaaaattgaacttggagttcctgatatggcttctgtcggacgggtagtcaaaccagtttgtccatcaaataaaaaggagttgatgtaa

SEQ ID NO: 2910 - DNA, 1716 bp, B.fragilis
tcctattttgatatgtttagattcaataaagaaaataaattccaaggcaggcatagatttctcttagcgggtactctatgcctgcttgctgtatgttttctgatggctcaggacaagaaacctcagcatgacaagaaagcgcagccggagcagaaagttgaaccggaaaaggcacagggtaaaaagaaaacacgtgtcgacttgcttcatgccgatcagggacaggccgataagttggcccgccccgatgttcaggtgctgatcggttcggtcaagttgcgtcatgacagcatgtacatgtattgtgacagtgccttgatttacgagaaaaccaattctttcgaagcattcagtaatgtacgtatggagcagggggatacccttttcatctatggtgattatctgttttatgacggcatgacccagatagcgcagcttcgtgagaatgtaaaaatgatcaaccggaatactaccctgttgacagatagtctgaattatgaccgtttgtacaatttgggctattattttgatggaggcaccttgatggatgaagaaaacgtgctgacttctgattggggcgaatacagtcccgccaccaaactatccgttttcaatcacgacgtcaagcttgttaatccccgttttgtactgacttccgataccctgaagtatagcacggatacgaagattgccaccatcctgggaccctctgatattgtcagtgaacaaaatcacatctactccgaacgtggcatttacaatacggtttccggacaagccgagctgctggatcgctcagtactgaccaatgatggcaagcgattgaccggagacagccttttctatgaccgtaaagccggctatggcgaagcgttcgataatgtgcagatgaatgatacggtgaataagaacatgcttaccggcgattattgttattatgacgagctgaagcagaatgccctcgccaccaagcgtgccgtggctgtggattattcgcgtggcgacagtcttttcatgcatgccgatacattactgatgaatagctataatcttgacacagattctcttttccgtgagatgcgtgctttccacaaagtgcgtatgtacagcatcgatttgcagggtgtttgcgactctttggttttcaatacgaaagattcctgccttactatgtatcgcgatcctattctttggaacgaagggcaacaactgttgggtgaagagattaaggtctatatgaatgacagtacgattgattgggcccatatcatcaatcaggcacttacggtagaacagaaagactccattcattttaatcagatttcgggaaaagagatcaaggcttactttgccgaaggtgaagctcgcaaggtagatgtgataggaaatgtcctggtagtttattatcctcaggagcaagatagtacgatgattggcatgaacacatccgaaaccagtttgctaaatatgtatcttaaggatcggaaaatggagagaatggtaatgagtccaaagtcgaatggtacactttatccgatgaatcagattccgcccgacaaaatgaaactgcccacctttagttggtttgattatgtccgtcctttaagtaaagaagacattttcaactggagagggaaaaaggccggtgaggctttgcgtaaaaccgaacgtaaagctattagtggtccgaaacgtgaaataattaatatgaaatag

SEQ ID NO: 2911 - DNA, 324 bp, B.fragilis
tgttttttcgacatgaaatcacaaagattaggtttgcagccaataaagaattacgaacgagtggtcaatcctcggaagaaacgattccacatgtcatcccgtatgaatagccatggaaaaattattattactaaaattgccgattatgagagtaattatattaaaaaagccggtttgttagaaggtgatgaaattattgctataaatgaaattcctattaaaatgatcactatagaagagaatacaaagttaaatcgacgaggtcaaggtaaatcttataaaataccggtggttattgatagaaatgaggttcaaggtgattga

SEQ ID NO: 2912 - DNA, 210 bp, B.fragilis
aaacatgccgaaatatacggatcatttataaaacatcattcttttagaaatatgtttattaaattcatttttgttttaacctaccaaaaagaagaacactattgccattttccgacaatccattataaagcttttcaactttacccctcatcgcagtatccatttcggaaagtttcaatatctgcgatagctgctctttcaattcaatag

SEQ ID NO: 2913 - DNA, 1020 bp, B.fragilis
attaaaacagaattgatggaaaaaataaatgcagtaatcacaggagtcggaggatatgtacctgattatgtcttgacaaatgacgagatatctaagatggtggataccaatgacgagtggattatgactcgtattggagtaaaagaaagacgaatactgaacgaagaaggattaggtacttcgtacatggcccgtaaggcagctaaacagttgatgaaaaaaacgggttcgaatcctgatgatattgatttggttatcgttgcaactactactcctgactatcatttcccctcaacagcttctattctttgtgataaactcggactaaaaaatgcttttgctttcgatctgcaagccgcttgtagcggattcttgtttttgatggaaacagcagccaattttatccgttcgggacgatataaaaagataatcattgttggtgcagataagatgtcatcaatggtagattacacagagcgtgcaacatgtcccatctttggcgatggagcggcagcctttatggttgaaccgactacagaagatctgggaattatggatgctatcttgagaactgatggtaagggattgcctttcctccatatgaaagcgggcggttcggtttgtcctccttcctatttcactgttgacaataagatgcattacattcaccaagaaggtagaacagtatttaaatatgctgtttcaaacatgtctgatgtgagtgcagctatagcagaaaagaatggtctgacgaaagataacatcgactggattgttccccatcaagccaatatgcgcatcatcgaagcggtagctcatcgcatggaagttccgatggagaaggttctggtagatattcagcattacggtaacacgagtgcaggtactctgcctttgtgtatctgggattttgaagagaaacttaagaaaggcgataacatcattttcactgcgtttggtgcagggtttacctggggagccgtgtatgtgaaatggggttacgacgggaaaaaagaatag

SEQ ID NO: 2914 - DNA, 393 bp, B.fragilis
tcgattagtttctcgatttcaattacaaggtttttacttccggcgcaaagacgcttttgtaaactctctgtttctttaatccttttattattaaatcatcttccggagagttttatttcatttatttcattttttatcattttcactatgaacatttatgttggaaaccttagctaccgtgttaaggaagcagatctgcaacaagttatggaagactacggaacagtaacttcttgcaaagtaatcatggatcgcgaaacaggcaaatcaaaaggtttcggtttcgtagaaatcgctgacgatgcagccggtgcaaaggctatcgccgaattgaacggagctgaatacgaaggtcgtaccatggtggttaaagaagccagaccaagagagtaa

SEQ ID NO: 2915 - DNA, 189 bp, B.fragilis
aataggcttttgagaaataaagatttctctctatcggtgattggcattgataaagcccgtgattatccagtgaaatgtattgaaatacgtgaagtagctgatgtagagtatataccgctggaagcagttagctcttctttgttaataaatgacatttggggatactatgtgttctacttgtcaaaatag

SEQ ID NO: 2916 - DNA, 774 bp, B.fragilis
caaaggatatggaagaaagcaagcaagatggtgcttcgtactgaagacttggtgaaaaagtacggtaagcgtacggtggtgagccatgtttccatcaatgtgaagcagggcgagattgttggtttgctcgggccgaacggtgccgggaaaactacttcgttctatatgaccgtaggattgattactccgaatgaaggccgtattttcctggatgatcttgaaataacaaaatatcctgtttacaaacgtgcccagaccggtatcggatatttggcccaggaagcttcggttttccggcagatgacggtggaggacaacattgcctccgtgcttgaaatgactaataagcctctcgattatcagaaagataagcttgagagtctgatagccgagttccgtttacagaaagtgcgtaagaacaagggtacccagttgtccggtggtgagcgtcgccgtacggaaatagcacgttgcctggccatcgaccctaaatttatcatgctcgatgaaccgtttgccggtgtagacccgattgccgtagaagatattcagcagattgtctggaaattgaaggataagaatataggtatcctgataacggaccataatgtgcaggaaacgttgagtattaccgatcgcgcctatctgctgttcgaaggaaagattctgttccaaggcactcccgaggagttggcagaaaataaaattgtgcgtgagaaatacctgagtaacagttttgtgttgcgtcgcaaggacttccagctgaaagattag

SEQ ID NO: 2917 - DNA, 675 bp, B.fragilis
cttatgaatcgtactttctgttttgttccggttcgcaaagggagtagaggtattcccggtaagaacctgcgtctgctgggggataaacctctggtatgttggattatcgataccatccttgcttccggcatagcggacgaggtatgtgtagcgacaaattgtgatgaaatggagagtctgatacgaggccgttacaaaggagttgtacagatattcaggcgcagtgagtggagtgcaagggatgaggcttccagcctggaagttgtacaggaatatcttaattatcgtaagccggaccggaatgatgattttattttgttacaggctacttctccttttacgactgcacaagaactaagggggcttgtagaagagatgaaaaggggggaagcggattcctatgttgcctgttgccgtttgaagaagtttcgttggagtgatgaggggagacctttggactattcattcgaaactaaacctcgccgacaggagtacaaaggttttctgatagagtcgggagctttctatgcttctacggtgggaagaatactggactccgggcagcttctttcgggagttgtgaaggtggtggaggtcggtcctgcagggatgatagatgtcgatgaagaagcggactggagactggctgaacattatattgaaaccgggctttaa

SEQ ID NO: 2918 - DNA, 1368 bp, B.fragilis
ataattgtcagaatgaacgtttcattacaaaacattgacaaagtaagcgcattgcttaccgtgaagcttgaaaaagctgactaccagcctcaggtagacaaatcgttgaagaacatccgtcagaaagctcaggttccgggattccgtccgggtatggttcccatgagcttggtgaagaagatgtatggtaagtcagttattgccgacgaggtgaataaattgctttctgagaaagtatacgcatacatcaaggagaacatcatcaacatccttggcgatccgatgcctatcgaagaaaagcagccggatatcgatttcgatacaaaggaagaattcgaattcgtgttcgatatcgcttgggctccggaattcaaagctgaggttagcgaccaggacaaggtagactactatacaatcgaggtacctgacgagatggtggaaaaccagattaaggcttatactcaacgtaacggtaaatacgaaaaggtagatgcttacgaagagaacgatatgctgaaaggtctgttggccgaactcgatgaagaaggtaacaccaaggaaggcggtattcaggtagaaggtgctgtaatgatgccttcatacatgaagaacgacgagcagaaggctatctttgcaaatgcaaaggtaaatgacgtattggtgttcaacccgaacactgcatacgaaggcaatgccgttgaaatggcatcactgctgaaaatcgataaagaagctgctgccgaagtaaaaggcaacttcagcttccaggtagaagaagttacccgtttcgtaaacggcgaactgaaccaggagattttcgaccaggtattcggcaaagatgttgtgaagactgaagaagaattccgtgccaaagtaaaagaaagcatcgcagctcagtttgttgccgacagcgactataaattcctgatcgacgttcgcaaggtattgaccgataaagtaggcaaactggaattccccgatgcactgctgaagcgtgtcatgttggtgaacaacaaagataaaggcgaagaattcgtaaacgaaaactacgataagagcatcgaagagctgacatggcacctgatcaaggaacagttggtgaaagaaaacgatatcaaggtagagcaggacgacgtgatcaacatggcgaaagaagctacaaaagctcagtttgctcaatacggtatgctgactatacccgatgatatcctcgagaactatgcaaaagagatgctgaaaaagaaagaaagcatcgacggtctggtaaaccgcgtagtagaaaccaaattggccgctgcactgaaaggcaaggttacattggagaacaaaaccgtttcaatggaagaattcaataagatgtttgaataa

SEQ ID NO: 2919 - DNA, 267 bp, B.fragilis; identical to SEQ ID NO: 2762

SEQ ID NO: 2920 - DNA, 243 bp, B.fragilis
tcgttgcaaaggtacaaaaaaagcccaaacgttatgtactacttaactaattttcatctgaatcttaagttagtagacataattcgggcgacaaagatacgaataataatcctcataacatacaaattatcagtaaatattcgtattttaaatagtattttatttataacccgctttccctactcccagggtcagagtagaaacagggcagcccggcgctccctttccttcccccccgtataa

SEQ ID NO: 2921 - DNA, 291 bp, B.fragilis
tgtgttatgagaataatatcatttgcagccataagaaattacgccaaaaagcacgctgatgctgatgtacctttgcgtgattggtataaaaaaacagaaaaggcagattggtcgtgtttggctgatataaagcaaacattcaatagtgttgactatgtaggtaatgatagatttgtctttaacatcaaaggcaatgattacaggctggttgctatgattttgtttgctgctaaaaaagtgtttatccgttggataggtactcataaagaatatgataacaaagattgttaa

SEQ ID NO: 2922 - DNA, 783 bp, B.fragilis
acttttaatgggatgatcgaagtaaaaggactctataaatcattcgaaggcaaaacggtattgcataatatcgacgccactttcgaaaatggaaaaaccagcctgattatcggacagagtggttcgggaaagactgtactgatgaaatgtatcgtcggattgctgacaccggaaaaaggagaagtgctctatgacggacgcaacttcctggccatggggaaaaaagaaaagaaacacctgcgacgcgagatgggaatgatttttcaaagcgcggcgttgttcgactccatgtctgttttggataatgttatgtttccgctcaacatgttcggcaccgacaccttgcgcgaacaaaccaaacgggctatgttctgcctcgaccgtgtcaacctcacggaagctaaagataaatttcccggcgaaatcagtggaggtatgcagaagcgtgtagccattgcacgggccattgcactgaacccgcagtatctcttttgcgatgaaccgaactccggactcgaccctaaaacttctttagtgatagacgacctgattcatgacatcacacgggaatacaacatgactaccatcatcaacacccacgacatgaactcggtaatgggaatcggtgaaaagattatctacatttatcagggaaccaaagaatgggagggcacaaaagatgacattttcacatccaccaacgaacagttgaataacttcattttcgcctccgacctgctgcgtaaagtaaaggatgtagaaatacaaaacctcgaaggataa

SEQ ID NO: 2923 - DNA, 255 bp, B.fragilis
gtcagcaccggcagacggccgataatctccggaatcagtccgaacgacttcaaatcttgcggtgcgatatattgcatcatgttgtttttgtcgatagtagccgtcttgcgggaagcattgtatcctacgacatgggtgttgagacgctgggcgatcttcttctcgatgccatcgaatgcaccaccacaaatgaaaaggatgtttttcgtgtttacgggaatcatcttctggtcggggtgcttgcgtcctccctga

SEQ ID NO: 2924 - DNA, 1233 bp, B.fragilis
tcaacacttatctttgatgtatacaatttaataaatatgcggatgaataaatattggggtacatggatcgtatttataggagttttttttcattcatgtaaacaagaagtcaagcagaataatatatccttttattctgtcgatttactggaaatggagaaaatgaaaggggaagaaatattgctttctgatttgatagaatcattggaaattattaagttggataacagagaagaggcattgattgctacttatccctttggtatcgatgtttcaagcaattatatcttaatagagccagatggcgtttctgctttgaaattatttactcgtaagggacgatatgtggctgatataggtggagttggtcaaggccctggagagtataaatatgctgtgaatagatttcttgatgaaaagcagggacgtgtggctattgccgaaaataaaaaaatattattttttgatctcaaaggccaatttttatcggaagagagtatttcattgccggaaacgataacgaagagttccatttggatagatttggaaaatgaaaaagctgtagtggtcgttcttccctttgctgatataggaaatccaaaagcaccgatcagtaagaatctatgctgggtacaagattttaaggggaatatcttgcaaaaaatatctgctataaattatgcaattgtgccggattatagtaatgaagtattggctccccggaatgttgatgcctattctttctccctttgtcaggttgtcgggcgtacacgccctgacactctatatcactatgatattgctaataatctattgaaaccttattttactttagataatgtaatgcaggaggataaatatattgtaacgtcattgtatgagactccggaatattattggagtagagtaactattggaccagctaaagtgctatcagatggagctcctgttcgtatgactgtatttaatgttcgtgtttctaaaaaagatggtagtgtgaagcgcattgatcgttttacaaatgactttttgggactttcttatcctttcttaactatgcgcaatggctatgtttgtattacttatgaacctcttgaattgatggaagctttggataaagttcttgcccaaaccgatttaaagcctgacgtacgtaaacgggccaccgatttacgaaatagtctgcacgagaatgataatgacattcttatcattggaaaactgaaacaataa

SEQ ID NO: 2925 - DNA, 1212 bp, B.fragilis
agagagtatatgaaaaaatatttatactttattttttttgtaactttatggtcgtgttcagctgataaggttaatgtaaaaagtgaggataattctttttactcagttgatttgcgtataatagagaagaccaaagggacagtgatgtctttgggtgatttaatggaatcatacgaaatcattagattggacaatagggatgaggcgcttattaaaacctatccatatggtgtatatgtgacggataattatattttgttgcgacctgctgacgttgtatctcctgttaagctatttacgcgcaagggacgatatgtggctgatattggcggagtaggtcaaggcccgggagagtatttatatttattttcatggttggtggatgagaaagaaaatcgtatttatttaggtccgggaagagccgacaaggtgcttgtctatgatttaaaggggaattatctgccggatgaggttattcgtttcggggaaatagtacataagtctcagatatgggtggactatgataaaaaaaacgtagttgtggttactttacccttttctgctaatgtgaactcgaactttgcaattaataagaatgtgtgctgggtgcaaaatagggatggtgatatcgtgcatcggattcctgtaaatcattacggtttaattggagattacagtaatgctttagtggcacgtcggaatgtggatgcgatttctttttctatttctgaaatacccatgttgcgtactcgtcctgatactttgtatcactatgatgcggtaaagaatataataactccatgctttacaatagatcatgttgtttctgaaaatcaaagtgcttctactgttttatatgaaacttcaaggagctattgggcatatgtcactttatatccgaatgatatttcttcaagtgctttttctgtccgtctgactacatttaatgtttgcgtttcgaaaaaggatggcaatgtacggcgcattgatcgctttactgatcctcttttaggtttatctcatctttttttgatgatgaataatggatatatttgtatctcttatgatcctcttgaactgatggatgctttagataaagtccttacccaaacagatttggagcttgacgtacgtaaacgggccaccgatttacgaaatagtctgcacgagaatgataatgacattcttatcattggaaaactgaaacaataa

SEQ ID NO: 2926 - DNA, 252 bp, B.fragilis
attttaaatatcatgaaaacattgagacgtattaaattgaatagtttaagtcaagaagatttggcagaccgtgaaatgaatatgcttcgtggtgggagtaactgttcttgtggctgtatgggtgttagttctaaggcaagtaatttagagggtaataaggattgcggataccctttatcttgtacatgtggctgtactggaccttatgctttagcagctaatcaggaagctaataaaggagcggggatataa

SEQ ID NO: 2927 - DNA, 504 bp, B.fragilis
tcagtaagtataataatacttgtaaaatttaggtttatggataaaatctatttatggcttctgcttctcatttcatgtagttgctctcatactaaagaaaaggtttctaatgacatggattcctctttgtgtgtcatagatgttacttgtgaatatcctgttgagaaagtgaatatacatgatgttgccgatgtagagtatgttcctttagaaacgacacgaaattcactgcttgcgtcggattgttctgtttttcggatttcagatgattatataactgtcgcaagtggtgttgataatggcaatatctttttctttaatagaaaagggaggtacttgtggacttttaaccggcgaggaggatctgctgaagagtacagttctataaccgcatgggatgccgattttggcatgcaagaaatatacatctatgattcgttcaggaaaaagatatataccttaattccgcaacactataatttaactttatttataagttcctga

SEQ ID NO: 2928 - DNA, 807 bp, B.fragilis
ttgcggattttaggatatatttattcttttgatggacggtataaacgtagccatgctttgcctatgaaggattgcacatttatcgatctgtataattatgataaggattatctgataggttataatcggttttatgactttcgcaaaaagaaaaaggtggatacgcatccttactatctgatcgataaacagagcggagagatgtcttccatcgggattgttgtggataaacctatcagtgagaaggtacatacagagatcgtcaaatttcccggaggggcttataaagatcaggtcctctttctcataaccgcgctgataaaaaatggcgatgctttcttgattgccgactatgctttggatactatttacagctatcgtcatcacaaactggttcctatcgccgtgcagactccttcggtatatgcatcagatccaccggtcattgtcgcttgtgaattatacaccgattcatatttgcattttagaataattccgatgtactataatccttctgctcctatgtctcctatggcggatgctcctgagcttgtgttaaacaggcatacaggcaagattgcggaatggaaaatgtatgattataattattcctccgatatagaaaggcctgtgccgactatgatacttcagtctgctgatagagaaaattatggtataagcatgtttacagcggaaaggcttattgaacaatatcaagcaggcgggttgaagggggagctgaaggatattgcatcccgattgagtatagatgataatgatatattaatgatatgtaaatataaataa

SEQ ID NO: 2929 - DNA, 1257 bp, B.fragilis
gaaataaacatggctgaatcaaagaataataaaaaaaggtgtagcttttgcggtcgttcggagaatgaagtcggattcctgattacgggaatgaacggctacatctgcgacagctgtgcaacccaggcttatgagatcactcaggaagccatgggagccggcaaacagagcgcgggggctacccgactcaacttaaaggaactacccaaaccggtagaaataaagaatttcctcgaccaatatgtgattggccaggacgatgccaaacgctttcttgccgtatcggtgtataaccactataaacgcctgttgcagaaagacagtggcgatgatgtggaaatcgagaagtcgaacattatcatggtgggcagcaccggaaccggtaaaacacttttggcacgtaccatcgccaagctgctgcatgttccatttacaatagtggatgcaaccgtactgacagaggcaggatatgtaggcgaagatatcgaaagcattctgacccgtctgcttcaagtggccgattacaatgtccccgaagcagagcagggcattgtctttatcgacgagatagacaagattgcccgtaaaggagacaacccttccattacccgcgatgtcagcggtgaaggggtgcagcagggattgctcaaactgcttgaaggttctgtggtcaacgttccgcctcagggaggacgcaagcaccccgaccagaagatgattcccgtaaacacgaaaaacatccttttcatttgtggtggtgcattcgatggcatcgagaagaagatcgcccagcgtctcaacacccatgtcgtaggatacaatgcttcccgcaagacggctactatcgacaaaaacaacatgatgcaatatatcgcaccgcaagatttgaagtcgttcggactgattccggagattatcggccgtctgccggtgctgacttatctgaatccgctcgaccggaacgcgcttcgtgccattctgaccgaacctaagaattccattatcaagcaatacatcaagttgttcgagatggacggcgtcaagctgaccttccagcccgaagtttacgagtatatcgtcgacaaggctgtggaatataagctgggtgcccgtggattgcgctctattgtagagaccataatgatggatgtcatgttcgagattccttctgaagaccagaaagaatatgaagtgacattggattatgcgaagcatcaactcgaaaaagcaaatcttgcgagattgcaaactgcttaa

SEQ ID NO: 2930 - DNA, 741 bp, B.fragilis
ctctgtgtttttttgtgtctctgtgttcttttttgtttctttgcagttacattattaataatagaaaggaacgtaacaatggatgattttagaaaatacgcaaccaagcatttaggtatgaatgcaatggtgctggacgatgtgattaaatcgcaagccgggtatttgaatccctatattttggaagaaagacaactgaatgtcactcagctcgacgtgttctcacgcctgatgatggaccgcattatcttcctcggtacacagattgacgattatacagccaatacgctacaggcacagttgctatatcttgactcggtagatccgggtaaagatatctctatctatatcaattcgccgggcggatcggtatatgccggactgggtatttatgatacgatgcagtttatttcgagcgatgtggcaacaatttgtaccggtatggcggcttctatggcttctgtgctgttggtggccggtgccaaaggcaaacgctcggcgctgcctcactcacgtgtgatgattcatcagccgatgggcggtgcacagggtcaggcttcggatattgagatcacggctcgcgagatacagaaattaaagaaagaactttataccattattgccgatcattcgggtacctcttttgataaggtttgggccgattcggaccgtgactactggatgactgcccaggaagcaaaagaatatggtatgattgacgaagtgttgattaagaaataa

SEQ ID NO: 2931 - DNA, 420 bp, B.fragilis
ctaaaaaaaattgctatgaaacacttattaagtacgattatttttctatttgctgtcattcttaaaggtaatgctgaatcttattcctttccttctcctaatgaaattaatagtgtaattaatctggacttgaaaggaatattcagtagtactcatacaaaatcactccctttgacacctgtggaagcgtctcttgtagataatactcttcttaatatatcttttgtagttcattccggagaggttactgtacgtattctttcagagaaggggatattgtattcttcttgtataaattcggatcagcaaaactccttagctatttctgtagaagattttgaaaggggagactataagctggagttgacaacgccagcaggaggatacgtctatggttggttcactattaattgggaataa

SEQ ID NO: 2932 - DNA, 1380 bp, B.fragilis
atacacagaatgaagaagtttgtgaactttaagtttgttgttatgtttgccctggcactggttgctaacgtggcatcctatgcacaggacaatgtgattgacgaagtggtttgggtcattggcgacgaagctatcctgaagtccgatgtggaagaagcacgactggccgctttgtatgaagggcgtaagtttgatggtgatccttattgtgtgattcccgaagagttggccgtacagaaactttatatgcaccaggctgtgctcgacagtattgaagtgcccgaggcagaagtcatacagcgtgtcgactatcagatcagtaattatattcaggctttgggtagcagagaaagaatggaagcagagtttaataagacctctacacagattcgtgaagccatgcgcgagaatgcccgtgacggattgattgtacaaaggatgcagcagaaactggtaggtgatatcaaagtgactccggcggaagtacgccgttactttaaggagcttccccaggacagtattccttacgtccccacccaggtagaagtacagattattacgcagcagcctaaaatacctgttgccgaaattgaagatgtaaaaagacgcttgcgtgaatacaccgaccgtatcaataagggtgaaagtgatttctctacgcttgccctgctgtattccgaagatcgcggctctgctatcaaaggtggtgaaaccggttttatgggtaaagggcagatggttcccgaatacgccaatgtcgctttcaacttgcaggataccaagaagatctctaaaatcgtagagtctgagtatggtttccatatcatccagttgatcgaaaaacgtggcgaccgtatcaacacccgtcatatcctgttgaagcccaaagtgtcggataaggagttggatgaagccaatgcgcgtctcgactctattgccaacgatatccgtagcgataagtttacctttgatcaggctgcttctgctttgtctcaggacaaagatacgcgcaacagccacggtctgatgcagaacccgcagaaccagaccgctaaattcgaaatgcaggatttgccgcaggagattgctaaagtggtggataaaatgaatatcggtgagatttccaaagctttcacaatggttaatcctaaagatggtaaggaagtttgtgccattgttaaactgaagtcacgtatcaacgggcataaagccacgatcaccgatgactaccagaacctgaaagaaatcgtgctcgacaagcgtcgcgaagaagcgttgcagaaatggatcgttgaaaaacagaagcatacatacgtacgtattaatccggcatggcagcgttgcgattttaaatatccggggtggattaaaaaagactga

SEQ ID NO: 2933 - DNA, 972 bp, B.fragilis
aacgaagtagttttcccggcaccgttcggcccgagcaaaccaacaatctcgccctgcttcacattgatggaaacatggctcaccaccgtacgcttaccgtactttttcaccaagtcttcagtacgaagcaccatcttgcttgctttcttccatatcctttgttattttgcggcaaatgtagcaaaaataagccgaaaaaacgtacatttgcaaacaaatatacgagttatgattaaagcattaagaaccgtcggcagatacatcatgcttatggggcggactttttcacgtcccgagcgtatgcgtatgttcttccggcaatatatcaaagagatagagcaactgggagtaaactctatcggcatcgtgctgttgatttcattcttcatcggagcggtgatcaccatccagataaaattaaacatcgaaagcccatggatgccccgctggacggtgggatacgtcacccgagagattcttctgcttgaattctcctcctccatcatgtgtctgatcctggccggtaaagtagggtcgaacatagcttccgagctgggcaccatgcgcgtgacgcaacagattgacgcacttgaaatcatgggagtcaactccgccaactatctgatattacccaaaattacggcaatggtcaccatgattcctattttagtgactttcagtatcttcgcaggtatcatcggagcgtttgcaacctgctggttcggtggcatcatgacggctaccgaccttgagtacggacttcaatacatgtttgtagaatggtttgtgtggtgcggcatcatcaaatccctgttttttgcctttatcattgccagcgtctcctctttcttcggctataccgtagaaggcggttcgatagaagtgggaaaggcatctaccgattcggtggtttccagcagcgtactgattttgtttgccgacctggtattaactaaacttttaatgggatga

SEQ ID NO: 2934 - DNA, 1905 bp, B.fragilis
actaaaacagtcaaagctaaatctattatgagcgatatcattcatttattacccgattcggttgccaaccagatagctgccggagaggtgatacaacgtccggcatctgtcatcaaagagttagtcgaaaatgccattgatgctgaggcgcagaatattcatgtgttggtcaccgatgcaggtaaaacctgtatacaggtgattgatgacggtaagggaatgtccgaaaccgatgcacgcctctctttcgagcggcatgccacttcaaagatccgtgaagcatccgatctgtttgctcttcgcacgatggggtttcgcggtgaagcattggcttccattgccgccgttgctcaggtcgagctgaagacacgtcccgaatccgaagagctgggaaccaagattatcattgcgggttccaaagtggagagtcaggaagcggtgtcttgtcccaaaggaagcaatttttctattaagaatctctttttcaatattcctgcccggcgtaagtttctgaaggctaactccaccgagctcagtaatattctggccgaatttgaacgtattgccctggtacatcctgaggttgctttttcactgtatagcaatgactccgaactgttcaatcttcccgcttgccatttgcggcaacgtattctttctgtttttggcaagaaacttaaccaacaactgctcagtgtagaagtcaacactacaatggtgaaagtttcgggttatgtagccaaacccgaaacagcccgtaagaaaggcgcccatcagtatttctttgtgaacgggcgctatatgcgtcatccttatttccataaggcagtgatggatgcttacgaacagttgattcccgcaggcgaacagatttcttatttcatttactttgaagtcgatcctgccaacatcgatgtgaatatccatcctaccaaaacagagatcaaatttgaaaacgagcaggctatctggcagattctttctgcttcgatcaaggagtcattgggcaagttcaatgctgtcccttctatcgatttcgacacggaggacatgcccgatattcctgcttttgagcagaatctgcctcccgcgccgcctaaggtacatttcaattccgatttcaacccgttcaagccctcctcttcttccggtggaggcaactactcccgtccgaaagtggactgggaagatttgtatggcggtcttgagaaagccagtaagatgaatcagcctttctccgactccgatcctgaatcggaagagtttgcggtgatcgaagaagagagcattgctacagcggctcccgaaactctttatgccggtgagccggccgtgattgaaaaaggtacgcagcatttgcagttcaaagggcgcttcatccttacgtccgtgaagtccggattgatgttgatcgatcagcatcgcgcacatatccgtgtgctctttgaccgttatcgtgcccagattcagcagaagcagggattctcacaaggtgttcttttcccggaaatcctgcaacttccggcttccgaggcggctgtgttgcaaagtatcatggacgatttatccgcagtgggctttgatctcagtgatcttggtggcggcagctatgccattaacggagtaccttcaggcatcgacgggctgaatccggtcgatttggtacgtagcatgctgcacaccgctatggagaaaggcaatgatgtcaaagaagaaattcaggatatccttgcgttgactcttgcccgtgcggctgccattgtctatgggcaggtgctgagcaacgaagagatggtcagtttggtcgataatctgtttgcctgtccttcacccaactatacgccggacggacgcgtggtgctgactaccataaaagaagaagagatcgataagcttttccggtaa

SEQ ID NO: 2935 - DNA, 711 bp, B.fragilis
tgctttttatttatatttgtacagagcaaaaagaagcaaaccataaatacagacaaaggctacatggaagcgaaggcagaaatactattagttgacgatcatgcactggttcttgaaggaatgcggcgtatgctggagtcggtctctgatgtcagagttgccgatgcggtgacttcgggggcaaaagctgccgagctgattggagagcgggattatgacatctatgtgttggatgtgaatcttcctgatatatcaggattcgatctggttgatatgattcgtgagattaacgagagtgcgcgtattattattagtactatgcatgaggaaatctggattatcaatcgtttgattcgccagaaagtgaatgctgtgatccttaaatcatccgaagcggtagagtttgaaaatgccgtgaaaagcgtgcttgaaggaaatccctatacttgtccgcggtttcaatctattcgtcaaaagctaagtctcagtcctgtacaaattcactcgaaagatatccctacaaagcgagagctcgatgtactgaaagctgtcgcgaggggatgtaatacgcacgaagtggctgccgaattaaaaatctcggagaatactgttgagacatttcgtaagaggctgattcaaaagttctgtgcaaagaatgctattgatatggtagtgaaagcaatgtcaaaaggatggatagaactcgaatga

SEQ ID NO: 2936 - DNA, 1233 bp, B.fragilis
tacttaatatttaatgcaatgaattattacttatatatagaaccttatactcttttttttcgaaaaaagggtgaatgccttttctataatactttaaataagaaggtattgaaaatagatgtatctaatgatatgtattttattctggataaactggaaacagataaatacactatattatcagacgaaaatcttcaaactcaaacggtatctttttgggtgaatagacttagagaaacgtttaatggtgatattcttccattttcagacgggagcgttcctcccgccatctttcctcctttcataaataatcagagggattttgaaagattgaatacttatgaatgggtagagaaggataatcaagttatgaattacttagaagaaatatatctttatttgaatggttgtgaggaagaggacgattcaatctggaaacagatcccttcatatttatgtagcgataaagagatggatagcagaaaactcctgcaatggttagatggttgtatagataagcaaataagtcaagtctatttattgggtggagatgtgttgatgtataaagacttaaatgaaatatggggaatgctggagcaaaaatctatgagtattcagctttattatcgatacgacctttttacagaaaaccataaaaaacttttgaatgctacaatcgggcagttaacttttgtggtaccgatgtggaaatttgatgaggaactattttcttctctgagccgtacggtagaaggcatagaacagaataaacggtggttattcctgattacatcggataatgagtatgaacttgctgagcaattggtaagcaagtactcgttagagagtagatcaataagacctgtttataaggaagataacctttctttttttaaagatgctgtatacttggaagagactgatatttgtaatacttgtttggagaagagagatttttatgtcagtcagaaaataaataagaatgattttgggcgattaactgttttacctgatgataaaatatatgcaaatgttaaccatgctgagattggagttatggagaaagatacaatagcatctgtattgtataaagagatgaccgaaggtcattcctggcttcgcatccgcgatcaaaaaccttgctgtgactgcatttaccaatggctgtgtccttcgccctctaattatgaattggctattggaaaaccgaacctctgtcatgtgaaaccataa

SEQ ID NO: 2937 - DNA, 1620 bp, B.fragilis
gtcagcgcttttttattaataattcacaccttatttattacgtacgataaacaatatttcgtaactttgcgcaccaaatacttaataagcaaatcaatgtctgagtctaaaagaataaaaaccgctttggtatcggtttatcacaaagaaggtttggatgaaatcattaccaaactgcacgaagaaggagtagagttcctgtcaacaggcggaactcgtcagtttattgaatcgctgggctatccctgtaaggctgtcgaagatttgacttcgtatccttctattttgggtggtagagtgaagacgctgcatccgaaaatattcggaggaattctttgccgccgtggactggaacaagacatccagcagattgagaaatatgaaatccctgaaatcgacctggttattgtagacctctatccgtttgaagcgactgttgcttcgggtgctgatgaggctgctattatcgaaaaaattgatataggcggaatctctttgattcgtgccgctgccaaaaacttcaatgacgtaattattgttgcttcacaagctcaatataaacctttgctcgatatgttgatggagcacggggccacttcttctcttgaagaacgtcgttggatggctaaagaggcatttgccgtatcttcacactatgattcggctatcttcaactattttgatgctgaagagggttctgctttccgttgctctgccaatagccagaagacgttgcgttatggcgaaaatccacatcagaagggatatttctatggaaacctggatgagatgttcgatcagattcatggaaaagagatctcttataacaacctgcttgacatcaatgccgctgtcgatttgatcgatgagtttgacgatgtcacatttgctattctgaagcataataatgcttgcgggctggcttctcgtcctactgtgcttgaagcatggaaagatgcgttggccggtgatccggtatctgcctttgggggggtgctgatcacgaatgcggttattgataaagagacagcggaagagatcaataaaatcttctttgaagttgtgattgctcctgattacgatgtagatgcactcgaaattctgggacagaaaaagaatcgtatcattttggttcgtaaagaggctaaattgccgagaaagcaattccgttctttattgaatggtgtattggttcaggacagagacttgaatattgaaacaactgcagacctgaaaacggtaactgataaagctccgacaccggaagaggtagaagatatgctgtttgctaataaaatagtaaaaaacagtaaatcgaatgccattgttttggccaaaggaaaacaattgctggcaagcggtgtgggacagacttcacgtgtggatgcactgaaacaagctatcgaaaaagctaagttgtttggtttcgatttgcagggtgcggtgatggcatcggatgctttcttccctttccccgattgtgtggaaattgcggataaggaaggtgtgacagctgtgatccagccgggcggttcggtgaaagaccagttgacatttgactattgcaacgaacatggcatggcaatggttacaacgggtatccgccactttaagcactaa

SEQ ID NO: 2938 - DNA, 384 bp, B.fragilis
caaactcttacgtttatgaattttaaagaaagtaaagccatttatctgcaaatagcagatcgaatctgtgacgagattcttctcggacagtatcaggaggaagaacgaattccttctgtaagggagtatgcagctatggtggaggtaaatgccaacacggccatgcgttcgttcgattatcttcagtcacaagatatcatttacaataaacggggtattggttattttgtttcttccggcgcaaaggagctgattttttcacttcgtcgggagacttttctgaaggatgaacttgagcatgtattccgtcaactctatacacttggagtttcggatgacgagttgttgactatgtaccgtaactttatgatgaaacaaaaataa

SEQ ID NO: 2939 - DNA, 663 bp, B.fragilis
aaacgaacaactatgagtgctgaagtacaagaaagcggtaaaaagaaggggaatagcaaacagaagaagatgacggttcgcgtagactttacgcctatggtggatatgaatatgttgttgatcactttctttatgctttgtacctcgctgagtaaacctcagacgatggagataagcatgccgagcaatgataaaaacatcaccgaagaacagcaaagcaaggtgaaagcttcacaggcaatcactctgttactgggccccgatgacaaactatattattatgaaggagaacctaattacaaggattatacttcgctgaaagagacgacgtataaaccggatggattacgggggatactcctgaagaaaaatgcgactgctgtcagacaagtcaatgatctgaaacagaaaaagctggaacttaagatatcagaggatgaatttacgaagcaactttctgaaataaagagtggaaagaatactcctacagtcatcattaaggcaatggataatgcatcgtataaaaatctgattgacgctctcgatgaaatgcaaatatgtaatattggtaaatatgtgataacgaacattgctgaagccgacgagtttctggtgaagaactttgaaagcaagggtgaactttcacagaatattgccgactaa

SEQ ID NO: 2940 - DNA, 1422 bp, B.fragilis
tttaagtctgcaaatatacgactttacctcaaaacctcttacctttgtagctcacaaaaagaggcaaaagctaacatcatgagatccatactgatagttgaagatgatattacgttcgggatgatgctaaaaacctggttaggcaaaaaagggtttaatgtatcatcagtgagtaacattgcacgtgcgcaaaagcacatcgatgcacaaccggtagacctgattctttccgacttgcgacttcccgaccacgatggtattcacctgttgaaatggatgggtgagaaagagctccatatcccattgattatcatgacaggatatgcagatatccaatcagccgtacaagcaatgaaactgggtgcacaagactatattgccaaacccgttaatcccgaagagctgcttaagaaaatgagcgaagcacttcaaaagaaagaagctcctcttcccaaaactcccctcacggagaaaagccctaaaaccaaacaagaatctcattcctatctggaaggagaaagtgatgctgccaaacaactctataactatgtcagcctggtagctcccaccaacatgtcagtcctgatcaacggtgccagtggaacgggaaaagagtatgtagcccatcgtattcaccaattaagcaaacgtagcgacaaaccgtttattgccatcgactgtggctccatccccaaagagttggccgcttctgagttcttcggtcacatcaaaggctccttcaccggtgctctctctgataaaaccggtgcttttgtagcagcgaacgggggtaccatctttcttgatgaaatcggtaacctgagttacgaaatacaaattcaacttcttcgtgcactacaggaacgtaaaatacgccctgttggttcaaactcagaaattactgtcgatatccgtctggtgtctgcaaccaacgagaacctggaacaagccatcgaaaaaggtacattccgcgaagacctctaccaccgaatcaatgaatttactttgcgcatgcctactctgaaagaacgtggcggagacatccttctttttgccaacttcttcctcgaccaggctaataaagagcttgacaagcaactgatcggcttcgatgccaatgcttcaaaggcattactcgaatatcactggcccggcaacctaaggcagatgaagaatatcatcaaacgcgccacattgcttgctcaaggcagtttcataggccttgcagaactgggtagtgaaattctggaaacacaactatcaactcccaaaatgacattacgggatgaagatgccgaaaaggaacatatactggaagcactccgacaaacaggaaacaacaaaagccgtgctgcacaattactcgatattgaccgcaaaacattatacaataaactgaaactatacggaatcgacctctaa

SEQ ID NO: 2941 - DNA, 1296 bp, B.fragilis; identical to SEQ ID NO: 845

SEQ ID NO: 2942 - DNA, 867 bp, B.fragilis
gctactggggcagggcggttatcatatatctgctattcaacctttggagaatactttggaatcggtttatttaaaattaacttcacaaacaaaatgaggatattaagagacttacaaaatgtcatagcatcagaatattataaaacacgtcacgatgtagctgcaaagttatttctattcttcccggtgttgttgacagtagctttcattgtgtatgatttatggaatctgagtcaggaaggctatgacggtacgaacttgtggatatacaatatcggacgtacgttattcatgttttacggtatgttgtatccattaatggcagccttgttttgtgcggcctatataggaaaagagtttaaaaatgacaattaccttctcttgtttttatttcctgttcccagaggcactgtttatgtagctaaacttatttaccttctatcaatgacattcttgtcagttcttatcgcctatgttgcttttatgttatcaggctttattttgggcgtttgtttaccgtcaatgggctttcaaaattttgatgtgagaattttagtgatttctgtcttctttcgtgtttttattgggctattgcctatccttgttattcaatatgtgtttagtttcttgtttaagaattatgctttagcactgggatttagtttttttatgactgtgttttcgatgattgcgagtaattggcgttacattaattttattccgtattcctccattttacatgcatactcttcatttatgcagcaaacggtttattattggaaatcatttgaaaccattaatatcagttattttatagtcttttctatcgtgggttatattttatataggtataaaaaatggcggtag

SEQ ID NO: 2943 - DNA, 1542 bp, B.fragilis
cctaaaatttactttaccatgataggatatagaaacttactgatatcgttattttgtagtatggctgtttctgctgccggacagccgcgcttagtaaaaagccttgtgcctgatatgccatcgcaagcttccgattacttttgcacgtggaatttacaaggctatgtggccagctataaaagtactgaactgaccagggctgctatgactgaagattatttatttggggacgggctttatcagaattgggtggattgttatcctgcaatccgaaaagatctttactttgtaatggacgattcgtgggatattcctaaagatgtgaatgattcacccaatccttatttaggttgcgtagaactgagttctgatcgttttccgtcttttcgtggagatgcagtggagcgtttgaaacaattatcggaacagatcaagagtaaaggctggaaaggtgtcggtggatggatttgtgcccagaaggcagagacgcatgcagctattcctgaagaggagtattggaaacaacgaattaaagcggcaaatgctgccggatttgattattggaaagttgattgggggaaggaagacaggaatggggaatggagaagaaagttgacagctatcggcaagcgatatgctccccatttatatatagaacatgctttgcgaaatgaatttattgagtttagcgatgtttttcggacctatgatgtcgaaaatattacggcgcagccgataactatccggcgtatttgtgatttattgccttataagacagtcgagggagcgaaaggaattattaattgtgaagatgaaccttatattgcggtaggtttgggctgtgctatcggtgtgatgcgacatccgttcgcagggactttgccggatggggcacaagattttgtgtttcctccggtcggacgtgatattaagcggcgtctggatgaagtcgtgcgtggtgtcagatggcatcggatagctgagccgtttgcagtgggttacgggactttcgccatcgacagtgtgaagttaaccgatcattggattctacaggaaaatgagacttggaataaggggcgtacggtgggtgcagatgtaacggccgatgcaccggcgcgggttgctcggaatatgaagttaccggaggtatccggagctcctttgtcggtttgtccgtttgtgttggcttcccgataccccaatggcgctgtagccgtttctactataggccgtaatgtaggacgtgagtatgtaaccgaaaaggttgctgtttcgatatccgtcgaccgttgggacatacctatcggactatttggttatttcaaagaagtgacaatggtgtttccttctccattgaaaacaggaaagcatacggtttttgcgcaggatctggccggtgagaatccggtggacattacttccaatgttgtaatcaaggataatcgattgataattccgggagaagtaattagccgggtaggacttatgaatgcttcagaaggagattgttctgatccggggatggtgataagggttatgtag

SEQ ID NO: 2944 - DNA, 810 bp, B.fragilis
aaacgaaattttatgaaacgtactacatatatatttattggcatacttgtttcggtactcgtgatactgatggcaggtgtcgtttatatttctttccagaaatcagaaactaattcgtatacactcactttgtcggagaagatacttagaacagagttttccggtatccgtgctgtcaaagtgtatgcaaacgacacgcgtcgtgtgtggttggacgaagcttgtgtgaatgttgtttcttctacagatggaaaaaccagacttttaagtccggaatccgaatatctgaaaatcagtcagaatgcagatacattggtcatttgcctggatttgacaacttatgatcttcctaagcaaaaaaaggagtatcttattccggccctgcaagctaaaggattacaactgaccatagaagccgactctaatctggcttttgtggctaatgctattcgtggattacgtacgagaatcgataggttgcatgccgactctttgactacatatataagaggaggggaattacgtttggactcttgtgagatacgtgctttttgtgtcgatggagatggagtgacatttaatgctcatcaatcaattattccccatctctatttagatttggatggcgtcaggaattggggcgttcatgaatctgtaattggtactgaacatctgaccggaagtggagtttatcataataacttgcagaggggtgagtgtaaaaagatgatctggactccgaagaaagaggacgccgaattgagattaactatacgggagaagggaagtttgatacttcaagaagaataa

SEQ ID NO: 2945 - DNA, 252 bp, B.fragilis; identical to SEQ ID NO: 860

SEQ ID NO: 2946 - DNA, 303 bp, B.fragilis
ccaatattcctcactgctgcctcccgtaggagtttggaccgtgtctcagttccaatgtgggggaccttcctctcagaacccctatccatcgaaggcttggtgagccgttacctcaccaacaacctaatggaacgcatccccatcctttaccggaatcctttaataatgaaaccatgcggaatcattatgctatcgggtattaatctttctttcgaaaggctatccccgagtaaagggcaggttggatacgtgttactcacccgtgcgccggtcgccagcaaagaaagcaagctttctttctga

SEQ ID NO: 2947 - DNA, 852 bp, B.fragilis
attcttaataacaaattctttaacaaaaaaaactttattatggaaactactcaaaaaaagtcaactaagattgtaggtatcaagaatgccggattggttattatctgctgttttattatagcagtgtgtatctatcattttattttgggaaatcccactaactttatgaacaatgaccctaacaaccatccgcttccgggaaactttatgggaaccatttacaaaggtggtgtgattgtgcctgttatccaaacgttattgctgactgtattggcattgagcattgaacgctattttgctcttcgttcagctttcggtagaggttctttggttaaatttgtatctaacattaaagaggctttgtcggtaggagaccttcggaaagctcaggaaatctgtgacaaacagcgtggctctgtagcaaacgttgtaacttctacactacggaagtatgaggaaatggagaatgaatcttctctctcaaaagatcagaaactacttgccatccaaaaggaactggaagaagctacggcgcttgaacttccaatgatggaacagaatcttccgatcattggtactattactactttgggtactttgatgggattgcttggtacggttatcggtatgatccgttcgtttgccgctttggctgcaggtggttctgctgattcaatggccttgtcgcaaggtatttctgaggctttgattaacacagctttcggtattcttaccggtgcgttggcagttatctcttataactactatacaaacaaaatcgataagttgacttacagtctcgatgaggtcggtttctctattgtgcagacttttgcagctactcataaataa

SEQ ID NO: 2948 - DNA, 198 bp, B.fragilis
aacaagatcaaaaccatgaatggatatttgcctgtaggccgtttttatagactttaccggattgtggcccgcaaaaaacgagaaacagagggttacgattatcaatttgacacattgacaaaccgaccatctcctccctcgcgactcccggagggtgatttaaagttcaccggcagggagcgtaccaaagaggtgtga

SEQ ID NO: 2949 - DNA, 195 bp, B.fragilis
cctccaaccaagttggatgacattccttcagaatgccgggttgtcccattcggaaatcttcggatcaaaggtcatttgcacctacccgaagcttatcgcagcttatcacgtccttcatcgcctccgagagccaaggcatccgccatgcgcccttatttactttcttttatcgccagattcatctccttttcttaa

SEQ ID NO: 2950 - DNA, 2379 bp, B.fragilis
ttgattaacaacagagatttaaacaggatgatacgtaaagaaacagttcatataatatggggtaccatacaagccggtcttgtaatgttgttgttgggagcatgttccacaaccaagcacctgcccgaaggggaaatactctacaccggatcgaagactattgttgaaaacgagccacaagcgcctttgacagaggatgcgctgaccgaacttgatgccgcactcgataaagctccgagtacaaaaattttaggctttgtccccatccctttcaagatgtgggcttataacagtctggttcgctataagaaaggtttcggacactggctcttcaaccggtttgccgccaatcctcccgtattcatttctacggtcaatccggaaatacgtgccaaagtaggcaccaacctgttgcacgactatggctactttaatgggacggtccgattccagaccgtgcccgacaagaaagacagcctgaaggcaagtatacgctatacggttgatatgaaagacccttattacatcgatacggtttattacactcgtttcaatccgcgtacgttgagaatcatggagagaggacgcagaggatcgttgttgacccccggtgaacagttcaacgtgagtgatctggatgcagagcgcagccgtatcagtactttattgcgtaatcgcgggtatttctactttcgtccggactatatgaagtatcaggcggatactctgttgaatcccgggcatgtcagtctccggttgatacctgtaccgggacttccggatgcggcccagcgcccgtattatgtcggtaagacatcggtctttttgtacggaaagggtggagaagtgccgaacagtacactcgaataccggggactcgatattcattattataagaagatgcaggtgcgtccgaatatgctttaccgttggttgaattatcaggcttatgtccgcaatgattctttgcgcaactctgctcatagccgtttatacagccagtatcggcaaacgcgtatccaggaacgcctttcgcaactgagtattttccgctatctcgatctgcaatatatccctcaggactctacggcaacttgtgacacgctgaacgtgcgtttgcaggctacgtttgataaaccgtatgacgcggaactggaattcaacctgaccaccaagagcaataaccagacaggccccggtgcatctttcggcctgacccgttacaatgtatttgggggaggagagacgtggaatgtcaagttaaagggctcttacgaatggcagaccggacagaataaaggaagttcattgatgaatagttgggagatgggagtatctactgccttgacttttccccgggtcgtgttcccttctttcggaggacgtgagtatgacttcccggcaaccactactttccgtttgtatatcgatcagcttaaccgtgccaaatactataaactattggcgttcggaggaaatgccacttatgactttcagccgacccgtatcagtcgtcacagcctgacacctctccgggtgactttcaatgtgctgcaacacacaacgaaggcctttgaggaaattgctgatcagaacaaagccttgtaccgtagtctgcagaatcagtttattccggcaatggaatatacctatacttttgataacgcggctttgcgcggagtgcgtaatcctatctggtggcagactacgtttacttccgccggtaacataacttccggtatttatcgtattttcggaaagaagttcagccaaagagacaagaaactgttcggtgttcctttcgcacagtttctgaaggtgaacagtgacttccgttatacctggaagatcgataagaaccagtccatagccagccgtgtggctggaggaattatctgggcgtatggcaatacaaatacggcaccttacagcgagcagttctatatcggaggtgccaatagtgtacgtgcttttactgcacgcagtatcggaccgggtggattccggccgacaaagacttcgaaagggctctatctggaccagacgggagatatccggatggaagccaacgtggaatatcgtttccgcatttacggtgacttgcacggtgctgtctttctggatgccggtaacgtctggatgttgcgtaaagatgaagaggcaccggaaaagcaactgcgttggaagactttcggcaaacagattgcgttgggaacaggtgccggtatacgttacgacctcgacttcctgattctgcgtctggattgtggtgtgcctttgcatgatccgtacgataccggcaagaagggatattacaatgtgaccggttctttctggaaggggttgggactacactttgccgtaggctatccgttctaa

SEQ ID NO: 2951 - DNA, 852 bp, B.fragilis
ataaagttaaattatagtgttgcggaattaaggctgaatatcgtggggaactatatcttgattaacggtaaacttggatttcccgaacttggattattgggtgccggaatcagcacgttgttctcacgtattgtcatggtgctggtatttgcattcgtgttttttagcagccgccgtttcttacgttataaactgggatttattcgcttgggatggtcgcgtacattgttccgtcagctgaatgccttaggatggcctgtagcttttcaaatggggatggaaaccgcttcatttagcttgagcacagtgatggtaggatggttggggactatcgcccttgcctcacatcaggtaatgcttactatctcacagttcacgtttatgatgttttatgggatgggggcggcagtagctgtgcgtgtcagcaatttcaagggtcaaaacgatattgttaatgtacgtcgtactgcgtatgccggggcacatatcatattggctatgggagttgttctgctgtctattgtcttcttgttccgctatcaggtaggaggatggtttaccgacaataccgaagtctctgcgatggtagttgttctgatggtgccttttctggcttatcagttcggcgatggaatgcaaatcaatttcgctaatgccctgcgtggtatttcggatgtaaagcctatgatgctgattgcttttatcgcctattttatcatttctctcccggccggatatttctttggatttgttatgggctggggattactcggggtctggatggcttttcctttcggactgagtagtgcggccattatgttatggttacgtttcagatataaaacaagataa

SEQ ID NO: 2952 - DNA, 1044 bp, B.fragilis
cgcattagaaatttattcattatgggattattctcttttacacaagaaatagcaatggacctcggtacggccaatactatcattattaccggtggtaagattgtagtagatgagccttcggtggtggcccttgaccgtcggacagacaagatgattgctgtaggtgaaaaggccaagctgatgcacgaaaagacgcacgagaatattcgtaccatccgtccgttgcgcgacggagtgattgccgacttctatgcttgcgagcagatgatgcgcggactgatcaaacaggtaaatactcgtaaccgccttttctctccatcgcttcgtatggtgatcggagtgccttcgggtagtacggaagttgaacttcgtgctgtccgtgactctgccgaacatgccggcggacgtgatgtctatctggtatttgaacctatggctgcggctatcggtatcggtattgatgtagaagcaccggaaggaaacatgattgttgatataggtggtggttctaccgagattgctgtaatttcattgggaggtattgtttcgaacaactctattcgtatagcgggagatgatctgactgccgatattcaggaatacatgagccgtcagcataacgtgaaagtcagtgagcgtatggccgaacgtattaagataaatgtgggtgctgctttgaccgaactgggtgaggatgctcctgaagattatatcgttcacggaccgaaccgtatcactgcacttccgatggaagtgccggtatgctaccaggaagtggcacactgtcttgagaaatcaatctcgaagatagaaacggctattctgagtgcgttagagaatacacctcctgaactgtatgccgatattgtgcataatggaatttatttggccggtggtggagcgctgcttcgtggcttggacaaacgtctgactgataagataaatattcctttccacattgcagaagacccgttgcatgcagtagctaaaggtacaggggttgcattgaagaatgtagaccgtttctcattcttgatgagataa

SEQ ID NO: 2953 - DNA, 213 bp, B.fragilis
gtaatcagaaaaacaattaagaaaacaaccgtaaataccaaccaacgggaaaagtatttttcaaacgatgtagcaggagtcatcagaacagagagccgcccggttttcgatttcatcctctccattgtgaacgaagcactcaagcaaccgaatacacaaagcccccacataaaaatcaccagattgaactcccaggtactatctgtatcttga

SEQ ID NO: 2954 - DNA, 2397 bp, B.fragilis
ttatatatgaagaaactcctttgcctgataatactccttttctcttttattcggtcggaagcccagtctgatcatatctgtcctcacgagaaactttatgtccatacggatcgtgccaattatgagcgtggtgatacggtccgtttccgtgcttacctgatggatacccgccacgaggcaacggcttacagccgctacgtttatgccgaactgctggctgacagtcaggtcatctcccgtgagatggtcaaggatgatcacggtgtcttttccggttacctctctttgggcgatacacttcgttccggcaattatacgcttcgtttctatacccgttatctttcttctttgcccgctccccgttacttctatcgtcagatcattgtcggcgggcgtccctttcaggattaccgcaaggagagcgtgactcgtatggcggcttcctaccatgtctctttctttccggaagggggacgtctcccttcgggttgtgtcagccgtgtcgctttcaaggctttgagtcccgatggtttgggaacagatgtgcagggctttgtggtcaatcagcgtggagataccgtcaccacgttgcgttccgtccatcgggggatgggcttcttcaatcttgaacctgtttcgggtgacagctatacggcggtgtgccgtaatcgtgaggggatggagcttcgctttccattacctccggcagatccttctgccgtcagcctccgtgtcgatgtccgtaaggatgactttctggtgcgtttgaattcaggtgtttctccgtctccgggtcattcccttcgtgtggaatatcgggatagtattcttttgcatgcggctttctccggttccaggcctttgcggcttccccgttctccgctgcctccgggtgtactccgttttgttttgttggatggttcgggcgttcctataagtggtcgtaccgctttcaatcagagttcttccgtgtgtgccgacgttgatttctcggctcgcttgaaagaagagaagggacgttcgttttgggatgtcagcttggggcttcgtgattcctcgggtgagccgttgggcggtaccctttctgtttcggtcaccgacgaccgctatgcacttcaggataccacggtgaatatcctttcttcttttcttctgagttctgaccttcagggctatgttgaggctccctctttctatttttccggtgatgactcccgtacctcgtatctgttggacttgttgatgctgactcagggctgggtgaaatacagctttgttccggattacggttcctttccggtggagcgtagtcagtgtgtcagtggcaaggtggtttccgaatattcggaaaagaagtgtatcgctgatgcggttgtcactttattctctttcgataaaaagattatgcgtcagacgacgagtgatgcttcgggctgtttccgtttcgacagtctttccttcccccggggtacgcatttcattcttcaggcgcgtaagaaaaagggaggtacagatgtggcgctgttggtcgatcgggattccgttccttctgtacattcttctcttcccgtttatgcggattggtttcgtgcagagatggatgaaccggttgtttccgaacaatccggtaatgatccttctccgaccagtgcgaatgtgtttcaacgatcttctaccgtccctttttccatggagcaatatttagacgaagttgttgtttccactaaaaagattgagaaaaagaaacggtatgcaatcgaatctttaatggctcactccgattggaataagacttatcatgtggacgaaatgactctttcgccttattcatctactaaagatttgttgattaatactcccggagtagggtgggcagtcgattcgaattcaggagatttcttttatataacacggttgcgtgcaggaggaagttccactcctcctccggctctgttaatggtagatgggctggaaacttcttattccgaacttgtcggcatccctgtatccatagttgaatccatcgagttggtaaaagatgccgctcagatggcatatatcggatctaaagcatcgaatggcgctattttgattagtacaaaatcaggtttaggcactgttggtaagaaagcatccaattttaggataattcgtcccataggatatcaggtgaagcgtgagtcttattcgccttcttatccggttgtttatggtgcaataaataacggtgggaatagtttcagaacaatatactggtcaccggatcttctgcttgataaagcggcttctcatttggagttcggtaatccgaaacagggtcgactgactcttgttgttcagggaatcacaccagatggaaagttgataaatttgactcggactttaggtaatgaataa

SEQ ID NO: 2955 - DNA, 1440 bp, B.fragilis
attacaatgaaacgatttcaactgtttttagtaggagcatttgtagcagccggtccgctttttgcgcaatcggcagatgctgattggcacagtgaggttgccaaagtgaaagaacttattcagactaatccggcgcaagcttccgaggaagccgcacaattgctgaaaggtaaaaataaaaaaaatacggatcttctgattgccattggacaagcctatttggaagccggtaaaattaatgaggccgaagcctatgctgctcttggacagaaagctaacagcaaatctgctgcggtttcggtgctgcaaggtgacattgccgtagctaagaaagatgccggaaaagcttgtcagttatatgagcaggctatctattttgatcctaattataaagaagcctatctgaagttcgctgacgtatataagggggctagtccgcaacttgctatcgagaagctggaacaactgaaaaaccttgatccttcgtgcgtggctgccgataaaaaattggcagaggtttattatctgaataataaatttgataaagcggccgaagcttatgcgcattttatcaatacaccggaggctacggaagatgatttgacgaaatactcttttgcgctttttttgaaccatgattttgagaaatcacttcagatagctttgatgggtttacagaagaatccgcgtgatgctgcattcaatcgtttggctatgtataactataccgacctgaaacgctatgatgaagctatgaaagcggcggatgcgttctttaaggagtccgataaggcagatttttcttatcttgattatatgtatttcggccatctgctcaatgccgtgaagaagtatgatcaggcagttgaagcttatatgaaagcgatcacgcttgatcccgctaaaacagatttgtggcgtgaagtttcttcttcttatgaattgaataatgaatttacaaaggcaatagaggcctataaaaaatatagcgaatcgttgagtgccgacaagcgtacccctgacgtacagttccaaataggaaagctttattacgaaaagggtacgcaatcggatacgttaaccgtttcgctggatgagcggaaggcggctcttgtttctgccgattccatttttactgagattgctaaagtggctccggatagttatctgggtaacttctggagagcacgtactaattccgcgttagacccggagaccactcaagggttggctaaaccttattatgaagaggtggctgccttcttgattgataaaaatgacccgaggtacaactcagctttgattgagtgttatagttacttgggatattattatctggtagctaacaaacttcctgaatctaaggagtattggaataaaattctggctatagaccccgctaatgctactgctaaacgtgcattggatggcatcaaatag

SEQ ID NO: 2956 - DNA, 564 bp, B.fragilis
ggtgcgtgtgattgcaagaactggtcagagagagcaaaaagagttggaacaaaagagtttggcgcaatgattatcaactatatacatagagtaggatggtttgtcggtctgatattacttcaggtgctgatcttgaataatgtgcacatagccggtgtggctactccttttctatacgtttattttatattaaaatttaactccggtacttcccgaaacgaattgatggtatggggtttctgtatggggcttgccatcgatatcttttctaataccccgggtatgaatgcggcggcgacagtactactggcttttctacgtccgttgtttcttcgcttgtttacgcctcgagatactttggatagtatcgtaccttcgctgaaaagtatgggaattgcttctttccttaaatatttggtggtaagtgtctttgttcaccattttatgttactgactcttgagttcttctcatttaccagcataccgttgttgctgttaagggtggtgtcgagcaccattttgactataacctgtattatggctgttgaaggagtgaggagatag

SEQ ID NO: 2957 - DNA, 309 bp, B.fragilis
agagttagttttatagtagtagcaatgtttatgtttgtttgtgatggttttaacctagaccttaacatgaaattaaaaacagacaatcagaactttaacaagaaaataattatgaaaaagttagttttagtagtagctatgtttatgtttgcttgtggatcgttctttacaatggcacaggatccggtgaaaaaagacccaaagaaagaggtcaaagacactgcaaaaactgagcctaagaaagaagtagccgacacaaccgctataacggtcgcagcatcaggagcatttgcacagtttgccgaataa

SEQ ID NO: 2958 - DNA, 198 bp, B.fragilis
aactatacggaatcgacctctaaagaacaccaaggtgtggaatatttccacacccttttccacattttccacaacattccacactgcatcccatttccattcattttttactcacctacaaatcaacagattagttcacacgtattctttttggcacaagatttgggaaatactcaatacaagtgtttaaccaaatga

SEQ ID NO: 2959 - DNA, 1092 bp, B.fragilis
aggagtgaggagataggtatggcaaaagattatgttttagagaaacggaaatatgtgatcggcggagtagcattggctattgtcctgatttatctgctgcgtctgttttctctccagatagctactgatgactataaaaaaaatgccgacagtaatgctttcctgaataagattcagtacccgtcacgtggggcaatgtacgaccggaatgataaactgttagtgtttaatcagcctgcgtatgatataacaatggtgccgaaggaagttgagaacctcgatacactcgacttgtgccagacgctgaatatcactcgtgcacagtttctgaagataatgagcgatatgaaagatcgtcgcaggaatcccggttattcacgctataccaatcaggtattcatgtctcaactttcggcagaagaatgtggcgtatttcaggagaagctatttaagtttcacggattctatatccagcgacgtaccattcgtcaatatagctataactccgctgcccatgtgcttggtgatattggtgaagtatcaatgaaagacatcgaaaatgatgattactacatccggggagactatatcgggaaacagggtattgaaaaatcatatgaatcttatttacggggtgaaaagggcgttgaggtattgttgagggatgcgcatggacgtatacagggacattatatggatggaaagtatgataagcgtccgatacccggaaagaacctgaagctcggaatcgatatcgatctccagatgttgggagaacgcttgttgaaaaataaaatcgggagtattgttgctatcgaaccggagacgggagaaatactttgcatggtttcttcacccgattttgatccgagactgatgattggccgtcagcgcggaaagaaccacttgatgctccagagagatccgatgaaacctttgttaaaccgttcgattatgggagtatatcctccgggatcgacgtttaaaacggcacaagcgctgactttcttacaagaagggattattcagaccaatacgccggctttcccttgtggtctgcaccacagggcggaaggatccagcggtggtcta

SEQ ID NO: 2960 - DNA, 183 bp, B.fragilis; identical to SEQ ID NO: 2746

SEQ ID NO: 2961 - DNA, 873 bp, B.fragilis
atcgtagtttgtaacttatatgtctttatgcggaatttactgaactttcttttgaaatataatcactggttcctcttcattctgttggaggtgatcagttttgttttgttatttcgctttaaccactaccaacacagtgtttatttcagttcggccaatgtagttgccggcaaagtatatgaagtatccggtggaataacttcttatttccatctgaagtcggtcaatgaggatttattggatcgcatcatggagttggagcagcagaaccgcaatctggagaatgcattagtaaaacatctctctgactcaaccgagctgaatagtatccgaaacttgtcggatacagactatgaaatcttcaaagcccgggttatcaataacagtctcaatctggtagataactacatcactctgaatcggggatcgaaggatggcatccgtcctgagatgggcgtggtcgacggtaatggggtggtcggcatcgtatatgaaacttcttctcactattcccgggtgatttcggtgttgaacagcaaatccagcattagttgtaaaattgtgggtagtgagtatttcggttacctgaagtgggaatatggagatgcccggtatgcttatttgaaagatttgcctcgtcatgccgaattcaatttgggagatacagttgtgaccagtggttattccacggtttttcctgaaggtattatgattggtacggtagatgatatggccgattcgaatgatggcctttcctatctgttgaaggtaaaactggcaacggattttggtaaggtgagtgaggtgcgtgtgattgcaagaactggtcagagagagcaaaaagagttggaacaaaagagtttggcgcaatga

SEQ ID NO: 2962 - DNA, 2046 bp, B.fragilis
tttattaagtgtatgaaagtaattaagtatttaccaattcttgcaatctgttgtatggcaacaggatgcaacagtaagaaagaggccgtacttacgtccggcattgaccttgccaaccttgacacaactgccctgccgggcaccagtttttatcagtatgcttgtggcggatggatgaaaaaccatcctctgacagatgagtattcacgtttcggttcattcgatatgctcgccgaaaacaaccgtcagcagttgcgtggactgattgaagggctggctgccgaaaaacatgaagccggcagcattgcacagaaagtcggtgaactttataatatagctatggacagcgtaaaactgaataaggaaggcgctgcccccattaaacccgaactggagaaaataggtgccatcaaagataaagctgaaatctatccgttgattgtagaaatgcagaagagagggatgtatccgtacttcattctgtatgtcagtgctgatgacatgaatagcaatgaaaatatggtgcataccatgcaaggtggcctgggcatgggcgaacgggattattatttggaggatgatgcgcagacgaaagaaattcgtgataaataccagcagcatgtaagtaagatgttccaactggccggatatgatgaagctactgcccggaaagctgtgaaagcagtgatgaatatcgagactcgcctggcccagtcggcacgttcgcaagtagaattgcgtgatccgcatgccaactataataagaagactttggaagaattgcaaaaagagtatccttcttttgcatgggatgtatttttctcaactgccggactgaataacctgaaagaagttaatattggtcagcctgatgcattgaaggaggtgaatgccatcatcgatacggtatcactcgctgaccaaaattattgcttgcagtggaatctgatcaattcagctgccaactatctgagtgacgactttatagcccaagattttgatttctatggccgtaccatgtcgggtaagaaagagatgcaacctcgttggaagcgtgctgtcagcactgttgatggttcattgggcgaggctgtcggacagatgtatgtagagaagtatttccctgctgcggctaaggagcgtatggtagcgctggtcaagaatttgcaggaatctttgggagagcgcatcaaggggctgagctggatgggtgaagagaccaaagaaaaagcacttgaaaaactggcgactttccatgtcaagatcgggtatccggataagtggaaagactactcttctctggaaataaaggatgattcatattgggccaacattgagcgtgccaaccagtggagttacaacgagatgatcggcaaatatggtaaaccggtcgataaggacgagtggtatatgactccgcagacagtaaatgcatattacaatccaacgacgaatgagatctgtttcccggccggtatacttcaatatcctttctttgatatgaatgcggatgatgccttcaattatggagcgattggtgtagttatcggacatgaaatgactcatggatttgatgatcagggtcgtcagtatgataaggatggtaacttgaaagattggtggacggcagaagatgccaagaactttgaggctcgtgcggcggtgatggctaacttcttcgacagtattgaagtagctcccggtgttcatgccaatggagagtttactttaggcgaaaatattgccgatcacggtggacttcaggtatcatatcaggcattcaaaaaagcgacggctgcggctccgttgaaaattgaaaacggatttacacccgaacagcgcttcttcttgtcttatgccaatgtgtgggccggaaacatccgtcctgaagaaatcctgaagcgtacgaagaccgatccgcattcgttgggtaaatggcgtgtagatggagcactgcctcaaatcggtgcatggtatgaagctttcaatattactgaaaaagatccgatgtacttgccggtagataagcgggtgtcaatttggtaa

SEQ ID NO: 2963 - DNA, 1269 bp, B.fragilis
ataaatatgctgcaaatcaacaggcatattctggataatggtttgagattggttcatgcgcaggacaccagtacgcagatggttgcgctcaatattctctataatgtgggagccagagatgaaaacccggagcataccgggtttgcccatctttttgagcacctgatgtttggcggttctgtgaatatacccgattatgatgctccgttacaattggcaggaggggaaaataatgcctggaccaataatgacattaccaattattacctcactgtacccagacagaatgtggaaaccggattttggcttgaatctgatagaatgttgagcctcgatttcagtgaacgcagtctggaggttcagcggggagtggtaatggaagagtttaagcagcgttgccttaatcagccctatggtgatgttgggcatttgttgcgtccgctggcttatcgggttcatccttatcaatggcctaccatcggtaaggagctgtctcacatagccaatgctacattggaagaggtcaaagatttcttttttcgtttttatgcacctaataatgctgttctggctgttaccggcaatatttcgtttgaagaggctttacatctcacagaaaagtggttcggtcctatcccccgccgggaagttcctttgaggcaattgcctccggagccggtacaaacggaagaacgccgtttggtagtggagagaaatgtaccgcttgattcgctttttatggcgtaccatatgtgtgaccgcgcggatagcgattattatgcttttgatatcttgtcggatatcttaagtaacggacgttccagccgtttgaaccagcatcttgtgcaagaaaagcaattgttctcgagtatcgatgcttatatatcgggaacacttgatgccggcttgttccatatcagtgggaaaccggcagccggtgtgtcgttggaagaagctgaggctgcggtgcgtgaagagttgaatgaactgcaatctgctttgatccaagaacaggaactcgagaaggtaaagaataagtttgaatctacccagatattcggaaatatcaattatctgaatgttgccaccaatcttgcctggttcgaattgaacgggcgggctgaagatatggaaaaggaggttgaacgctatcgtgccgtgactgccgaccgtttgaacgcggtggcacaaactgcattccgagaagaaaatggagtagtactttattataagagtagtagaggagagaaggatgagacttatatataa

SEQ ID NO: 2964 - DNA, 258 bp, B.fragilis
cattatcaccgccatagcaccatacatcaacgcaacacgaagcagattggacttccaattctccaccatctctttacggcaaagattcacaaaacgcgtttgactgaaaaaagtatctcgtatcataattctatttgtttagagtggaacaatgcagaaatcctttcgggaactgccaaggtagcattaaataataattccaggttaatctctgaatcttcgcccgattcattaggcaaaagcaaaaaattaccttga

SEQ ID NO: 2965 - DNA, 759 bp, B.fragilis
tttaaatttagtatgggattattagatggaaaaacagccattgtgaccggtgcggctcgtggtattggtaaagctattgctttgaaatttgcttctgaaggagcaaatattgcatttacagatcttgttatcgatgagaatgcacagaatacagcaaaagaaatcgaagcaatgggtgtgaaagccaaaggatatgcgtcgaatgctgccaattttgaagatactgcaaaagtagtggaagagattcataaagatttcggccgtatcgatattctggtaaacaatgcaggtatcactcgtgacggattgatgatgcgtatgagcgaacagcagtgggatatggttattaatgtgaacctgaaatctgcttttaactttgtgcatgcgtgtactccgatcatgatgcgccagaaagccggaagcattattaatatggcttctgtagtgggtgttcacggtaatgccggacaagctaactattcagcttcaaaagcaggtatgattggtttggctaaatctatcgctcaggagcttggctctcgtggtatccgtgccaatgccattgctccgggattcatcattactgacatgacagccggcctttcggaagaagtgaaaacagaatgggctaagaagattccattgcgtcgtggcggtactcctgaagatgtggctaacatcgctactttccttgcttctgatatgtcttcttatgtatcaggtcaggtgattcaggtagatggtggtatgaatatgtaa

SEQ ID NO: 2966 - DNA, 267 bp, B.fragilis; identical to SEQ ID NO: 2762

SEQ ID NO: 2967 - DNA, 1389 bp, B.fragilis
ttgaaggaaggatgtagtagagagtattttagttttcttgctgcatcctttttcagttatttgaagttgaaagctatgaagaattttcgagtggcaatacggaggtcttatttatcggtcatccttttgcttttggcattggtatgctatcttttgtatcctttggaaataccggctctttcttcagaatcggctatagaaattgatcggtatgttcattccgtgccatgtactgtacagatgccggataccgctactgatttcttgtgcttcttggatgaagagttaaaaaacaagcaaatcttattgttaggtgagcagttgcatcaggatggagccaccttgcaaatgaaaaccaggatggttcgttatttacacgagaaattaggatataatgttatactatatgaaactggcttatatgacatgtatcttatgaatcaggatggtcgtcagcggatgaatccatctaaagctgtatggacattttggtgggggagtaatgagacaaaatcattatgggaatattatcgctcccatccttctattgccttggatggcttcgactgccagttaaccaattatggacaaggaaggaaacacatggaatccgttgagaagtatttaaatggttactcttcttctctttcggatttcccgtatgtgcaacgcttcttcttgcagatgagtgagtttaatggaaactggaattatttcggataccggcttgataggatgttaaaagactccattgttcaggattttaataaattggaaaatagaattcatgaggagtcaagatattctatggaagatggtttgcatcagcgttatattgcaggactgaaactacggtatgagagcatatggaagtatcggaatgtcggtgatttaacacgaatgaacctacgcgattctattatggccgataatttgacttggttggtagactcggtttataaagaccaaaaagtgattgtatggtgcgctaatgtgcatgtattcaaccgggggaggatgcaggttgactcgaccagattcacctctatgggacaaaggttaaaaatacattttggagaccggatgtatacaatagcatttacttcgtatgcacgaagaaacactgacggcggcatacgggatccgcttagtacgttgtcactcgagtatttgctacatcggagaaaagtcgggtttgcttatttaaatttcaatgaactacccgtggatagcagatggagacaagcgtttatctcgggtttggatcaaggtgcaagtctttcggaagtttggagcgaacaaatggatatgctattctatatcgacctgaattatgatgtatattacgataaaacttttataaataaaatgtataaatgggcaaaatag

SEQ ID NO: 2968 - DNA, 603 bp, B.fragilis
tactttattataagagtagtagaggagagaaggatgagacttatatataagaatcattataaagcattgtttcttctcggccttcccattgttatcgggcaagtgggggttattgtgcttggctttgccgataccttaatgattggtcatcacagcaccaacgaactgggagcagcctcctttgtcaataacatgtttacgcttgccattattttcagtaccggattttcatatggattgactcctattgtagggggcttttatgggactcgtagatttgcgtctgccgggcaggcattacgttgcagtttgcttgccaatcttttggtcggtattttattaaccgtaattatgggcattctctatctgaatgttgaaagattggggcaaccggaagagttattacccttgatcaagccctattatctgatactacttgcctcgctggtctttgtgttgctatttaacggattcaaacagtttaccgatggaataaccgatactaagacagctatgtggatacttttgggtggaaatgtactgaacctaaaatccgcaactatcatccaatacacgattaagggtagatttatgagtcgttag

SEQ ID NO: 2969 - DNA, 732 bp, B.fragilis
tatgtcttcttatgtatcaggtcaggtgattcaggtagatggtggtatgaatatgtaatattcggtatgaccgtcatatacgaagacaatcatattatagtagttaacaagaccgcttccgaaatcgttcagggagacaaaacgggtgatactcctctttcagaaactgtcaagcaatatctgaaagataaatatcagaaacccggaaatgtttttatcggtgtaacccatcggctggaccgccccgtgagcggtcttgttatttttgcgaagaccagtaaggctctttcccgcttgaatgagatgtttaagaacagtgaagtgaaaaagacctattgggccatcgtgaagaattgtccgaagcaacccgaaggagaattggttcactatctggtgcgtaacgagaagcagaataaaagctacgcttatgataaggaggttcccaacagtaaaaaggcgattctgaactataaacttatcggacattcggatcattactttctactcgaagttgatctgaagaccggacgtcatcatcagattcgttgccagttggcaaagatgggatgtcccatcaaaggtgatttgaaatatggttctgcacgttccaatccggatggaagtatttgtttgcatgcccggcatgtgcgttttgttcatccggtgtctaaagaattgattgaactcgatgctcctgtaccggatagtaacttatggcatggatttcaatga

SEQ ID NO: 2970 - DNA, 2304 bp, B.fragilis
gttatggctattccttcccgtttcacaaaagtaaagatcgcggcggggtatactttgttgctggttgtgctgctgctctccctgttgtttgtacacagggagatggagaaactgtctgatacggacgatgtacagagtttgcagacggatagtttgctgcttttactgaaagagaaagatgaaaataccatccggatgcttcagatcattaatgaagcgaacgagagtatgattactccggttgaattggattccatcattgccgaacaagatacagtgatcactcaacagcgtgtgcaacatcgtatcatcaccaagcgtgactctgtgattacgaaacgaaagaaaaagggttttttcaggaggttgggcgaggtgttcgctccttcgaaagaagatacggctgtgctggtaaatacagctgtggaatttgcgaccgacaccattcttgaaccttacaatccgattgattcactacatcagcgcatacgaacggtgaccaaacggaagtccaggcctgtggtacggcccaactacaatgcccgtcttcgccggatgaataaggaattaaccactcgtattgacagcatgattacgacctatgagcaagtagtcacccaacgtgctatggacaacgcatccgaacagcaagaacttcggaaccgttcaactcgtacgattggcgggattgccattgccgccgtgttgctgtccgcctgcttcctgattatgatttggcgggatatcacccggagcaatcgttaccggaaggaattggaggaggccaataagcgtgcggaggcgttgttggaggctcgtgaaaagttaatgcttgccatcactcatgattttaaagctcctttggggtctatcatcggatatacggatttattgaccgggttgactacggataaaagacagcgtttctatctggacaatatgaaaagttcctcgcaacatctgcttaaactggtaagtgacttgctcgacttccaccggttggatctgaataaagcagaagtcaaccgggttacttttaatccggcacaactgtttgaagagatacgtattagcttcaaaccactgaccgatgccaaacatctgactttaagttgcagtatagacgccgaactggacggacgcttcatcagtgatccgctccgtatccggcaaattgtaaataatctgctttccaatgctgtgaaattcacagctaagggtagcattgcattgaatattacctatcattcgtccagtgtccgcatcgaggtggtggacactggtaaaggtatggcacccggtgaccgtgaaaagatatttcaggaatttacccggttgccgggagcgcaaggtgaggaaggctttggactggggctttccattgtacacaaacttgtgaccttgctcgaaggatcgattagtgttcaaagtaccttgggtgaagggagtcgttttattgtcattctgccgctctatcctgtggggcctgtgacaggagagaagcgggaaggaaatgtgtcttcggtttcaacgacagatcaagccggtgaggacggggtaatggcatctccaaaattaaaccgtgttttattgattgatgacgaccggattcaattggctctgactgccgctatgcttgaacaacaaggcattcaggctgtttgctgccaacagccggatgagttgattgagcaacttcgtacggctacattcgacgtgttgctgactgacgttcaaatgcctgccatcaatggtttcgatttactgaaactattgcgtgcatccaatatacctcaggcgcgtactattccggtaattgctgttaccgcccggagtgagatgaatgaacaggactttcaggaacacggctttgcaggatgtttgcataagccttttacggtaaaggaactcttgacgattatcagtggtgaagaaatgaccggttcgtcagctgaattgacaccggactcccttaactttcgggcgctgactgctttttccgaagatgatccggaagctgcctctaccatcattcaaacctttattgaagaaacggagaagaaccggaaccggatggaaagcgctatccgagccactgatgtggatgggatagccggcatggctcacaaattattgcctctgtttacgttgcttggggcttccgaggcacttcctctgctattatggctggagcagcgtcgtggcgaagccgtatcggacgaaatgatacaaaaggcgaatgaagctcttcggcaggtagatatcgtaatggctgaggcaagacgatatgcagcgggagattga

SEQ ID NO: 2971 - DNA, 960 bp, B.fragilis
actacagtaattatgactaaaaaacaattttggctgatcggtgcgtggtccttgattgcactatctgcttgtagctcgaaacccaaagacggactgacagacacttatacatcgggtgtaatagctattactgctgacgaaagtttccaacccattgttcaggaggaaattgatgtgttcgagggattgtttcctttggccggaattgttccccgttatactactgaggtagacgctatcaaccagctcctgaaggacagtgtacgtttggctatcaccacgcgtacactgactccggaggagatgaactcttttcatagccggaaattttttccccgggagataaaactggctactgacggtttggctctgattgtcaatagacaaaacgccgattcgttgatttcagtgcgtgatatccgccgtatactgacgggacaggtacaaaagtggaaagagctctatcctgcgtcggggttgggtgatatccaactcgtctttgataacaaaaactcaagcacggtacgctttgcggttgactccatttgtaagggagctcctctgtctgataaagacgtaaaggctctgaaaacaaatcagcaggtgattgactatgttgcacatacacctgatgcaatcggagtgattggagtcaattggcttggaaaccgaagtgataccactaacttgtctttccgtgatgagatcagagtgatgtctgtcagtgcagacgatgtggctacggtagagaacagttataagccttatcaggcttatctgtactatggtaactatccgttggcacggcctatttatgtattattgaacgatccccgtaatgcactgccctggggattcgcttcttttctcacatctgacagagggcagcggattatattaaagtccggactcgttccggctactcagccggttcgtattgtggacgtgaaagacgaataa

SEQ ID NO: 2972 - DNA, 618 bp, B.fragilis
attctgacaataatgggcagagcgaaaattaaaaagaaaagtacgttcatcgacatgacagcgatgagtgacgttacggtactgttgcttactttctttatgctgacctctacgtttgtgaagaaagagccggtacaagtgacaacacccgcttcggtttcggaaattaaaattcccgagaaaaatattcttcagatattggtcgatccgaacggaaagatatttatgagtatggacaagcagtccgacctgaaagcggtattggagagcatgggacaggaatatggtgtcacatttactccggaacaggaaaagaaattcatgttggcctctactttcggagtgccgatgaaaaacatgaaaacctatctcgacctgccgaccgacaaacaggacgcagtactgaagaacgaaggtattccttgtgatagtcttgataaccaattcaaatcatgggtgcgtaatgcacgcgcggtgaatgctgatttacgtattgcaatcaaggccgatgcggatactccttattctgtgattaaaaatgttatgaattcacttcaggacctcagagagaatcggtacaacctgattacttctctgaaaacgacttctgaaaactaa

SEQ ID NO: 2973 - DNA, 825 bp, B.fragilis
aaaagtaaaatggcaaaaatagatttaacttcttttgaatggtgtgagctgatttttaaaggcaaaaataaagcttacggtgcctataaaatgcgtgccgattcacccaagcgtcacaacgtggcaatggtcattgtgttgataatagctttagtaggttttagtcttccgaccttaatcaaaatggctactccgaagcaaaaagaggtaatgacggaagttaccactttgtcgcaattggaggaaccggaagtgaagcaggaagagatgaaaagagtagagccggtggcaccaccaccgcctgctttgaagagctctattaaatttaccgctccggtgatcaagaaagacgaagaggtacatgaggatgacgagattaagagtcaggaagaacttacacaaaccaaagtcgctatatccattgccgacgtgaagggtaacgatgaagcaaacggtaaggatattgccgatttgaagcaggtggttactcaggcagagccggccgaagaacaagttttcgatatggtagaacagatgcccacattccccggtggaactacagaattgatgaagtacatcggtgaacatctgaaatatcctcccattgcggctgaaaacggtacacagggaaaagtgatctgtcgttttgtgattggtaaggatggccaagtgagggatgtaaccatcgcgcgttcgttggatccatattgcgacaaggaagccattcgtgttatcaaatcaatgcctaagtggattcccggaaaacagaacggtaaagccgtagctgtaaatttcacagtacctattgtctttaaactacagtaa

SEQ ID NO: 2974 - DNA, 903 bp, B.fragilis
atgggcaaaatagagataagaaatctctgtttccgatacggcaaacagatggtactcaataatctgaatctggatattccggaaaatgcactctatggatatttaggtaataatggttccggaaagacaactacgattcaagtattacttggcttagctcgtcctgttaaaggtgaggtattatatgatggacagccatttcgagatcagagagaaaaacaattaaggaagataggcttatgcccgggagaaccattctattatgataatcttacggggtatgaacaccttgcgtatttagaccatatttatcattgtggaaggaccgctatcaataaagtattggcaatcacgggaattgagaatgccagaaacaagaagcttcgacactattccacgggtatgatacatcgattgggaatggctatggctttattgcatgatccggatatactgtttctggacgaaccgctcaatggacttgatccggaggggatacattctataagagagttacttttacagctgcatcaagagggtaagaccgtttttttatccagtcatttacttgatgaagtagaaaaaacttgtacccatgttggtatccttcagcatggctgtttattgtatcaaggagatttatcggaattactaaacagtatagagaaaagaatccatatcaggttggacaaggtggatttgttacattcggtatgtaaagaggtccaaattgacagccggatcaagtcggagtcaatattggaagttatcctttccaatgatactacctatgacaggcttattgagctactggggcagggcggttatcatatatctgctattcaacctttggagaatactttggaatcggtttatttaaaattaacttcacaaacaaaatga

SEQ ID NO: 2975 - DNA, 828 bp, B.fragilis
acaaatagaattatgatacgagatacttttttcagtcaaacgcgttttgtgaatctttgccgtaaagagatggtggagaattggaagtccaatctgcttcgtgttgcgttgatgtatggtgctatggcggtgataatgttatggagcggatatttaagttaccgggcagtaggtcaagatacagatagtacctgggagttcaatctggtgatttttatgtgggggctttgtgtattcggttgcttgagtgcttcgttcacaatggagaggatgaaatcgaaaaccgggcggctctctgttctgatgactcctgctacatcgtttgaaaaatacttttcccgttggttggtatttacggttgttttcttaattgtttttctgattacttataaactggcggattatacaaaagtattggtatactctttggtttatccggaaaataacgcaattgcgattactccgttatctcatctgtttggtgaaaatacggattattatacagtattcaagcatacccatacatttgtattaatgattgcaagctatttcttctgtcagtcttgctttgtactgggcagttctgtctggcctaagaattcgtttatcaaaacattttctgccggaatgattatattcattgcttatgtattgattgtggtcggatttgccaagttgatatggccggatcaaataagttacaatccggatatgagcgaggagactgcttttgcttgtctttcggcaatagctgttcttttcactctgactaactggacacttgcgtatttccgtttcaaggaatctgagattattaatcgaatgtaa

SEQ ID NO: 2976 - DNA, 861 bp, B.fragilis
atgaagatgattacagtagaaaatctttcctttctttatcgtaaatcgaagcgtgccgttttgcatgacttctctctgtcacttgaaaaggggcgggtttacggattacttggcaaaaatggtgcaggcaaatctacactactctatctgatgagtgggctgctcactcctaaaagtggaaaagtggtctatcatgatgttgacgtacgccgccggcttcccatcactttgcaggatatgtttttggttcctgaagaatttgatcttcctccggtttcgctaattagctatatagagttaaacagtccgttttatccccgtttcagcaaagaggatatggtgaaatatctgcactattttgaaatggatatcaatattgatctgggggcactctctatggggcagaagaaaaaagtattcatgagctttgcgctagccactaatacatctttgttgttgatggacgaaccgaccaatggacttgatattcctggtaaaagtcagttccggaagtttattgcttcgggtatgacagatgataaaacgatcttgatttctacccatcaggtgcgtgacattgataaggtgctcgatcatgtgttgattatggacaatagtcgggtattgctgaatgaatctactatgagtatttgcgataaactgttttttactgaaagcgaaaaccgggagttgttacagtcgtctttgttttccactccctctattcaaggtaattttttgcttttgcctaatgaatcgggcgaagattcagagattaacctggaattattatttaatgctaccttggcagttcccgaaaggatttctgcattgttccactctaaacaaatagaattatga

SEQ ID NO: 2977 - DNA, 1962 bp, B.fragilis
aaagaagtgatttcagtagaaggattaacagtagaatttaacgccacaccattgtttgaggacgttagttatgtcattaataaaaaagatcgaatagccctggtgggtaaaaacggtgccgggaaatcaactatgttgaagatcttggccggattgcaaagtcctacacgaggtgttatagctattccgcgtgatgtaacgatcggctatttgccacaggtgatgattcttgccgataaccataccgtgatggaagaggcggaattggcatttgaacatatttttgaattacaggccgacctggaacgcatgaatcaggaattggctgaccgaaccgattatgattcggaagagtatcataaactaatagaccgtttcacgcatgagaatgaccgcttcctgatgatgggaggcactaactttcatgcggagatagagcgtacgctgataggattgggattcagccgggaagattttaatcgtccgaccagtgagttttccggaggatggcgtatgagaatcgaactggccaaacttctgctcaggaaaccggatgtgctgcttcttgacgagccgaccaaccatttggacatcgagagtatccaatggctggagactttcctctctacccgtgccaatgcagtggtgctggtcagccatgaccgggcctttttaaacaatgtaaccactcgtaccatcgaaattacttgtgggcagatatacgattataaagtgaaatatgatgagtatatcgttttgcgtcaggagcgtcgtgagcagcagttgcgtgcttatgagaatcagcagaaacagattgaggatacagaggcgtttatcgagcgtttccgttacaaagcaacgaaggctgtgcaggtgcagagccgcatgaagcaactggaaaagatagaacggattgaggttgacgaagtggataactccgcattgagattaaagtttgtctgttccagccgtagcggaaactacccggtgatctgcgaagacgtgaaaaaggcctatggggcacacgttgtcttccatgatgtcaacctgaccattaatcgtggtgaaaaagtggcctttgtaggaaagaacggtgaaggtaagtctacccttgtgaagtgtatcatgagtgagattgattatgagggtaaacttacactggggcacaatgtgcagattggatattttgcccagaaccaggcacagatgttggatgagaatctaacggtcttcgatactatcgaccgggtggcagtgggagatatccgtctgaaaatacgtgatattctgggagcctttatgtttggtggagaggcatcggataagaaggtgaaagtgctttcgggaggtgagcgtacacgtctggcaatgataaagttgcttttggaacctgtcaacttcctgattctcgacgagcctaccaatcatttggatatgcgttcgaaggatgtgctgaaagaggctatccgagagtttgacggaacggtgattatagttagccatgaccgtgattttttggatggacttgcgactaaagtatatgagtttggtggtggcgtggtgaaagagcatttgggaggtatctatgattttcttcaaaagaagaaaatagagaacctgaatgaacttcagaaggcgaatccgtcatccgcctcgcccgcaaacggtaagaaagaggaaggagccgaagaaggaatatccgagaataagttatcatacgaggctcaaaaagaactcaataaaaaaataaagaaactggagcgcctggtagcagactgtgaagctgctatcgaacagacagagtcggctattgctattcttgaagaaaagatggctacgcccgatggtgcttcggacatgtcgctatatgaacaacaccaaaaactgaaacagcaacttgaccatacggtggaagagtgggagcgcgtttcgatggagttggaagagatgaatgaaaaataa

SEQ ID NO: 2978 - DNA, 600 bp, B.fragilis
cctatgaccgtatcaaagacaaaagccaagttagtagacgttgcccgtcagcttttcgcaaagatgggagtggagaatactacaatgaatgatatcgctcttgcttctaaaaagggtagacgtacgctctatacttattttaaaagtaaggatgaaatctatttggctgttgtagagtctgaactggatattctgtcggatatgatgaagcgtgtggcagataaagatatctctcctgataaaaagattatagagatgatttacacccggctggatgcggtaaaggaagtagtatatcgcaatggaacccttcgtgctaatttttttagagatatttggcgtgtggaaaaagttcggaagcgctttgatgcaaaagaaatgcaactgtttaaaagcgtgctgaaggaaggacaggacaaaggagtgtttcatgtagatgatgtggaaatgactgctgcattggtacactattgcgtaaaaggtatcgaagtgccttatatccggggacatataggagctaatctggatatggaaacccgaaaaagatatgttgccaacatcgtgtttggcgcactacatagaacagaaattaatcaataa

SEQ ID NO: 2979 - DNA, 498 bp, B.fragilis
ttactatttttgtcccgaaaatcgaaaagagagtttatcaataaaaataggacgatgagaacttctgtaaaattcatattaatgtttgttctgctgatgctatcctttagcataagtggaaatgcattgaatattacggaatgctctcataagtcggttaattcctgccaggtttccgcatcttctctggatactaactattcttatcgctatggcagtgatatcaccggttttgataaatcacaaactctatctgtctctgatgttgaattgggttttaaacctgtttctgaaacatactcttctaataacctccgtctgcgcagaattcttgaagattctgaccttttcaaagacaccatgcgtaagtggtgcctggtaagagagaatttgttggtattagaccaaagtaagtcttattattcggataaagatccgcattatgcgtctataagctgccactactacatttttgctttgagacgtattcttatttaa

SEQ ID NO: 2980 - DNA, 4557 bp, B.fragilis
gagacaagcttcatgaaacgaaaatggatcaaatgggtaagctggattttgcttacccccctcatactctttgtgatactgatggtattactctatatccctcccgtacagaattttctgagaaaggaggctgctgcttatgcttccgaagcaaccggcatgcagatcaatgtacgtcgcatcgatttacggtttcctttaaatctgttggtacggggagttgaagtcatccaggctcccgatacattgctttcacttgaaagcctcaatgtacatgtgcaggcacttccgcttttccgtggcaaggttgaggtagatgacatcagccttcagcaggtagctgttaattctgccaacctgatagacggtatgcggctgaaaggtgttctgggtagttttaggctggagagccatggggtggatctacccaatgaaatagccattataaaccgggccgaactctctgatactcatgtacagttgcttttgaatgataccactgctacgcctaaagatactgctcaaagtgaggtccgctggaaagtagacctgcgtcatttgaaattgaagaatgtctctttcagcatgcagttaccggcagacagtatgcgcttggcggctcatgtgggagaagcacaagtgaatgatgcggaagccgatttgaagaatttgcattacgggcttcgtagttttctggtatcgggtacctcggtcaattatgatgtgggcaccgcggagccggcggaaggtttcgatccttcacacatcgctttgcgcgatattcgtatcggactcgattcgatgtattatcgcggacgcaatatgaatgctgttatccgtgagttttcgatgaacgaccgttccggattaagtgtcaattcgcttaccggacgtgtgtttgccaatgataccattatccaagtgccgagtttgaaactgctgactccacattccgaaatggatcttactgcacagacttattgggagttggtgaatattcctactaccggacgtctgactgcccgctttaatgcgatgatcgggaaacaagacgtgttgttgctggccggtggattgccggatagcttcaaagaggcctatcccttccgtccgttggtgatacgtgccggtacggaaggaaacctgaaagagatgcagataacccggttcagtgccgagttgcccggagctttttcactttcgggcggtggagagttattgaatctgaccgatagcctggagaggtccgccattattgacctgaggatgcagacacagaatcttaacttcctgaccgctctgggcggaacgaggccggatagtttacttgttattcccaatcagatgtcattggttgcgaaagcccgaatgaaagggcctcaatatatggcgcaactcctgttgaaagaaggagagggaatgctgaatttagatgctgcatacaatggaagcactgaggcttatcgggctgacctgaaggtggacgctttgcaactttatcatttcctgcccaaagactcgatctacgaactgactacatcggtcgctgctgtgggaagagggatcgatttcacttcttatcgtacgactgcctctttgaaggcctcactgcaatcgttgcattatgggcgttatcagatttcgggaattgaagtgaccggtgatgtaaagaacgcacttgccacagcccgtttagtgagtgacaaccgcttgttaaagatgaatgccaatgccgaatatcaccttgccaaaccttatatggacggaaagcttgatatggatgttacacaacttgatttgtatgaactggggattgcccctaaacccctgaaatatcctttagcttttaattttacggcagaagcccggcgcgaccgtattttcactcatcttacggccggtgatatgaagcttaacctttcggcacgttccagcctggataagctgattaaacagtcagcacattttgctgatgtgctggtcaagcaaatagataagaaagaacttgatcacggggaattgcgagaggcgttgccgaccgctatattctcgatgtcggccggtaaagaaaatccgttggcctattatctggcaacgaaagatatcgcttttcacgatgtgggtgtgaagtttggcactgctcccgactgggggatcaacggaaaagcctccattcatgcattgaagatggataccttgcaactggacacgatctactttactgtcaagcaggacacgactcgcatgagtttgcacggaggggtcatcaacggccccaagaatcctcagatcgtttttaaatcgagctttgccggagaaatacgcaacgatgatgccgaactcacgctacgctatgaaaatgcgaaaggcgaaaccggggtacttttcggtgtgaacgtccgtccattggtcgaaggaaacggaaaaggcgatgggcttgcttttacgctgataccggaaaatcccattattgccttccgaaagttccacttcgtcgatcatcacaactggatatacctccataaaaacatgcgcttgtacgccaatgtcgatatggcggatgatgaagacatgggattcaggataaaatcaaaccggagcgatactgtatcgttgcagaacattgatgtagagttgcaacgcatccgcctgtctgagatcagtgaagtgcttccttatctgcctgacttgtccgggctcttctcggctgaggctaattacgtgcagacagctacttccttgcaagtatcggctgaggctaatattgatgaattgacttatgaacgtcaacgcatcggcgacgttgcactcggtgtgacctggcttccgggtgaaagaggaaaacattatatcagtacttatctgacccatgagggcgaggagatattgatggctgacggttcgcttcatccttcggtgaccggtaaagacagtattgaggtgaatgccatcatggaacattttccgttaaagatagccaatgcctttgtaccggatcaggtagtcaccctttccggcgatatggacggtgggcttcacatcaccggtgatacagaccggccgttggtcaacggagatctggtcttggacagtgtgtcggtctttgcccgtcaggcaggggcgcggtttacgttcgacaatcgtcctgtacaaatcaaaaacagccgtttgacttttgataagttcgctatattcactaccggaaagaatcctttcacgattgatggtacagtcgattttcggaatttgaccgatcccagggttaatctgtccatgctggcagaaaactatatgctgctcaatgctccccgtacaaaggagagcctggtatatggcaaagtgtttgtcgacttcaatgcaaccgtgcgcggaccgataaatgcgttggtgatgcgcggcaatatgaatttgctgggcaatacggatgtcacttatgtattgatggactcgccgcttaccgtgcaggaccggttgggagacctggttacttttacttctttcagtgatacgacgaccgtacagaaagaagaagcccctgttgtgtcacttggcggactcgacatgattatgactgtacaaatcgatcccggagtccggttgaaggccgatctgagtgctgaccgtagcagccgggtagagttgcagggaggaggcaatctgagtatgcaatatacaccgcaaggtgatttgtccttatcgggtcggtatacccttacgggtggtatgatgaagtatgcacttcccgtgatacccctgaaagaattcaatataaacaatggtagttacgtggaatggaccggtaatccgatggacccgatgctcaatctcaaagctaccgagcgccttcgcgcttccgtaggcagtgagaacgggcaatcgcgtatggtcaactttgatgtgtcgattgtagttaagaaccgtttggataacctttcactggcctttgagatcgatgcgcccgatgatgcggaagtgcagaatcagctggcttctatgagtgctgatgaacggggtaaacaggccattgcaatgttggctaccgggctctatctggctaattcgggaagttccggaggtgggggactgaatatgggatcggcattgaacagtatactttccagccagatcaatgcattggccggaaacctgaagaatgccagcttctcgatgggagtagaagaccacgatgcggctgatgcgggaggaaaacgtaccgactacagtttccgttattcgcagcgtttcttcaatgaccgtttccagatcgtactgggtggtaaggtgtctaccggagcgcaggctacgaatgatgtcgagtcgtttatcgacaatatctctctcgaatatcgtctcgatacatccggcacccgttacattcgccttttccacaataagaattacgaaagtgtgcttgaaggggagataacggaaaccggtatcggtctggtactgcgtaaacgtatcgacagattgggtgagttatttattttccgtaaaaagaagaagacacttcctgagacgcaaaaagccccgtctgacggcgaagcacatcagtaa

SEQ ID NO: 2981 - DNA, 228 bp, B.fragilis
  unsure (58),(74): Identity of nucleotide sequences at the above locations are unknown.
cggtcattttttacatacctatattataagtatttgacggttcttaaatttgacttgnaactaactggattgtntatcattttttcaaaagaacctcttctttttaaaatcttggctccgtttcaaaaagcgggtgcaaagggaaaaggggttaattttaaacctgccaaagtttttgggaagtttttttttaaagtgccgggttttaatttccaagcccttttgggg

SEQ ID NO: 2982 - DNA, 906 bp, B.fragilis
gctacaaaggtaagaggttttgaggtaaagtcgtatatttgcagacttaaattaaataaaagcgttatgaaacagaatttttggatattattaattatactggcttgcagcgcagtagcttgtaagtcgggacaaaagaaagatggaaacatggaaaaagaaactgtattgaagattgagacctctatgggggatatcaaagtaaagttgtataatgagactccgaaacatagagataatttcattaaactggctaaagacggaacatataatggaacgttgtttcatcgtgtcataaaagactttatggtgcaagcgggtgatccggaatcgaaaaatgctccgaaaggtaagatgttgggttccggtgatgtaggttatacggttccggctgaatttgtatatccgaagtattttcataagaaaggcgctttgtctgctgcccgacagggagatgaagtgaatcccaagaaagagtcatccggttgtcaattctatattgttaccggaaaagtgttcaatgattcgacacttctgaatatggaacaacagaagaatcagaataaggtaactgaggcttttaatgctttggcgcaaaaacacatgaaagaaatctataaaatgcgtaaggccaatgatcaggacggactttatgctttacaagatactctgtttatacaggctgaagcggaagctgccaaacaacccgatttccactttactcctgagcaaataaaagcttatacaaccgtcggaggtactccgcatctggatggtgaatatactgtttttggcgaagttgtcgagggcatggacattgttgacaaaatccagcaggtaaaaacagaccgcagcgatcgcccggaagaggatgtgaagattattaatgtttctgttattgaataa

SEQ ID NO: 2983 - DNA, 387 bp, B.fragilis
actctatcattaaaacactctcaatcggtttttgttttaactaaaagattctttcttttatataaaagattaatcaagttaaaaaaaagtatattggaaaaggttcttttaacttcgcctcctataaaacaaattattcaaagcagtgaaacttcctatataaaacccattcattcgcttgaatcgcctcttttgcaaggctccgtgcccccaagggatgccgagatacccacctcttccaataaccgttatataggacaagaaaaggctatcggatttcccatagccatctccattaagaaagtgttatccggaggggcgctccctttcctccgccccctgtataaaacaagtcatcccctccggtctttcgaccgaaggggatga

SEQ ID NO: 2984 - DNA, 1002 bp, B.fragilis
gaaaattcttcatacttcgttcttcattcttcattctattttgtacttttgcaacgatatctgatgagacacatcactaaccttttaatattcacagttatgaaaccaacattatttgtgcttgctgccggcatgggcagccgttacggaggcttgaaacaattggacggactgggtcccaacggcgaaactatcatggactattctatttacgacgccattcgtggtggatttggtaaagtagtattcgttatccgtaaagattttgagcaggatttccgtgaaaagattctgagtaaatacgaaaatcatattccggtggaactcgtattccaggcattggacaacttgcccgaaggcttcacttgccctgccgaccgcgtaaaaccctggggaaccaaccatgctgtcctgatgggtaaagacgtcatcaaagaaccgtttgccgttatcaatgctgacgacttctacggacgcgacagctttgctgtattgggtgccgaactgtctcagatggacggtaaaaagaacgactattgtatggtaggttaccgtgtaggcaatacgctttcagaaagcggatctgtggctcgtggcgtttgtgagacaaatgcggaaggctatctgactacagtggtagaacgcactgcaatcgagcgtatcgatggtaaagtatcgttcaaggatgagaacggcgaaatgcagacaatcggcgataacactccggtttcaatgaatatgtggggattcactcccgactatttcgcttattcggaagagtatttcaaagagttcctgaaagaaaacgaaggaaacctgaaatcagaatacttcattccgctgatggtaaacaaactggtgaacgaaggtactgcccgcgtaaaggttctggatactacaagcaaatggttcggcgtgacttatgctgccgaccgtcagggtgtagtagataagattcaggcattggtagatgcaggcgaatatcctgataaactgttctaa

SEQ ID NO: 2985 - DNA, 771 bp, B.fragilis
caaatcatgaaaacagaactcaaaggctggcttgcggacaataccgtgaccaccgacaacaaagaagacaaaatcctggtattagaaagcgccggaaacctgacgctgtccgatgtactggatgaaatgaagaaagaagataccggcttgcgggcagagactttaaagcatgccgtcgacctctttcagcgtacagtatcggaattggtactgaacggatactctgtcaatacggggctattccgtgccgtaccacagtttcgcggggtaatagacggcggagtatggaattccgagaaaaattctatctatgtttccttcaatcaggataaggatttacgtgaaactatcgcacggaccggagtaaagattctgggagccaaaggtgactcggcctacttcatcggtggtgaagacgccgccacccgtgctacggacggtagtgcaactgcgggacgtaactatcgtctgcaaggaaagaatattaaagtaactggtacagatcctgccgtaggtatcgtcttgattgatgaaaaaggcacggaaacgaagctaccgatggatatgatagcagtaaacaacccttcggaagtattggtgctacttcctgccgacttgaaagacggaatctatgagctgcgactgactacacaatactgccacagttcgcagacaatgctaaaaacgccgagaactgtcagtcgatttatcaatatcggcgcatcccaggggagtggtgatgacgatattgtagatgatccaacggcctga

SEQ ID NO: 2986 - DNA, 2181 bp, B.fragilis
agactaaaatggcattataacagtgcttatgacgctgtcaacaggttagctacttttgccgacatcgatctggtctatgcccacaacgacgtgatggcgcttgctgcccgggacgtcatcatgaagcgtgattccgtgtccggcaaacgtatccggtttataggtatcgacggggtatatggtgacggtgccggattgcaagccgtagccgatgagaagttggaagcctcgttccagtaccctaccggaggtgctatttccattcaggtggccatgcagattattaatggagaaaaggtgaagaaaaactatgtattgaacactgccattatcaatcgggggaatgcgaagaccattttggcacagtccgaacaactcaaccactaccagaaaagaatcaaccggcagaagcaggaagaagataatttattgtctcgtttcaagttcctgcgcaactctactatcctgattttggcattgatgttgctcattatccctttgctgggatatgtaatgtacatgaacctccgggttaaaaataagaataaagaactgcatgataaaaatcagcttgtagaagctcaaaaagaagaactggctgtcaagaatagccagattgagaatatctccaaccagaaactacaattttttaccaatatctcccatgaaatccgtactcctcttacactgatacttggaccggtcaataaattgataaagaactccaagctcgatccttctattcaagaagacgtggctttgatgaaacggaatgtagaccggctctacaggattgtcaaccagatactcgatttccgaagaatcgacaacgataagatgaaattgattttgcgtcaggtagatttgatcggtatggtaagggaagttttcgactactttaccggtattgccgaagagaagcagattcattaccggttctctaccaatattgacgaactgaacatttacatagatgtcaataagatagagcaggtgttggtaaatatcatttcgaatgcctttaaatattcggatagtgggggagatatttctgtccggattaccggtgaagcggaaactgtcctgctggaagtggaggatcacgggcggggaatttcaaaagagagtatggaacacctgtttgaacgcttctataccggtaataagactttcggtacagtaggctttggcattggactcaatctttcaaaagagtatgtcgacctgcatgacggtgaaatccgtgcagagagtcaacccggagagtatactttattcagcgtccggctttataaagatatcgctcactatacacacgagtatatactggaagagaccgatcgcttcaatctcagttatcacgatatggaggtggatacgacggtggtcaacgaaatgctttctaaaacctatgattaccacgtcctggtcgtggaagacgatcccgatgtacgatatagcttacggaaagagctgtccgccaattttcaggtagaagtggcaggtaatggtaatgaagcattggacttgttgggacagggtgatgcttttcacctgattctgagcgatgtattaatgcccggtatgaatgggttccagctggttaaccgggtgaagaatgatcttgctttcagccatatccccatcatactgctgacagccttgtccgaagacagccagcgcatctacggcattgctgagggggcagacgagtatattcccaaacctttcaacatcgacttcctgaaaatacgtatcatcaacatgatttcggaacggcagaagatgaaggaagcttatatgaagaatctccgggccggtacgatggacaatgtggaggtatgcaaactgatgaaggtagacgagttgttcagggacaagctgctgagcattgtcgacacgcaatatgaaaactccgatttcagcatcgaagacctgagtgaacatttgggattgtcgagggtgcacctataccggaagatgaaaacactgttcggggtttcccccaccgattacctgaggaattaccggctcaataaagcaatgcttttgcttaaagcccggcagtacaatatcagtgagatagcttatatgaccggttttacttcgcccgcctatttcactaaatgtttccgtacactttatggggtcactccgacagaggcaatggtggctaactga

SEQ ID NO: 2987 - DNA, 1611 bp, B.fragilis
tatatgaatagaacttttattatgcgagagtgtctcggtaaagccttatggctgtgtttttgcctttcgatagcaggatgtgccgaagatgacagaatgactcccctgtctgctgacagcggggatactgccgacgagttaatccccatccatatcagtctgacaggtgacaacgactatcattcttcctcttttaacaacgcttcgacccgtagccactctcccctgatcgccgaatgggtgggggtaaaagctttctcacctacacgcacaggagagcaaccggactatgacggtccacggatagcctcgatggaactgacggaagataccctgccccgtgtaagtacccgtgcaacagtgcctgcgggagtctatttccggctgattgtttttcggaagtccggaaataactatgtcttccagtcggttgccgattacgcctccaatggtacgggcactcctgtactcaaacaagggaaattgctgacacgctcgggaacgatacgtatggtgggttactcctttaataccgctaccgctgccgacttgggaactatgctttccacgtatgcctacaacagcagcacagtgtctatccctaacatgagcaaggacttcatgaccttcgattccggagatataacgaatgtaaatagcctcagccacaatcttccggtgagtttcaatcagaagttgtgcaaactgacaattaccatcagtcctaccggatttccaagcaatacgatcaccaattgcacgggtgtatatgtaaagcaagggggaaactccacatcatggaagatcggcccttcgaccaatgtggtggccaccaacacgaataatacggcggcattcagtccgagcacggccctaagtacaaccatacgcatggttccgtttgcaggggccagaacgataacagtgcatttcaatacactgacggtaggcggacggattgtgaacaacaacaccgaaatcacgtccacccaaagcgtacagttgaaggaagggaaaagctatacactaaaaatacagtttaaaaagggacccggcatcaatgtgttggagagtgatataaaccttacaggtaacgggtgtacggctcaggataagaaggatctggctaaattaatatgggcggacgggaatctgaaatcaacaggaaattctaactatgtgtggaccacttcaacagatagaggttattactatacttggtatagtacttacacaggaaatacaagccaaaataataccgatccatgttcgaaacttaacgtttcaacttatggaaccgggtggcgtacaccgtcgcgaaacgaactaaccaagttatctcggtgtacaaataaggcaaaagtaaataatggaatgtggtttatgaatagttccaaggggctctttctgccattagctggacatacacctagtgcatctggagccagtactggtggtaatgcagtagtgaacggtaatcgcgatggtaattattggtgtacagagaaatattatcgttttttgtttggaacaaatggacacacagtttccgacgcagcttctggtgcctttggatgttctgttcgttgcgtaaaaggtaccaaacaataa

SEQ ID NO: 2988 - DNA, 222 bp, B.fragilis
gtttgtgtattacaatcagatatgacggtcttgaatacacaatggtgtttcaaaaaacgtacgtctgatgcaacaaagataaggcgctttttccatctgtgcaaatttttctacatcgttttaattatcagtcatttatctatcctccttgcatttagtgcggagagtaaaaatagtgtttcaaaagacgtacgtcttttgaaacatcgtttgaaaaactaa

SEQ ID NO: 2989 - DNA, 330 bp, B.fragilis; identical to SEQ ID NO: 1570

SEQ ID NO: 2990 - DNA, 375 bp, B.fragilis
cccactttatccactacccaaataacaactcttatgcttacacaatttttaaatctacttgctactatcatcagcgtcatcagtttgctgatcgtaacttatggcgcgcttattgccattatttctttcattatcaatgaactgaagagagtaaccggagcttacaccccgaccaatatccgaaagttgagagccgtgttcggcacttacctgctattggggctggagttccttatcgcttcggacatattgaaaacggtattggaacctacaatgaacgaactgattattctgggaggtattgtcgttgtaagaaccatattatcggtattcctcaacaaagaaatcaaagaattggaaacagaaaataactaa

SEQ ID NO: 2991 - DNA, 1296 bp, B.fragilis; identical to SEQ ID NO: 845

SEQ ID NO: 2992 - DNA, 231 bp, B.fragilis
aatgtagaacatatggcaaaagtaattaacagagatgtacctatcgcagaagagaataccactcttaccggccagccggcaacaaatatgtatgacgactggagtgaagagatggaagaccgtgcagacaatgtgtatgatgataccaaaaagaaatctgccggcaacaaaaagtcaaaggagaagaagctcaaggagatagatgaagtagtaaaagaggatcttgagtaa

SEQ ID NO: 2993 - DNA, 2064 bp, B.fragilis
catcacaagcacataaataatagtgtttcaacaagttggctttttggcatacttcttgaaacactatttgtaaaaacaagaacccgaatgatacgacattattttaaaatcgctttccgcaatctgctgaaatataaaacccaaagtattatcagcattatcggactagctgtaggaatcacctgctttgcccttgctacactatggatacgctacgagatgacatacgacacctttcatcggagagccgacgacatctacctggtaagagcacaactcacaatcacagacggcacgctcagcaactcaatgccttatccggctatagagtatctacggaagaacatatctgagattgaagatatatgtggcatatctccgttcaaaaccaatcttcgattcaaagacaagggtggggatttattggccattgaggtggactctgcgtttatacgcatgtttgatgtgcgtatcctgcaaggcaatgtcaattttctaaagaaaaagagcaacgagatagccataaccgaagcggtagcgaaagaatggttcggcaacgaaagtcctcttggaaaagagattgagttgggaagccggccatgtaaagtgtgtgccgttgtcagcggatggtcgcaacattcaaatctttcatacggggccttgcttccggcacgccaccatccaagctggcaaagcaattcagaacagatatttgtccgcatcttgccggataccgacaaatcagctcttcaaaaaaggataagcagcctcgatgcttcctcacaggagaaagagagtacattaggtaaattgaattttaccccgattacttcgctccgctattctgattatctgcaaaaagacgagatcgttatttcattcaactacattcgctattttgcaatggcaggagtattggtcattgtatgttcattattcaattatctgaccctgtttgtcagccgtcttcgaatgcgcggtcgtgaactgggactccgaaaggtttgtggatctaccaaccgttcgttgttcgcattgctatctgtcgaatacctgattgtcttgctagccggttctctgctgggcatggctttcatcgaggcctgcttaccccatttcatagaactggctcagatatcagaagctaccccgctgtatacagaagtcatcatttacatactggcagtcatcgttttatctttcggtatttcacaaattcctctatattacttcagaagccgtacgttacagagtagtattcgcaataaaaaaggaagtccccagcgcggaatattccgccggctcggactgatagcacaattgatcatcagtctgggcttcatcttctgcaccactatcatgatgaaacaactctattatctgaaaaacacagatctgggaatagaacgccacaatataggcaatgttgctgtctggatgaaaggagatattaatgaatggagttctaagatcgccaatttacctatggtgactgaagctctgcctcctcactacttcccgatagtccctacaggacctatgatgtatacagatattaacggctgggacggactcaatgaaaccactgatgaaacatattccgtcggcctgataccttcgggcaaagagttcttcgacttttatggattgcagttgacagaaggggagtggctatccgaaaagaactctcccggagatgtcatcattaatgaaacggcagcactgacgttcggatggagaaatccagtaggaaaacagttctactcagaatatgaacacaatcggacatattatacagtagtaggagtggtgaaggacttcagctacctgccacccactatcgctccacgccctctcgcctttgtccgcactgaagagcagaaatatctatggtctcgtgccagtattctttttaagtttacggaagggagttgggaggcctgcaaagatacgatccggaaaatgaaagaagaagattttccctcttcgttcttgagactttataacgaggaagaggagtataataaacctaaaatccgcaactatcatccaatacacgattaa

SEQ ID NO: 2994 - DNA, 252 bp, B.fragilis
  unsure (24): Identity of nucleotide sequences at the above locations are unknown.
gttcctgagcaccaaatagttgcncaggattttgccatgtcagaattttcacttatcttagtgttgcaaaaagaaaacaagcaaaactctaatatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatag

SEQ ID NO: 2995 - DNA, 2514 bp, B.fragilis
ttctctcttaatatcttaataagcaagaggttaaaattctttcagactctgtgttactccgtggtgaatcaaactcaaaatcatacaaacatgaaaaccataaggctggcctggaaggctctggcacgtttcagaacatatacattcatcaatatactgggcttggccttgagtctggcttgtgtacttatcatcctccggtatatccatcaggaggttaccgtaaatcatttctgcaaagaccttgaaaacacctatctgctatatatcgagtacgaagatggaaggcggacaataagcagtaatgaagataggaataacgaccccaactttatcgatccgctgaacgacccgtctgtcctgaaaagtacccgatggattaactttccggaagacaggattacagtagggaaacagatatataatgtaaaaaccgtagtgaccgacagtgtgtttctgcagatattaccctatccgtccgtgtccggcatttcatctctgaagtctccgaatgacgccatcatcacccggcgattggctgaaagattgtttggaaaagagaatcctattgggaaaacaatgacttacagcacgggggacatcgtcacagttacgggagtaataggagagccgacgacgaaaagctttttagatttcgaccttattatatccgaacgattgcaacattcatggtcgcgtttaagcaatagtctggtacaactgatacccggaacggactttaagaaactgaacgtcaagaacgagaagtttatgaagttaaggtgccatatggatgcaccgacccgcctgcagttctttccattaaaagatttctatttcgataagactgtccgcgtttataataacaatatccggaaaggcaactacaataatatcttagtacttgccgttgtcaccattgctttgttgataatcggcttgttcaatttcatcaacatctatacggtgatgatgctcaagcgtgccagagagtttggagtcaaaaaagtatatggtgccggcgcaaaggatgtattcgcacagattttcactgaaaactttatcctgacaggcatggctctatgcatatcctggtgcattatcgaaataaccggtggcatgatggaacatgtgctccggataccgcaaacctccaatacggaatttagtgccacattatccgtaggaatcctgattctgttgccattattgacttctatttatccattcatcagatacaactacgtttcaccttccgtatctatccgttcggtaaatgcgggaggacattccatcgtatcccgtgtgctgtttttattcgttcaatacatcatcacctttgtacttattattgtttccctctttttcacgaagcaagtccgcttcatgctgtctgccgatctgaactataccaccaaggacatcattcaatgtcagttatacgccgaacgctcttcgtatgatataaatatatcagacgaagagtgggagagacggaagcagagagagaaaagtaatctggcctacatcaaagaagagatggatcattccccgctctttatccgttgggaatatggagagaacccgaatcagctggatgacaattatatcaatgtgcggaatgcacagcgggacgagttcaagcaagttatttacagcagcctgagcaataaatatattgaactgttcggctttcagctaaaagaaggccgcctatggaatgattctgtcgaccaatggactgattataaaatgatcatcaacgaatcggccaaatcacttctggaaatagataatatagaaacagccctgattcagcctgaaaggagattgtggtggtccttgtcaaaatccgaagaaatgaagaagaatcctccatatcaggttatcggagtgatcaaggacttcaaaatcggccatttatcgaaaaccactcctccgctctttatcgtttacgaagatccgcggggcagctacagagaccggttgatggcacaaatcgttcccggaaaaaagcaagaagccattgccttcctgaaaaaactgcgcgatgaaatactgggcgaaggtgagtttgaatacagctttttagaagacgagatagcgaccatgtatcaggaagacaagcgaactgccgagatatactccctgttcagtatcattgccattcttatatcttgcctgggactgttcggattgtccatgttcgacatccgtcagcgatatcgtgaaatagcactacgcaaggtaaacggcgctaccctgaaagagatctatccgcttctattaaagaaatactcgattatcctgggaatggcattcatcatttcggcacctctgtcctggtatatcatttcgaaatatctggaaggattcgccaacaaagctcctatatcctggtggctgtttgcaattgccgccatagtgactgctttcatatcactggccactctgatatggcaaatacggaaagctgccaatatcaatccggccaaagtattgaaaggagagtag

SEQ ID NO: 2996 - DNA, 258 bp, B.fragilis
gaaacgtctaaatcgcaacctatccttttttcttatgatactgcccattcgtcattggaggtaacgtctaccgtttgtcctgtccctacattcacaagcgatagcgaggacttgttcaccgaaagagcagatgctcccgctgcccatttaaattggcaccttaccatttttcctgcactatcagtcacgtcaacattaggagctaacggtgtgggcaacggattgcgggctatttccagtttgatggaaaacgcataa

SEQ ID NO: 2997 - DNA, 447 bp, B.fragilis
aattacatcgacatgaaacttattatttataacagccggcttgcaaaacgcatgctgtttccggggtattcgacaatcatgttatttggcattatcctgactaaaagaaggaaagaagaatgtccgcctgcattgatccgacatgagcaaatacatcaaaaacagtattttgagtgttttatactccctgttttaccggctatcctgtttactccatggatgctgaccttatgccctttgagtttctatatactttatctggcagagtggttcataagtttcgtatggtatttttggagtcaaggaatgacagatccgggcagagccggccatagggcatatatgtcgtcggccatggagatggaggctaaggtaaaagaggtagaagcagggtatctcgaaagaagaaaacactttgcatttatgaggtattacgacaaaatataa

SEQ ID NO: 2998 - DNA, 1371 bp, B.fragilis
tataacatggatcagcttggaaaaatattaattgtaggcgataacgaggatgtgttgttcgccctcaatctattgctcgaaccttatactgaaaagattaaggtggctactactcccgatcgcatcgaacacttcatgactacgttcggtccggacatcattttgctcgatatgaacttcagtcgtgatgccatcagtgggcaggaaggatttgagagtctggaacagattctgaagatcgatccgcaggccattgtgatttttatgacggcttatgccgatacggacaaggctgtgcgtgccatcaaagcaggtgcaacggactttatccccaaaccatgggaaaaagagaaactgctggctacactctcttcgggcatgaaactccggcagtcacgtcatgaagtgaatatgctgaaggagcaggtagaagtgctgagcggacagggtggacccgaaaatgagattatcggtgaatcggaggctatgcaagaggtgttttcaaccatcaacaagttaagcgagacggatgccaatatcctgattctgggtgaaaacggtaccggaaaagatgtgattgcccgcttgctgtaccgttgttctccccgatacggtaaaccgtttgtaacgatcgacctgggcagtattcccgaacagttgttcgaaagcgaattattcggatacgagaaaggtgctttcaccgacgcacgcaaagcaaaggcgggacgcatggaagtggcgacagggggtactctgtttctggatgaaataggtaacctttcgctccctatgcaatcgaaactgctcactgcgatagagaaaaggcagatcagccggttaggctctactcagtcggtacctatcgatgtccgcctgatctgtgcgacgaatgccgatatcagggcaatggtggatgaaggtaacttccgtcaggatctgctctatcgcatcaatacgatagaaattcatattcctcctctacgggagcgtggtaacgatgtcattctgctggccgagttctttttagagcgctatgcccgcaaatataagaaggagatgcacgggctgacgcgcgaggcaaagaataagttactgaagtataattggccgggcaatgtacgcgagttgcaacataccatagagcgtgccgtgattttgggtgacggctccctgctgaagcctgagaactttcttttccactcttctgtccggcaaaagaaagaggaagaggtactcaatctggaattgttggaacggcaagcggtagagaaagccatgcggctgagcgaggggaacatcacccgggcagccgagtatcttggtatcacccgttttgctctttatcgtaaacttgaaaaactgggcttatga

SEQ ID NO: 2999 - DNA, 1488 bp, B.fragilis
aaaaagaaatgcacaatgaacttgaaaacgatacttatcattgccggatgcagttatatctttccggcaactgcacaggaacgcacgatggagctctcgctggacgaaaccgtaaagcttgccaagcttcagtcacccgacgcacaaaccgcacgccacagtttccgctcagcctactggaactataaatattacagggcgaactatctgcctgccttgagcctgacctcggacccgaacctgaaccgggctatcaataaggtaacactgggagacggaaccgtgaagtttgtagaacaaaacatgctcagcaccgaccttactctgaatttaacacagaacattccatggaccggcggttcactgtttgtggaaacggcagcacaacgaatggatatcttcagcgaccacacgacagcctggcagacttcacctattaatataggctatcgtcagtcgctcttcggatataacagcctgaagtgggatcgccgcatcgaaccggtccgctaccgggaagcaaagaaatcgtatgtagaaacactggaactggtagccacgcgtgctactcaaaaattctttaaccttgccaccgcacagagcaattacgaaaccgccactaccaattacgctaacgcagacacactctatcaatatgcccagggacgctacaacatcggtaccatcaccgaaaacgaaatgctgcaactggaactgaacaaactgaccgaagaaaccaaccgaatgaatgcccgtatcgagatggacaactgcatgcaggagctacgctcgtatctgggcattcagagtgacgaggaactcaaggtgaaaatcaacgaccacgtacccgacttcagtgtagaactgcacgaagccttattactggccaacgaaaacagtccggaaatacaaaacatgatacgccggaaactggagagtgaaagcaacgtgtcgtacgcccgtgccaatgccggactgaaagcggatatttatctgcgtttcggcctgacacaaactgccgacaagctgggaagcgcctacaagaggccattggaccagcagtacgtcagcctgagtgtagcactacccatcctcgactggggacggggcaagggcaaagtgcgcgtggcacgctccaaccgcgaccttgtgtacacacaggtggaacaagacaagaccgatttcgaactaaacatacgcaaactggtgaaacaatttaatcttcaggcccagcgggtcagaatagccgcgcgaaccgatgaaacagctcaacgacgcagcgacgtggcccgcaaactttatctgctgggcaagtctaccattctcgatctaaacgcttccatcaccgagaaggaccaggcacgccgcaactacataacggctctttacaactactggagtctgtattacacgttgcgcagccttactcttttcgactttgaaggcaaaacgccgcttaccgagaattatgacctgctgatagactga

SEQ ID NO: 3000 - DNA, 462 bp, B.fragilis
catgattgtcgaataccccggaaacagcatgcgttttgcaagccggctgttataaataataagtttcatgtcgatgtaattttaatggttgccgcaaagttcgcatactcttttcagggcgtaaaggacatcctagttcttatggaacttggaaaataccccggacggggagtaaaagcaaagcgaatcaaaacagtagaaataaatcatttaataaattacaagtatggcaaaagcaagttggtgcaatgtaagccccatgtcgggcaagagagatggcgttttgacaatcagtgcgggtgctcacacaggacgtgtagcacgaaatacagtagttaccgtaacagcggcaaacggaacgagaccctcagccagtatagcggtatctcaggcaggtgcaggggtatccacaaccatggatacaagcaaaccggaccttccctcttccggaggagtcgttaa

SEQ ID NO: 3001 - DNA, 225 bp, B.fragilis
catgattgtcgaataccccggaaacagcatgcgttttgcaagccggctgttataaataataagtttcatgtcgatgtaattttaatggttgccgcaaagttcgcatactcttttcagggcgtaaaggacatcctagttcttatggaacttggaaaacacctcggacggggagtgaaagcaaagcgaattaaaaacagtagaaatcatttaataaattacgattag

SEQ ID NO: 3002 - DNA, 639 bp, B.fragilis
attacgattagtatggcaaaagcaagttggtgcaatgtaagccccatgtcaggaagtgagaacgggactttaacaatcagtgcggcagcacatgccggacgggaggcccgcagtacgacagtgaccgtcacggctaaaaacggaacgaagccctcggccagtatagcggtatcacaagccggcgtaggagtgcaattaacgatggatacctctaaaccggatttacccggagaaggagggtctgtcactattaacgggaactctaacagcccgacattgaaaatatcggttcctctgattaactttccgggggttaccgcttccgcaaaattcaatgctccgggaattactgacaaagtgcttgccgcctcagagacggttactatcccaggagaccccggagcgaacggttcttatgcgttttccatcaaactggaaatagcccgcaatccgttgcccacaccgttagctcctaatgttgacgtgactgatagtgcaggaaaaatggtaaggtgccaatttaaatgggcagcgggagcatctgctctttcggtgaacaagtcctcgctatcgcttgtgaatgtagggacaggacaaacggtagacgttacctccaatgacgaatgggcagtatcataa

SEQ ID NO: 3003 - DNA, 246 bp, B.fragilis
ctaaaacatagtgaaccaaccatctgtaatggcgtttatattattattaataaaagaaaggagatcggacttatgaataccgaaaaagagaaaacttcatcagaagaacaaaaaaaggctgaaaaagtgcttaaagacaaagttcccgtacagcaaaccggaacctacagcgaagccaccaagaaagaagtgcgcgacgcagtaaaagagctcaatccggacatgagcggattggataggggttaa

SEQ ID NO: 3004 - DNA, 1305 bp, B.fragilis
cctgctgatagactgaccggaattataaactgcaaatcgaaaaaacaaaataatatggatattaaaattgaaaagaaaccctggtacatccgctataaattctacatagccggaggaattgcatttgtcgctttccttgtttacgtcatcattctgtcggccgggccgcgcaagctccgcatcgagtcggaaaacatacagatagccgaagtcaaagatgacaagtttatggaatacgtcgatgtggaaggattgatacagcctattctcaccattaaagtaaacacccgtgaagcgggaagcgtagagcgtatcatagccgaggaaggcagtttgctccagaaaggagatacaattctgaccctctcgaatccggacttgctgcgtagcatcgaagaccagcgggacgactgggagaagcaacgcatcacttatcaggagaaagaaatcgaaatggaacagaaaagcctgagcctgaaacaacagacgctggaaaccaattacgaactggcacgcctgaaaaaaagtttcacgttggacaaagaagaattccgcatgggcatcaagagtaaagcacaactcgaagtgtcggaagacgaatacaattacaaggtgaagaatgccgaactgcaacgcgaaggtcttcgccacgattcggccgtgaccatcatccgcaaagatctgatacgaaccgatatggagcgggagcgtaagaagtatgaacgggccacagagcgtctgggcaatctggtagtgaaagcacccatcagcggacagctgagctttgtgaaagttactccaggacagcaggtgggctccagtgaaagtatcgccgaaatcaaagtactcgatcaatataagatccatacttcattgagcgaatactacatcgaccgcattaccaccggactgcctgctactgtcaactatcagggtaaaaagtatccgcttcgcatcacaaaagttgtgcccgaggtaaaagaccgcatgttcgacgtcgatctggtcttcaccggcgaaatgcccgataacgtacgtgtaggtaagagtttccgtgtccagattgaattgggacagcctgaacaagccatcgtcatcccacgcggcaacttctatcaggccaccggcggacagtggatttacaaagccaatgcatctagaaccaaagccgtacgtacgcctatcaccatcggacgccagaatccgcaacaatatgaaattaccggaggattagagcccggagattatgtcgttacaacaggatatgatacctttggcgaggcagaagaattaatacttaagtaa

SEQ ID NO: 3005 - DNA, 1290 bp, B.fragilis
aaaactgggcttatgaaacgctattccatcagtgtggtgctgcacattctattgttggtggtgctctccatcggaggatacttgctgttctgttacgaattatggttcagcactctgattgtgggcatcctgctgatcgctacaggcgttcatctctattccatccagatgaaattggcaggcatgatgagacgactgacagactgcatccgcttcaatgacatgacgcagaactttcagccgccgtttaaaagcaagatgatggttgaactggcggacgaactctctcagacacttaggttgttccgcggacgcctgctcgaggaagagatcaagcaccagtattacgagaaccttttaaataaggtagatacggctgtggtggtgactgaccgttcgggccgagtggaatggatgaaccgtgcggccgtggcactggtcggacaagaatcccggttgcctcaggagtggctgaccacctcctggaacgagacgcaggtggtacgtatccggcagcaaggagcctcggtagagatggcggtatcatgtactttgtttgccgcacaaaataaggaaaggctgttggtcagcctgaaaaacatccattcggtattggaacgtaacgagatggaagcctggcaaaagttgatacgggtattgacccatgaaataatgaactctatcactcctatcatttcattatccgaaacattgagtgaacgcggaatacccgaacggctcagtgagaaagaatacggagtgatgttgcaagccatgcagaccatccatcggagaagtaaagggctgctcggttttgtggaaaactaccgtcggttgactcgtatccccactcctgcccgcacattggtagcggtggacgaactcttttccgacctaaggaaactcttccctgattcgttcattcattttgcggcaacacacaggggggccactctgtacattgatcgtgcccagatagagcaggtgctgatcaatctgattaaaaatgccaaagagtcctgcggacaaaatactgcaccgcagatagaagtagagttggaacaggtccccggaaaagtttgcagtctcacggtgcgtgacaacggcgaaggcattcttccggaagtgatagacaaagtatttgttccgttctttacgaccaagccatcggggtccggcatcggactcagtttatgtaagcagatcatgaatctgcatggcggcaccattacagtctcctcagagatagggaaaggaagctgctttacactgatgtttccgggaagatag

SEQ ID NO: 3006 - DNA, 1254 bp, B.fragilis
gtatttattatggcttctattaaattgtatttcgacaaacgtgtgaataggaaagatggaaagtttcctcttaaaattaatgtcacacacaaaaggcagcaggccttaatcaatcttggtgttttattatctccagatcagtgggattccacaaaaggaaaggtgatcaatggtcctaacaagtcattccttaatggctatatctcccagcgagtgcattgtgctgaaacggaattattgaatttaaggattgccggaaagttggacttaatgacaggaaaacagttcaaggagcatcttcaacgaatattattgaggggaaaattagaggagaaacaggaagaaactggatgttcttttgtgcagtattatacaaggtttgtggaaggaaagaaaaatccccaaacgaaggcagtctaccaatatacacttgatcgcatatgtcgttttgtggatgtaccagataagtttagatttgaagatgtgacctatgcttggctaaagagttttgagattcatctttcagagacctctaaagttaactcgattagtattcacatgagaaatatccgagctgtatttaatgatgctcttaatactgaaactatttcatgttatccatttaggagatttaaaataaaacaagaggcaactgcaaaaagggcattgactccagaggaacttgtgactctaagagattatccttgcgaagagcatcagaagcaatatgttgatatttttatgttaattttctatcttgtaggcataaatactgttgatttatgtcgtttggagaaaattagaaacggcagaattgaatatcgaagggctaagactaagaaaatatacaatataaaagtagaacccgaagcagccgagataatcgaacgatacaaaggaagtaagtatttacttaatattcttgagcgttacaagaattataaagattacgctcacagacttaatgaaaacctccaagagatcggaagtgttgaactagtagaaaaggtgattaatggtaaaagaagacgagtaaaaaaacgctttcccttatttccagagctaacggtttattgggcgcgtcatacatgggcgacaatagcacataaaataggagtgtcaaaagatgttatttcattggcccttggtcatgaatttgggtgtaaaactacaagtatttatatcgattatgatatggagaaagtggacaaagccaaccgacaggtgcttgattatttagagaacttgaaatga

SEQ ID NO: 3007 - DNA, 633 bp, B.fragilis
attacaagtatggcaaaagcaagttggtgcaatgtaagccccatgtcgggcaagagagatggcgttttgacaatcagtgcgggtgctcacacaggacgtgtagcacgaaatacagtagttaccgtaacagcggcaaacggaacgagaccctcagccagtatagcggtatctcaggcaggtgcaggggtatccacaaccatggatacaagcaaaccggaccttccctcttccggaggagtcgttaacataaacggaacgtctaatagttcaaaattaaagtggacctgtaccgcaagagttatgggagtagatatgcctatagacggtaattatgtaaaagtggcggtaaacggtgggaatataggaaataatgtggctattccgggggaccccggagcatcggggcgttttaactttgtggcgacattaacttttcccgcttcgatgtttccggttgacgctgtagtgacttttaggctgacggatgataccaattcagctaaacaatgtactttcacttggaaagcgggtgcgtcttctctttcagtgaacaagtcctctttgtcattggttaacggtggaaccgggcaaaccgtaaatgttacttccaatgatgattggaacgtctcttaa

SEQ ID NO: 3008 - DNA, 378 bp, B.fragilis
ataaagttagttttaattatccatactaaaaatgtaattatgaagaaagtattagtagcattgacaatggttatggggatgggcagcgcagtagcgtttgcacaagaaccggttaagctccccgctatggaacagaatcaacaaacatctcaagacaaattcacaaagattactgtcaaagagcttccgcaagtagtcaagagtactttgtccaaggattacgaaggaactatagttaaagaggctttcgttgctgaaaaagaaaacggaaaggtttacaagataattgtaacagcaatcaaagaagaccaatcaactgaagagataactgtattgttgaatgaaaaaggggaacctgtgaatgaaaaagattgctaa

SEQ ID NO: 3009 - DNA, 690 bp, B.fragilis
aaccttccatcgaaaccgaatttgcctccctcagtaaaagaacaggccgatgacgaagcgatccgggtctttaccgaaaacctgcgccaactgcttcttgccccacccttgggacaaaaacgggtaatgggtatcgatcccggctttcgcaccggttgtaaggtggtctgcctcgatgcacaaggcaatctcgtacacaatgaaaacatctatcctcacccgccggtagacaaaaaaactgaagcggcttcgaaactccgcaaaatgattgaagcttacaagatagaggccatcgccatcggtaacggaactgccagccgcgaaacggaaaacttcgtcacgcaccaacagttcgaccgtcccgtgcaggtctttgttgtcagcgaacagggtgcttccatctactcggcctccaaaacggcccgtgacgagtttcccgattatgatgtcaccgtccgtggggccgtctccatcgctcgccggctgatggatccgctggcggaactggtcaagatcgctcctaagcccatcggtgtcggccaataccagcatgatgtagaccagaccaaattgaaaaaatcactcgaccagacagtggagaactgtggaatgtcagaaacaacaaagggatctgttatcaaaaagcggatactcgctatctttttgcgccattattctgcaaacggatga

SEQ ID NO: 3010 - DNA, 2949 bp, B.fragilis
tttgaaacatctaacttgatgaaacagaatacttttatatatgcagctattgcgttttttgtttgtagctcttgtacatccggtaaatattctcctgttgactatgtagatccctttattggtacaggttttcacggtcatacgtatccgggggcaactgttcctttcggtgcggtacaattgagtcctgatacccgtgcgggaaattgggatgcctgtgcgggatatcactatgatgatacaactctaaaaggcttttcgcatacacatctaagcggaaccggatgtattgatttgggtgacattttgtttcgtcctacaactctaaaaccggatctgaccgccgaaagcatttgccgaccggctaatttctcacataaagatgaaagggcgtcggcggggtattattcggtgatattgaaaggtgaagggataaaagcggaattgaccgcaacaactcataccggaatgcaccgttatacattcccttccggaaaacccgttactattattgtcgatttggctcatttacttgacaatgaatatatctatgaagcggaattggaacggacaacatctaatgagattgtgggaatgcgtagaaccagaggttggacagataatcaatatgtttattttgcagcccagttctcagaaccttttcaaactgttgagtttgtacaggataagaagatagtttccgccgaaaccaaacaggtgggtactgacttgcaagcgattctgacattcgctgacaaagatggagaacctataatcgccaaagtaggattgtcattggtaagcgtggacaatgcgcgtaaaaatttggcggaggaagtgaaagacttcaattttgatgctgtgtgtgctgccgcccggaatgactgggaacaagcgctttcatctattactgtcgagggaggcggtacagacgatttgaaaaatttctatactgccatttatcatgctatggttgttcctaatgtagtgagtgatgtcaacggtgaatatcggcggcataatatgcagataggacaattgccaaaagggaaaatgcaatactccactttctctctttgggacactttccgtgcatggaatcctttgatgacgttgattgatactgcattagtcaataatatggtgaactcttatctggatatttacgatgcttccggagaacttcctatttggccgctttctgccgcagagacgggaacaatgataggataccattcggtgtctgttattgctgacgcttatttgaaggggattagaggatttgatgcggaaaaggcattggatgcaatgaaggtttcctctgaaaagaataaaaaaggagcggattactatataaaatatggatttatcccttcgaacataaagaaagaatctatatcttgcttgctggaatttgcttatgatgattggtgcatagcgcgtatggctcaagaaatgggaaaagaagatgtttatcggaaatatattgaacgttcccagaactatatcaatgtgtttgacggttctaccaaattcttccgtggaaagcggatggatggcaattgggagacttctttcaatccattcgaggtaggacgttcctatacggaagctactgcctggcagtatcgcttttccgtaccctatgatgtgaacggaatggtgcaattgtttgggggcaaggaaaaatttatcactgcactcgattctatatttatcgcagacccaaatgtgcatggtgatcttgcggatattacagggttgataggacagtatgctcatggtaatgaacccagtcatcatatcgcctatttgtatgattatgtagggcagccctggaagacacaggaaatgacacgccacttacttgatgagatgtaccaacctactccgggaggtatcagcggcaatgaagattgtggacagatgtccgcatggtatatcttgtccggtctgggcatttattccgtttgtccgggaagcaatgaatttgcattgaccacccctctgttcgagaaagcggtgcttaagttggcaaatggaaagagactgactttgcttgccaatgatccgaagaagaatatctatatccataaagtagagttgaatggaaaacagatagatactaactttattacttacgctcaattgatggaaggaggagagcttcgctttactctatcagacaagccggacaaaagcagaggtatttcggaagaggcttctccttattcttataccaaagaaaaagtggtttccattccttatgtagatagagatctgaacttgtttatggataaggtgacagtagctcttgccacaacgaccgagggcgcggagcttagatacactctggatgggaccgaacaaacagaaaagtctttgctctacgataaaccatttagagtagatatggttacactgattaaagcaaaaggatttaaacaggggttccgcccgagtagaactttgtctattgcagctactatagctgaattgaaagggtcgcttccggtacatccttcacggaacggtacatcctataaatattttgaaggaacttatcaaaaagtggctgatattgaaaaaactccattgttagaggtaggtgtattgccggaaccctctataaaggaagcaaaacagaaagatcatttcggttatatattctctggtctgattaatgttcccgaagatggagtttatattttccagactcgttcggatgatggtagcgttttgtatataggcaatgaattggtggtgaacaacgatggggcacatgccgctattcctgatacaggatatattgcgttggaaaagggattccatccgtatatactttattattttgaggattatgaaggggagcatttaagctggttctggaaacttccttctgcaaaggaattagcaccgattcctacttcagccttgtttgtaaaataa

SEQ ID NO: 3011 - DNA, 183 bp, B.fragilis
agtatgagatcaacatttaaagtcttattttatctaaagcgcaatgctcccaaaaagaatgggcttgtgccggtcatgtatcatttctccatttacgataataatactaaactgtattccagagagcaaagtcgcaaggaagcatgcgccattgacatccggtttttactaaataaaaaataa

SEQ ID NO: 3012 - DNA, 315 bp, B.fragilis
aaaagattgtctatgaaaagaaatatgtcgcggcgtcatttcttgaaaacaggaggactcgctttggctgctatggctatgtgcccacctttgtcgtttgcctcctccgaaatgccggtgcagaagtacatttctctgcgtcctcctgtgggcaaaagacattttgtatcgaaggcggtagaggcaactattgagcagaccaggccaaaaataaaagatgagaagttgcgttggatgtttgagaactgtttccctaatacgctcgataccaccgtcaggtataaaatgaaggccggccggatacattcgtcataa

SEQ ID NO: 3013 - DNA, 3165 bp, B.fragilis
actttaaattttgaatgcatgaaacaagtaaatcttagaatctatcaaactattctgactttattagtaggactgtttctttcggcaggtgcttacgcacagcagatctctgtgaggggaatagtaaaagatcagatgggggaacctgtgatcggtgccaatgttctcgtgaaaggaacttctaatggagttattacagacatagatggtaagtttgcattgtcggctgccaaaaatgatatcttgattatcagttttgtcggttttatgagtcaggaaatcccggtaacgggaaaagatttgatggtaactttgaaagaagataccggacttctggacgaggtggttgttttgggatatggcgcgaatgcccggaaacaagacttgtcagcggctgtgggtgtattgagtaacacggatgacttgacggtgcgtccggttagctctacggaaagtttattgcaaggtcagttagcgggtgttacggtacaatctaatggcggtgatcctacatccactccttctattgttattcgtggacaaggttctcaaaatggtgacaacgtactttgggtagttgacggcgttccgggtgctcctattgcttcaatgagtgatattgaatctattgtcgtattgaaagatgccgcgtctgctgctatttatggtgcgcaatcaggtgcgggcggcgttatcctggttactaccaaaaaagctaaagcgggtattcctactcttagctatgaaggtacttacggcattcgccaggctacaaatttgccggaaccgttaaatgccgaggaagagttggagatgcgtaaacgctcttatgccaacgcgaatgtgactttacctgacggttggaatatagaaaagaatccatggatcggtactacccgtacaaactggatggatgagatttttcgtacagctttctatcagcgtcataatattgctttaaatgtaggtaccgacaactattccagtcgcttatctttttcatttgataacgatgaaggtgtattgattaatacttataataagaattatgcaattcgttataatggcaagtttgatttgaataagtgggtatctattagtgaggatttggtatggaagaatactgagaatcgttcaaaagatacaaacgacgcttatacaggtcctgttttatctgcaatttatatgccggcaagtgctactgtctataatccgttggatggtacttggggaggtactactacggaggatcctgaatacatagctaaatatggaagcaatttcgccggtgctcatggtgatgcggtcaatccggtacgtttactgagagctgaaaaccgttttaatagaaccagcgatgtgtggagcactaccagtttgcagatagccaatataatacagggcttgaagtttaccagccgttttacttataatctgaaaaccaataattataagaacttccgtcccattcaagatgaaccgggtaaacctaataattcaaatagcctggatgtaaccaactaccgtacagatgcttggaaaacggagaatactctaacttatgataatagtttcggaaaccatacagttggtgccttattctctactacagccgaccattataatgtacgcggactgaaagtaaatggtaagaattttgctgatgaaagtccgtatctgcagtatctggcatatgcaggaactacttctgctacagattatttgacagggcctgatgccaacgtttcattagtagctcgtctcgcttactcttatgatgatcgttattttgtgacggcatcttggcgtcgtgactatgccggtcgtttaccgaaagagaataactttggtgatttccccgcagctaccttagcttggaagatttctaatgaaaagttctttaaaaagagtgatttcatcggtatgttgaagttgcgcgcttcttgggggcgtgtaggtaatttgggttctattgactataattacaagtcactcttattaggaacatcatactggcaagaacaagctcaatatggtgtgataaataatgcaacctggaataattttgtatataattccactgcaatgaataggaacttgacatgggagacttctgaacagtgggatttaggtttagatgttgaactgttcaaaaatcgtttggcattgtcttttgattactttgataaacgtacctttaacttgattcagaagcaaacaatgaattggccaagttctatcggattggacccgttgttgattaatcaaggtgagattcgtaatcgtggtattgaaatacaggctaactggaacgatcgcgttaataaggatttttcctacttcgtgtcgggtaatttttcatatctgaagaattgtgtgtcagatattggcgtaaagaatgctgatggtagccccggcgtatggacagatagtgattctaaattccgtaacataccttatactcgccagactgccgagggagagcctttgaactcttactatctgattaagactgacggtatttttcaaagtgatgcggaagcggccgcttatgtggataagaatggaaaacgtatccaaccgaatgccgtagccggtgatttgaagtttattgattataataacgatggtaagattgacgataaggaccgccaatattgtggaagcgctactccaaaaataacgtattcattttcatttggcgctacttacaagaaattctcttttagtgctatgttccagggagtagggggggctcaggcattttatgctgctaaatctgtaattctgagtgatgcggatggtaatttcaaccgcgtaaaagatattttgaatgcgtggagtcctactaatacatcttctaatattcccagactttcgatgaatgacccgaactccaatttctctacggcttctgactggtatctggaaagtgcttcttacttgcgtcttaagaatttgactttatcttatgatttgaccgatgttcttcaaaaatggtcacatctaagggaacgtaacagtcgtatgtctgtttttttcagtggtgagaacctttttacgattactgattattccggtatggatccggagtgcggaggatgggatgctatgaagtatcctgtatccagagtattttcttttggtgttaaactaacttattaa

SEQ ID NO: 3014 - DNA, 186 bp, B.fragilis
ttttattattaccattcactaattaatttgaactatgtatactattgcattaacttcagtttctttctttcggtcaataatgtgggaacagtagcatcgggtatatacaacgtcatgccacaatgtccgtcaatggtaaatccccctacactctccggcataaagttctccgtggccgctttataa

SEQ ID NO: 3015 - DNA, 237 bp, B.fragilis
tatttttttcatatttgtcgtttgtttgataattatgcggctctttcttataatgaaagggagaatgacttcataaatattataagcatttataatacagtaagttacttcatatcccatctgaaaatgtttctgagtttttttattttcagaaacaaagaaaaagtgtatgaatgtaatacattgattaataatacattacttaatattgactcagaaacgctttcagaaacataa

SEQ ID NO: 3016 - DNA, 753 bp, B.fragilis
tgtattattaatcaatgtattacattcatacactttttctttgtttctgaaaataaaaaaactcagaaacattttcagatgggatatgaagtaacttactgtattataaatgcttataatatttatgaagtcattctccctttcattataagaaagagccgcataattatcaaacaaacgacaaatatgaaaaaaatactatgcatatgggtcttaaccgttactttccttggagcatttcctgctttggccgacgcccagcaatggggattgactgccaatggtctttattgggcgacagctactccgaatataggtgtggaatatgccttccattcaaagatgagcatagcaggacttgttcaatataatccgtttacttacgctaaaaaccggaaaatgaaacatcttgccgggcagttggagtatcgttattggctgagtgatgtgttcaaggggcattatctgggtgtgcatgccacgggcggtatctttaattttggtaatctccctttgggtatcctcaaagactatcgtctcgaggggcaattgtatggtggcggactcacctacggttaccagtggatcatcagcaaccgggtcaacattggcgtcgatatcggattaggatatctctatgttgattacgataaattctattgtcccacttgtggggaacgtgtcgatcactaccggaccaattatctggggcctaccaaggtaggtgtatccattatttatctgttaaagtag

SEQ ID NO: 3017 - DNA, 1176 bp, B.fragilis
gaaagagacaacttagttaaagtaatgataacaatgaaaaatatattgagaaacttcgtattcatagtttgggcagttgcattattgcccgtcaatgtgtcggcgcaaaatcgtagagacaaggagcaaacgtatgtattggaacaaccgtatgaagtaaccaagataactccttctcaaggaaagaagataaaaaatgtcattctgatgatcggagacggcatgagtcttatgcatgtatattctgcatggacagccaaccgtggtaaactcttcttagacaactgtcaggctgtaggtttgtcgaaaacttactgtgcagataaactgattactgattcaggagcgggggggacagctattgctagcggacagaaaacaaactatcactatgtaggtgtagatactttgggacatcctttgaaatcattggttgattttgctgctgccaaaggcaaatctacgggaattgcagtaacctgccgtctttgggatgctactcctgctgatttctgttgccataataaagaccgcgatgctgagagtgagattgtgacagattatgtgaattgtaatgcggactatgtatttggtgggggtgccaaactctttgaaaatcgcgaggatggacgtgatctgttcaaggagttacgtgaaaaaggtttccggactccccgtagttgggatgaactggcaggtataaagagcggtaaagtattcgcagttccttatccggtagacaccccgcttcctgctgaacgtggtgacctccttgcacgtgcttcattgaaaggaattgatttgctgaatcagaacaaaaatggtttctttatgatgattgaaggttctcaattggatgattacgggcattttaatgatcttgatctgctgatgcaggagacacatgactttgaccgcactattggcgctatttatgagtgggcagccaaggatggtgaaacactggttgttgttactgcagaccatgaaactggtggccttacattagtagatggtgatttaaaggagggtaaaatcgtatgtaaattctctacaggcgggcatagtggtgtgatggtgccggtatatgcttttggtcccggagcacaggaatttaccggaatttatgagaatactgctatctttgacaagataaagaaattactcgatctttaa

SEQ ID NO: 3018 - DNA, 297 bp, B.fragilis
aaacctttaaatggatatgctatgaaactgtcaattgatttaggaggaacaaatgttcgaattgcccaagtggagaatggtatctgtttgaacaagatgtctgtaccttgtcttgcgcaacaagatgcttcagcggtacttgatcagctttttcaacttattacgggtatgatgaacgtccaggtggatggtattggtatcggtgtcccttcaattgtagatgtggaaaaaggtatcgtgtataatgtggcgaatatatcttcttggaaaaaaatacatttgaaagatatattgtaa

SEQ ID NO: 3019 - DNA, 1224 bp, B.fragilis
accaaattaaagctatttctttcatttattttgattttaccagataccatgattcgactgatactattgactgactttacagaatccttttcatacaatttattgaaaggggttttggcatactcaaaaaaacatgaaccatgggttgtatgccggatgccaccttcctataaacttacttatgggatagaaggggttctgaaatgggcaaaagcgtggcaggcagacgccattatcggtagatttgataatgatgataatgtagagttgttccgtaaaaacggaattatcgcaattgcgcaagactacaaatcaagattcagcaatattcccaacatcaccggcgactaccacaaaaccggcaggatggcagcagagttttttttaagcaaaggattccggaacttcgctttctatggttaccgtgataccgtttggtcgcaggaacgttgcgaaggcttctacgagtgtatagccgaacatggtttcggcaataatttctattcctatcaagagcagtcacttgatgatttatggttttatgaagctcctcctctgcttacatggttaaaatcattgccacagcccacggcgcttatggcttgtgatgacaaccaaggtaaccgcatcactgaaatctgtaaggttaacaatatcagagtacccgacaaaatagccatattaggtgttgataatgacgaaataatatgcaatctgtctgatcctcccctatccagtatcagtcaaaatattgtgagaggtggattcgaagctgccgaacttatagaacatttactgaacgacgaagaatgttcttaccaagacgtggtactccaaccggtaaatatagtaaataggctttcaacagacttttactctaccaccaacacacatattcacacagctttgaaatatatccaccgaaacttagccaatgacatcactgtatcggacattgtcaagcaagtgcctttatcacgccgtctgttggagatacgtttcaaagaggtcaccaagcaatccattcacaaatatatcttaaatctcaggatcgagcgttttgcacaattacttctggcaagcgacgccccgattgcagatgtggcggaacaagtaggaataaataatctcaaaaacctgtcccgccaatttaaaactttaaagaacgtctctccctatgaatacaggaaagaacaccggatgatgtccaatgataactattga

SEQ ID NO: 3020 - DNA, 408 bp, B.fragilis
caacggtcaaaaataatattacttattttctcctcgatagtcaccaatttgtcctcatccaatcctaccacttcacgaggatcatctgccacaccaatatacaggtcgccacctgcatcattggcaaatgccacaaccgtcttagccaaatcggaatgctccggcaactctgccttaaattccaatctacgcccttcggattggtttagtatctcttttatgttcatacttctactgttctgctttgtaataaacttgtggcaagttatagaaaatcttttagatgacaaagatcgcaagcgaaaacattcttttcgttctatttttaatgttattttttatttagtaaaaaccggatgtcaatggcgcatgcttccttgcgactttgctctctggaatacagtttag

SEQ ID NO: 3021 - DNA, 876 bp, B.fragilis
aaaaacatgaattcaaaatacctgtctttgccaaaaacaaaaaagtacatccaaaagaaatatctacagttcaaagaaataagaaatccgaagcgacaaacaatttatttcgtctattacggtacagtgggctgctttagtatcggaatcatcgccgacctttgtgtctacctgatcagaaaagacctgttactggctttatgtaacatattatccctggggttattcttactgttcacttacctgctgattcggaaaaagaaacagataactttcttgttgaaatgcaccttttataccatacaaagcaatatcctaatatcaatgtactgccgtatctacctcccaccggaagagaccggcttctttttgtcgcaagatctgatgatcggtatggttacttgtggtctggcttccatctctgtgagtcgacacaccgtaatgatattatctttcgccccgattcttttgtatatgttcatcggggtctatacatcatccgaactttatttgatgagtctgcccagcctggcagtggcatatatctttcctcccatcatgttggcaagattacaggaaatactacgaaccatgcaacgacaaaaggcaagaatgacatccgagctaaaactatgggctgctttcaatgctttgcacctgcaaccgagtagcaaagaaatacaactttgctgcttgatactggaaaacaaaacaaccgaagaaatagcagcactccaatacatagccacttcaaccgtgagaagcaaccggagccggctccgacagaaattacaactgaaccaggaaaccgacctgcaaacctttttatcagaactgataaaaaaagattttgattatttggaaagtcccgattaa

SEQ ID NO: 3022 - DNA, 258 bp, B.fragilis
aaaataagtgaacaggacgaatcattgtttgcggatgcttttagaatttttgctgaattgtcgtgggctgatatttataattctgaaggattagactataaggaatatactaataaacagaaagattcattcgccatctttcggtctaaaaagatatttaagttcaggattactcagaaatatcgatgttttggagaagttgtaaatggagtatttcatgtcttgatgtttgatttaacacataagttaagtgattga

SEQ ID NO: 3023 - DNA, 1194 bp, B.fragilis
agaaaaaacgataaagcaatgaagaatatggaaaagagctataaaagaatcctgctgctaggaatcggtttcatcttatgcggaactctggcagcacaagagcaaaagcaagattcaacagaaggaaaaaacaatataaaggcctcagaatatttgatgcccaaacgaaagggagcagaaaagttccattcgaagagaggatcggaacatctgtttttctctgtcggatcgggtatcggttatctgtttaacgtaggaggcggacaaaccgcccacgggccacgggcatcattcatggcaggtaattggctgacccccgtcataggactacgggccggaggggaatatacacaatggaaacagggaaatacgaatatgcatctggcaggagccaatgtagactatttgatcaatatcagtgcatttgccgccagatacaacccgaagcgagtattcgaagtgatcggcgctctcggactcagttatcaggccactatcgtaaaagaccaaaaaacaatccattcatacggattgagggcaggactacaagggaaactgaatgtatcgtctgcttttaacctgtttatcgagccacaactggcactttatccggaccgggtggacaaccagtcatcgtggaaaagatataacctggcaggatcactaatggcaggtattacttacaaaccggcaggatacgctaccctgactttccttaaaggaggttttgcctcgctggcagccggtaccggaaacaccggaaatgtattgttcgacacggaattcgctttaggtaaatggttcgacaaatttaacgggatgcggatcagtgccggtagtagtaccgcttttttggataatgaagatagcggtagcaaccgcgattttaatatcagcctcaacattgactatctgtgcagcctcacaaggcttttttccgatcgggacagccacgtgttcaacctgatcgtggcaggcggcatcgggagctattttcccggagcggaatcatcgtcttcaattatcttgaacggacgcatcggactacagggagaaatcaggctatcggcacatagcggactctggctggaaccccggatcaatatattcaaagacagaagttatcgggcagaccttcaggaacccatacggggaacagtagggttaatggtgggaacgacgtataaattttag

SEQ ID NO: 3024 - DNA, 432 bp, B.fragilis
aatatttttttgcaaaagagttcatgcgatggattattaccgggaagccgcctgcatcggttggaagataatactattgccttgttgacctttggtaaaaaagatggtaaagaagctatgtttttcttcaggatgaatcccaatacaactggggcaaaaaaccgggcaaaaaggattgcggcttgtattcgtaattttgatagaaaatgtgaagaacaacttttttcacgccggtgggggatctcttttgtgagtgctaccggactgcattcgggaataccgctggttttcgcgaataaggttaataaaccagtggcggattatctgaaggagaaccgtaaacgaaattgtggcattgtattcattgattttatagaaagttcgggaggacaaaaattagtggaatatctcattggaggtaatatctattga

SEQ ID NO: 3025 - DNA, 555 bp, B.fragilis
tccggggcggatggaaagtccgctccggttgatatctttttcttgtcggaaagagaagaatacgaaactaaaatgaagaaattgctaccgatacttttaggggttaccctactgctgaattcatgtattaaagatgatatggatgcttgtgccggatatatgcacatctatttcagctatatttatggtggagccaaccgcttttttgagacggtttctactcctacgcaacttcatttttataaacagaagcataaatatcgggagttggaaatagccgtggatgaaataggactgaccgaaccttatcgcttcctgaaaaactttgatgatacggatagcctggaactgatagcttggacacaggatgaggcgattgattatgtggatactcctgatactcccataggagaggggtatgtgaaattaaaagaaattaccgatggcagcggaatctgccgacctgtagacgacctgttgtacggacgcattgccatagatgccggtttgcgcgaaaatcggtcttcaccacgggggtggaaggatcagcagtag

SEQ ID NO: 3026 - DNA, 1698 bp, B.fragilis
aagtataaactattcgaacttatatctataattaaattttttagtaacatgaaattaaacaaattgtttacgtttacattggcagcccttgcgatggctgcatgtagtaatgatgacgaaccgggaattgataaaggtggtcagaaaggtgaattgattgatgctatcagcattgcttttaccagttcttcagctcctgctacccgtgcagacaaaggtgagatagaaggagtgggcactgaaaataatgtatatgtagcctatctctttgctaaagagaatgatccccaacatgaaggtgcaaaagtgggtgactggactgtaaagcgtgtagctggtgatgctaatacagaggataaggatgttgcagctgcaatcggtgagggcgatgtggcaactcccgggacgaagaaaaatatgtgtacgttcaacggtgtacgccagggagatagtgtttatgtggttgtgaatgatcctcagatgacccttgctaccgctcagacattggcgcatcagggtgacaagtcggaagccgctatccgtgcatatatctctaatctctctaaaagttatctgaatgagctgaccgttactaaagacgggacgcagggtaagaagtatatcatggcaggtgtatcggctattcctaccaacccgaatatcccgaacggatctaccgtgaaagtttcgattcctctgaaccgtgaattagccaaagtattctttaatgcctctgttactaccaaccccgtatacgaggcttatggtaagatggcaatcaaagatgcagaatgggaaaatccgacaggtactaaagaccctgatggtattgtcgtagtgcgtattccgagacgtgtttctccgtttacggcacaggctcgtgactggtatttcccgcagagtgcagatgcaactgctaaagactgggatgtggaaggttggttgaaagcatttgcaggtgagaaagaatctgcacccggtactgcagaagttgctggaacgacttctgcattgaataagggagaatacaatgcagacgcgaaagaatatcgtctgacatgggttgtaggtgaaaaagcattggctgatggagctactcctgcagctgcttcgatggtatacgttaagagtgacaagttatattctccttatttttatgtaactcctaactatgccgacaatgccggttgtgctactgttgtagttacccaggctacttatatcggtgcccatactctgcttgaaccgactattacagaacagatgttgaaagaagctttggatgattctgatttccaaacagctacttctactgacggaagtgtcacctatgataaattggctgctaatttttgggatactggtgcgaatgtaacagcattggttacgttcctggaaaaggatgcgacatataaacttgcgttgagaggtgaaacagaacaagccaagaaagaagctgccattacgattaaacctaacgataaacgttactatcgtgctgatgttgccaactatagcgatgacgaaacaacttcaatgaagattaccgaacgcaacacattctatcatataacaggtaccatcactacactgggtgccaagagcattgaagatgctatcaattcggataatatcgacatgcttgtacaggtagttgttaagccatggaaatatgttgttaacaatataaatatgtaa

SEQ ID NO: 3027 - DNA, 1176 bp, B.fragilis
aatgaaggccggccggatacattcgtcataacaggtgatattgacgctatgtggctccgtgattcatctgcgcaggtatggccttatttgccattgatgaaagatgataaggaactgcaacttttaatagcggggcttattaacaggcaggcggaatgtattcggattgatccttatgccaatgcattcaatgacggtccgttgggcagttattgggagactgaccatacacagcatatggtgaaagaactgcatgagcgcaaatgggaaatagattctttatgttaccccatacgtctggcttatcactactggttgttgacgaaagatatttccgcatttgatgcagattggcacgagactatgaagctggtagtgcagacctttaaagagcaacaacgcaaacaaggtttggggccatacagttttacgcgtgattgtgaccgcccgactgattcacaaattaataacggatggggtgcgccggtaaaaccggtgggtttgatcgtttcctctttccgcccttcggacgatgctactcaatacggcttccttattccttccaatatgtttgcagtggtgtcattacggcagttggcagagatagaacgtgaggtttatgataatcttccctttgcggaagaatgtactgcattggcggatgaagtggatgccgctatccgtagatatggaacattcaatcatcctgtatgcgggcggatatatgctttcgaagtggatggtttcggtaatgccctttgtatggacgatgccaatgttccttgtttactggcggctccttatttgggctactgttcgtttaaggatgccgtctaccggaatacccgtaaaatgatatggagtgaaaacaatccttatttttttaaaggcaaagctggtgaaggtgtgggaggcccccatgtggggttgaactacatttggccgatgagtatcattatgaaagcttttacgacggatgcccctgaggaaatacgcagttgcctgaaacaattgcgtgatacggatggcggaacaggttttatgcacgaatccttcaactcggagaatgccgctgatttcacgcgctcttggtttgcctggacgaatacattgttcggtgaacttatccttaagataatccgggagtatcccggccttttatcccaagcattatga

SEQ ID NO: 3028 - DNA, 189 bp, B.fragilis
gaagtaaccagagaaaatccggtactttcagccgcttttcaaggagaaaaaagactactgtcgatcatctaccgacttgccgccgacaagaagttaacttcgtataaacaaagaattaactttctgccggcaaagaacgaactctttgcaactacgttattcacttcctatgggcaaaaaagtgaataa

SEQ ID NO: 3029 - DNA, 624 bp, B.fragilis
acagaagtgagcgcgtttatgaatacatttaatttaaaactagatttccccaacttgttgtgggagatagccggatataatttcccgtctctattcgggaaacgggctatactctttattttcatagcaatatcttttcaagtatccgcccaacgcatggccatcaagactaatacgctggaatggttggcggcatcccccaatctgggagtggaattcccattaaacgattggatgacagctgaaatttcggcatcggctaatccctggaagattacagataaacttttctaccgccatggacgcatacaagctgaagctaaatattggcttcggaacctgctggcacgccattacatcggtatcacaggattctattccatgttcgatgtgggaataaaccgcagggcatattatggagatgccgcggccgcgggtgtcacgtatggatacaactggattctgtcacgtcgctggaaccttgaggtatcaggcggtgtgggtgtggcacgctacaggttggtgcgctaccaaccgggaagcactcatgatgaaccgaatgaatcgggatgggcccccataccggttaaactaagtgtatcttttatttatatagccaaataa

SEQ ID NO: 3030 - DNA, 1131 bp, B.fragilis
agtaggggaggacaggctatgaatatcaaacaggtaattttcataaatatctcatttttcatctctctaacagtgttagcagcagataggcctacacagcctgtccgtactgaggtgtatcgcttggagcgtcttgactccgttctgctggtcgatctggctgtcgacctgacaggggtgcacctggcgccggactgtacggtctatctgtttccgctactcgcttcggagaataccggtgattcgttgtctcttcctcccattgtgctcaacggcccccaaagcgatctgatgtatcgccggcgtcgggctttgggtacaacttcgggattggagaagattactccctacaccgtgctgcgtgagggagaccatgctttgcctcgcatccattatcggaccgaggtgccttatgcggcatggatggacgatgttaaagtatggatgcgcgacacgaattgcaattgcgatgcccgtctggtaccttttgccatgcatacggagcatataccgccgttggttgtggaacgggtggatacgattgtgatacatgacaccatccgcctggcttctgttgcatccggacagtcgaccgtagcttcggatattccccttcgtaagaaggtgacccgtattcaggccggttatgaagctgatatttattttcctacgaatgaaatgcgtattcttcccgatcatgagttgaaccgtgcttcatggatgcatttcgttaaccaagtggattctattgaacaggataaccggaattccatatcgggagttaccgttaccggttactcttctcccgaaggatatacttctaataatgaacgtctggctgaaaaacgtgccaaggcccttcaagcgttcctggaaaataaatatggcgaacgtatggaggtggcagtcgagtgggtcggtgaggattggaaacagtttgagaaagatatagaggtttctgaccttccggaacgtaatgaaattctttcaatcctgcgtactgtgagtgatagcaatcaacggaagagtaggctgaaggcactgaataaggggaaaacattcgaaattctgcttcgggagtattttccgaaactccgtcgggtgtcatgccgtattagatacgtaaaataa

SEQ ID NO: 3031 - DNA, 582 bp, B.fragilis
aagcgatttatggtgccggttgctattaacaatgactctaattgtttcactttaggcaaaagtatgttcggcgaggggaagccttatgcccatatggtgggagttactattgggacaggtataggtgcgggtgttatcattaatcatcggttgtattgtggtcaatatatgggggctggtgaaataggctcgcttccttatctggattctgattttgaacattattgcagtagttctttctttaagcgacatgacacgacaggtgtagtggtagccgaaaaagcagaacggggagatggggctgcgctggaaatctggagggaatttgggacgcatctgggtaatttgatgaaagtaattctcttttcttatgctcctcaagctattattttgggcggaagtatagtatcggcttttcacttttttaaggatactatgaaggacgctatgcaagatttcccttataaaatactattggacaatgtgaaaataattacttcatatttgaaggatgctagcttattaggagcttccgctttgtttgagaaacaatatttaccaatatctattatagacaattaa

SEQ ID NO: 3032 - DNA, 1146 bp, B.fragilis
aataagaatatgaaaagaatgtattacataggatatatgctctgcttgttgcttgccggttgtgtagtcggtgaggaagcggacggcctgttggagcaacgtctgtctgatcgtacccttttggtctatatgggaggggataatgatttagccgacgagaccgacgaaaaattgtcagcgttaacagaggcgtgggacaggtttccggggcatctattgatttatcaggataaaaaaggagcggatagtacccgcttgttagaggtttgtttggatgaacagggagaaaaggtaacaaaaatattggctaagtataaacaggagaattcagccggtgcctccgtgtttgcacgggttgtcaatgaggctatggcccggtatccttccgttgatccgggattgatcgtattctcccataccagcggatggttaccgtcggggacggcagtggttccggccggtattacccgctcggttatcaaggacaatcattacgagatgagtttacaggattttgcttcagccattccggacgggcaatttaattttatcctttttgaagggtgttttatggccggactcgaggtggcatacgaactgaaagataaaacgcaatatattgtgggttcatcagccgaaatgctttcaccgggttttactcctgtctatcaacaaatgtttccgttgctttataaaaaagaagcggatcttccggcagtggctgctgcctattacgattattacaacagtatggaaggcgacaatcgttcggctaccatcagtgtgattcagacgtccggcctggaaatgttgaaagttcaacttcgggcggccgagagtcgtgtggagcgttgggaatggatagatcgtagcggattgcaggcttttgaccgcttatcggacgggcggcatctcttttatgatgcttcggcctatataaaacggattggaagtgttgaagaatctgctgcttttgacgaggctctggagcaagttatcatttataaagcggccacggagaactttatgccggagagtgtagggggatttaccattgacggacattgtggcatgacgttgtatatacccgatgctactgttcccacattattgaccgaaagaaagaaactgaagttaatgcaatag

SEQ ID NO: 3033 - DNA, 186 bp, B.fragilis
tcaggatgtatagtctttactcaatattgctttctatttgctcaaaaatctttcttttttgtgacgcataccctatttttttcttttgtgatagaagttgtttattgtatatatatgcaaaaggaaaatgtttttgagagtctgaataatatgttattcacttttttgcccataggaagtgaataa

SEQ ID NO: 3034 - DNA, 1446 bp, B.fragilis
aaaaacggtattgcacatttgcagcaccccgaaaaggggaggtgctgcaaaaatgcaacgctgatttttaggttatcttcagggcggaggttacatttgtcctaccctttatggagggagatgcaaacaaaatgtataagattatttaagatagtgaaattgggaagctgccaacatattgatagcaggtgttgttttacttttgtaaaccagttaaaagtaaagaagaagatgacatcaattacaccacggctcaatcgctcgcgcgaggggcgtgatggcagttatccgcttgtgatacaaattattcgccatcgaaagaagagagagatttatacgccttaccgtttctgggaggcagagtttaacacccgtttagaaatggtggagaacgtcggaggcaatcgccgtcgtctgctcattgtccgcgaagccaatgaataccttatatatataaagaaggagttggaggctatttgcagatcgcttgaagcggataaggggagtgcttatacggtggacgacattgtgaacgtttataactaccacaatgatctgagccaggtgttggtatatgccgactcggtgattgccgggctggagaataagggacgtcagggtacggctgccaattatcgtagcgcccgccgtgcgtttgagatgtttttggatggcagacctttttcatttgaggagttgactcccgaagtgctggaccgctttgtcacctttctccgtgagcggggcaaccggcccaatacggtttcgttttatctccgtcagtggcgtgccatctacaatcgtgcctgcgccgatcatgtggttttttccgatcaaaagcctttccgacggctgaacctcaaagaggaggtgacatccaaacgcgccatctcccgggagaagattgcgcagatcgaatgtgtcgaccttactgcttgtcatgctgatatgcagcttgcccgtgacctgttcctgtttagcttctatacgcgcggaatgtcctttgtagatatgtgctatttaaataaggagaacctgcagggaaattatcttcggtacaaacggcagaagacagggcaggagttacagatacgcattgaaaaagatttgcgtgtgttaatcgacagatacgccagccctttgtcggactatctgcttccaatgcttcgaaacggtgaccgttatcaggattatcggcgcaggcagcggaggcttaataaactgattcgtgaattgggcgaccggttacagttggatatgccactcacattttatgtggcgcgccactcatgggcgacactcgctcacgaaaatgatgtgcccgtctcggtgatcagcgattgtatggggcacacatcggagaagactacccgcatttatctggatcgcatagacactaagcggcttgaccgggccaaccggttggtgattaatagtctgcggtaa

SEQ ID NO: 3035 - DNA, 873 bp, B.fragilis
cataatgccatggaaaaaataattttattagttttgccatttttcgctgcatcatgcggcctagtgaaacaacaggcatctgcaccggagcctgtcaacgtcatgtctttcaatattcgctatgataatccggaagacagtctggacaattggagatacagaaaggatcgtgtggcaaatgctattcatttctacgacgtggatatattgggtacacaagaagtgcttcataaccagttggaagacttgaagctgcgtttgccggaatacggcgtggttggagtaggccgtgaagacggtaaagagaaaggagaatacagtgcactttggtataagaaggatcgtttcaacgtgcttgattcaggatatttctggttgagcgaaacacccgaagtagccggttcaaaaggttgggacggtgcttgtgagcgtatcgcttcatgggtcaaactgcaagataaggtttccgataaagaatattttgccttgaatacccatctggatcatgtgggggggatggcacgtcgtgaaggtataagccttatgctggatagagtgaatgagttaagtgatggattaccggtaattgtgaccggagatttcaattcagaaccggaatcagatgtgatcaaacacgtcacagattctgccaatccggaacatctgacggatgctcgccaggcatcttccattgtttatgggccttcctggagctttcatgatttcggaaagattccctataacaaacgtccgttgattgactatgtattcgtacgcaacggtcttaaagtcttgagatatggtattttggctgaaacggaaaacaacggttttttgtcagaccatacgcctgtactggtaacggttgaatag

SEQ ID NO: 3036 - DNA, 1170 bp, B.fragilis
  unsure (1026): Identity of nucleotide sequences at the above locations are unknown.
actaaaacaatatttcccatgctgaaacacattttgtttacatgcttctttttctttacggcaattccgttgctgaaagctcagggctgtggcaatgatgaaaaatatcatttgccttataaaaacacgtatgtaaaagaacctttggtagccgagaacgagtaccgcatagccaaacccgaaaccgttgaaccgaagagtttcgaagaagcccggcagattcttcctaatcctatttgggccggacacgaaaaggaacttgaaatgtattggagagcatgggaaatagctgttggcaatatccgtgctcctcaacaggggtcaggtttcgtatcaagttatctggatacggcttacaacggtaatatctttatgtgggattcttctttcatcctaatgtttgcacgatatggtacacgcttcttccctttccagcgtacattggacaatttctatgccaagcagcatcccgatggttttatctgccgtgaaataaaggccgacggagccgattgcttcgagcgttacgatccggtcagcactggtcctaacttgatgccttggtgtgaaatggtttattattaccagttcggtgatacggaacgcctgcataagatattcccggtactttgtgcgtattacaagtggttgaaactcaaccgtacgtggcgtaacggaacttattggtcaagcggatggggaaccggtatggataatatgccccgtgtgcccgaaggttatagtcctatttacagtcatggacatatgatttggctggacaccaatctccaacaactgtttacggccaacttgttacttgagatgggattctatctcgaacgttggcaggaaatagaggaattcgaagatgaggctaagatgttagggaagtatatccatgataatctttgggatgaaaagaccggttttctgtatgaccaatatgctgatggtacactctgcaaaacaaaaggaataggtgcctattggacattgctcactgatgtgttggatgataaacagctngaccgtatggtgaaagaattagataatccggcaacgtttatcggaaatttcgtattccctctttgtcggcagatcatcctaagtataaagagaacgggcgttattggcaaggtggcatatggccgggtaccaactatatggtga

SEQ ID NO: 3037 - DNA, 2148 bp, B.fragilis
ccaaataaaataaccctaatgaatatcaaaagatttttgctattggggataatggccctatacgccattattccggcatggggacaagcccagaaagtagaaatacgcggaagcgtaatcgatgacgagggagagcctgccatctctatcgtaatcagagatcagaatgaaaagggagatgtatacggcatcacagacctcgacggaaagttcaagatcatggcagatcccaatacgaccctgcatttctcgggatttgcctacgcatcaaaaacggtaaaactaaaaggaaagacaacgataaacgtagtgatctcatacgaagcatcgatgattgacgaagtggtgatcaccgccaaaaaagtggtggacaaactgctaccggaaccaaccgacatcgaaatcgtcggaaatcaatacatcatccaccctaaagtaaaaattcccaaagaaatgtataagccgaatacacgtatcgtagtgcaaccgatgttggtgaatattacccgtaaaacacagagcctgttccgcccggcagtggtgaccggaaaggagtatgccatcacattggaacgaatgatggaattcgacctgagcagagatccgttagcagcttttcaggagaaaacgcaaaagattgataagaatgaagtgattgcctacgtagactccctctatatggataacccggacgatgaatgccggtgtgacatctacatgtatctggtagaatataaaaaactggcatacaaagatacggtagtgatagccaaaggtacggtaaatccgatgcgtttctttacgtaccaagcagatggcatgaaaatcagagatgaaaaatacatccctaaacctcaaaaacaacaaagaggcgacagaggagaagtgaagctgaacttcctgatcaactcggcaacgatagacgaaaaagatccgaacaaccaaagagaattggagaaaatgcgcttgcgcctgcaggaaatagaaaccgatccgaactcggaattcctgtcgttttcggtcaaaggggtatcttcgcctgaaggtccgtatcaatcgaatctgaaactggcacaaaaacgcacggacagtacgctgaaacgtatctttggttttctgaacggaggtactataaacgcaataaaagacagtacatatacagaaggagtggtggcctcatgggaagaggtagcagaattgatggaacgcgactcactgcctacagacaagttacgggaaatcatcaattgctatccggacaacatggcctcacagtacagccggatcctacgactaccggaatatcggaatgtcattctaacgacttacttaccacggctgcgccgggtggaatatagtttcaactattcggtgatgagattgctgaacgatgaagaaatacgcataatgtataaacaggactataaaaaattggtaccctatgaattttggcggatatacctggatgccgataatgactctacacgcgaagtgatctgccgacaggcactggaacaatatcctaaatttatgattatggccaacgaattggctgcgttgctgatagaacaaaagaaagcagacagcaaattgctggaaccgtttgtcagcagatcggctcccacagaactactctgtaatcaggtaatcgccttaatggacgaaagagcttataaccgggcggactcgattatagactttctgccggacaacgacatgacacaagacgtaagagccatcgttggagcttataacgggcattttgaggatgcttatgaacggttcggaacgcaaggcggcataaatgaagtggtattattaatggccatgaagcaaaatgaagaagcatgggaaaaggcacaagaactaccggatgaaccactcagctattatctaagggcggcatgtgccaacaggttggacaaagtgagcgaagcatacgctttcattaaacgggccatgaacgaagatccgtcactgaaagagattgcgcagatagacggagacgtaaccgacctactgcaacagttggaagatgaaaagaaagaactgaaggaaaaagcggagaaaacaaaagaaaaaaacgaaacggaagacaccgaaacggaagagagcggcttgaatgaagaaaaaacgataaagcaatga

SEQ ID NO: 3038 - DNA, 1464 bp, B.fragilis
tatcaaagaatcatgaaaaaattaattatttttttattcgtgttgtcgggttgtgtcccggctgtggtttttgcgcagcaacaattctcttttaaagatgggaagtttaaaattgcccaatttacggatttgcattggacaccccgatctctggcgtgtactgaaacagaagcgaccatctgcgccgtcttgaaagcggaacatcctgatattgccatattgagtggagatgtagtaactgaagatcctgccattgatggttggaagtctgtgattcgtatcttcgatgaagctaaggttccttttgtcgttactatgggaaaccacgatgcggaacacatggcaaaggacgatatctatgatcttcttctggagtctccttattatgcgggagcaaaaggaccggaaggcatcatgggatgtggtaattgtgtgataccggtttatggctcgagaaacagagagaaagtagaagcattgctgtattgtatggactctaatgactatcagccggacaagctttacggtccttacgactggattcactttgaccagatagcatggtatcgcaagcaaagtgcccgttttaccaaagaaaacaatggaaaccctgtgcccgcattggctttcttccatatccctttgcttgaatacaacgagatagcaggtgatggaaagactttcggtaataacagggaaggtgaagtcgcttctgcgaatatcaattccggcatgttcgcttcatttattgatatgaaggatgtgatgggtgtatttgcgggtcacgatcatgataatgattaccttggaattaacaaaggcattgtacttgggtacggacgtgtaaccggtgcggatgcttatggtgaactgacgaggggagcacgcatcatcgaactgtacgaaggcaaattcaggtttgatacatggatcactacaccttcgggacgtgaagcgacctattattatccttccggcttgaattcagaggaagaacggaccgcggactacctgccggcagtaaagaatgtatcttcacccaaacaaggggtggcatatacctattatgaaggaaagtgcaagcgggttgccggcatcgcttcttgtcttaaagtaaaagaaggggttatgaagaatatttcgatcaaagaggctgccgttgcaaatcactttgcctatgacttccatacgttgatacagattcccgaaaaaggaatataccgtttctatacattctcggatgacggttcaatgctttatattgacggtaaattggttgttgataacgacggtggacatagtgcccgccgcgccgaaggaaaaattgctcttgaaaaaggttttcatgagttgcatttattgtattttgaggattacatggggcaggaattggaagtaggattctccggactggattttccggaagttcctctgcaggatgaaatgctgttcttaccgaattaa

SEQ ID NO: 3039 - DNA, 570 bp, B.fragilis
tccggcaacgtttatcggaaatttcgtattccctctttgtcggcagatcatcctaagtataaagagaacgggcgttattggcaaggtggcatatggccgggtaccaactatatggtgatgcagggacttgtaaagaagggatatcataaattggcccgggagattgctttgaatcattatgccgaggttctggaggtatataaaaatacagggacattttgggaatactattctccggagaaagcggagcccggatttatggcgagaaaagaatttgtgggctggactgggcttcctcctattgccgaactgatagagtttattatcggcattaggggagattatgtcaatcaacagataatctgggatatgaatttgactgaaactaatggaatagaacgttatcctttcggttcggaaggaatcataaacctgaaagctgaggcacgtcgttctgcaaatgatgaaccacgtatcgctgttgatacgaatatcggttttgagttgctggtgctttatggtggtaaggaaaagaaggtgaatgtaactcccggtaagcatacctattaa

SEQ ID NO: 3040 - DNA, 543 bp, B.fragilis
tcgacagtagtcttttttctccttgaaaagcggctgaaagtaccggattttctctggttacttctcaattttgattggcgcaaatctgtgaaaatgtttctcttttatgccgatctctttaatgttgtctttgtgttatgtgctttttgctgtctttattgtaatatgtactttgtttttgtttctttctgtattcttctaatgctgatttacgggcttttttccagcttcccagtcagtcgggcaggaaaaacaaattctatcgcaggtaagatatacaatttgacaattgtcagattcttgctccgaccgtttatcgaaagtataagtcaatctcttttgattaaagatgcagcagggatgtattcttatattcctaagcaagcacaagtccgcattcgtttcatgtctttctataatgtatatacttttcttatctgtcacatggggcgtgagatgtcgttttcaccttgtccgggctgttcagagacccggttatgcgatattacgtggtttccatgccctctaggggaagccggataa

SEQ ID NO: 3041 - DNA, 192 bp, B.fragilis
caggctccggtgcagatgcctgttgtttcactaggccgcatgatgcagcgaaaaatggcaaaactaataaaattattttttccatggcattatgtcattaattattttacaaacaaggctgaagtaggaatcggtgctaattcctttgcagaaggaagtttccagaaccagcttaaatgctccccttcataa

SEQ ID NO: 3042 - DNA, 1656 bp, B.fragilis
actaacttattaataaaaacagttatgaaaaaatatataccattattggcgttatcggcactaaccttttgctcttgctctgactttttaaatgtgcagccggaaggtaatcctgccactacatcctattttttgaatgatgaacaagcgattgatgccattgacggactttatgctcctattcatcaggaaaaaggctttggacgtgagttgttttgggaacaaggtgctgcttgtgatatagtatgggctaaatcacgtggtttcaactcgttagctacctttaactataacggtgatgaaagtcccatcagtggtggatttgacttattctaccaaaatatggctcgttccaactggattatcaagcagttgcttgccaaagagaaaaaaggtggactaagcgatgtagaacatcggagtttgggtgaagctttctttatgcgtggcatggcgcatttttggattgcttaccgttatggaacgaaagaccaaggtgtaccttttgtgcgctacgaagattttgagggcgattatgataattccatacctccacagcaggcttctgtaatagacaattataagtttattatagaggatatggataatgccatttcttatttgccgaaattcgaagaatattcagatgatgataagggacgtgctcacaaagctgccgctgtagcctataaagctaaggtatatgcctattgggctacatgggatgaaactcaatggaacaatgtaattgctatggttaattctctggaaactgattatggacgtggtttggctgatacttttgccgaagtgttctcttcggagtttacggatttttggaataaggaatatatttggtctattccttccaatggtggctctacaggcggcggtgttgaattccccggagtgattttggaagataaagcttggggtgtgtataatggctggggccacataaagccttcttacgatatttatgaagaaatggcaaaagacggtgctggtaatgatcgtctggtgcgttctattttggaatataatcaagagttcgaattttttggtgagaaacgtaaattctatactgatacaaacttggatgtaggtttccagattaataaatatatggacccgttcaaacataaggatgccgatactaaaggatacgttaacacaaatggcaactggcccactgctcgtgtaaatttcccattgattcgttttgcggaaatgctgctgttccgtgccgaagcctatttaatgacagatcaacctggtaaagcgaaagaagatttgaatcgtatccgcagacgctctaatttgaaagagttaatagatatgcctactatggcggatttatatcatgaacgacgttgtgagttggcttttgaatatactgaccatctgtttgatttgaaacgttggcatcgctcgtcaaatgttgtaatcaaagaattggctgcaaaagaattgaatgcccatcctcgtatccgtaagtatgcggaccgttctaatccggagtcaacttttacaatagagccatatgccgactatctgaataagactccttatcaagattatatgatggtatttccttatccggctgaacaaattactaaatcaaacggtaagttgatacaaaatgacggttattag

SEQ ID NO: 3043 - DNA, 786 bp, B.fragilis
atgttttcattgtgtacgagattgccttgtgcatcgaggcagaccaccttacaaccggtgcgaaagccgggatcgatacccattacccgtttttgtcccaagggtggggcaagaagcagttggcgcaggttttcggtaaagacccggatcgcttcgtcatcggcctgttcttttactgagggaggcaaattcggtttcgatggaaggtttcagcagacggcggtaggcatccgcgctgatgacagcctggcgggcaaagagattacgcactgcattacgggcacgttcgtcttcgctcacctcggtgtccatttgcattggagcgatttgctcttaagcgggttgtttttcgccatggttgccattgtcgaagaaactatgatgcgcggatatgttctgggacgtttgttgcgtacgcgtctcaataaatttatttctcttctcatctcttcccttttgtttgcgttgcttcatctgatgaatcccaatgtggcttttttacccatgctcaatctggtgttgggagggttgttactgggagcttcttatctttacacccgtaatctttggtttcctgtttcgcttcatttcttttggaactggattcaagggcccgtacttggctatgaagtcagtggcaatcgtttctgtgaaaccttgttttcacttcgcctgcctgcaaataatctgattaatggaggggcatttggttttgaaggttcgttggtttgtaccgtattggcaacactctttacactattcattatctggtggttcgaacaataa

SEQ ID NO: 3044 - DNA, 1599 bp, B.fragilis
aaaataacattaaaaatagaacgaaaagaatgttttcgcttgcgatctttgtcatctaaaagattttctataacttgccacaagtttattacaaagcagaacagtagaagtatgaacataaaagagatactaaaccaatccgaagggcgtagattggaatttaaggcagagttgccggagcattccgatttggctaagacggttgtggcatttgccaatgatgcaggtggcgacctgtatattggtgtggcagatgatcctcgtgaagtggtaggattggatgaggacaaattggtgactatcgaggagaaaataagtaatattatttttgaccgttgctatcctgcgatattgccggaaataaaatttataagcgaagaaaacaaacacttgattcaggtgactgttttcagaggtagcacgccaccttattatctcaaagagaaaggtaagttacaagggacatttattcgtgtaggctcggccaatcgacttgcggatgaagctatcatctcggaattggaacgtcggagacgaaacatctcttttgatagcgaagttataccagataagcctgtaaatgatttgaacatagatggttttaaggctatattcaaggagaaaacgggggaagaattatccgaccaagcattaaggaaattagacttggttaaagatatgcaaggagcagaatatccgaccaatgcgttgattctattctcggacgacccgttgcgtaactcgttgtttcactatgcaaaggtggagtgtgctcgttttaaaggtgttagtatcgatgatttcatagaccaaaagagtattacgaccaatattgccacacaagcagaggaagcatacaactttgtgttacgccatatcaataaaggtgcttcggttgagggagtgtacacagtatctcgttgggagtatcctgttaaggcaattcgtgaggcgattcgtaatgcggtggttcatcgggattattctctcacaggaaaagacgttaagattgcgatctatgatgatatggtagagataaccagtccgggacttctaccaccatcaatcgactatgctgcaatggaaagccgtcagagcgatgcacgcaacaaagtaatagcccctgttttcaaacgtcttggtatcatcgaccaatggggcaacggcttgaagttgattgccgatgaaatgaaagagtatccaaacatcgaacttcgttggagagaggtgggcttgtcgtttcaggtacagtttgtgaggctggattatgtgctgaacgcagagcggataaaggatatacagcaagagttgcagcaagagttgcagcaagagttgcagcaagagttgcagcaagagctacgaaaggcgacattgtattcggaggtattgcgttgtatagtaagtaatgctttatcaaggcaagatatatcccttgcattgggacaaaagaaagtatcgggacaattaaataaagttattcaaaaactgattgccaacaacctgattgaaagaactatccctgagaaacctaaccatcctgctcagaagtttcgactaacagaacgtggacagttatttcttggtttacttgctaaatga

SEQ ID NO: 3045 - DNA, 225 bp, B.fragilis
gtggccagttcccggaaagggaataaaaacctaaagcattggaggtattggatattccaagccctattatacacctgtactgaaaagctgaaggttctggtgaatggggttttacttcgttgtgatgctgattatttattcattcgcaatacgggtgaaggatacatatgggatgaaacaccgatttttataagaataatgccccaaagttggcaacaaaaatag

SEQ ID NO: 3046 - DNA, 207 bp, B.fragilis
gaaagcagatttgttaacgagcttggaaacggaacatcaaggctcaccattccggtaaatgacctgatgaactattatgtggagtattttcacataagcaaacagaacgggttggttgaatattgcaataaggcgattgttactttacaacagaaattggataaagaaaaagataattttaataaaagaatcaacagtttgctatag

SEQ ID NO: 3047 - DNA, 234 bp, B.fragilis
tatgggaagccagctcgtggcaggagcggccaacagcgtcatcaacgccaccaagtcggcggcaagcaagaatatccggaaggtaaaggtgacaatcaagaccaactaccgcatactgctcagacagtcgaaagagtgaggaaggaaagagcctgtcggggctgtccgatgacagcagatgctgcccggctcctgaaggaatttgatcagataaagaacctaaaaacgatgtga

SEQ ID NO: 3048 - DNA, 1611 bp, B.fragilis
aatttgaaaacgcataaagaagtaacttcaaataaaagtaaaacactggattttgtaataagtaaaacaatgaaaatatttagatatatattgctcgcctcgcttacctgtacgcttttctcatgcggcccggatgaactgataccggaatccgtgccaccggtggtgaatcccggggataaggacgagccgggtgaagaaccggaggagccggaagagcctgcaaagatacagctgggcatcacggcatcgctgcagaacatgcagcagaccaggggaatcatagaggcttttgctcccggccatgaaatgggagtctttgtcggaacaagtcagacagatgaagcagcaggtataaaaaacgcctcctatctttttgatgggaaagtatggaatgccggacaggatgtaccggtggaagcggacgccgatgtggtggcatacctgccatataaccgggaagtgaccgatttcaagagcgtacctttcgacctagcggatcagaatgacatcctgtacggagcggccaaagtgaccaaagatgtaccgacggccagcctgatgatgcaacacgccatgacactggtacgtatgcggctgatgaaaaacgaatatatgggcaccgggcttgtctcggacatgacattcgccggtgtattgacatcaggaacagtcgacgccctgaccggagcggttacgaaagattataatcacggccggggttcggtaaaagtcggaggaaactacatgctcaatgacgagaatcccgtcattgtcgatgccatcatgatcccaagggcagcgtatgacgaacaggcctccgtcagttttgtcatcgacgggcaaaagcacacatatgccttcccggtacagcatgaatggaaagccggcatgaaatacacctacaccctgaaaatgacaggaaactacaatgcgccggtcaacaaggagcaggtggatatcgacgtcgaatattggggacagtatggcaagaccgatgatattgtactcaatccgaatccggaagactacgaatttaccatctggccaaattatactgcatatggttatgactgctaccaaaatgaaggcaaggtattcgggacattctattacccttggtgcggcacttcggaaggtgaactgcgtttcgtgttcatgaaacagggtatgaatgaaattgtggaaaagttccagccgattgacatcaagacgaatggtggatgggatggcaagcgcatccagtgctacatcacctccgtgccgggaacataccagctcgttccgttgttccgcaggaaaggagaaaccatgtggtgtagggcagcggattatgatcacggcagtacggattgggagtggctctatgaagtcaaagcacccgcaccggatgatctgccggcattgcgcatgatggaggtggaaggacagggatatacctcaattcttgtatatcccgtccctgacgagacctcatggaatctggtatatactttatccaataagggagaaaaagccctgagaggcgaaataaaagcggtctgggagagggaattcaagctgaagtccaactcgtatcggccaagtgacaaaaaaaaaggggctatttaa

SEQ ID NO: 3049 - DNA, 189 bp, B.fragilis
gaaggagaaacaatagatgtattcatgtatgtatcggattatttgtctctttgcatctttccttgtgtcttttttgctttaaagatttatgataagctttccaaaaaacaaaaaaatggaaaacaatattcagaccgagaacaaggcaaaataataaccggatcaagtaatccgctttttcccaaatag

SEQ ID NO: 3050 - DNA, 201 bp, B.fragilis
atggaaactgcgtttgccggttatgggatgaatccggatgccaaagccgctgctcttcctgaacctgtctttcaggggacaggtgagcggaatcctgtcggatactccgtaccgggagagtatatcccggtagctttccagtgtctccagacgttcgcatctctccagtgccttgtcgagcagttcctttccgtcgtttga

SEQ ID NO: 3051 - DNA, 324 bp, B.fragilis
ccggcaaacgcagtttccattcaggtattgacatgggcgtggagctggcagcccccggtttacgccaccgctcggggaacggtttctttcgcgagaaggaaaggggggtacgaaagatgtgtcattatacgccattcttatggctttgaaacgctgtacgctcacttagccgcgtattacaccacagaaggtcaaaaagtcgacagaggggctgtaatcgcgtttgcgggaagcacgggaaagagtacgggctaccacctgcattatgaaatcagaaaaaacggtaaacctataaaaccatactggtatggctatgacgattga

SEQ ID NO: 3052 - DNA, 417 bp, B.fragilis
tcgggaagagcagttcgagaaaaaagcccccggcctgttaaaaagcaacgccaatcactcattaacatacagatgcgcatcaccgcacgaccgggggcaaagaccctcgtcgcggaatgcgctttttatctgtatatgaatgattggctttgcaaagataaaaaaatattcgctatgacactgtttgagattctaaattttaatagggaagtcctggaacgtctggccggtatgggcttcaaaccggatgactataagtacatcgacctgtataaggagtatgaaaggatgcgctgccagggtgataaagtgacgtattgtgttgcggttctttccaaccggcacggcgtttccgaacgcaaaatctatgagatcctgggaaggttcaaaaaagagtgtacgtttcatgcagtataa

SEQ ID NO: 3053 - DNA, 327 bp, B.fragilis
aagggagggcaaagcggagctgatgaaatgcctgtacctggaggagaggtattttaccgagtttctgaagctgtcgggacaggaggagggattatgaccaccctttcagttatcagctatatagagaggatcaaccgggtgtaccggctgatccggatggaaaggaccggaagcctggacgaactggcctccttgctgcgggtaagcaggcggacaatcaacaattatctggaggagctccgcctgatgggtgccgagatcaagtttagcagaaggcaaaaccccatattatttcaagaacaaattcgtattgcacgcgacggttaa

SEQ ID NO: 3054 - DNA, 1239 bp, B.fragilis
acaacaactaaaaacaaaaaatatacaatggaaaccatacaggaaattatagatacaataaaacaatggccggccaccatatggtgggttatgggagctcttttcattatctcctggttttgggatactccaccgagaaagaaacgaaataaagataaaatgacggatgataagaataacgacttaaaaagttcaaatatgactgataaaaaagaatttaaaggcaacctgatgaaagaaggcatttttgtgtgggtcgtattcgcaccggatggtaaggccggtttatatatggatggtgagaaacaccttgaaaatggaacatatgcctatggaaaccggctttccacggatgtatcctcctttcatgaaatctgtaatctggataacaaacccgtgtacctccactttccggaacacgggatttcagtacgctaccggatacgccttcgatattcccgaacagacgatgccggtatagaaaggtcggaacatgaaccggaaacatgccttcctgcatggattgtaagagggaaaacagggcaaacaggcctgtaccttcagaaatggcatgaggaaaaatgcttcattccggatatgtccggattaccgggattgccggacctgcaaccggacggtatccccgtaaggatcgagatgctgataaggaaggcatatccgttttttgacctagttaagccggcttcttggagaagctggggaatcagcagtaatccggcatccctgaaaggaaatttctttgtaaaccccggggagggaaacctgacgggagagggagttgtcatgtggaccgtatttaccggggacggaaaagcggcattgtatatggatgaccggtggcatcttgagaacgggatattggcttatggcgaaaggctctcccatgacgtgccggttttacataagatctttaacctggaagaaatgctcctgttccgtcatttcccaaaacggggagttccgcagaggatcagaatgcagctgcggtttcccggaacaggagaggcgtgcaaggagcggccggactgtaatcggggaacatacttcctccccgcatgggtcgtaccggaagaaagcggccggatcagcctgtaccttcaggaacaactgtccggagaatgtgacattcaggatataagccggctaccgggagcacccaaactgcagccgaatggagttccggtcagggtagagatactgctacaacaggaaggctga

SEQ ID NO: 3055 - DNA, 189 bp, B.fragilis
agaattttaaaactatgtgatatgatacaggaaattatagatatgataaaagagttatcgggaagcgacatactctgtctaagcttctattgtggatttattctaatactgtcacacagaagtaatgaaaaggcatctgtgtatggagaagaaaaagtcccggataatagtccggaacctgaaaagtaa

SEQ ID NO: 3056 - DNA, 408 bp, B.fragilis
agccgacaaaatattaaggaggatagcccgatgaaactactgctggccctattgctttcctgtctccccttcaatggatcaaacgacggaaaggaactgctcgacaaggcactggagagatgcgaacgtctggagacactggaaagctaccgggatatactctcccggtacggagtatccgacaggattccgctcacctgtcccctgaaagacaggttcaggaagagcagcggctttggcatccggattcatcccataaccggcaaacgcagtttccattcaggtattgacatgggcgtggagctggcagcccccggtttacgccaccgctcggggaacggtttctttcgcgagaaggaaaggggggtacgaaagatgtgtcattatacgccattcttatggctttga

SEQ ID NO: 3057 - DNA, 210 bp, B.fragilis
aaacgatgtgatatggaaactatttgggaaaaagtggattacctgggccggatattatgctgcattataatgggaattgcatatatacttataatgatagcccctctttatgcttcacgccacgaacagtctgggcaaagaagtgatgaaaaggcatttgtggatgaagaagagaaagtcccggataatggtccggaacctgaaaagtaa

SEQ ID NO: 3058 - DNA, 894 bp, B.fragilis
gaattttgctgcccggaaatacaaacacatatattacacgacaaaatgattatgaaaaaggaaaagacttactcccgtgctccgcttcctttcgtgggacagaagcgcatgttcgtatcggaattcaaaaagatactgaaacattttgatgacaaaacgatatttgtcgacctgttcggcggctccggcctgctctcacacatcaccaagcgtgaaaggccggatgcggtggtcatatacaatgaccatgacaactaccgcggacgtctggaaaacatcggccggaccaatacccttctgggagatctccgtaaaatagtcgggatatatccccacaatcagaagattaccggaaaaatgcgcgaagctttccttgaacgcatccgcctggaagagacaaccggtttcgtggactatctcaccctctccacctccctgctgttttccggaaaatacgcacaaaacatggaggaacttgaacacttgtgtttttataacaagatacgtcaggctgactaccggtgtgacggctatctggacgggcttgaggtagtctgctacgactataaggaactggcagagacctatagggtccttccgggagtggtctttctggttgatcccccttacatgggaacagacatcagtacgtaccggatggactggaagctgggggattacctggatgtcctgccggtactgaaaggacacccgttcgtttatttcacctcctccaaatcccccatactggatttctgcaaatggatggaggaacatcccggaacaggcaatcctttcaaggggaccggccgctctgcaattaccgcacggatgaattacaactcctcatataccgatatcatgctttacaacaatatggcttgtactgcctga

SEQ ID NO: 3059 - DNA, 816 bp, B.fragilis
tcaaggagatgcaaacgtatgaaaacaattacaacagcatgtgtgaaccataagggaggtgtcgcaaagacaacctcgctgctgaacctggcagccgggatcgcacggatgcataagaaaagggtctgcattatcgatgcggatccgcaggcgaatacgacaatggcagcgttcggggaggaaatggcaagtcttccccgggaggttctgctcgagagtgcgctacaggactgtatgcaggacactccgccgaagttaaagccgcaaaagtggctggagaaggtggacatactgccggcctccctggatctggcggctacggaagtgatcatgtacaccacacccggaagggaattccttttcagggaaatagtaaagggactggaagagaagtatgaccacatacttatcgactgtccgccatcattggggatcatcacgcagaacgcgctgatggcaagtgattacgtgatcatacctacggacgggaattacttcgccatgaaaggaattgaaaagatacactatatcatcggactgctcaaaaggaagctgggagccgaagtcaggatactcggatactttatgaccaagtacaatgccaggagaaagctggatgtggatatcagggagagtctggtaagaagtttgggagatggtgtctttgaaacggtaatacgcagcaatgttgccttgggagaggcacaatacaaggcacagagcatatttgactatgcgccttcgtcaaacggggctgatgactacagggagctggtcaaggagttcctgggcagaattaaaaaaataaataaatag

SEQ ID NO: 3060 - DNA, 999 bp, B.fragilis
ccagcaatacgagctcttatgacacgggaagggaaaagcagaacagccatactggcgggcctggcgattgtagtagtcctgctggtgtgggtaatcatcgccagcctgcccgactccgggagcaaggagccggaaacgggtgaggtgatcctcagaacgcggatcaaggagagttttacgctcgatgacatgctccaaaaagtcgggaaggagaacacaagcaaatccgcttccctttcaggtttcgacccggtaacggaggagcctgcggacacggccgggaatgaaagggagatccggcgcatacaggagctgatccgggataacgagcgggagctcggagcgggaattacggtcccggtacaacagccggttgcttccgggggaaaggaaaaacctgccttgcaggaaaagaaggaagaggaagtacggcccgggcagcgcaaagccgtggatagtgtgccccgggcaccggcccgcaggggattcaacacggtacggctcgtcaggcaggaagagaggaatgccatcaaggcgttcgtacactccacacagaccgtcatggtcggttccaccctcaagatgcagctggccgaaaactgcctgaccgatgacggacagcgcatccgcaaagggactcccgtattcggggaggtgacgggcatcaatggtgagcgtgtcctggtaaagatcacctcggtaaacctgggtggaaatatactcccctttgataagcaggtttattccgaggacgcaatacaaggaatctatgtaccgggcaatgtgaaggcggagacagcacaggaggccggagcggcgggaataagcggcgcgaacaccaatatctccggaggatttgatatgggaagccagctcgtggcaggagcggccaacagcgtcatcaacgccaccaagtcggcggcaagcaagaatatccggaaggtaaaggtgacaatcaagaccaactaccgcatactgctcagacagtcgaaagagtga

SEQ ID NO: 3061 - DNA, 294 bp, B.fragilis; identical to SEQ ID NO: 1481

SEQ ID NO: 3062 - DNA, 624 bp, B.fragilis
aatatgaaaagaatacttacactgatattgtcgttttgttgcctgctttcttttgtaagctgcgaaaaaaaggaaattgccgacacttttgaagcaaacatccggaaacttcatggagattacaggctgactgatatccattggcccggcctggcagttgacctgaaccatgacggtatagggcactgggcgctattatatgaattccagaataagatcggctattatgagcctgactataccgccagcgtatctgacggcatggtattttctcacgatgaaacctgggcaaggcctgcaaccgcattcaatctgaccattccatgtccgcgttatattgtctcagaggggaaatgggtatgctcaggaatccatggcatccaggttactttgcgtgctgatgtggattccttcagtctgcagtcaaattgcagcaggatatttcccgcatacaatgaccgggatgacgttttcctggccaacatcaaagatatcagcctggttgtcctgtcatatgatgccgcgtcattcagaatcggcgtgcattgcacactcccttacgaccgtcctgacggaacacaggagctgaacgagaattatttgtattacgagtattcaaggtag

SEQ ID NO: 3063 - DNA, 783 bp, B.fragilis
gaaaagaaaagcagctgttcattgatcttccctgccggtatcacctacgtcgattacggaagcacgaacgtggaggtggacaagcccgagggggtggataatatcctggccgtaaaagccgtccagccctataaggaggatacgaacatatcggtcgtacttgaagggggaaagttctacactttcgacctgcgctatgtgcccgctccagagcgtttcagcttcgtcattgacaaggaggatacgcagagggtggccatactcgacgaaaaggaacgctcttacggacagaaggaaaggatcagggaggctatcgcgaaacgtaccccgctggatctgggactgaaggacaagaattccggtgtggagttcgaggtcggaaatatcttcatcgacggggatatcctgctgttgcgcatgaccctgataaaccgcacacagatcggttatacgacggatttcatgcggttctacatccaggatgccaagatccgcaaaaagacggcggtacagcagctcgagcagaacatcctgttcactttcgattatccggaagaagtaccggcacatgaaagccggacattcaccgtggccatgaacaagttcaccatccccgataagaaacggcttatcatcgagattcaggagaagaacggcggccggcacttcctgtataagctgaagaataagtcgctcctgacggcggaggaagtattcagaagcagaaagcaacaggaaacggaggatgaagccgacaaaatattaaggaggatagcccgatga

SEQ ID NO: 3064 - DNA, 405 bp, B.fragilis
gtagatatgagactaaaaccaatttacatcaccaccctgcttctcctgtttttcctttcagggagagcgcagaagatcgaggaactcaccgcagtccccctgcagatcgggtatgaaaagaccctgcacctgatcttccctactgaagtgaagtattacagcatcggaggggattacgtcatcggtgagaaagtggtcaattgcccggggatcatacgcctgaaagcggcggaagagaacttcccgggggaaacaaccctgtcggtggtaacggccgacacaaagttctattcgtactccatcagctacaacgcacatccggcccagagttatgtgcgtataggcggagaagctcccgcaccggaatacgctgccggtaggaaaagaaaagcagctgttcattga

SEQ ID NO: 3065 - DNA, 354 bp, B.fragilis
aaccatactggtatggctatgacgattgaacaggaaatagaacagctggtactgaagtgtatcgcattggacgggctgaaggcctgcccgaaagaccttgccttccttgagaaatacggactgaagaacctgtatttcttttccctggaatacgcgatggaagggacggatgcgacggttctcgacagtaaggcgaaagggttgatcagatggtacctctattcgacggattttcccctgctgcggcagaagtatgaaagggagggcaaagcggagctgatgaaatgcctgtacctggaggagaggtattttaccgagtttctgaagctgtcgggacaggaggagggattatga

SEQ ID NO: 3066 - DNA, 195 bp, B.fragilis
  unsure (42): Identity of nucleotide sequences at the above locations are unknown.
tcattttggggtaaaagaggcattgaaaaggaaagtgttccncgggtacaggtcggcgggatagtttgggtagaaagccatatagtgaacggtaagtttatagccagtaaacttggggttaaacttacaccgccaaataatcccggaataccccataaacgtcggggttcaatagcatgtattcaaatgccataa

SEQ ID NO: 3067 - DNA, 198 bp, B.fragilis
caggccgggggcttttttctcgaactgctcttcccgattaaaatcccctggaaattcctgctttcatatggctctatatctttaaagaccgcaagatataacacatggttgcaattttattgcgctgtagcttttcccatgaaagaaatacgttatttaactaagtattctactttaaagagtatattactaatatag

SEQ ID NO: 3068 - DNA, 1182 bp, B.fragilis
caaaagagtatgatacatccattattaacaaccattaaaaaacgattcattatgaagaaagtaagatttttactgttggccgcaatggtggccatgtttacaggatgccagaaagaagtggtggaacaggagttggataacaacaaaccgacccctaccggtgatacgcgcatcatcatcgagggagaagggatgataggtccggcaaccagatcctcggacgggaaagtggagtttgaagggggctatgcaaccggagcagggctatatgatggtaaaaaagccgttccagtggaagcccatcctgatgccggatatgaagttaattatttctatggcggtccggaaaaccaacctaaaaagtatgactatgcacagtcaggaacatcggcttttaatgtttatttagaaggccaggatcacaccttccactgtggattcaaagaaaagaaacgtgatctaacagtgaatgccggaaccggaggttcggtgtccccatcaggtacaaacagctaccgcgtggagaagccgatcagcattacggccaccccggacagcggatatgaatttgccggttggacagttacccaaggtgatgtaacgattgagaatcctggcagcccggctaccaccgcgaccctgcataatgataacagtacgattactgcaaactttaaatccggcgctgagttggtatttactgtacgtgccagcgcaaataaaattgtgccgatgccgactctgggttccggtccttatactgttgattatggggatggaaaagtagcccacgaggtaaaccttcgtgctccgggatatactcaatatcctggcagttaccatacatactcagcagatggggagtacactgttacaataaagggaccggctgcgactgctttttcattcagaggtacacgtaacagtgaccttcagtatataaatccctgtccggcaaagtctattttaaagaatacgattgatataagttgtgtaacgtcactggaggatgcttttagcggaatgaaatcattggaaagcatagaatgtgatttgttagaaagttgtaaaggaagagtgacaacttgcgctaatatttttgatcaatgtacaaatttgcataccatttataatggattgtttgaaggctttgataaatgcactgatttctcattagcatga

SEQ ID NO: 3069 - DNA, 426 bp, B.fragilis
gagctcgtattgctggtcataggtacggaagaagaaaccggacgtattttccggaaagcgcggagtggcatggatggcggtaccctcactcagaatccgtactttcctgatgtcatcgccattgataatgctcaggatggaggagaacctgacatggtactcctcaccgtcggcgcgtatgtcgatgatcttttcaaactccgtcttgtagacaacgccgagttacagcgcatcgccataggcacggtccgcctggtatttggcaaaaacggcatttgcgtccggcttgttgaccaggaacagggcacgggcacggttttcctgaagggaaaggcctgtctagcttgttcacgaaatatgcccttcctgctggagtgcgattttcaggaggtttctgtacaagaggccctggctgattgtccttga

SEQ ID NO: 3070 - DNA, 363 bp, B.fragilis
agggaggtattccacatttccggcaaagatgttatccaggaacagttctcaaagcaagaggatacattttcaatcgccctgcaattctcaaaaacattaccgggtacagtagtaacatgggactgccggaaagttcccctgaaaaaagtcgcctttacgcattttgcgaataaacgttcggggaccgtacttatgttcagcagctcaaaagtggaagcaaactcttgcgcatttacgcaatcatcaaacaatcctgccggaattgataaaatattaggtatagccgagaaggtagaattaaactttacggccgaggtacatcctctgaatgtatttgctggaatagaattaagggctgcataa

SEQ ID NO: 3071 - DNA, 693 bp, B.fragilis
caaaaaagatcacattttcatagtgttattataatatttacgtatatttgtaatcaaacaaaaatatcatatacacaaacaagaataccaaacttattaattatgaaaaagctattattaaccactctgttgatcttcggaacagccatcgttcacggacaggacaaaatgcaattttcaataataggaggatatgaacacttcaaaaaagaaaatccacacaaccaaactgccggatatggtttaggttgcgagttcaagtattatttctataacagactctatgctctggccaactttcatgcaggtatttataatgaattcacacctcgaacagccatggcggaaataggcgaagtggacttctcaatgcactggagaactcgcgaatataaaggtggagccggaatgggaatcgatttactaaagacacagagacataatatatacacgcaagccacatttggattagccaaactcaaacagtctgttccggttatccacagttatagaccaacagtggaaatgggaactaaaaatacctacttactccgatacgccacctccatctcaataggatatgattatcgggttagtaaatctttcagtataggcctcaattatacaggctggtgggtagcagacgtcgcatacaggaacacgctaaatgccaaaattggctataatttctag

SEQ ID NO: 3072 - DNA, 534 bp, B.fragilis
tttctatatccggtaagtccggatactcctttattcatttataaaataactcttatgaaaataaaagtaggttttggtttcgacgtccaccaattggtcgaaggacgtgaactttggttaggaggcattcttttggaacatgaaaaaggattgttgggacattcggatgccgatgtattggtgcatgctatttgtgatgccttgctgggtgctgccaacatgcgtgatatcggttatcacttccctgacaatgccggtgaatataagaatatagacagcaagattttattaaagaaaacagtggagctgattgctgccaaaggctatcagatcggtaatatcgacgccactatctgtgcagagcgccctaaactgaaagcccatatcccttcgatgcagcaagtgcttgccgaagtgatggggatcgatgcagatgatatttccattaaagccactaccaccgagaaacttggttttaccgggcgggaagaaggtatttccgcctatgcaaccgtgctgatcaatcgcgtgtga

SEQ ID NO: 3073 - DNA, 786 bp, B.fragilis
ggaaaaatgcctatgctgatacttttatcttgtgccaaaactatgagtgacgtttcgaagacaaaaacgcctctcactacatttcccggcttccggaaggaggcagcggaggttgctctgcagatgtcacaattttcagtcgaggagttggaacggctgttaaaggtgaatcctaagattgctgttgaaaattatagacgctatcaggcttttcactcggagggtacacgggaattgcctgcattattggcttatacagggattgtttttaaaagagttcacccccaggacttttcagaagaagacttttgctatgcccaggatcatctgagattgacctcattctgctatgggttgttgcgtcctctcgatatgattaggccttaccggcttgagggagatgtacggttgcctgaacccggcaacagaacgatgtttgattattggaagccaatccttacagaccggtttattgcagatatcaagaaagccggtggggtgctttgtaatctggcaagtgacgaaatgcggggacttttcgattggaagcgggttgagaaggaggttcgtgtgataactcccgagtttcacgtctggaaaaacggaaaattggctacggtagtggtttatactaagatgtcacggggcgagttgactcgttatattctgaagaaccggatagaatctgttgaacaattgaagacattcgcctgggaagggtttgaatttaacgaacagctttcggacgagacaaaatatgtatttacaaacggaaaaacagaatga

SEQ ID NO: 3074 - DNA, 1434 bp, B.fragilis
ggccaaaagtttaatttttattcgaataagaaaatgagcacagaaaacgaagaatggcgcgaagactccaagagtgagaatacggacgccggccgtgatggtaacagaagttttaacagagaaggcggatacagtcgtccttcatacaatcgtgaaggtggcgaccgtccttatcgtccgagatttaatagtaatagtgaagatcgtcctcagcgttcttatggtgatcgtccgcaacgtccttcatataatcgtgaaggtggcgaccgtccctatcgtccgcgttttaacagcgagggtggtgaccgtcctcagcgttcctatggcgaccgtccgcaacgtccttcatataatcgtgaaggtggtgaccgtccctatcgtccgcgttttaacagcgaaggtggtgaccgtcctcagcgttcttatggcgaccgtccgcaacgtccttcatataaccgtgaaggtggcgaccgtccctaccgtccgcgctttaacagcgaaggtggtgatcgtcctcagcgttcctatggcgaccgtccgcaacgtccttcatacaatcgtgaaggtggtgaccgtccctatcgtccgagatacaataacgataacagatcgcagggattctcacgtccgatacgtcgtacgggggattacgatccgaatgctaaatacagtaagaaaaaacagattgaatacaaagaacaatttgttgatccgaatgaaccgatccgtctgaataagttcctggctaatgcaggagtctgctctcgtcgtgaagctgatgaatttatcacggcaggtgtagtttctgtcaatggagaggttgttacagagttgggtacaaagatcaagcgcgctgatgtggtgaagtttcacgatgaaaccgttagtattgagcgtaaggtgtatgtgttgctgaacaagccgaaagattgtgtaactacttcagatgatcctcaggctcgtctgactgttatggatctggtaaaaggggcctgcgctgagcgtatttatccggtaggacgtctggaccgtaacacaacaggtgtattgctgttgactaatgatggtgatttagcttctaaactgacacatccgaaatacctgaagaaaaaaatctatcatgtatatttggataagaacctgactaaggcagatatggaccagattgcagccggtattcagctggaagatggtgaaatccatgcggatgccatcagttattctgacgaggtgaagcgtgatcaagtgggcatcgaaatccactccggaaagaatcgtatcgtccgtcgtatatttgaatcgttgggttacaaggtggtgaaacttgaccgtgtattctttgccggactgactaaaaaaggattgcgccgtggtgagtggcgttatcttacagaacaggaagttaacttcctccggatgggatcttttgaataa

SEQ ID NO: 3075 - DNA, 627 bp, B.fragilis
aagataaggttgggaaccacttattcactggatcatcccgagaaattcttgtcggaaaaagccatcgcccgccgccagcgtcagcagttgcctgtcgactctaccgatctgccggtctgccgtcggtatgtggatgccatccgcgacaggggagtgaagattgtggctatgggaaaatgggataatttcgtcactgtgtcatgtaacgacagtgccgtgataggcgaaattgccgcactgccttttgtgcgtgctaccgaaaagatatgggttgccccgtcgaaacctgcagcggaagataaacgggactccctggcgaacagtccgctcaagagtgagaactactacagtcctgccctccggcagatagaaatcagttacggcgaaaaattgcatgaagccggatttaagggacaaggtatgaccattgccgtgatcgatgccggatatcataacgtggacaagatagaggctatgaaaaacatccgcatcctgagtacgaaagatttcgtgaaaccgggaagcgatatctacgccaaaggatcgcacggaatggccgttctctcctgcatggcgatgaatgatccttatttaatggtgggtacgggtcccgaagcctcttattga

SEQ ID NO: 3076 - DNA, 1014 bp, B.fragilis
atcgtaaaaaccgtaaataaaatgacatcacaaaaatcacagaacagcaatatgctgcttgcattcctcaccctgctgggagttattgtactggttgcagttgtcggtttcttcatgctccgcaaaggtccggaaatcattcagggacaagctgaggtaactgaataccgcgtctcaagcaaagtgccgggacgtatcctggagttccgtgtaaaagagggacaaaaagtccaggcaggagatacactcgccatcctggaggctcccgacgtaatagccaaaatggaacaggctcgcgccgccgaagcggctgcacaggcacagaacgaaaaagccatcaaaggagcgcgtcaggaacaaattcaagcggcttatgaaatgtggcagaaagcaatcgccggtgtcgatatagctgaaaaatcatataaacgtgtcaaaaatttattcgaccaaggagttatgccggcacagaaactggacgaagtcaccgcacaacgtaatgcagccatcgcaaccgaaaaagcggcaaaggcccaatacacgatggcaaagaacggtgccgaacgtgaagataaaatggctgcagcagctttggtggaccgtgccaagggagctgttgccgaagtggagtcgtacctcaaagaaacttatttgattgcccaggcagccggagaggtttccgagatatttcccaaagtgggcgaattggtaggtaccggcgcccccattatgaatatcgccataatggacgatatgtgggtgactttcaatgtacgtgaggatctgctaaaaaatttgaccatgggatcagaattcgatgctatcgtacccgcattggacaatcagaccattcgcctgaaagtgcattatatgaaagatcttggtacatacgctgcctggaaagcaaccaagaccaccggccagttcgacttgaaaacattcgaagtaaaagcgactccgcttgaaaaagtaactaatctgcgtcccggaatgtcagtcatcatcaagaaatga

SEQ ID NO: 3077 - DNA, 558 bp, B.fragilis
atcgagatgacagaaatagaaaaaatgcgtagcggtgaattggcggatatgtcggcacctgaattacaggtgagatttgaacatgccaagaagttattggcacgaatgcggtgcttgagtacgtatgacgaaacttatcggggactacttgaagaattgatacctgatcttccggctacttccgttatttgcccgccttttcattgtgatcatggcgatggcatccgtttgggtgagcatgtatttgtgaatgccaattgtacgttccttgacggagcattcatcaccatcggaagtcatacattgataggtccgtgtgtgcaaatctatactccacatcatccaatggactatctggaacgccgtaaccccaaagagtacgcttatccggtaactattggcgaagactgttggattggtggcggggctgtcgtttgtcccggcgtgacgataggtgaccgttgtgtgatcggagccggcagtgtggtgacaaaggatataccggacgattgtgtggcggtaggtaatcctgcacgtgttattaggtgtcggatgtaa

SEQ ID NO: 3078 - DNA, 417 bp, B.fragilis
gatagtagttattcaatagaacgttgcggtagtatgaccctggaagagatattgcaaatagaagcacagaatgttgattgtatttttctgtatcaggaagaaggagcatggtatgcttatgaacattctgctttttattgttattctcttctgggcatacttgatatcgactggttgccttgccccgatggagtctcttccgggcagaaaacaatcagggtacgtgtttccgaaccggataagtttttgtgtactcctttgttacgtctgatgcggaagcgtaaaacagaatatgttgttttgtgtaagatttcgtgtggaggtttttattattggcgggaacagcaacaaatgaaatttcgtgtattacaggaaagagaaagctcttgtacgaagataaatgaacatgctgaatga

SEQ ID NO: 3079 - DNA, 1437 bp, B.fragilis
tctcttttatacaaactttctctccccttatgccttataactcaggaaaaagagttaattttgcagcctgataattatctaaacgacaatatgaaacttgatttacttacggccatctctccgattgacggccgatatagaggcaaggctgaagctttagctgcatatttttctgaatatgcgttgattaaataccgtgtgcaggtagaagtagagtattttattactttgtgcgaactgccgttgccgcaactgaagggaattgataagagtgtgttcgagtcattgcgcaatatctaccgtaattttacggaagccgatgcgcagcgtatcaaggatattgaaagtgtgactaaccatgatgtgaaagccgtagagtatttcctgaaagaagagtttgataagttgggtggattggaagagtacaaagagtttattcattttggactgacttcgcaggatattaacaatacatcgatccctctttctattaaggaagcattggagcaagtttattatccgctgattgaagaactgattgcgcagttgaaaacgtatgctactgaatgggaatccattccgatgcttgccaaaactcacggtcagccggcatctccaactcgcttgggaaaggaaattatggtttttgtttatcgcctggaacgtcagctggctactttgaaggcttgccctgtaactgctaaattcggtggtgcaaccggaaattataatgcacaccatgtggcttatcccgaatatgattggaaagcattcggaaatcagtttgttgcagagaaactgggattggaacgcgaggaatatacaacgcagatttcgaactacgacaatctgtcggctatcttcgatgccatgaagcgtatcaatacggtgatgatcgatatgaaccgtgatttctggcaatacatctcgatggaatatttcaagcagaagattaaagccggagaggtgggatcgagtgcgatgccgcataaagtaaatccgattgattttgagaatgcagaaggtaatctcggaattgccaatgccattctggaacacctcgcagtgaaacttcccgtatcacgtttgcaacgcgacctgacagattctactgtgctgcgtaatgtaggtactccgttcgggcatattgtgattgctattcaaagttcgctgaaaggattgcgcaagttgttgctcaacgaaacggctatctatcgtgatttggataattgctggagtgtggtggctgaggctatccagactattcttcgtcgtgaggcttacccgcatccgtacgaagccttgaaggctctgactcgtacgaatcaggctatcacagaaacttctatcaaggagtttattgaaggattggatgtgaacgaagaaatcaaaaaagaattaagagtaattactccccattcgtatacgggaatttaa

SEQ ID NO: 3080 - DNA, 1929 bp, B.fragilis
cctgaaaatcattttaataaaaacaatatgaagaaaatcacatttattgctattcttttgctgtgtatctgtagcctcacaaaagctaaagagaaagttatagagcaacccccattcatcgcctggaccagtacctctattcaagtggacaaagttgttctcagcgatacagctacggtgctttatatcaaagcattctatcatcccaagcaatggatcaggatttccggacaaagtttcctgaaggacaataacggagaaacttacactctgcgttcgggaatcggcatcaagcccgacacggaattctggatgcccgaatccggagaaggagaattccgcctggtattcccaccgatcccggcctcggctacttcgatcgatttttcagaaggagacaacgttcaaggtgctttcaagatatggggcattcagctgaaaggcaaagccctcccggaacttttgttacctcaagaagccatcgtacataaaatcgacatcaacgatgaattgcccgagcccaaaattgaatataaagacgctactataaaaggacggattctggattatcgcccgggactcgtcagcaaaattgtaccgattatattcgatccggtaaaaggtgcctacgaaagcgaagaagtaaaaataaacaatgacggtacattcgtcacgagagtgaaagtgccgaccaccacatcggctgccatccgtctttttggtaaaatgataactttctatgccgtaccgggcgaagagagcagcgtcattatcaatacccgtgaactttgccgccagcagtccaagtttcataaggatgacaaaccttatggcgaagccgtttatttcggcggaacattagccggcctgtcacaggaatattcgaactgcaccctaaaaacctccattctaaatgattaccgccaattattcaaggatgtagcaggaatggacgccggcgcttacaaagactttatctatggaaagcgggccaatctcctggcatccatagagaaagctccaatcagcaaggctctcaaggcagtgttgggtaatcaagtggatgccgaggctgcccaagccatctccctgacggaaatggttatcaagcaagcctacaccatggagcacaaaatgagcaaagaagaggccagggaatactttaacacggctcagatagaactgcctgaaaattattatgcgaatgctttcagaccgctcgcttccatcaacaccatggcagcactctataattccaagctctccgaactgattccgtattatctacgccgccgaaccgatgaactgaccaaagcctggggaaccgacaaaggaatctacttcgatatcaacaaagcaggcgaactctattcgtccatcaaagagttcaccccgctgactgccgaacaggaagtgatacttgccactcttccacctgcctgtcagaatgaagtgcgggacgccaacaaccaactgctgaagacccttgaggccaataaaaagaagacagggttcaccatcaacgaagttggtgacgtcagcaatgaagagctgttttcatccatcatctctaagtaccggggcaaagtgattctggtagacttctgggcaacctggtgcggcccctgccgcatggccaataaagcaatgttgccactgaaggaagagttgaaaggaaaggacatcgtttacctttacattaccggcgaaacctcacccctgaaaacatgggagaacatgattccggatatccacggtgagcatttccgtttaacggatgcccaatggagtttcttaggtgataaattcgacataaggggcgtacccacctatctcatcatcgatcgggaaggaaatgtcaaacatcaaaagacaggattcccgggtgtagcccaaataaaagaggagttgatgaaagtatatgattaa

SEQ ID NO: 3081 - DNA, 1035 bp, B.fragilis
ctaataactaacgatatgaaagaaatagactgggctaatctgtcattcggttatatgaagacagactacaatgtgagaatcaatttccgtaacggcgcatggggcgaactcgaaataagcagtagcgaggtgttgaacctgcacatggctgccacttgcctgcattatggtcaggaagccttcgagggtttgaaagctttccgtggtaaagacggcaaagtgcgtattttccgtttggaggagaatgctgcgcgtctgcagtccacctgtcagggcatcatgatggctgaattgccgacggaacgtttcaaggaagctatcctgaaagtggtaaaattgaacgaacgctttattcctccttacgagagtggagcttctctttacattcgcccgttgcttatcggaaccagtgcccaggtgggtgtccatccggcagatgaatatatgtttgttgtatttgtcacaccggtcggtccttatttcaagggtggcttctctaccaatccttatgtcattatccgcgagtacgaccgtgctgcgcctcacggaaccggtatctacaaagtcggtggaaactatgcagccagtctgcgcgccaataagaaggctcacgacttgggttattcctgcgagttctatctggacgcaaaagataaaaaatacattgacgaatgtggtgcggccaacttctttggtattaaagacaatacctacatcactccgaagtctacttccatccttccttccatcaccaataagagcttgatgcagttggcggaagatatgggcatgaaagtagagcgccgtccggtacccgaagaagagttgagcactttcgaagaagcgggagcttgtggtactgctgccgttatcagtccgatcgaacgtattgacgaccttgagaatggcaagtcgtatgtgatttcgaaagatggaaagccgggaccggtttgtgagaagctttataataaattgcgtggcatccagtatggtgacgaacccgatactcacggatgggtgactattgttgaataa

SEQ ID NO: 3082 - DNA, 807 bp, B.fragilis
atgaactacaaaataacaaccctcgcggaaaacagtgtttacggtaagggattacagggagagcatgggctttccctgcttgttgaagcgggggaacacaaagtgctgttcgataccggtgcttcggatctgtttctccggaatgcccgcctgttgggactcgatctgagcgatgtggaatatgtggtgttatctcacggacatcgtgaccatacaggggggctttatgcctttctgaagatgaacagtgtagcgaaggtggtttgcaagcgtgaggtattccggaaaaagttcaagaacgagcgtgagaacggaatgcttcatcccgaagcattggataagtcgcgcttttggctggttgacgaaactacggagattgtgccgggcgtatttgcgtttccggacgtcaaggtggtggacaggaacgacactcacttcgaacacttctttacggagatagaaggagagatgcgtcccgatacttttgaagatgaactggcattggtgttgaagggcgaaaagtctctttcggtactgagtgcctgttcacaccgggggattaccaatatcattcgtgccgtgcagaatgcctttccgggattgggactcaaactggtgatgggaggctttcatattcacaatgcggaagaagagaagttcaatgtgatttcggcctttctgggtatgaaacttcccaaacgtctgggagtctgtcactgtaccggcattgacaaatatgcgttgttccgccagcaatttaacgaccgggtgttttataactataccggttgggtagaaacgatttaa

SEQ ID NO: 3083 - DNA, 849 bp, B.fragilis
agaaaaaacaagatgtcaagaacaaattttgatacattattggaagccggttgccacttcggacaccttaaaagaaagtggaaccctgcaatggctccttatatttttatggaacgcaatggtattcatatcattgacctccacaaaacagttgcaaaagttgatgaagccgcagaggctctgaaacagattgcaaaatcaggcaagaaagtcctttttgttgctactaaaaaacaagctaaacaggtagtggctgaaaaagctgcatctgtaaacatgccttatgttatcgaacgttggccgggtggtatgttgactaacttccctactatccgtaaggcagtgaagaagatgactactatcgacaagttgactgctgatggtacttactcaaacttgtcaaaaagagaaattcttcagatttctcgtcagcgtgctaagctggacaagactttgggttctatcgctgacctgactcgtctgccgtctgctttgttcgttatcgatgtaatgaaagaaaatatcgctgttcgcgaagctaaccgtttgggtattcctgtatttggtatcgttgatactaactcggatcctacaaacattgacttcgtaattccggcaaatgatgacgctactaaatcagtagaagttatcctcgatgcttgctgtgctgcaatgatcgaaggtctggaagaaagaaaagctgaaaagatcgatatggaagctgccggtgaagctcctgctaacaagggcaaaaagaaatcagctaaggctagactcgataaatctgacgaagaagcaatcaacgcagctaaagctgctgctttcctgaaagaagacgaagaggcttaa

SEQ ID NO: 3084 - DNA, 282 bp, B.fragilis
caaaagaacaataggaaacctatgaatgcagtcgccgaactcctcccggcatttccgcagggacacacaagtatatatctaaaatgttattacatagtcctatcctttaactcaaccacaaaagggatagagcagaaaagagaaataaaaaaaatagctaaaagcatttgccttcttcaaaaagaatcagtatatttgaagtataagaagactcagatatggcaaaccccaaattaccgggaatacccgaagctgaacaagctctgttgtatgccaaactga

SEQ ID NO: 3085 - DNA, 720 bp, B.fragilis
catattacaaaaatgaaaaagcaaatcatacaccgctggatgctgatggctgtcttctgcctcggagcatcattgataggaataaatgcccaagaaaaagactgggctaacctgcaacgttatgcacaacaaaacgccgaacttccgaaaccggacaaaaacgaaaagagagtggtctttatgggcaattccatcacagaaggatgggtaaacactcatcctgatttctttaaatccaacggttacatcggccggggcatcggcggacagacttcttaccagttcctggtacgtttcagggaagatgtcatcaacttatctcctgcactggtagtaatcaatgcagccacaaatgatattgccgagaacacaggagcatatcatgaagaccgcacttttggcaatattgtttcgatggtggaactggcaaaagccaatcatataaaagtgatattgaccaccactttaccggctgccgctttcggttggaatcctgccattaaagatgctcctcaaaagatagcttcactcaatgcacgtctgaaagcctatgcccaaacaaataaaattccattcgtcgactattactcttctatggtgagcggtagcaacaaagctttgaatccggcctataccaaagatggtgtgcatcccacttccgaaggatatgacgttatggagaatcttattcaacaggctataaacaagactttacgataa

SEQ ID NO: 3086 - DNA, 483 bp, B.fragilis
catttaaaaaacaaattaagagtggatactttaagttacaagaccatttctgcaaacaaggcaactgtaaccaaagaatgggttatcgttgatgctacagaccaaactttaggtcgtctgggagcaaaagttgcgaaactgttgagaggaaagtataaaccaaactttactcctcatgtagactgcggtgataacgttattatcatcaatgcagacaaagttaaattaagtggtaacaaatggaatgacagagtttatttgtcttatactggctacccgggtggtcagagagaaatgactcctgctcgtttgatcgccaaacctaacggtgaagacagattactgagaaaagtagtgaagggcatgcttccgaagaacagactgggagctaagttgctgagcaatatgtatgtttacgcaggtagcgaacacaaacacgatgctcagaacccgaaagcaattgatataaactcacttaaataa

SEQ ID NO: 3087 - DNA, 759 bp, B.fragilis
atgggaaaaaataaattagagaagtttgccgatatggcaagttatccgcatgtctttgagtatccttactcggcagtggacaatgtgccttttgacatgaagggaaaatggcacaaagagtttttcaagaacgataatccgattgtactcgaattgggttgcggacgtggcgaatataccgtcggactggggcggatgtttcccgataagaattttatcgcggtagatatcaaaggcgcccgtatgtggacgggagctaccgaatctcttcaggccggcatgaagaatgtggctttcctgcgtaccaacatcgagatcatcgaccgcttttttgcagaaggggaagtgagcgaaatctggctgactttttctgatccgcaaatgaagaaagctaccaagcgactgacttctacctattttatggaacgctaccgtaagtttttggtatccaatggaatcattcatctgaagactgacagcaacttcatgttcacttataccgaatatatgattgaggagaacggactgccggtagagtttatcaccgaagatctttatcattctgatttggtagacgatattctgggtatcaagacctattatgaacaacagtggctcgatcgcggtttaagcattaagtacatcaaattcctgttgccgcaggaaggagaactcagagaaccggatattgaaattgaactcgattcgtaccggagctataatcgtagcaagcggagcggattgcagacatctaaataa

SEQ ID NO: 3088 - DNA, 1461 bp, B.fragilis
gatgcgatgaaaaaattactgtttctgttttttctcctaacaactcccttttccctgaaatcacaggggattctatccttagatagttgccgtgcattggccattgccaacaataaagagttgctgataagcggagagaaaataaatgctgcacactaccaaaagaaagcagcctttaccaactacctgcctaacttctccgccacaggagcttacatgcgtaaccaaaaggaattctcattgcttaacaatgaccagaaagcggctctatccggcttgggtacaagtgtgagcggtccgttgcaacaagccgcccaagtcatcggacagctgcatccggaactggcccccatgctttcacaattgggaggagccattgtcccggcgctcaacgaagccggaactgcaattgtagacgcattccgcaccgatacccgaaatgtatatgcaggagccatcaccctcacccaaccgctatatatgggtggcaagatacgtgcatacaataaaatcaccaaatacgccgaagaactggctcgtcagcaacataactcgggtatgcaggaagtgattctcagcacagaccaggcttactggcaggttatttccttggtcaacaagaaaaaactcgcggaaagttacctgaagctattacaaaaactggacagtgatgtagaaaagatgattgccgaaggagtagccaccaaagcggacggcctgtcggttcgggtaaaagtaaacgaagccgagatgacactgacaaaggtagaagacggattaagcctttcccgcatgctgctgtgtcaactgtgtggcatcgacctaagcactccgattgttctggctgacgaacaagtagacgatcttccgctgattccggctactaccaactttgagatagaaacagcctacgccaaccgccccgagatccgcagtctggaactggctgccaaaatctatcaacagaaaataaacgtgacccgttcggaacatttgccttccgtagcattaatgggaaattacatggtcaccaacccgtctgtattcaacagttttgaaaacaagtttaaaggcatgtggaatgtaggcgttatggttcagttgcctatctggcattggggagaaggcatttacaaagtgaaagcggccaaagccgaagcacgtatcgcccaataccaactggaagatgccaaagagaaaatcgagttgcaagtcaatcaatcggctttcaaagtaaacgaagccgcaaagaaactggctatggccaaaaagaaccttgaaaaagcggatgaaaatctgcgttatgcaactctcggattcgaagaaggtgtgatcgctcccagtaatgtacttgaagcacataccgcctggctgtcggcccaatcggaaaagatagatgcacagattgatgtaaaactgacagaaatctacttgcaaaagtcactgggaacgctcaaataa

SEQ ID NO: 3089 - DNA, 1263 bp, B.fragilis
atacgtgccctaatgaaagatataagtttaaaagataagataacacaaggcatcaatgacctgttttatatctggaagcgggaatttcgtactacattccgcgaccagggggtattgatctttttcgtactcgttccattggtatatccactgatctacagttttatttataccaacgaagtggttcgtgaagtgcctgccgtggtagtagatgactcgcattcatcactcagccgagaatatctgcgtaaagtagatgccacccccgatatacagattgtggcttattgtgccgatatggaagaagccaaacaaatgctcaaagaccgactggcatatggcatcatttacattccgaaagatttcagttcggacatagctcaaggcaaacagacacaagtcagcatctactgtgatatgagtggactgctgtactataaaagtatgcttttggccaatactgccgtgtcattggatatgaacgaagatatcaaaatagcccgctcgggcaatacgaccgaccgacaggacgaaatcactgcctaccctatcgaatatgaagacgtagcgatgttcaatccgaccaatggctttgccgctttcctgatacccgccgtgttgatcctgatcattcagcaaaccttgttattgggtatcggactttcggccggcacggcacgcgagaacaaccgctttaaagatttggtacccattaaccgccattataacggtactttgcgcattgtattgggtaaaggattaagttatttcatggtatatgccttggtatctgtctatgtactatgcgccgtcccccgtatgttcagcctcaaccagataggacaacccggcacactggccctgttcatactcccctatctgatggcctgcatcttttttgccatgactgcatctatcgctatccgtaaccgggagacatgcatgctgatattcgtattcacctctgtgcctctattattcatctcaggtatttcctggccgggagctgccatacctccattctggaaatacttctcttacatatttccatcaactttcggtatcaacggatttgtgagaatcaacaacatgggagcaacactgagtgagattccatttgaatacaaagcgttatggatacagaccggcttctattttctgaccacttgctgggtataccgttggcagattatcaagagccgtaaacacgtcatagacaaatacaaagaaatgaaaaatagagggaaagaattcttttcataa

SEQ ID NO: 3090 - DNA, 2046 bp, B.fragilis
cttttgcttgaaacaaagataattagtacattcgaagcgtctatatcttcatgcagaagatgtaaacagagcacatacaataataaaacacatgttatgaaaagaaaaatgatgtccctattactcgcattggcggtaataagcggaagtagcgtgtacgctaaagtgattgacgtaatgtctcccaacggagccattaaagtatcggtagacatcaaggaccggatttattattcggtgtcctatgataatgaccagttattaaaagattgctatctcaacctgcaactgcagaatgagacgttaggtacgaatccccacttacggagcaccaaacgtggaaccattgacgaaagtgtaaaacgtgaaatacctttcaagaatgcgatcgtaagaaatcactgtaataccctgagaatgaatttcagcggaaattatgccgttgaattccgcgtattcgacaatggtatcgcttaccgttttgtgacagataacaaaggagataacatcgtaatgggggaagacttcgcaattaactttccagccaattataaagctcatctctcccaaccggatggctttaaaacctcatacgaatgcccatatactcatgtagataccgaaaagtatgctgctaccgaccgcatgagttacctgcctgtattgatagaaacggataaagcatataaaatactgatatctgaagccgacttatccgattatccctgtatgttccttaaaagtaccggtaagaacggaatgcagtctatttttcccaaagcacctttagccttcggagaagacggtgaccgtagcctcaagattaccgaagaagccgattacattgccaagacggacggcaagcgttcattcccctggcgcatgatggtgatttcgaaagaagacaaagaactgattgaaaacgaaatggtgtataacctgtctgctccttgtgttcttgaagactacagttggatcaaaccgggacaagtgagttgggaatggtggcacgacgcacgcctctatggggtagatttccgttcgggtttcaatatggattcctataagtactacattgacttcgcatccaagttcggtattccttatatcatcatggacgaaggatgggcgaaaaacacacgtgatccgtttacccccaatcccaccatcaatcttaccgaactgataaaatacggaaaggaccgcaacgtaaaaatcgtactttggctgccatggctgactgtcgagaatcatttcgacctctttaaaacatttgccgattggggcatcgcaggagtgaagatcgacttcatggaccgcagtgaccagtggatggtaaactattatgaacgtgtagccaaagaagccgccaagcataaactgtttgtagattttcatggtgcttttaaaccagccggacttgaacgcaaatatccgaatgtgctttcctatgaaggcgtattgggcatggaacaaggtggtaattgcaaacctgaaaacagcatttatctgccctttatgcgtaatgccgtgggaccgatggatttcactccgggttcaatgatctctgcacagccggaagacaaccgttccacccgggccaatgccatgggctcaggaacacgtgctttccaaatggctcttttcatcatcttcgaaagtggtctgcaaatgttagccgacaatccggtttactattacagagaacttccctgtaccgaatttatcacaagtgttcccgtcacctgggatgaaaccaaggtcctctatgccaaagtaggtgaagcagtcgtcgtagccaaacgaaaaggagaacaatggttcatcggaggtatcaccggcaatcaaccacaaaacatcgagatcgacctcggattcattccggcaggacaatcattcacattaacctcatttgaagatggcattaacgctgaccgtcaagcaatggattacaagaaaaaggagtctaccgtgaacaatcaaacccgcatgacattgaaaatggtacgcaacgggggatgggccggaacaattaaaatgaaatag

SEQ ID NO: 3091 - DNA, 1383 bp, B.fragilis
ttcatcgttgatcattcatcattcaaaaaccgttcatcgtttcactcagcccttaagcttcatcaacaccggtgttttcactgttttcacttctgtttgaggggtttcattcaattgttcaaagataacaatcttattttcacccttcttcagccatacacccggaacatagagtgtttgctgaggacctactttccagtaacgtccgatattaacaccgttcacaaaaacgataccctttccccagctttccatatccataaatgtatctccgactttatccaacgtaaaagtcccctcataaagcaccggacagcctttcagcttagccacttcagacggtacatttttatgtgtatcagctttcaatttggtcaaatcgggcatttcgtccatcggcaactgatacatatcccatccaccgacaatttccttcccggctatctgaaccgggctaataattcccttggtattatgtacgatctcgctaccataattaatgcgtcccatattttcaaccagaatctgcagagtagcattaaacggcacctctatctccatggagtaggtcttggtattccgattcagcactcctacctgttcaccatccacataaacaacggcatagtcacgcaaccccggaatttcaagtgttccgctaatcggctgattgaaatgacgagtatacaatacatatccatacccctgattcaattgttcaaaagtcaagggagtatcagacgacacgggcttctgtttttctgcaaaagcaagtacatccgcaactttattcaattgaatagaaggtatttcgataacaggattaggagccggagcttcaggaattgtatatttaacatatttcttgatcacattgcgaatcgaatcatactttggagttacccagcctgcctcgctaataggagcatcataatcataactggtcatatccggctgaatatcacgcttcttatcataattagcaccactcgtaaaaccaaaattcgtacctccatgcaccatatagaagttgaaagaaacatcattttgcagatacttctcggtttgacgagcaatcccggaagctcctatctgcgggaacggctctgcccaatgcgacagccaacccggataaaattctgcaaccatatacggacctttgccgtcgtgatattgatcaaccacttttttcaaattctcaatatcactttcgccattcgccgtaggcaaagctcccggagtagccccaccctcaaaaagccaactgccatcagaagtaaacagaggtacattaaatcctgcatcagccaactgctgcttgattttagcattgtaagcgcgatgttcttccaaaggtatatccttacgctgggcaacgtatga

SEQ ID NO: 3092 - DNA, 675 bp, B.fragilis
aagcagaatgaagtgactatgaacaatcagatacagcataaagacagtacaaaggttccggagcctactttgcgtcggctgccttggtatctttcgaatgtaaagttgctgaagcagaaaggtgaacgttacgtctcttctacccagatctccaaagaaataaacatcgatgcttcgcagattgcgaaagatttgtcgtatgttaatatttccggtcgtacgcgggtggggtatgaagtggatgcgctgattgccgttctggaagattttcttggctttacaaatatgcacaaggctttcctgttcggtgtaggaagtctgggaggagctttattgcgtgattccggacttagccatttcggcttggagattgtagctgcttttgatgtaaacccgtcgctggtaggcactacgctcaatgggattcccattttccactctgacgattttcagaagaagatgcaggagtacggtgtgcacatcggtgtactgaccgtgcccatcgagattgcccaatgcattacagatacgatggtggccggtggtattaaagccgtctggaattttacccctttccgtattcgtgttccggaagatatcgtggtgcagaacacatcactttacgctcatctcgctgttatgtttaatcgtttgaattttaatgaaatagaatag

SEQ ID NO: 3093 - DNA, 873 bp, B.fragilis
gaagactcagatatggcaaaccccaaattaccgggaatacccgaagctgaacaagctctgttgtatgccaaactgaatgaatacaaccggggccgcatgtcttacaaagaggcaggagcctattttgtggttctgccaagaccgggacatcccacttactcggtctggatctattcgcctacactcgagaagaacagacttctgtttattcacgaactctcagcagacatcaacgaatcactgcggatggcaagcacgctgtttttcttttccaggcgttgcctgctgattgtggaatacaacgagaagaggatgcaaagcaacggagacgatatcatatcgttcggaaggtatcgcggacactatctgcacgaaatcctgaaagtcgatccggcctacctgagctggatagcctacaaatacacacccaaaatccccaagcaggagcgttttgtagccatagcgcaagtatatcactctgtacatctggacatcatgcaacgaaaggcacggcagaaacgcgaagccggccgttttctgggcaacgagggtgaaaagttggagggcctgaatctaaaagtggtaagagtgcggcttgaagacgatccgtataaaacaagggtcatgggtacttccgttcagttctttgtacgacagatagtaacgttaaccgatccgtccggaaatctggtggtcttaaggatttcttcgaaaacacccagccccgtatcctgccaacttccggcactggaacatgaggtccgccccggcgagatagtccacatcgcctcggcacggatagcgcgcacgtacgaaagttatgggtcaaagtatacacgtttgagccatgtgaagtttcttatcggcacataa

SEQ ID NO: 3094 - DNA, 501 bp, B.fragilis
aatcgtacagatatgaaaaagctttatttctttaccatgctggcggcgatgctgtttgcggtaacaaatgtgatggcacaaaaggctaactttaagccagctaatctgaaaggaatctggcaattgtgccactatgtttcagaaagtccggatgctccgggtgtacttaaaccgagtaatactttcaaagtactgagtgacgatggaagaattgtgaatttcacgattcgtcccggagcagatgctattataacgggatatggtagctatgagcagttgtcggatcatacatacgctgaaagcattgaaaagaatattcatttgccgatgctcgacaatcaggataatgttcttactttcgaactcgttgatgataaagtattgcatcttaaatattttatagagaaggatctgaatggcaatgaactgaattgctggtataaagagacttggaaacgtattgagatgccggacaaattcccggaagacattgtaagataa

SEQ ID NO: 3095 - DNA, 1236 bp, B.fragilis
gatatgcaagacacgctttctctttatgaactgaatgccttggtccggcggagtctggagcagtgcctgcccgatgaatactgggtacaggcggagttgagcgatgtccgtacaaacagtaccgggcattgctatctggagtttgtccagaaagatccccgcagcaataatctgatagccaaggcaagaggaacgatctgggctaacatctaccggctgctgaagccttattttgaggagtccaccggacagttgtttacttccggcataaaggtgctggtcaaggtgacggttgctttccatgaattgtatggttacagcctgaccgtgcaggatatcgatcctacctatacattgggcgatatggcacgccgccgccgggagatactcaggcagcttgaagaagaaggggtgttgacgctgaacaaagagttggagatgccgttattgccacaacgcattgcggtcatctcttcggctacggcagccggttatggcgatttctgccatcagttgcagcacaacccgcgcgggttctacttccgtacggaactttttcccgccctgatgcagggcaaccaggtggaggagtctgtattggctgccctcgatgcagtgaatgcccgggtggatgagttcgatgtggtggttatcatccgtggtggaggtgccacttccgatttgtccggctttgatacttatctgttggctgctgcctgtgcacagtttccgttgcctgtcataaccggcatcggacacgagcgggacgataccgtactcgattctgtagcccatacccgcgtgaaaactccgacagcagcggccgaactgctgatcgaccggatggaagaggcggcagaccggctcggggcgttggccgaagaactgcatacccgtgttttctaccgcctggagcaagaacgcaggaggcttgctttgctacaggcacgcataccgtcacaagtgatgcgtaaactgtcggaatcgcggataaagttgcagatggcgaaaagcaatctctcgcatgctgccgaaactttattggcccgccagcaccaccggctggaacttttacagaaccgcattgcggacgcttcgcctcagaagctgttgaaacgagggtatagcatcactctgaaagacgggaaggcggtgaagagtgctgcctgcctgcaatcgggagacgagctgataacccgcctttacaaaggagaagtgaagtcgagagtcgaataa

SEQ ID NO: 3096 - DNA, 1008 bp, B.fragilis
aatataaaagatattatggctgtaacaatggctgatataaccaagctccgcaaaatgaccggtgctggtatgatggactgcaaaaatgcgttgactgatgctgaaggcgatttcgacaaagcaatgaagatcatccgcgaaaaaggacaggcagttgctgcaaaacgttctgaccgtgaggcttctgaaggttgtgttttggtaaaagtagaagaaggtttcggtgctatcatcgctttgaagtgcgaaactgactttgttgctcagaatgctgacttcgtgaaactgactcaggatattctggacgctgctgtagctaacaagtgcaagactctggaagaagttttggctcttccgatgggtgatgctactgtagctcaggctgtaacagacagaaccggtatcactggtgaaaagatggagttggatggttacatggttttggaaggcgctacaattgctgcttacaaccatatgaacagaaacggtctttgcaccatggttgctttcaacaagaaagttgacgaacagctggctaagcaagtagctatgcaggttgctgctatgaatccgatcgcagttgatgaagatggcgtttctgaagaagtgaagcagaaagaaatcgaagtggctgttgaaaagactaaagtagaacaggtgcagaaagctgtagaagctgctttgaagaaagctaatatcaatccggctcatgtggacagtgaagaccacatggaaagcaacatggctaaaggctggattacagctgaagatgttgcaaaggcaaaagaaatcattgctactgtttcagctgagaaggctgcaaatatgcctgaacaaatgattcagaacattgctaaaggacgtttggctaagttcttgaaagaagtttgcttgctgaatcaggaagacatcatggatgccaagaagatagtgagagaagtgttgaaagaagctgatcctgaattgaaggttgttgatttcaaacgtttcactttgagagctgaataa

SEQ ID NO: 3097 - DNA, 819 bp, B.fragilis
cgttatggagaatcttattcaacaggctataaacaagactttacgataaccatattcaaaaaggaaattatgaaaccgtttatctctttttgtcttttattgtgtatttgcttaggtaaactatatgcgcaaggcgtaaatatcgtatacataggcaacagtattacccaaggcgcattattgaaaactccggcaacggaagcaccgccggtacaggcaagtcaatacatcgaacaagcaaccaagcaatcggtcgcttttcgaaattgtggagtaagcggagcgaccactttgaattttcttccaatcgcagaaagacaatttccgaatgtaaaatctgccgcccaagaattgagtcaacgtaaaggaacactgcttttttccattatgctgggcacgaatgacagtgcttgtaacggtccattcggttctccggtggaaccggtgtcctactataccaacatgaaaacaattatcgacgaactcctttctttgtatccggaatgcaaagtggtgattcatcaaccaatctggtatagcccgaacacatataacagtgccatgtatctggctgccggcctcaagcgactgaaaagctacactcccatgatccataaactggtagaccactattcacaggcaaaccccaatcaagtctttttgggagatacggctgcttccgatttcttccggaacaattatcagagttatttcacgccggagaatggaaatgcaggtactttttatctgcacccgaataaagagggagccggtatcttgggtaaatactgggcagaggctatcctaaaggcaatataa

SEQ ID NO: 3098 - DNA, 393 bp, B.fragilis
gatataatggaagtagtaaatgcattaggcagacgtaaacgtgctattgcacgcgtattcgtaagcgaaggtacaggaaagattactattaacaagagagaccttgcagagtactttccatcaactattcttcagtatgttgttaaacaaccattgaacaagcttggtgttgctgagaagtatgacatcaaagtgaacttgtgcggtggtggttttactggtcagtctcaggctttgcgtttagctattgcccgtgcactggttaagatcaacgctgaagataagccggcacttcgttctgaaggcttcatgacacgtgatcctcgttctgttgaacgtaagaaaccgggtcagccgaaagctcgtagaagattccagttcagcaagcgttaa

SEQ ID NO: 3099 - DNA, 297 bp, B.fragilis
atgttactactaaaaattttcttcaccacttatcaaccttccccggacaaaggaagattaacttgctatgaattaatctcttatccttttgagataataatcggcttgcaaaagtacggcttttctttgaattggcaaactatttctgtctttttttggatttatccggttgataacgagccacaagctatctgccgtaaacagcgcccaacaagacaaaaaaagactgcaggcaacaagccacacacgatcaatgctacaatacataatcggcagcttgctacctgcagtccgtaa

SEQ ID NO: 3100 - DNA, 246 bp, B.fragilis
atatatacttgtgtgtccctgcggaaatgccgggaggagttcggcgactgcattcataggtttcctattgttcttttgctacttgtgacggcttttcgtgcgcagaaagtaattaaagtcggtgtttgggtgacagccccttttctccggatcggcaaaccgggtgtaatggagcgggaaaacagtgcttttaaggacggaaagccggggtcgggagggggaagagccgggctttggggaaaatga

SEQ ID NO: 3101 - DNA, 1203 bp, B.fragilis
catgaggtctgttatgccccctgtagttttaaagtttgtatactaacttgtccaattgattgtattctgccgggaatcttgtacatttgcattcttcgtaaaaagagaatgaatatgaaagaatccaagaagcgtgttcttgtcggtatgagtggggggatagacagcaccgccacctgcctgatgctgcaagagcagggatatgagatagtgggggtcaccatgcgtgtctggggtgacgagccgcaggatgccagggagttggcggcacgtatggggatagagcattatgtggccgatgaacgcgttccttttaaagataccattgtcaaaaactttatagacgagtaccgtcaggggcgtacgccgaacccttgcgtgatgtgcaatccgttatttaagttccggatgttgatagaatgggctgacaagctggggtgcgactggatagccaccggtcattactcccggttggaagagcggaacggacatatctatatcgttgccggtgatgatgacaagaaagaccagtcctatttcctctggcgactgggacaggacgtgctgcgacgttgcatttttcctttgggtaactataccaagcagaccgtccgtgactatctgcgtgagaaaggctatgaagccaagtcgaaggaaggggagagtatggaggtatgctttattaaaggagactatcgcgattttcttcgcgaacagtgtccggagttggatgctgaggtaggtccgggatggtttgtcagttcagaaggtgtaaagctggggcagcacaaaggcttcccttattataccatcggacagcgtaaaggactggagatcgcactgggaaaaccggcctatgtcttgaaaatcaatccgcagaagaacaccgtcatgctgggtgatgccgggcagttgagagccgaatacatggtggcggagcaagacaacattgtggatgaggatgaattgtttgcgtgtccggacctggcggtgcgcatccgttacagaagccgtccgattccttgccgggtgaagaggcttgaagacgggcgtctgctggttcgtttcttggcggaggcgtcggcgattgctccggggcagtcggccgtgttttatgaaggccggcgggtgttgggcggtgcgtttatcgcttcgcaacgcggtatcgggttagtgattgaacagaacaaagactggaaatag

SEQ ID NO: 3102 - DNA, 207 bp, B.fragilis
cagacctcatgtcatggcaatgtctcctacatatccatgaacagaacacttgtagaacgatgcttttgtctttctgtcaatttgatatcagaacctccctacatttcggtttttcgggccgacggaaagcttcgtaagaaaaaacgacctacacgcaatcagccgattatccttttagcagccaatcggacaataaccatacaataa

SEQ ID NO: 3103 - DNA, 1014 bp, B.fragilis
tataacatccgtatagagggaatgaaggtttcattctccatgatttttgaaaaagcgaccgatccgtttatcaagtcggtaataaaagctgccgaaacagctattcttagtcatgtgggcaaagaggtggagatagttggaaatatcagtgtgaaaacagtacaggctgcacgtcccgaagtgggcaaattgctgccccatgtgaagaatatcatcggcatctcttccggtaagggaggagtgggtaagtctaccgtatcggccaacctggctgtagcgttggctaagttgggttataaagtcggtctactggatgccgacgttttcggtccttccatgcctaagatgtttcaagtggaagatgcccgcccctacgctgagaagatagacggacgcgatatgattattcctgtcgagaagtatggcgtgaaactgctttctatcggtttctttgtcgatcccgaccaggccactttatggcgcgggggtatggcgagcaatgcgttgaaacagttgatcggggatgccgcctggggagatctcgattatttcctgatcgaccttccgccgggtacgagcgatattcacctgacggtagtccagacactggcactgacaggtgctgttgttgtcagcactccgcaggctgtagctttggccgatgcccgcaaggggatcaacatgttcactaatgataaagtaaacgtccccatcctcggattggtggagaatatggcctggtttactccggccgaacttccggaaaacaagtattatcttttcggaaaagaaggtgccaagaagttggccgaagagatgaacgttccgctgttgggacagattccgattgttcagagtatctgtgaaggaggcgataaaggaactccggttgctttggacgaaaatacggttacaggtcgtgcattcctcgcactggctgccagcgtggtacgtcaggtagataagcggaatgtagaaatggctcccacgaagattgtggagttacataagtaa

SEQ ID NO: 3104 - DNA, 2586 bp, B.fragilis
ttaaaaaatagaaaaacaatgaattggggaatacacgacagaagaggctggatggctgtggtattattattgtgcgcatatcctttttcggctcagaataccggtcaaatcacgttggaacttagaaacaagccactgcctgctgttttgaaactgattgagaaagcgggggagaagcatatcattttttcctataacgagactgagacttaccatgtcactgcctctatccatcaaagaaacgaatcggaagcactttccatcgttctgaaaagtaccccgttcatttataaagaacgagaaaactattttgtcattcagaaagggagcattgacaaacgcttgataactattcgaggaagtgtgattgatgaaaacaatgaaccgttagtttgcgccaatgtgctattgctggacaaagcagactctgcttttgtgaatggagtggttacgaatcaggatggttcgttccggataccgggtgaagaagggagagattatcttttgaaaacgtcctacatcggttatcagactaaaatccaaccttgcggtgcaatgaataaagtatgtctgttttccgatacccaattaatgaaagaagtggttattagtgtcgatcatcctttaatagtacataaagataatggcttattggctaatgtcgttggtactcctttagctaaaatgggttctgctgcggaaatgatatcccatcttccttttgtaacgggaggggtaggggaatacatggttctgggacacggggtccctgttatctacatcaatggccgtaagatacgtgatcagggggaattggaacgtttgcgtgccgatgatattttatcggcggaagtgattactacaccaggagtggaatatggttcggatgtatcttcagtcattcgtatccgcacgatccgtcggcgaggacaagggataagcagtggatttcgaggtgttttttctcagggacatgactataatgccagtgagaatctatacttgaattaccgtacgggtggattggatttatttgtgaaaggtgacttgaaacatggaaattattatcaggaatcaatcttaaatcaggaaactgacgcttcttcccgatgggaggtcaaaggaggagctaccagttttcataaagctgtttatttctccggtgaggtaggtttcaactatgagttggatgacaagaattctttgggtgctcgatatatgccgggtgcaaatgtcggttctgtgaatcggactaaccttggcaataattttgtgtataaggatggtgaaaagatagaagaaatatcttctttgcagcatgcacatacttatcctacctggactcattcggtgaatggatactataatggggtgttcggccaatggaatgtggatttcaatgctgattatttattgggaaagaataattccacgaatgaagttttcaacaatgatgataaagccgctcaatctgaaaatgaagtccggaactatctgtatgctatgcgtatggttgtaaaacgatctttcagaaaagggacattgtcgtttggtaccgaggaaacgtttacgaacaggcacgacgtatttgttcaaagtggcttttctgacaacgccgatgatcatatcaaacagtctatttattctgtgtttgccgattattcgctgcatttggataaattcaatgttgctgtggggctgcgttatgaacatcaaaaaacggattattatgaatatggggttcaccaagatgaacaaagtccggtgtataatgatatagttcctgtcgctttagtaggatatgaagataaaggttggcatgcatccctttcttatcgcttaataaggaataatcctgactatcacatgctttcaagctcaattacatattcaagtaaatatatgtatcgtagcggagatcccctactggttccacaaaaacaccatgtctttatattggatgccggatcaagatgggcatttgtaaatctcttttttgatagaacattggatttatatacgaggttcctcaaaccttataatgatgaaacccatccgggagtgttgttgtttaccatggcctccatacctactacagatacttatgggatgaatcttaatgtttctcctaaaatcgggtgctggcaaccgcaattgaatggaggcatgtatttttatgatgccgatgttcgttctttagggataacccggcattggaatgaacctcagttttattttgaacttgataatagttttacttttcctgatggttggtttttgaatgtgaacgggaatatctcgacagccgccaaacaaagttattctttgatacacagggagggtacggtaaatgcccgcctgtcgaaatcatttttggaagatgctctgatgataacacttacagccgatgatatttttcatacccgttatcattatatggatggatatggagtcagaagtcatatactgacccgttcatataatgataatcaacgttttggtattcagatatcttataaatttaatgcaactaagagtaagtataaaggtaccggtgcgggacagagtgaaaagcagcgcctttag

SEQ ID NO: 3105 - DNA, 567 bp, B.fragilis
ttttgttggcttatggcaaaattaacgatattccggtttcgtggacatatttcacgggaagaacgcttcaggcaattgtttgtggagatatatccccgcctgttgcgttatgccattcagctaatgagcgatcgggaagaagcgaaggatattgttggcgaagtgatggaagaggcttggaaatgttttgatagactggaggcggaaacgcagaacgcttatttctatacagctacacgtaatacgtgcctgaatcggttaaagcacctgcgtgtggaacagcagcatttggatactttacgtgaggtgacccggatggatgtgaataccggatatcggcagcatgaggcacagttgcagcaagcggaaacgattgcttgcagtctgtcggaaccgacgcgtaccattttgagactttgttattgggagaaactgacctatcggcaagttgcagaacggttggaaataagtccggatacggtgaagaaacatatttcgaaagctttacggattttacgtaatgaaatgaacggaaaggaggaaacaaatggaacagagagaggataa

SEQ ID NO: 3106 - DNA, 462 bp, B.fragilis
tgtcccgccaggcgtcgaaaatggcggataaaggaatcgtacttggtgtgcagtgccggtaattcgggtgcctcttcatggaagaaaatcacgacaccgggggatgcggagaatgtgctgacggtaggtgctatcgaccggagaggcgtgttggcttcgttttcttctatcggcaacacagccgataatcgcgtgaaacccgatgtcgttgccgtggggctgaactcggatgtgatggggacaaacggtaatctgcgtaaagcgagtggaacctcgtttgcttcaccgatcctgtgcggcatggtgacttgcctgtggcaagcttgtccgcaactgactgcaaaggaaatcatcgaactggtgcgtcaatccggcgatcgggtcgatttccccgacaatatctacggatacggagtgcccgatctgtggaaagcttatcaatctgtttcgaagaaaaaataa

SEQ ID NO: 3107 - DNA, 243 bp, B.fragilis
gtgctccgcagtgaagacgaaacgtccgagcatttggtggagcaggactacttggcggcggctgtcgagtttgccgatagtgtcggagtagatgtggtgaatacttcattgggatatttcacctttgatgattctaccaagaactataagtatcgtgacctggacggacaccatgcactgatgtcccgccaggcgtcgaaaatggcggataaaggaatcgtacttggtgtgcagtgccggtaa

SEQ ID NO: 3108 - DNA, 1773 bp, B.fragilis
gaaaggacaagaaaaataatcgctaataccctgaaaaacatgactcccgaactggcatattttctgaaaataaatatagcaattgctttattctacgccttctatcggttgtttttctacagagacaccttcttccaatggcgaaggacagctttgctttgcttccttgtcatttctccgctctatccggtactgaacattcaggaatggatcagatcgcacgaaccgatggtagcaatggtcgatttgtatgcaacaatcgtattgcccgaaatcgaaataactcccgaggttagggctgcggactggcaaagtatcattttatctacagtaaatatcatctattggtcaggggtcactttacttttagtacgtttcttcgctcaacttgccagtattctacggttgcgtcttcgttgccggaaagatcagatagaaggaatacccgtctatctgctggataaagaaagtggtcctttttctttttttcactggattttcatttatccgcaggcacacccgcagaacgaattaagtgaaatcctgactcacgaaggaacacatgcccgccaaaggcattccatagatgtgattatcagtgagctaatgtgtattgcctgctggttcaatcctttcatgtggttgatgaagcgggaagtacggaacaatctggaatacatggcggataatcgggtgctggaagccggacatgattcaaagtcctatcaatatcatttgttgggactggcacatcaaaagagcgcgatcaccctttccaacagcttcaatgtgttgccgctgaagaaccgtatcacgatgatgaacaaaaagagaaccaaggagataggacgaaccaagtatctgctatttatccccttggctcttgctttgatgatagtaagtaacatcgaagcagtggcacgtaccactaaaagtattgcacaggaagtgatgcaaaccgtagaagaacagatagaacccgaaaacgctgttgctgttaaggaaagcacttcctctccccaggcagccaatcatatttcacaacctcaagagagcggcatagccgaacagcccgcccaagaagaaagccaggagcaaatcgtattcgaggttgtggagaaaatgccggagtttccgggcggcgtaaggaatatgaatcatttcatcaacagccatcttcgttatccggtgatcgcccaggaaaacggaacacaaggccaagtcatcgcacagttcgtaattcaggcagacggcacactctctgacctgaaaatagtgaaaagcgtagacccgttgctggatgccgaagccatgcgcgtgataaaagagatgcctaaatggcaacccgggaaacaaagaggaatagctgttgccactagggtcacagtgccgatacgattccgactgatggattccgattccgctccgtcaacagacagcaataagaatcaggagaataccatattcgatgtggttgaacgagcaccggaattccccggcggaatggaagcctgcctgaaatatatgtataaaaatataaaatatccggcagtcgcaatggaagcgggaatacaaggacaagttgtcatacaaatagtcattgacaaggacgggaaaatacatgatcccaagatagttcggggagtatcgccggaactgaatgccgaagcggtccgcgtgataagcaacatgcctcagtggatacccggaaaacaaaagggaaagaacgtggcaacccgattcacacttccggtccgcttccgtctggcttag

SEQ ID NO: 3109 - DNA, 960 bp, B.fragilis
acggaaaggaggaaacaaatggaacagagagaggataataaaaacgatatagcctcctgtaggctcaaaaatcttttcggagaggctcttggtgacctgtcttctgttgaagagacggaaaccgcttggcaggcatttgcctctcgccgacggcaggaaagagtccgaactttggtattcggctttgcagcagttgcttccgtggcattacttttgttttggggcttttctcaggaaaactttctatcccaagaagtcgaagtgtttgcttctgtaaattcgcctgataaattggtgatgacagaggataaagggatcattgcagtcagaacgccacccgctaccactattactattcatttgcctgacagtactgaagtgctgttgaacgccaatagccgcttggaatacccgaaagcgtttaccggtgatcttcggcgggtaatgttggaaggtgctgcgagatttaatgttcaaagagatactttacatccctttattgtagaaaccgggagtttacaaacgcgtgtattgggcacggtatttgatgttgattcctatggatgtggtacgacttctaaagttgtgctgtatgaaggttcggtgcaagtcagtgataaagccaatacgaaagcctgtaagataaagccgggtgaacaggtttatctggatagagtaggtgatatctgtatttctcaggctgatatctgtatgcaaaagagttggacagaaggtctgtttatctttgataatgtcactctgagatatgttatgcaggaaatcggggcttggtataacacaaatattgttttccgttcccatcctttgctggaggaacggatttatttttctgccagtcgtcaccttcctgtcggggaaatattaaatgttttgaatgatttgcaaattgcgagattcatagtggaaggggataaaatagtcgtatcaccactatcctga

SEQ ID NO: 3110 - DNA, 1581 bp, B.fragilis
agactttatggaaagatagatgttgctgtttcggtaaccctaccgcaaccggagtcagtaaatactcttactcgtgccggtggtccatatacggataccgatattaagaacgcagacttgttgatattcgacaaagacgcaaagtttatggaacgcgtcaaagtagataatgacaggttggtggtcaccggaacggggattaatttcacagtccgtttggatgccacttcagaacggcgtatcattcatctggtagcaaacggtcggagtgctgatggcacttcggatcgcttgaactttggtggtataactccggggatggctgaaaatgcggctatctcttccttgcagacagcctcgctcgaacatgtggatgaaggagagagcacattgttaaaccatgtaatgcctttggtcatgtggggacgttttgcattgaacggaatcaatatcgtaacgaaagcagagggtgtgaaactgttgcgttccacagcatgtatacaagtgaagaagggtaatggaggtgggaataccggactgggtgattttgtcattgagggaattactgtacatcagggagcctgtcatggcttcctggctccgaccgattgcacaggagaagtaaatactcccgttgtcgcaaatccggttaccggtggaacctatctggattatcgtaagggttgggttaatggtgcggaaccatctttatacatttatgagcgcaattgttcggcttccgactatatgggagtagtgattgcagcccggtataaggggaaaaagggctactataaggtagtgatgaacggtaatgacggaagtcctttgaacattgtacgcaaccaccgctatattgttacagtggtgggagtcaatggtccgggatatgaaagcccggatattgctgtggcttctgcaccttcgaatgccttgaaagtggagttgacggatgaagacacggatctgccctgtattgtggccgacggtcaataccgtatggcatcgtctaataatgtattcagcctatatggaaaaacaggtgtgactacatcggcaactggtgtggatatttgtaccgtatattccagtcgtggtattcagccggttctgacccttcctgacgattgtaattggttgacaaatctgtctgcccaggctttgggaagtaacaaatataaaattacgggggattttacctcagcggccaatgatgccgtagctacaaccttgactatgacgtgtgataatctgtctcagccggttcgtgtcagttggaatcccatcatatcggatcagaaagatatcgattcgtttgtcctcgatttggtcggttcaaccgatcgtaactggacggtacgggtgttgaatccgacatctcccggctggctctttctacacccatccgccgcatctcccggagctcttccgggggacggcatggtgtcggaactcagtagcaaatacagttcgcatgcttatttgcacgtagctttcggagcgaacaggagagggactgtacagatgacttccgcctccggcggggaaactgtagcccgtaagatagtagttattcaatag

SEQ ID NO: 3111 - DNA, 1296 bp, B.fragilis
actttttccggaatacctcacgcttgcaaaccaccttcgctacactgttcatcttcagaaaggcataaagcccccctgtatggtcacgatgtccgtgagataacaccacatattccacatcgctcagatcgagtcccaacaggcgggcattccggagaaacagatccgaagcaccggtatcgaacagcactttgtgttcccccgcttcaacaagcagggaaagcccatgctctccctgtaatcccttaccgtaaacactgttttccgcgagggttgttattttgtagttcatttatcgaacgtttattcaacaatagtcacccatccgtgagtatcgggttcgtcaccatactggatgccacgcaatttattataaagcttctcacaaaccggtcccggctttccatctttcgaaatcacatacgacttgccattctcaaggtcgtcaatacgttcgatcggactgataacggcagcagtaccacaagctcccgcttcttcgaaagtgctcaactcttcttcgggtaccggacggcgctctactttcatgcccatatcttccgccaactgcatcaagctcttattggtgatggaaggaaggatggaagtagacttcggagtgatgtaggtattgtctttaataccaaagaagttggccgcaccacattcgtcaatgtattttttatcttttgcgtccagatagaactcgcaggaataacccaagtcgtgagccttcttattggcgcgcagactggctgcatagtttccaccgactttgtagataccggttccgtgaggcgcagcacggtcgtactcgcggataatgacataaggattggtagagaagccacccttgaaataaggaccgaccggtgtgacaaatacaacaaacatatattcatctgccggatggacacccacctgggcactggttccgataagcaacgggcgaatgtaaagagaagctccactctcgtaaggaggaataaagcgttcgttcaattttaccactttcaggatagcttccttgaaacgttccgtcggcaattcagccatcatgatgccctgacaggtggactgcagacgcgcagcattctcctccaaacggaaaatacgcactttgccgtctttaccacggaaagctttcaaaccctcgaaggcttcctgaccataatgcaggcaagtggcagccatgtgcaggttcaacacctcgctactgcttatttcgagttcgccccatgcgccgttacggaaattgattctcacattgtagtctgtcttcatataaccgaatga

SEQ ID NO: 3112 - DNA, 906 bp, B.fragilis
tgtgtattagggggaattgttttattttgttcagtattattcctgtatttgcgaaaaaaatatgaaagtattaaaaaagatgccagtgttttaatagctggtttagttgtggcatcttgtgctaatgatttggatggttttattagtattcctgataatgcgacaggtgttcaacaaatttctactcgtagtagttctgacaatttgaagattgtatatcatggtaaggtctatgaaactttatatacgattattgatgactcaatttattcatatcagaattctgaagtgaaagatttgatggataatttgagtgaaacccggcctaatcttaggacatttattcatgggaatggagtcattgaatattttgatgatgaaaatgattttaatttaaataaagagaggataatgtctgaatatgaaaaagagtcattgtcgacatcgctttctgaaagatggtttcctactgataatgtaccacaacttgcgcctatagatccggagaataatgaagtggaaatttatttgtacgaagatccatattatttaggagatttgtttagtttgcagcgtaatagaagtgacagtgactacaacgaacttagtaaagtttggaattttggtggtcagatattatctatgatagtacatactattggttttggtggtgtttttacattttatgaaagaatgggttgtcagggtaaaggtataacattagtccttactgccggtcaatatattaatttatgttcagaattatctgctgatgcaatgagagggatcagttatggttcaattgccatgtcagatttgaggagcctccattggtctgggattgcaggtaattggaataataggatatgttgtataaaagtggatcgttacattggaatgatgtaa

SEQ ID NO: 3113 - DNA, 1044 bp, B.fragilis
tggactcggggttaccgaccaatatgcccgttgggcgctgtagacctggacaattctgccagctcacgaaacattctccgcaatctggacgcattcgggcaaacagctgtcgtggcgcgttatagcagtgttaacgaagcacgtacagctatgcaggaaggcaaaatctacggatttttttatatacccaaaggaatgtcggccgatgcccagagtcaacgccaacccaaattatctttttataccaacaactcctacctgattgccggctcattattgttcaaggatatgaagatgatgtccgaacttgcctcaggagctgccgcccgttcagttttatatgccaagggagcaacggaagatcaggcgatgggatatttacaacccattgtcatcgatacacatccgatacaaaatccttggttaaattattcggtctatctatgcaatacacttgttccgggagtattgatgttgttgatattcatggtaacagtattttccatcggtgtggaaatcaaggaccgcacggcccgggagtggctgcgactgagcaacaactccatctacatcgcattggccggtaagttgcttccacaaaccgtggtattctttatcatgggtatattttacaatgtctatctgtatggatatctgcacttcccatgtaacagcggaattcttccgatgctattggcaaccctctgcctggtattggcatcgcaatgttgcggtatcctgatgataggcacactgcctacccttcgcctcggtctgagcttcgcttcgttatggggagtcatttctttctccatttcaggcttctcttttccggtgatggccatgaatccggtattgcaggcactcagtaacctgttcccattgcgccactatttcctgatctatgtagaccaggcactcaacggatacagcatggcttattcctggtcaaactatatggcattactgattttcatgttacttccgttcttcgtcgtacatcggttgaaggaagctttgatatattataaatacgtgccctaa

SEQ ID NO: 3114 - DNA, 222 bp, B.fragilis
aatagtaatatgccagccaagaagaaagagacctattcacaggctatagaacgccttgaaaagattgttcggcagatcgacagtaacgaactggagattgacgaactgagtgaaaaaataaaagaagccaatgaaataatagctttctgtaccggaaagctgacaaaggcagatcaggaaattgaaaaattactgcaagaaaagaggctatctgaagaataa

SEQ ID NO: 3115 - DNA, 1413 bp, B.fragilis
aatagttgtatggaaaagattagtagaacaaaaattgtcgacctgatgaagcgcgaagattttggcgctatggtcaatgtgaaaggatgggttcgcacccgcagaggcagcaaacaagttaactttatcgcactgaatgacggttctacaataaataatgtgcaggtcgtagtcgatctggcgaactttgatgaagagatgctgaagcaaatcacgaccggtgcttgtctgagcgtgaacggtgtgttgacagagtcggtaggcgccggacagaaggctgaagtgcaggctcgtgaaattgaagtgctgggaacttgtgacaatacgtatccgctacagaagaaagggcactctatggagtttttgcgtgagatagcccatttgcgtccgcgtaccaatacttttggagcagtattccgtattcgtcacaatatggctattgctatccataaattcttccatgaaaagggattcttctattttcatacacctatcattacagcgtctgactgtgaaggtgccggacagatgtttcaggtgactaccatgaacctgtatgatctgaaaaaagatgaaaacggttctatcgtgtatgatgatgacttctttggcaaacaagccagtttgactgtttcgggacagttggaaggtgagttagctgctaccgctttaggtgcaatctatacgtttggtcctactttccgtgccgaaaattctaacactccgcgtcacttggccgagttttggatgattgaaccggaggtagctttcaacgaaattcaggagaatatggatttggctgaagagttcattaaatattgtgtgagatgggctttggataactgcgcagatgatgtgaaattcctgaacgacatgttcgataaaggattaattgaacgtttggaaggtgtacttaaagaagacttcgtccgtctgccatacacggaaggtattaaaatactggaagaagctgttgccaaaggacataaattcgaattcccggtttactggggagttgatttggcttctgaacacgagcgttatctggtggaagaccactttaaacgtccggtgatcctgactgactatccgaaggaaataaaggccttctatatgaaacagaatgaggatggtaagactgtgcgtgccatggatgtacttttccctaaaatcggagagatcattggcggttcggaacgtgagtctgattataacaaattgatgacgcgtattgaagaaatgcatattccgatgaaggatatgtggtggtatctggatactcgtaagttcggtacttgtcctcactccggattcggactgggatttgaacgcttgttgctcttcgtgacgggtatgtctaatatccgcgatgtaattccgttcccgcgtaccccacgtaatgccgatttttaa

SEQ ID NO: 3116 - DNA, 375 bp, B.fragilis
atatactccatggaaaagttgacaatgcaagaagaagaagtgatgatctacatttgggaactggaaagttgctatgtgaaagacatcgttgccaagtttgagcaacctactcctccctacaccacggtggcttccatcgtgaagaatctcgaacggaaaaaatatgtaaaggcacagcgtgtaggaaacacgtatctgtacactccgtctattaaagaaagcgaatacaaacgaagtttcatgagtggagtcgtacggaactactttgaaaactcttacaaagagatggtttctttcttcgccaaagatcaaaagatatcgaccaacgacctgaaggaaatcatcgacatgattgagaaaggacaagaaaaataa

SEQ ID NO: 3117 - DNA, 2241 bp, B.fragilis
aaaactaacattttacctaaaatgaagattaaacgactctacttactgggagcctggctccttttgggcgtcagtgcttcggcccaaatcacaagtattcaaccacaaccacagcaggtcctttcacaagcccgaaacctgagcttaccggacacctatctgattgttggagatacagaggcaaacacacatgccgtcagtgccctgaaaaccctgcttgccggaaagcattcggataaaaacgggtttcgcatctatatcggtgaaaaaggggacaaagctatccgcaaattcgcccgacagattcctaatcacaaagaaggctattatttggccatcaatgataaagagattgtcttagccggccaggacgaaaggggaactttctatgccttacagacgttagcacagttactgaatgacaatcaacttcctgtagtagaaatcaaagactacccttcagtccgtttccgcggtgtagtcgaaggattttacggaaccccctggagccacgaagcccgtctccgtcagttgaagttctacggagagaataaaatgaatacctatatctatggccctaaagatgatccataccacagttctcccaactggcgcctgccatatcccgaaaaagaggccctccaattacaggagttggtaaaagtagccaatgagaacgaagtggactttgtatgggctattcatccgggacaagacatcaaatggaaccaggaagaccgcgatctgctactggcaaaattcgaaaaaatgtacgatctgggagtccgttcgttcgctgtattctttgacgatatctcgggcgaaggcaccaatccgaacaagcaagccgaactgttgaactatatcgacgagaaatttgtaaaggtaaaaccggatgtcactcctttggtcatgtgtcctacagaatacaataaaagctggtcgaatcccaagggaaattatctgactaccttgggagaaaagctgaacccttctatccaaataatgtggacgggcgaccgtgtcatttctgatataaccaaagacggcatagcttggatcaacgcacgcatcaaacgtccggcgtatatttggtggaactttccggtatcagattacgtacgcgaccatcttttactcggaccggtctatggcaacgacacgcagattgccgatcagatgtcaggctttgtcaccaatcccatggaacatgccgaagcatccaaaattgcaatttacagtgtagccggctatgcatggaatcctgaaaaatacaacagtgaacagacatggaaagatgctatccgtaccattctgccaagtgccgcagacgaattggaattttttgcagcacataactccgacttgggaccgaacggacataaataccgccgggacgaatctgtcgaattgcagccgttatcacaacgttttctcgatagctacctgaaaaacggttcatataccgaagctgacttcaacgctttggaagcaactttcggaaagatggtagagtccggtgacattttgatgaccaacacagggaatcgtcccctcattgttgaaatgatgccttggctccgtcagtttaaattattgggcgaaaccgggcaagaagttctggctatggccaaagcttataaaaaaggggacaactcactctttatccggaaataccgtcatgtgaaagcactgcaacagcaaatgttccaggtagatcaaacctataaccagaatccttaccaaccgggtgtaaaaacagcaactaaagtgatcaaaccactgatagatcaaacatttaccacggtcaccgaacgctataataaggagcacggtacacaattggatgccgcaacagactatatgccccacaaactggtaagtgacgtagagcaattacgcaatcagccgttacagatcaaaaccaaccgtgtattggtatcacctgccaacgaagtaattaaatggggagccggatgcacgctgaccatcgaactggatcaagcttatccgggagaaaatctggatatagatttcggtaaaccggacgtggctgcctggggacaacttgaaatttcggctgatggcaaagaatggcagaaggtcgatttcaaacaggaaaagaaccgcatcaccttgaacttgaaacaaacacctgtgaaagctgtacgtttcagtaatgtcggcaatgcggaacaagaagtttacctgcgccgcttcatgattactctggacaaatag

SEQ ID NO: 3118 - DNA, 360 bp, B.fragilis
actggaaaaatgaagaacagcgattggaaagaccggctgaacgtggtttactccaccaacccggattataattatgagatggatgatgacgaagagcaagtaaccctggaaccgtcacaacagaacttacgggtgcaattggatcggaaaaaccggggcggcaaagtcgtaaccctaattaccggctttgtcggcaccgagaacgacctgaaagatttgggaaaactcctcaagacgaaatgtggagtaggcggatcggctaaagacggagagattatcgttcagggagacttcaaacaaaaaatagtagaactgctgaagaaagaaggatatacgaaaacaaaagcagtaggaggataa

SEQ ID NO: 3119 - DNA, 618 bp, B.fragilis
agcatgaagattatagctgttggaatgaattatgcccggcacaacgaggaactgggacatacgttggagaataaagagccggtaattttcatgaaacccgattcggccatccttaaagatggcaaacctttctttattcccgatttttcgaatgaagtgcattatgaaacagaactggtagtgcgcatcaatcgcttgggaaagaatatagcttcacgctttgctcatcgttattatgatgcggtgacagtcggcatcgacttcactgcacgtgatttacagcgcaggtttcgtgaggccggtaatccttgggaattatgtaaaggtttcgatagttctgctgccattggcacatttgtaccggtggagcaactggccgatgtgcagaatcttcatttccacctagatatagacgggaaaacggtacagcaggggcatactgccgatatgctgttccgggtagacgatatcattgcttatgtcagccgctttgtgactctgaaaatcggtgaccttcttttcaccggtacgcctgtaggggtcggtccggtcagtatcggccagcatttggagggataccttgaaaccgagaagttgcttgatttctatatccggtaa

SEQ ID NO: 3120 - DNA, 282 bp, B.fragilis
aaatacgagatgaaaaaattagcacttattgccttggtcttcgttgctttgggagcgtcggcacaacaggatacgttaaagtatcgcatcagcctgaaagataaggttgggaaccacttattcactggatcatcccgagaaattcttgtcggaaaaagccatcgcccgccgccagcgtcagcagttgcctgtcgactctaccgatctgccggtctgccgtcggtatgtggatgccatccgcgacaggggagtgaagattgtggctatgggaaaatgggataa

SEQ ID NO: 3121 - DNA, 1932 bp, B.fragilis
tttatttctttactttgcttcatcaataaacctattaatactaccatgcgaacaaaatcgatttttttacttttgttgttggctgtcatgccattgtgcgtgttctcgcagtcgaaatctacgtttgaaatcaagaatggacatttttatcgtaacggaaagataacgcctgttctttccggtgagatgcattatgcccgtatccctcatcaatattggcgtcatcggttgcagatgatgaaaggtatggggttaaatacggtggctacctatgtgttctggaatcttcatgagccggagcccggaaaatgggattttacaggtgacaagaatttggctgaatttataaaaaccgcaggtgaagaggggatgatggttattttgcgtcccggtccttatgtttgtgccgagtgggaattcggtggttatccttggtggttgcaaaatgtgaaaggaatggaaatcaggagagataatccggagtttctgaaatatacaaaagcgtatatcgatcgtctttataaagaggtcggtagtttgcagtgtacaaagggtggtccgattgtaatggtgcagtgtgagaatgaatttggttcatacgttgcccagcgtaaggatatacctttggaagaacatcgcgcttacaatgctaaaatcaagcagcagttggctgatgcaggatttaatgtacctctgtttacttctgatggcagttggctttttgagggtggggctactccgggagctttgcctacggcgaatggcgaaagtgatattgagaatttgaaaaaagtggttgatcaatatcacgacggcaaaggtccgtatatggttgcagaattttatccgggttggctgtcgcattgggcagagccgttcccgcagataggagcttccgggattgctcgtcaaaccgagaagtatctgcaaaatgatgtttctttcaacttctatatggtgcatggaggtacgaattttggttttacgagtggtgctaattatgataagaagcgtgatattcagccggatatgaccagttatgattatgatgctcctattagcgaggcaggctgggtaactccaaagtatgattcgattcgcaatgtgatcaagaaatatgttaaatatacaattcctgaagctccggctcctaatcctgttatcgaaataccttctattcaattgaataaagttgcggatgtacttgcttttgcagaaaaacagaagcccgtgtcgtctgatactcccttgacttttgaacaattgaatcaggggtatggatatgtattgtatactcgtcatttcaatcagccgattagcggaacacttgaaattccggggttgcgtgactatgccgttgtttatgtggatggtgaacaggtaggagtgctgaatcggaataccaagacctactccatggagatagaggtgccgtttaatgctactctgcagattctggttgaaaatatgggacgcattaattatggtagcgagatcgtacataataccaagggaattattagcccggttcagatagccgggaaggaaattgtcggtggatgggatatgtatcagttgccgatggacgaaatgcccgatttgaccaaattgaaagctgatacacataaaaatgtaccgtctgaagtggctaagctgaaaggctgtccggtgctttatgaggggacttttacgttggataaagtcggagatacatttatggatatggaaagctggggaaagggtatcgtttttgtgaacggtgttaatatcggacgttactggaaagtaggtcctcagcaaacactctatgttccgggtgtatggctgaagaagggtgaaaataagattgttatctttgaacaattgaatgaaacccctcaaacagaagtgaaaacagtgaaaacaccggtgttgatgaagcttaagggctga

SEQ ID NO: 3122 - DNA, 195 bp, B.fragilis
aaatgtccattcttgatttcaaacgtagatttcgactgcgagaacacgcacaatggcatgacagccaacaacaaaagtaaaaaaatcgattttgttcgcatggtagtattaataggtttattgatgaagcaaagtaaagaaataaatcactttcccgccaaatttccctttgttttctttaaaaaaataacttga

SEQ ID NO: 3123 - DNA, 318 bp, B.fragilis
ttacaacgttcccacgcttttttatatacgaaagattctttcgagggaaccgggagggatagaaggaaggaaaagagcatgaaagcagcaagaaatagcggaatttgtatgaaactggatgattttaccggagttttatcgttagagcatctggatgttaatacaatggtatatctgtatagtgagcagggtgagttaatagggaaaattcactcaacaaaatcttctgctacttttacattacctcaaaaaggtatgtatgtgcttgtaattcactgtttatcctatccggtggaagttaggagagtcatttattga

SEQ ID NO: 3124 - DNA, 996 bp, B.fragilis
gatatggtatcagctattacgaaaacgttgaggacaaacaacaaaacggtctatgtttctttgctttctattttgactttctttttaatgttggattatattcccggtttgcaagcattttctacatgggttactccgccattggctctttttctaggattagcttttgcgttgacttgtggacaggcccatccgaaatttaacaaaaagacatctaaatatctattacaatattctgttgtaggattagggtttggtatgaatttacattcagctcttgcttccggtaaagaaggaatggagtttacgattgtttcagtaattggcactctgattttaggatggttcattgggcgtaagtttttaaaggtagatcgtaacacctcttatctcatcagttcaggaactgctatctgtggtggtagcgctattgctgctgtagggcctgtagtaaaggctaatgatagtgaaatgtctgtggcattggcgactatatttatattgaatgctcttgcgctttttatatttccggtgatcggacacgctttaaatatgagtcagcatgaatttggaacatgggccgcaattgccattcatgatacaagctctgtggtgggggccggtgcagcatacggtgaagaagctttgaaagttgctactaccatcaaattgacacgtgctctttggattattccgatggcatttgctacttcgttcatatttaagagcaaagggcagaagattagtattccttggtttatcttcttctttgtattggctatgattgtgaatacttatttgttgggtagtgtacctgaattgggggccgctatcaatgggttggctcgcaaaacattgactatcactatgttctttattggagcttctctctcattggatgttgtgaagtccgtaggcatcaaacctttgatacaaggagtgcttctgtgggtagtgatcagtttgagcactctggcctatatttattggttctaa

SEQ ID NO: 3125 - DNA, 432 bp, B.fragilis
aaaaaatatccaattttgaagccaattataaacagacctaacaatatggaagattttaaaaagaaaataggaacagacatgaatgataaagagatcgtattctcaaaatcaataaaggccggtaaacgtatatattacctggacgttaaaaagaaccgcaaagatgaaatgtttcttgccattaccgaaagcaagaaagttgtgatgggcgaaggagatgactctcaagtaagctttgaaaagcacaaaattttcttgtataaagaggattttggtaaattcatggccggactcgaacaagctatcaacttcatcaatcagaatcaagaatatacagaagattccgaatcggaggaaaaagtcgaacctgaaagtgaaccggagactacagttttggatagcgaaatcaagattgacattgattttgaataa

SEQ ID NO: 3126 - DNA, 423 bp, B.fragilis
tatactatgttaaagactattttgtctatctccggcaaaccggggttgtataagcttatttcgcagggtaaaaatatgttgattgtagaaacaattgatgcagctaagaaacgtttccctgcttatggtaacgaaaaaattatctctctggcagatatagcaatgtacacaaacgattcagaagtgcctttacgtgacgtgttgcgttcaataaaagaaaaagaaaatgcagctatcgcttctatagatgtgaagaaagctacttctgagcaattacgtgaatatttggctgaggttttgcctgactttgatcgtgacagagtatataccaatgatatcaagaaattgattttgtggtataatatcttagtctctaacggaattacagactttggtgaagagactgccgttgaagcagaataa

SEQ ID NO: 3127 - DNA, 825 bp, B.fragilis
tccttccagccccgtggtgaagacttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 3128 - DNA, 2607 bp, B.fragilis
gaaaggagaacaaacgatatgaactttaacaattttaccattaaatctcaggaagctgtacaagaggctattaacctggcacaaagtcggggacaacaagccatcgaaacggctcatatcctgtacggagtgatgaaggtaggcgaaaatgtgactaactttatctttcagaagttaggactgaacggacaacaaatctccctcgtactcgataagcagatcgactctttcccaaaagtttccggcggagaaccttacttgagtagggaagcgaacgaagtctttcaaaaagcaacgcagtactccaaggaaatgggcgatgagtttgtttcattggaacatcttttgctggctttactgacagtaaagagcacggtgtctaccatcctgaaagatgcaggaatgaccgaaaaagaattgcgtggtgccatcagtgaattgagaaaaggagaaaaggtgacctctcagtccagtgaagataattaccagtcactggaaaaatatgccattaacttaaatgaagcagcccgtagtggtaaactcgaccctgtgatcggacgtgatgaagaaatccgacgggtacttcagattttaagtcgacgtacaaaaaacaatcctatattaataggtgaaccgggtaccggtaaaacagctattgttgagggattggcacaccgtattcttcggggtgatgttcctgaaaacctgaaaaataaacaggtatactcacttgatatgggtgcactcgttgcaggagctaaatataaaggagaatttgaggaacgactgaaatcggtagtgaatgaggtgaagaaatcagaaggtaatatcatattattcattgatgaaatccatactttggtaggagcaggaaaaggagaaggtgctatggacgcagctaatattctgaaacctgcacttgcccgtggagaactacgctctatcggtgctaccactctcgacgaatatcagaaatattttgagaaagataaagctttggaacgtcgtttccaaatagtacaggtagatgaaccggacaatctgagcacaatatctatcttacgtggattaaaagaacggtatgaaaatcaccatcacgtacgtatcaaagatgatgcaatcattgctgccgtagaattaagcagccggtacatcactgaccgttttttacccgataaagcaattgacctgatggacgaagctgccgcaaaacttcgcatggaggtggattctgtccctgaaggattagatgaaatctcacgaaagattaaacagctggagattgagcgagaagctataaaacgggaaaatgatgaaccgaaattacagacaatcggcaaagaattggctgaattgaaagaacaggaaaaatcatataaagcaaaatggcaaagcgagaaaagcctgatggatataatccagcagaacaaagttgaaatagaaaatcttaaattcgaagctgacaaggcagaacgtgagggaaactatggcaaagttgcagagattcgctatggcaaattgcaggaactgcataaggaaattgaagatacccagaaaaaattgcacgaaatgcaaggggatacagccatgataaaagaagaggtggatgctgaagacatcgctgacgtagtatcccgctggaccggaatacctgtaagcaaaatgatgcagagtgaaaaggacaaattgctccaccttgaagaagaattacatcagcgtgttatcggacaagacgaggctattgcagctgtgtctgatgctgtacgccgcagccgtgcaggcttacaggatcccaaacgacctattggttccttcatcttcctgggcactacaggagttggtaaaaccgaacttgccaaagcgcttgccgaatttctgtttgacgatgaaacgatgatgacccgtatcgacatgagcgaataccaggagaagcacagcgtttcgcgtttagttggagcgcctccgggatatgtaggatatgacgaaggcggacaattgacagaggcgatccgtcgcaaaccctattctgtagtattgtttgatgaaatcgagaaagcacatccggatgtatttaatatcttgttgcaggtactcgatgacggacggttgacagataacaaaggccgtgtggtaaactttaaaaatacaatcatcattatgacctccaatatgggcagcagctacatacagagccagatggaaaaactgaacggcgccaacaacgaggaagtagtggaagaaaccaagaaagaggtaatgaacatgttaaagaaaaccatccgtccggaattcctaaaccgtatcgatgagactatcatgttcctgccattaacagaaaaagacataaaacagattgtcttgttacagattaagagcgtacaaaagatgcttgccggtaatggagtagaactagaactgacagatgcggctttggatttcctctcacaggtcggctatgatccggaattcggtgcacgtcctgtaaaaagggctattcagagatatttactcaacgatctatcgaaaaaattattggcacaggaagtagaccgtagtaaagcaatcattgtagatgcacaaggagacgggttagttttccgtaactaa

SEQ ID NO: 3129 - DNA, 279 bp, B.fragilis
gctgttcttgcaggactatatgaaatttgcatagaatattttagagaacttatttgtcgtattcagggctttttaattatctttgttgcaatccgtcggaacctgaagagtcagtgttacgaggaatattacacaaaaagaacaaaagcgtttttaagatattattctgtacttgaaatctggacaatttcactattcaggaataatgtaacgaacgctcatgctctgctgtatatgcaaatatatagtatcgagcgtgggttgttgtacattatttga

SEQ ID NO: 3130 - DNA, 1296 bp, B.fragilis; identical to SEQ ID NO: 845

SEQ ID NO: 3131 - DNA, 570 bp, B.fragilis
ataaacaaggcttgccttggcacgaagtattcgatggaaatttggaactgtaatcaacataacaatatgcctaaccctaaggtaagtcaatcggcatatttattattggaagaatcatcaaaaatgaacgtaggagataaagccccagaattgctgggtatcaatgaaaagggtgaagaggtacgcctcaacaactataaaggaagaaaaattgtcctttatttctaccctaaagataacacttccggctgtacggcccaagcctgtagccttcgggataattacgcagagctacgtaaagccggatatgaagtgatcggtgtaagtgtagacaatgaaaagtcacaccagaaatttattgagaaaaacaatctgccattcaccctgattgccgataccgataaaaaattggtagaacaatttggagtatggggagaaaaaaagctatatggccgtgcttatatgggtactttacgcacaactttccttatcaatgaagagggagttatcgaacggatcatcggacccaaagaggtaaagaccaaagaacacgcttcacaaattttataa

SEQ ID NO: 3132 - DNA, 1224 bp, B.fragilis
attcttaatttaaaattcttaattaaagaaatgggtagagttcttattatcggtgcaggcggtgtaggtaccgttgtagcacacaaagtggcacaaaatgccgatgtatttactgatatcatgatcgccagccgcacgaagtcaaaatgtgacgacatcgtgaaagccatcggcaatcccaacataaaaacagcccaagtggatgctgataatgtggacgaactggtagcactcttcaacgattttaaaccggaaatggtcattaacgttgcattgccttatcaggacctgaccatcatggaagcctgcctaaaagcaggagtcaactacctggataccgctaattatgagcctaaagatgaagctcactttgagtacagttggcaatgggcctatcatgaacgtttcaaagaagccggcctcaccgccattttaggttgtggattcgatccgggagtaagtggtatttatacggcatatgccgccaaacattattttgatgagattcaatatctggatatagtagactgcaatgccggaaatcatcataaagcttttgcaacaaacttcaatccggaaatcaatatccgcgagatcacccagaacggacgttattatgaaaatggccaatgggtgaccacaggtccactggaaattcataaagatctgacatatccaaacatcggtccccgtgattcatatctgttgtatcacgaagaattggaatcattagtcaaaaacttcccgaccatcaaacgagcacgtttctggatgacattcggtcaggaatatctgactcatttgcgtgtgattcagaatatcggaatggcgcgtattgacgaaatagattacaatggacaaaagatcgttccgctgcaattcctgaaagccgtgttacctaatcctcaggatttgggtgaaaattacgaaggtgaaacttctatcggttgccgcattcgtggtctgaaagatggcaaagaacgcacctactatgtatataataactgtagtcacgaagaggcatataaagaaacaggtatgcaaggagtaagttataccacaggcgtaccggctatgatcggtgccatgatgttctttaaaggcgaatggaaacgtccgggtgtaaacaacgtggaagagtttaatccggatccgtttatggaacaattgaataaacaaggcttgccttggcacgaagtattcgatggaaatttggaactgtaa

SEQ ID NO: 3133 - DNA, 318 bp, B.fragilis
catgttcattacctctttcttggtttcttccactacttcctcgttgttggcgccgttcagtttttccatctggctctgtatgtagctgctgcccatattggaggtcataatgatgattgtatttttaaagtttaccacacggcctttgttatctgtcaaccgtccgtcatcgagtacctgcaacaagatattaaatacatccggatgtgctttctcgatttcatcaaacaatactacagaatagggtttgcgacggatcgcctctgtcaattgtccgccttcgtcatatcctacatatcccggaggcgctccaactaa

SEQ ID NO: 3134 - DNA, 732 bp, B.fragilis
gaaatgaatttagaagaagtcttaaattatcgtcgttccgtgcgggtgtttgataaaacgaagccgttggaccctgagaaagtgaaacattgtctggaactggcaacattggcgcctaacagttcaaatatgcaattgtgggagttttatcaagtcatacagccggaattgctggcaaaaatatccaaagcctgccttgatcagaccgcaacttcaacggcttcggaggttgttgtttttgttacgcgtcaggatttataccggagccgggcaaagttcgtgcttgattttgaaagaggaaacgtgagacgaaacagtcccaaagaacgtcaggaaaaacgtattaaagacagagagctctattatggaaagctaatgccgtttctgtatgcccgcttttttaggatactgggactcctgagatctgtattggctaaggctatcggccttttccgccccattgtgcgtgaagtttccgaaagtgatatgcgtgttgtcgtccacaaatcttgtgcactggctgcccagacatttatgattgccatggcaaacgaaggatatgatacctgccctttggagggctttgacagcaaacaaatgaagaaactattgaagttgcctcatggggccgaagtgaacatggtgatcgcctgtggaatacgggatggaaacaaaggaatctggggtgaacggggcagagtaccgtttgatgaagtttatcatagagtttaa

SEQ ID NO: 3135 - DNA, 633 bp, B.fragilis
aacaactctcttctgatggcaattaaaattggaataaccggcggaatcggtagtggtaaaagtgtcgtttcacatttacttgaagtgatgggagttcctgtctatatctcggatgaagagtcaaagaaagtagtggccactgatcctgttattcgtaaagagttgtgtgatttagtaggagaggaggttttttctggcggcaaattaaataagactttactggccacatatcttttcgcttcttcgacgcatgcttctcaggttaatggaatcatacatccgagggttaaggagcatttcaggcaatggagttcacacaaagagtgtctggatataataggtatggaatcggcaattctgatagaatcgggctttgcggatgaagttgattgtatagtgatggtctacgcgcctttggaactcagggtagaacgtgcggtgcggcgtgacaatgcttcatgcgagcagattatgcagcgtatccggagccaaatgagtgatgaagaaaaatgtgagagggcttctttcgtcataataaacgatggtgaaaagccgttgataccacagattttagagctaattgcttttctatatcaaaagattcattacctttgctccgcaaaaaataactaa

SEQ ID NO: 3136 - DNA, 252 bp, B.fragilis; identical to SEQ ID NO: 860

SEQ ID NO: 3137 - DNA, 351 bp, B.fragilis
aaaactaataaaactgattattttatgaacctattaactgtattttttcaagctcctgctgctggccctgacggtagtttgatgtggatcatgctgatagcaatgtttgttatcatgtatttcttcatgattcgtccgcagaacaagaagcagaaagagatcgctaatttccgcaaatctctccaggttaaccagaatgtgattactgctggtggcattcatggtgtgattaaggaaatcaatgatgattacattgttcttgaaatcgcttctaatgtaaaaattaagatagataagaactctatttttgcagatgcttctgctgccaacagtcagtctgctacgaaataa

SEQ ID NO: 3138 - DNA, 537 bp, B.fragilis
acgtttggaaacagccggagaaatcgccaaaagcttctgtttggcaggtatcgacatcacgatgaatcagttcaacaaaaaataattattcatttttcaattcataatcaaatgcctgaagcaagaatagataaatggatgtgggcagtccgcatcttcaaaactcgcacaatcgctgcagaagcctgcaagaaaggacgaatcagcatcaatgggtcgtttgtaaaagcagctcgtatgataaaacccggagacgtaatccaagtgaaaaaacctccgataacatattcctttaaagtcctgcaagccattgaaaaacgggtgggtgcaaaacttgtatctgaaatgatggaaaatgtaacaacccctgatcaatatgaacttctggagatgagtaaaatcagcggttttattgatcgggcacgaggtacgggacgtccaactaaaaaagatcgccggagcattgaggaatttaccactcccgaatttatggatgacttcgattttgatttcgacttcgaagaagataatgaataa

SEQ ID NO: 3139 - DNA, 1272 bp, B.fragilis
tctcttatgaaccaaaagcgcaatcaaaccaaagtcgtaaacgtgtttaccgtatttatggtaatgctgatattgtattttatcgtgggacttttcaccgtcatcaatcaacaattccagataccgttacaaacagctatgctgccccacgatggtaatatcaccaatgcattggtgacaatgctgaatttttcatggtttcttgcctatcccctatccgaaggattcggaacacgatggctggaaaaatacggataccgaaaaacatcttatcttgccttactgatacttatcgccggactggcaatctacgaagcagctgtgcttttccatatatatacgcccatgcaggtctccatcatcggaaatcacatttctgtcggctttttcatttttctgatcggctcttttgtgatcggtgtagccgcaacgatcctgcaagtagtgctcaatctatatctcacagtttgccggattggtaaaacaacagccttgcagcgacagatgatcggcggaacaagcaactcgataggtatggctatcgctccgttggtaatcagttatctgatatttcacggaacacctttgcacgacatcgtgacgaagcagttcattattccactgatcatattgattctgatcatgctgattattactcttttagttggtaaaacacaaatgccttctatcgacaatgtacgccaagcaccgggagaaaaatttgataaaagcgtatggtcctttagaaacctgaaattaggggtatggggtattttcttctatgtaggcatcgaggtggccgtcggagctaatgtcaatatgtatgcatccgaactcggaggatcgttcgcctcaaacgctacccacatggctgccttatattggggattgctgttattgggacgcttcttaggctcctttatcaagcaggtcccttccgaaaagcaactggtgatagcctccatcggagccatcgtactactcgtgcttgctatgctgacggccaatccctggatattgacattgataggctttttccattccatcatgtggccggccatttttacattggcaaccgaccaactggggaaatataccactaaggcatccggagtgctgacaatgggagtcatcggcggaggtattatccctcttttacaaggaatctttgccgatgtgatgggtggcaactggctttggacatggctgttggtcatcgccggggaagcttacattttgtattatggcctaaatggatacaaacaacattaa

SEQ ID NO: 3140 - DNA, 690 bp, B.fragilis
acaattatgaaaacaatgaaatttattttggcatgcgtactgctattgtctcctctgctttgccaggcacaaaaaaacttattcaacaagtacaatgacatgaaaggggtatcctctgtttatatctctaaagcaatgatggaattaaatccgaatctatttatgaaggacctttatataggtaaagtagcagaacatttgaactctgtccaagtgctctctacacatgataataaggtacgtgaagaaatggccaaagatatccgttcattggtgcaatcatccaaatacgaattattgatgaaacaaaaaagtacggtttccggttcggaagtttatgtaaatcgcaaaggaagtaaagtgaaagaactgattatggtaatgaacggagcatcttctctaaaatttgtatatatggaaggggacatgactacggatgatatcaagaagttaatgttataccaaagcaccagtcaaaactttataatatcaggagatctgttttatgcaaataataaaccggttacttactttaaaaaaggaaattcggacaatcaaaaagacatggcagagttaagcggaacctataatttaaattcgatagatacgaattataaagaagaactaagtaccttaaacgacaaattaaaaagaattgaccaagggctcaaaaacatgaatataaagtag

SEQ ID NO: 3141 - DNA, 570 bp, B.fragilis
aaagatatgaaatacttaattgtcgggttaggcaatattggtccggaatatcatgaaacccgccataatataggttttatggtattggatgctttagccagagcaaacaacctatcattcacagatggtcgttatggctttaccactaccctatctgtcaaaggaagacaaatgatcttgttaaaaccctcgacattcatgaatctaagcggcaacgccgtacgttattggatgcaaaaagaaaacattccattagaaaacgtattaatcattgtagatgacttagcacttccctttggtaccttacgcctgaaaagcaaaggcagtgatgccggtcataacggattaaaacacatcgcaactatcttgggcacccaaaactatgcgcgcttgagatttggtatcggtaatgattttccaagaggcggacaaatagactttgtattggggcatttcacggacgaagactggaaaacaatggatgaacgtttggaaacagccggagaaatcgccaaaagcttctgtttggcaggtatcgacatcacgatgaatcagttcaacaaaaaataa

SEQ ID NO: 3142 - DNA, 1086 bp, B.fragilis
agaccaaagaacacgcttcacaaattttataaatcgatcattatggcaaagaaagaagacgaattaaactttgaaacagataataataaaatggcatcaagcgaaaaattaaaagccttacaggctgccatggacaagatagagaaaagcttcggtaaaggttctatcatgaaaatgggtgaagaagtggtagaacaagtagaagtaattccaacaggttcgatagcactgaatgctgcattaggcgtaggcggttatccccgtggaagaatcattgaaatttatggtccggaatcatctggtaaaacgacactggccatccacgccattgcagaagcacaaaaagccggtggaattgccgctttcattgatgcggaacatgcttttgaccgcttctatgcggctaaactgggagtagatgtggataacctgttcatctcgcaacccgataacggagaacaggcgttggaaattgcagagcaattgatacgctcttcagctattgacatcatcgtagtggactctgtagccgccttgactccgaaagctgaaattgaaggggatatgggtgacaacaaagtgggcttgcaagcccgcctaatgtcacaggcattacgtaagttaacatcagctgtaagcaagactcgtacaacctgtatcttcatcaaccagttgcgtgagaaaatcggtgtaatgttcggtaatccggagacaacaaccggtggtaatgcattaaaattctatgcttccgtacgtttggatatccgcggttcacagcagatcaaagacggtgaagaagtgattggtaagcagacgaaagtcaaagttgtgaaaaataaggtagctcctcctttccgcaaggcagaattcgatattatgtttggtgaaggcatatcacattcgggagaaatcattgacctgggagcggatttgggaattatcaagaaaagcggttcatggtatagctacaacgacacaaaattgggccaaggtcgcgatgcagcaaaacaatgtatcgccgacaatccagaacttgctgaagaactggaaggactgatctttgaaaagttgagagagcacaagtaa

SEQ ID NO: 3143 - DNA, 600 bp, B.fragilis
ttattaaggaattacgatatggacgaaaaaataaagtttccttcgaatgtggtactgattgatgcagcgtttctgaatctagttgtgacggatctgaagaagtactttgagaaaaccttgatgcgtgaactgcaagagattgatctctcggaactggtaacttatatagtacttgatgcaggtatggcagtaggcgataatcaaattcaaatattaatggtatatgataaagattcggctcagttgtctaattgccgaccttccgatttatcggcagaattgaatggggtggcatttaagagtcagttcggagaattttcttttgccagtgtaccttgtgaggaaatggtatctcgtgaagaattatatttggatctgctgagtatcgttttagattctgccgatgtggaacggctgattttggtttctttcaatgaagaatatggtgataaggtaatggaacggttaaaaggtgtcaagaataaggaaaccattcagttccgtatgaatgaaccggaggagagtattgaaggatatcaatgggaaatgttggcatatcccgtgatgcaagcattgggaatcaggggagaagagttgtaa

SEQ ID NO: 3144 - DNA, 705 bp, B.fragilis
tatattatggatgctttaaagatgctgattgttgtaaccggaaccgatatgtatgccgatggtaacctgcaaacagggttatggctcagtgagttgacccatatctatcattgtgccgaagaggcagggtatgaaataaccgtcgcaagccccaagggcggcaatgttcctgttgatccggagagtctaaaaccgatgatgttggacaaactttctaaggattattgggatgatcttgaattcaggcgtgaattgcagcatgcaaaaagtttagccgaagtttccggacagctatttgactgtgtttatttggcaggtggtcatggtgcgatgtatgattttcctgacgatactgtattgcaggcgattattgaaaagcattatgagagtgataaagcagtagcggccatctgtcatggtgtaagcgggcttttgaatgttaaactgtccggaggagagtatcttatcaaagataaaaagatcacaggcttttcttggtttgaagaaagtttggccgggagaaaaaaggaagtacctttcgaccttgaggctgcactcgaaaagagaggagccgactacgagaaggcattgattccgatgacctcgaaagtagtggtggactgtaacctgataacgggacaaaacccgttcagttcaaaagaaatggcagaagttgtaatgcggcagttgagtcgcgaaaagtaa

SEQ ID NO: 3145 - DNA, 864 bp, B.fragilis
ttcggcaaatgtatcaactttatgttatttttttatatatttgcgccgatatttaacttaaacagtatgacaatgaaaaaagtattactttcaatttgtatggtgagtgcagtattcgctatgtcatcttgcggttcgacaaaagaagccgcttctttatcatctttaaatggtgaatggaatattattgaagtgaatggctcggccattgtgccggcagaaaatcaggaattgccgtttattggttttgatacagctacgggtaaagtatatggtaatagtggttgtaaccgtatgatgggatctatagatctcaattcaaaacccggtactatcgatatgagccgattggggagtacccgtatggcttgtccggatatgacaacagaacaaaatgtgctgaatgcattgggacaggtgaagagttataaaaaactgggtaaacataatatggctctttgcaacgcttccaatcgtccggtagtcgttcttcagaagaaagcttcggatgtaaagttgtctgctttgaatggtgaatggaaaatcgaagaagtgaatggagaagctatcccttcgggcatggaaaaacaaccgtttatcaattttgacgtgaagaagaagtccattcatggcaatgcgggatgtaatttgattaatggaggatttgaaacagataaggagaatccccgttccatttctttccctaatgttatttctactatgatggcttgtcctgatatggaagtggaaggcaaagtgatgaaagctatcaacgaggtgaagtcattcgatgtgttatccggaggaggtatcggattttatagtgcagacggaacactggtaatggtacttgtgaaaaaataa

SEQ ID NO: 3146 - DNA, 591 bp, B.fragilis
acgtccgtgtgctactgtcacgggcaagaaaaaagatacgtgaagaatttaataaatggaataattatgaaagtcgaagaaattgaaaggctgctcgccgaattttatgagggaaccactaccgagagccaagaagaggtgctgagaaattatttcagaacaacggaagtgcccggacatctgctgaaggacaaagaaatttttctcaatctttgcccggatgccgaccaagatatagaagttcctgcacatctggaagacaaactaaatctgctgattgacgaaatggccgagaaagaacaacactttttccgccccaataactccaaaaacagctggcgctggattggaggggttgcagctaccatattattgcttataggcattggatacgggattgacaatttaagcaaaaatgtgtgcccacccaccccacaagatacattctccgatccggaagaagcctaccggatgttacaggcaactttactggagatttctgccaacctcaactatggactcaatgaggtgaaagaaagccagatagatatgagaaaaatacatcaagaagtaagaaatgaaattaaataa

SEQ ID NO: 3147 - DNA, 786 bp, B.fragilis
aaaaagtatcgtatgaaaataaaaagacttttagtgttggccgttctacccatgctgtgtcttgcagtgaatgcacagaactccagtaaagacaatactcctaaaaaaggagactttactgtagcagctactgttggatacaatagttacacaagtgtcacagccccttcggggctgctgactgactatgaagtcagagcgctctcaaccaactgggcagacaaaaagctgatggttggttttgaaggaggctggttcttcaaagatcagtggaaactaaatttgggtggcggtgtcagcttcacgaataaccccggttatccggctgttcccggcacaatagacgattcgaataagaataactcggctgacgagaatatgggagagattcctaactatcgtgccgtagccgatgctcagtcgttcgcctataatgtgtcagcaggtgttgatcgttatttcaacatcaagcgtgttcctaacctgatgtggtatacaggtattcgcgtaggttttgcttacggtgaaaatgaaatgaagtatgatgaagagacctctatgggcaaatctattgccgagagttggaatcttcgcggcgctttgactatcggtgtcgactactttgttcttcctgcactctatatcggtgcgcagattgatccgtttgcatatacgtataataagactacgtataacccacaagcaggtcttggcgatctgtcggcagacagccacaactacagtgtgctggccgctccgacatttaagatcggatttaagttttga

SEQ ID NO: 3148 - DNA, 216 bp, B.fragilis
catgcgaatagcattttgaaatcattcaagtacttcagacttcgattttgttacgacatccgtcaacaatcctttattgtgatcaaaatatcctctaaatacaaaatgcgtgaattgtactatcgcaaaatctacacgtttttatcctatctgttccctttggactataaaaaagcgcttctccgcattttaaaaatacaaaatgacagactgtaa

SEQ ID NO: 3149 - DNA, 1023 bp, B.fragilis
ataaagcctatgttcgaacgtaggaacataaagtatatttatttaaaattatcaagaaagattaaggactttctgcttagtgataagagcagagagttcttaatttttttatttttcttttttattgcaggcggattttggttgcttcaaacgttaaacaatgattatgaagcagaattttctattcctgtccgtttgaaaggagtgcccaatcatgtggttttaacttctgaacctccttctgaactccgcattaaagtaaaagataaaggaacggtgttgctgaactatatgttgggtaaaagcttttttcccgttaatatcgatttttccgagtcgaaagtacctgataatcatgtgaaaatttatacgtcggaacttgagaaaaaaatagcaggacaacttaatgtatcgacccgtttgctgtctgtaaagcctgatactctggagtatatctattctaccggaaagtctaaactagtgcctgtcaaattggaaggtaaagtcgttgcagggcgccaatattatatttccgatacgatctattctccggattctgttttggtatatgcccctgtggctatattggatacaataacggcagcttatacgcaaaaagttaattttgaaaatgtaatggatacattgaagcagcgaatagcgcttgccggagtaaagggggccaaatttgttcccggggctattgatttgactttacccgtggatatatatacggagaaaacagttgaagtcttattacgtggtatcaattttcctgcagataaggtattgagggcatttccatctaaagttcaggttacgtttcaagttggattaagtcgttttcgcgaagttaacgcaagtgactttgttgtgaatgtttcttatgaagaacttttgaaattgggtactgataaatatactgtaaaattgaaatctcttccacgtggagtaagtcatgtgcgaatccatccggaacaggttgattttttgatagaacaactctcttctgatggcaattaa

SEQ ID NO: 3150 - DNA, 342 bp, B.fragilis
aagtacatctttttcgccaaagatcttcatcttacttattcttttttcgctttctttgtaacaaaattcctcctgttacgtcttaaggatataaacattgacaagaacgaacacatggataccgaaagttttaaaagagagtttctaccctatcatcgcaagctgtactgcgtggcctatcggctattggagaatgctgctgatgcggaagacttagtgcaagaagcctatctgaagctgtgggataaacgggaaggactgtcggttatcagcaatcctgaagcattcagtgtcactttagtaaaacctaaaatccgcaactatcatccaatacacgattaa

SEQ ID NO: 3151 - DNA, 597 bp, B.fragilis
caaaatataatcatgaaaagacgcctcagaaccttattactccttcttttgatagccaccagaacattacttgcacaaaacagccattttgcaagttcctcctcccccggctccctatcacccgatgaagaaacggatttcataacaacacatttccccttaaagcagttatgtaaatggacacccggaatgaagtttatgttcatccccgatagtagtgatgaattcgtccccatattatgcaaatatgaagatgggaaagaagtcgacaacgatttgctcaaaagtaaaacgctggaatataccggttcggaagaaactgtacatgaaacgtatatcggcaagatttatacttcccgattcatattccagtgtgaagatcataaatactattatgagatgaaagatgtcaaactgaacgatttgtgtgatcaaaatccgtatgccagcatccctgccctcgtctatctgcaagatgtaaacaaggccaaggaattattaattgggaaaacgctctatacgcgtactaccatagcaaaaacagacgatgccaacagctattcaggatatagagaagtcaatatcgcgaaaggttaa

SEQ ID NO: 3152 - DNA, 843 bp, B.fragilis
aagatgacaattgataatcaaaccggtctggtactcgaaggaggaggtatgcgcggcgtatttacctgtggggtactggactatctgatggaccatgatattcgttttccctatacaatcggggtctctgcgggagcttgcaacgggctttcgtatatgtctcgccagcgtggacgggccaagtacagtaacatcgacttgttagagaagtaccattatatcggattgaagcatttgctcaagaaacggaatatcctggacttcgatcttctctttacggaatttcccgaacatattcttccttacgattatcaggcatactttgattcgcccgaacgatatgtgatggtgactaccaattgcctgaccggggaagccgattactttgaggaaaaaaaggataagaaccgtgtcatcgacattgtccgtgcttccagcagccttcctttcgtttgtcccatagcttatgtagacggcatccctatgctggatggcggcattgtagattcaattcctttgcaacgtgccatacacgacggatatcggaataatgtagttgtcctcacccggaatcatggttatcggaaagagaacaaagacatccgtattcctccttttgtctatcgtaaataccccaagatgcgggaagcgttaagtcggcgttgtgctgtgtacaatgaacagttagagatggtagagcgtatggaagaggagggggacatccttgtcatccgtcctcagaagcctgttgtagtggaccgcattgaacgtgatattcaaaaactgaccgatctctatgaggaaggatacgaatgtgcgaagcggcagcttgaaaccctctga

SEQ ID NO: 3153 - DNA, 666 bp, B.fragilis
cctgtcaaaattacaacaatagatgtcggtaacaagtccttcccggtaaaaatcacttttattgaccgcaagggagtttcttattatattaatgtagccatgtccaggaccaactccggtatggaacctgcagattttcaagcggaaaaaagaataaactattttccaaatgcattttctttcaccaatccggatgtcaaaaccagagagtctatccagtccaaatacatcggacagtctgtttatcctcaaaagacaattcgagtcaagcaaacagagttattacgttataccccattacatatcaaagatgtacaacctgaaaaggcaggaacatcagctacactccttctgacagatattcatggaaacacatatcaagtcaaagtagatttgaaatatgatccgatccttaaaaatgaagatttcatagaggaccttttcggattctccgacatacgaaagaaatatccaaacattagtgaatccaactggcttatgcttgccaaaggagaagtaaaaccaggcatgacaaccgaagaatgcaaattagcaataggagaaccgatagaaatcagagttcggacagactcccgctttgaaacctggttatatagaggaaagatattggaatttgaaaatggcatcttgctccgggctaaataa

SEQ ID NO: 3154 - DNA, 345 bp, B.fragilis
tgttgcggaattaaggtaaaaaatatgtgttttgatttgcttcgttcaggaaagtatgttctgtcccgacaaagcgtggagctatcagccgcccaagatgtttttcaaccggacaatctggaagcacgtgaaggggtacgacaaataaaagatattattgcccacttacccgaacaacagcaacgaatcataaatatgcgcgatattaaaggttgttcatacgaagagatagaacaagtcactggattaaactctataaacgtccgtgtgctactgtcacgggcaagaaaaaagatacgtgaagaatttaataaatggaataattatgaaagtcgaagaaattga

SEQ ID NO: 3155 - DNA, 1629 bp, B.fragilis
aaaattgagattatgaaaaagaaactcatgatggtagcagtgcttctgggtgctttgtcactgggggcttgcgtagacaacaatgaatcggcatcggtagaagcggtgcgtaatgcaaaagcaaagcaattagagtctgttgcgaacatgaataatgcgaatgcggatgctaagaaagccattacagcagctgaagttgcaataaaagaggctgaagccgcctatcaaaaagcacaagccgaattggcgcaggcacatgcagatcaacaaaaaatcctattggagaaagctcaggctgctttggaggcagaacttgaagctgctaaaattaatgctgaagctgaattgaataatgccaaagctgctttagaatctgctaaagctgctcttattgctgctttggatcaagtggatcaggccaataagacaagaattacaactttgttaggtaaagctaatgggttgctggcaacgatcaatgccgatagacagagtttgattgatgcaaaagatcagttggcaagattgaaagctggtttagtgtcagtggagttgagcaatcaacaaacaatagctggagaggagaaaaataaagctgttgctcaggcattaattgcagaatatgagaagtatagtactaaagataaggctgatgctgagaaagcagctcaggaagctaatgctaaattgactgctcttggccagactcgagatgaaaaaaatactgctgatcgaaatgcgcaacaggcttattgggaggcatatagaaatttgaacggctctctttatgttcggacattgcagcaagcaggtccgtcttactatgatacggaagatattcggggagaagttgtgaattatacgaacgatgactctactaccggaacagtataccctagttcttatactaaatatattcctaatttggatcgtatcaatgaggcaattactaatcaaacaagatatttgagtgtaagtaaagctgctcttgcagatgctaataaggctttgacggatgcaaaggcttctgatacttataaaagtctggcaaaggctgtaactgatgcgcagaagaaatttgatgatgctaaaaccgaagcagataaaaatactgctttgagtgaactgggtatagcggagggtaatttaagtgcttacatacaacctttggaagatgcagttgatagtgctactgcacgtgtggagaagggtgaaaatagcttgaaggagtataatgacgcattggctgccgtatcgggtgataatgctacggcatatgctaatttattaactgctatggataatgctgttaaagcacgagtggagactctaatagcatactataaagctgatcataactattctgttcagaacacattggcttatacattacaaactatagctgatggcttggctgattatgatcagttgattttagtccagaaacaagctattgctgctgctgatgaaaatatagctaatgccgcttcagttgtatcaaaggaacaggctattgctaatcaggagaaaaccattgctgaccttgaaaatagtttggctgtaaatgaacctatttacaatgattatttagctcagatcaaagctttagtaggtgactctgcagaataa

SEQ ID NO: 3156 - DNA, 909 bp, B.fragilis
gcctttatatttatgtctgattttcgtctgaaagtatttttaagcgttgctaagaacctcagtttcactaaggcttcacaagagctgtttgtcagtcagcctgccataactaaacatattcaggaattagagacttgttatcaggttcggttattcgatcggcagggaaataagatttctttgacagaagcgggtaagcttttgcaggagcatagtgaaaagatattggaggactataagcggttggaatacgaaatgcatttgctgcataacgaatatataggcgatttgaaattgggtgccagtactaccatttctcaatatgtgcttcctcctttgcttgctaattttatagccaagttccctcaagtaaatctttcattattgaatgggaattccagagagatagaggctgctttgcaggagcatcgcattgatttagggctggtagagggcatttgtcgcttgcccaatcttagatatactacatttttacaggatgaattagtggcagttgttcatacaggtagcaagctttcattgcctgatgagataactccggaggatctatccagaattccgcttgtactcagggagagaggttcgggcacactggatgtttttgagagagctttgtccgaacataatatgaaattatcatccttgaatgtacttttatatttaggcagtacagagagtatcaagttgtttttagaacatacagattgtatcggaattgtttctatccgttctatcagtcgtgaattactttcaggtacttttcgtgttattgagattaaaggtatgccaatgctacgtgagttctgttttgcacaaccgcaaggacaggagagtgggttatcacaagttttgatgcagtttgctatgcatcataacaaaaagttatag

SEQ ID NO: 3157 - DNA, 1017 bp, B.fragilis
aatactgcattaaaaaatgtgatttatttgtgtaaactcattaaaaatgtctacttttgcaattcgttaataacagtattaattaagattatgattaacagagttcttattcgtctaaagatcatacagatagtgtatgcttactatcaaaacggcagcaaaaatttagactcagcggagaaagagttgttctttagcctctcaaaggcttatgatctgtataactatttgctgatgcttatgattgctttgacggaatatgcacaaaaacgcatcgacacagcgaaagctaaactagcgccgactaaagaagagttgtatcctaacatgaagtttgtggaaaataaatttgttgcacaactcgaagtgaataaacaattgagcgaatttatagctaatcagaaaaggacctgggctaatgatcaggacttcattaaagaattatacgaaaagattattgcatccgatatatacaaggagtatatggcttcttctgacaaatcttatgaagcagatcgtgaattatggagaaaactctataaaactttcgtttttaataatgattcgttagatcaggtgttggaagatcagagtttatattggaatgatgataaggagattgtcgatacatttgtattgaagaccattaagcgttttgaagaaaaacagggagctaaccaaccattgttacccgagttcaaagatgacgaagaccaggagtttgcacgccgtttgttccgtcgggccattttaaatgccgactattaccggcacttgatcagtgaaaatacaaagaactgggatttggatcgtgtagctttcatggatgtaattattatgcaatgtgcattagcagaaattcttagttttccgaacattccggtcagcgtttcgttaaatgagtatgtagagattgctaaactctatagtacagtgaaaagcggtagctttatcaatggtacattggacggaatagttaatcaattaaaaaaagaaggtaagttgacaaaaaactaa

SEQ ID NO: 3158 - DNA, 609 bp, B.fragilis
cacaaaaaatttcaagaaatgagatcaattgaagtaaaaggaactgcaagaacaattgcagaacgctcttctgaacaggcaagagctttgaaagaaattcgtaacaacggtggtgtaccttgcgtactttacggtggtgaagaagtagttcacttcacagtgaccaacgaaggacttcgtaatttggtttacactccgcatatttatgtagttgatttggttattgatggcaaaaaagtaaatgccattctgaaagatatccaattccacccggtaaaagatactatcctgcacgtagacttctatcagattgacgaagctaaacctattgtaatggaagtacctgtacagcttgaaggtcttgctgaaggtgtgaaagccggtggtaaattggcattgcagatgcgtaaactgaaagtgaaagctttgtataatatcattccggagaaactgactattaatgtatctcacctgggtctcggtaagacagtaaaagttggcgaactaagctatgaaggtttagaattgctgaatgcaaaagaagctgttgtatgtgctgttaagttgactcgtgcagcaagaggtgcagctgctgcagccggaaaataa

SEQ ID NO: 3159 - DNA, 327 bp, B.fragilis
caggaggaattttgttacaaagaaagcgaaaaaagaataagtaagatgaagatctttggcgaaaaagatgtacttttaatgactgaattaaaaatagatactatgagtcaaaatgaaacaacaaaattggacattattgtagaagtattaggtgagagagagccggagatacgacgtttggttatcttggacgaccggttaaggatgtttgccgaatctaacgatgaaaatggtccgggcatacctatcgagttggtagcggagtgggctacgctgctgaataaatattatccgttggcattggaaaaacggaatatgatgaattaa

SEQ ID NO: 3160 - DNA, 588 bp, B.fragilis
atttctaaatctatgaagccgaatcggacaaaagaagacattttactgctttcccaacttcagcaaggagataaaaaagccttcaatactttgttcagaaggtattatccgatattatgcgcttatgcccaccgttttgtagacttggaagatgcggaagaaatagttcaggatgtaatgttgtggttatgggagaatcgagaaatcttattgatagaatcatcccttagtcaatacttgttgaaaatgatatatcaccgttcattaaaccgcatcgcacaaaaggaggtaaagtatcgtgccgatacattattttatgagaaaagccaggcaatgatttatgacgtggatttctatcagattgaggagttgaccaaacggattcacaccgcgatagtggagttaccggaatcttaccgggaagcgtttatcatgcaccggttcagagatatgagctacaaagaaatcgcacaaactcttaacacctctaccaaaacagtagattaccgcatacaacaggcactaaaattattacgtaaagaactcaaagagttcctgtcgttcgccttgatatttctggcagcgtaa

SEQ ID NO: 3161 - DNA, 399 bp, B.fragilis
ttgagcggccctgtgcagccccgtggtgaagacaatgggacggtagttcggtgggattgctccgtattacttgaaaatgccggatttaaagatgcttaccggacgaaataccctaatccggttacacatccgggctttacattcccgtctgataatgaaggagtgccggtgcagaaactgtcgtgggcacccgatgctgacgaacgggatcgtatcgactttatttatttcatgccggacaggaaattgaaattaaaagatgtatcggtggtaggtccttcaaaatcgatcgtccgtagtgaacgtgtggaggagagtggtaaagattcgtttataactccgctaggcgtatggccgacagaccataaagccgtaatggctactttttccctgagataa

SEQ ID NO: 3162 - DNA, 1836 bp, B.fragilis
  unsure (1787),(1788),(1807),(1809),(1811),(1812),(1815),(1823),(1824),(1829): Identity of nucleotide sequences at the above locations are unknown.
aagagtaaaccttgtgagcttgtttggcgacaagctgagataaactattttttaactttaagtcaatacaaaattatgcaaaattattttagcatccaattgttacgggtggtaaagtcttcgctttggctgacctcgaaaaaaattccaaaaactatgcgactattcatcctattcctaatttgctctatgagttttgtgcatgcgacagacagcttcgcacaaaaggtggaaatcagtattgatgcacagaatcaaactgtagagaaagttctgaaagaaatagaaaagcaatcgggctttggctttttctttaataacaaacatgtcaatctgaaaagagttgtttctgtttcggttgataaaagtaatatatttaaagtactggataaaatctttgaagggactgacgtgaaatactccgttttggacaaaaagattattttgtctactgaaatgacatcgaagcaacaacaagcggtgaaaatctcgggaaaagtagtcgatgtcaacggagaaccggtgattggtgccagtatcgttgagaaagggaccaccaatggtacggttaccaatttgcagggtgatttctctctatcggtcagttcagataaggcagtgatcgagatttcctacatcggataccagcctcaggaactgaaggtcattgcaggaaaaccattgaatgtgacaatgaaagaagatgcccaggctttggaagaagttgttgtggtaggttacggttcacagaagaaggtgaatgtgattggttcaattgctgctgtggatagcaaaaaacttgaatccagaactgcacccagtgtttcgaatatgctgaccggacaactctccggagtgacgatcacacagtcgagcggtaatccgggacaagaccagggtacgattcgggtacgtggtgtaggctctttcggagcgactcccgatcctttggtactggtcgatggacttcccggcagtctgaatgatttgaacccggcagatattgaaagtatctctatattgaaagatgcctcgtcggccgccatttatggttcgcgtgctgcgaatggggttgtactggtaaaaacaaaaggtggccagaaaggtaaagttaccgtaagttataacggatatgtaggcttcaatcaagctaccgaactaccggaaatgtgcgattcctgggaatatgcggaattatacaataaggctatgggtaaggaagtttattcggcggaggagattcagaagtataaggatggatcagatccgtataattatcctaatgaacattatctggataaacttctgggcaacaaaggactgcaaaccggtcatgaactgaccgtgaacggaggaaatgataagacacagtatatggtttctttcggctatgtaaaacagaatggtctgatggaacacaatcactacgaccgttacaacggcagagtgaatctgactacagagttggctaaaaaactgacactgactacccgtttgggtggagtcgtttctaaacggagcgaaccttctactccgggtggaatggactctgccggatttaaagctttctcaagtaatgcacttcgttttcccggattatgggcaactaaattggaagacggatcttacggcttaggaccgaaggtactcggaacaccattggcatggctggacagcggctctttttatcatgaaaacttccataagttccgttctaatgtcgagttggcattcacacctgtgaaaggcttaacgctgaaagcgtcttcaccacggggctggagttnncgatcggcactcagtttcngngnntcntatccatnnggggnctctatc

SEQ ID NO: 3163 - DNA, 1158 bp, B.fragilis
ttcggagaatacaggggctattgccggcaagtatttatatctttgctacttaatttttatttgagatatttaaatgtaatacttatgaacaggaaaaactacttattagctttcattctttgtgtgcagacgctgtttgtttctgcgcaagtctatccggtccgcgcaaagttgaccgatgaaaagtctttttcaatgattcttttacccgatccgtatagttatacaatggtcgatgcccattacgcactttttgagttacagacagcatgggtagccaatagcattgaatctctgaatataaaaggtgtgctttgtaccggtgatttggtggagcaaaatgaaattcgcattccggatggggtgaacggcaaccagacaagtgaggagcaatggcgtgctgcttcgcgtgcgtttgagcgactggatggaaaattgccttatgtgatttgtaccggtaatcatgattatggatatcagaaagcggaaaatcgtttgtgtcatttccctgattactttcctgcggagagaaactcctgttggcgcaagagcctggttgccgtaggcaacaattatcagggtataccgacactggaaaatgctgcctatgaatttataaccgatacctggggcaaaattctggttgtttctctggaatttgctccacgtgatgaggctttggcgtgggctaagaaagtggtcgatgctccccgctataaagaccataaagtgatattgctgacacattcatatctggcatggacaggaaaagtcattgaaagcgagaactacaaagtgactcctgccaattatggaaaagctatttgggataagttggtctatccggcaaagaatatttgtatggtgatttgcggtcacgaatgtgagattgccgattataaggataatgtcagtttccggattgataaaaatgcttcaggcaagaatgttcctcagatgatgtttaatgcgcagactgccgataagcaatggttcggtaacggtggagacggatggttgaggattatggaattcatgcctgatggaaaaacgattaaaatcaaaacattctctcctctctttgcactttctcctcttacttgtgataaatcgtggagaacagattcttatgatcagttcgacattacgatagagtaa

SEQ ID NO: 3164 - DNA, 1017 bp, B.fragilis
attacaaatatgaactacgaagatatagaccatttactgcctcgatattgtgaaggactggctacggaagaagaatgccggcaggtggaaagctggatggaagaatcggaagataaccgaaagatagtggatcaaatcaacactctttatatagctgtagatacggtcaacgtaatgcgtaaggtggatacggaaaaagctctgaaaaaggtcagtagcagaatgatcgtcaggaaaacaacttggtgggagtggatgcagcgtgtcgctgctatcttatttatcccgttgtccgttgcttttctggtgcaatatatgcacaatgggaaatctgctgtgtgccagatgatggaaataaaaaccaatccggggatgacaacctcggtggtattgcccgatagtacggttgtctatctcaattcggagtcttctttacgttatccttctgtttttgaaggcgatatacgaaatgtcgaattaaagggagaagcttattttgcggtagcaaaggatttgaaaaagaagtttgtagtttccgccccgcattcatcgcagatagaagtgctgggtacacacttcaatgtggaggcttatgaagacgagccggatgtttcgacaacattggtggaagggcaggtctgctttcattttagtgataaagactatctggccaagaaagtggttatgaaacccggacaaaggttggtctacagttcgaccaatggtgatgtacagttgtacgcaacatcctgcctgtccgaaaccgcctggaaagatggtaagattatatttaataacactccgttggatgtagcactgaggatgctcgagaagcgctttaatgtaacatttaaactaaagaatgcccgtttgaagactaatgcctttacaggcacatttactgaacagcggttggaacgtattctggagtattttaaaatctcgtccaagatacagtggagatatttggaaagtcctgatattcgggatgaacgaagtataatagaagtttattga

SEQ ID NO: 3165 - DNA, 291 bp, B.fragilis
agaaaatcccggagcatgggaaaaagcggcagcagttcgaaccggagcgttaccatctcttcccagaaagaggatatctaccagggaagggattttgcggacctggaaccgggagagttcatcggatccgccacccgtgccaatgtcagatacttcaaggtgatgctcggggagtttaaagaaaaggatgaaaaaccgctgcccgacgtccgggttctggaaccgggagaaatatccgggaattttgccaggatccttgaggaggtacgctcccttttcccatgtgaatag

SEQ ID NO: 3166 - DNA, 306 bp, B.fragilis
  unsure (142): Identity of nucleotide sequences at the above locations are unknown.
gccccggtgataggcatgcttatgagcatatccacccgccagttcaccatgcagaacaaagtgcctttcgtatatttcttggatgaaatgacaacggtcaacattaaaagtttcgagtcgctgctttcggtcatgcgcgaanacaaggtcgcctttgtactgcttacacagtccggttcaaagctggagaatctgtacggcaagctcgaccgttcatccgtggaagccaatttcggaatccagttcttcgggcgtaccaaggatgtggaagccttgaaatattatccgcagatgttcggtaagtag

SEQ ID NO: 3167 - DNA, 651 bp, B.fragilis
gcactctcggtaccttccagccccgtggtgaagacggcacagatgaagaaattcacccgcgaatgtatggatgaatatgcccgtaacttctaccgtgagaaaataaaatcaggggatgacctggtctggtacggccgcgtggaaacggaacgccactataagaatgatgatccggaggttaaggccggcagggcaaaggcgggagataagaagcccgggctccagcttcatgtgcatgtgatcgtttcccgcatggacaggacgcagaccgtatcactctccccgctgtcaaaaagcaggggaaaccggcaggtacttgaaggcagggaagtcgtggtaggttttgaccgttcccaatggtcctcccggtgcgcttcacgcttcaaccagtcatatgactatttccctaattactattccagggatgaaagcctgaggaagtactccgagaactggcaggccaaaaacgaactgaagaacgaggcggtatcaaagctcaaacaggaagttctcaaaggggagctgaaggaagaaaggcgtctgtatgccaacaccttccggatttaccggtttgtggtaaaccccaagaaggcaattattcaggaacttaaaaggctggggacggatcttctttccggaagggacctgtag

SEQ ID NO: 3168 - DNA, 1320 bp, B.fragilis
tacatcatgtcaaaaattcagttacgccaagtctatagagaccagttgtacaactatcgtcctacgtggatattaagatggggaataaccattttcttcgtttttcttttactggttatttccgtttctggatttataagatatccagatattgtacctgctacagttgaaattacaaccataaatccgccagcaaatctaatttccaaagtaaatggaaaaatagaaatcatattcacagaagaaggagaaagtataacaaaaggacaagtccttgccatattagagtcaccagcacaatggaaagacatgaaaattttagatcattacattacagtcctagaaaacacaattggaaaagatagcctttcagtaattcccgaacccgattttttgcgcaatgatcttgaattaggagaagtacagggacgctatgctgatcttaagctcaattatactgagctatacaattttctacattccggactatttgaagaagaagtattgtcattacaagaaaaaaagcaggcacaaaagcaattattagtacaagagaatagaaagagagaacttttaaaaacacaaatcagacttgcagacaaagaatatcaacgagattccattctgtttgtaaaggaagtcatttctgaaagtgaaatagaacaaagacaccaaaacaggcttcagttccaatcttcacttgtagatatggaagtcaacatattgaacattaaatcctcattaaaacaactacgctctgatctaaaaaaaatagaattaaagcataacaccgacaggcaggagctaacaaataaacttctacaaagcacgcacttattaaaagcgcaaacggaaacttggaaacaaaattatttaattactacccctatagatggtaaagtaagttttactacatattggagtaagaatcaaaacgtcaaatcaggtgagcttattttttctgttgttcccattgattctatgacaacaaaagccagactacaatttcccatacaaaattcgggaaagataaaagaaggacaacaagtcaacatcaagttacaaaattatccatatcaagagttcggaatgttagtgggtcatctatccaaaatatcagaagttcctaatgaactattatatagtgcagacgtagttttagataaaggacttattacgtcttacgggaaaagacttcctaaagtgcaacaactgaaaggagatgctgaaatcctaacagacgatttgagtctattaatgcgttttttcaatccattacgggccatttttgatcacagattaagaaaacataatcaataa

SEQ ID NO: 3169 - DNA, 1326 bp, B.fragilis
ctttgcatgtcaatgaataaacaaatgcacatcagtaacggaaacaaacggattctgcaaatagccgttccctctattatttccaatatcacagtcccgttattgggactggtcgatgtcactattgtaggacatctgggatcggccgcctacatcggagccattgctgtaggtggcatgctgttcaacatcatttactggatattcggctttctacggatgggcaccagcggcatgacttcccaagcattcggacaacgtaatctggaagaagtaacaaaactgcttctacgttcagtcggcgtgggattgtttatcgcactctgtctgatgactctgcaatatcccatccaaaaagccgcatttgctttcatacagacttccgacgaagtagaacgtctggccactctctactttcgtatctgcatctggggggctcctgccatgctcggcctttacggttttgccggctggttcatcggaatgcagaattcccgttttccgatgtatatcgctattacgcagaatattgtgaatatcctggcaagtctttgttttgtattccttttcggaatgaaagtagaaggagtagctctcggaacgcttatagctcaatatgcaggtttcctgatggctctgcttttatggctacgttattataaacaattgcggaaacgagtccattggagaggcatttggcaaaaacaagccatgtatcggttctttcaggtaaatcgcgatatttttctccgtactttgtgcctggtagctgtaacgatgttcttcacctctgccggagccgcccaaggcgaagtagtactggctgtaaacactttattaatgcagctgtttaccctcttttcatatattatggatggatttgcctatgcaggcgaggcacttgccggtcgttatatcggcgccggtaatcgtatggagcttcaccgtaccgtccgacagttattcggatggggtgtcggattatcagccgggttcacccttctttacggtattggtggacaatcatttctgggattactgacaaacgaatcatccgttatccaggaagccgacacttacttttattgggtattagccattccccttgccggattttccgcctttttatgggatggcattttcataggtgccaccgctacccgccagatgcttttctccatgttcatcgcttctgccagtttttttcttacctattacatcttccaagaagtaatgggaaatcatgccttgtggatggcttttattatctacctgtcgcttcgcggacttgtacaagcttttttagcaaaaaagatagtccattaa

SEQ ID NO: 3170 - DNA, 348 bp, B.fragilis
aaatatttgtttatgggactggaagacgattttttgttaaatgacgccgatgatgaaaagaccatcgagttcatccggaattatttgcctcaggaattgaaggaaaagttttcggaagacgagttgtactatttcctcgatttgattgatgagtactactctgaaagcggaatcctggatgttcagcccgatgctgacggttatgttgacatcgacttggagcaggtagtagaattcatcgtgaaagaagccaaaaaagatgaagtgggtgaatatgacccggaagatatcttatttgtggtgcagggagaaatggaatacggcaactttctgggacaggtggagtaa

SEQ ID NO: 3171 - DNA, 1257 bp, B.fragilis
ttgctattgttagatactatagattcagtactcataattatttctcttgattattatattattcataatattgaactcacgttaaatataaataaaatgaaaaagatcaatgcggctttggtaatatctctgtttgtaatgacaggatgtggaggaaataaacaactgacagatgattgcatcacggttgatgttagtgcggattatcctaaaaaggaactgatccttcaagattttatggatgtagaatacgttccgttggaaactactgacgattttataactcaaggtattgtgaaagctaccggtaagaaaattctgttggttgcaaacagaattatggatggtaatatttttgtgtttgacagggctactggtaaagggttacggaagattaaccgtttgggacaaagtggtgaagaatattcgcatattacgtctattgttctggatgaagataataacgaaatgtttgttgtagattatcctgcaaggaaaatattggtatatgacttatatggagagttcaatagaagtctcccatttccagatacctgctattatgagtttttatcggactatgaccgggatcatctgattggttataaaagttatttgccattgatagaaaccgacgaatcatgccatgtacttatttccaagaaagacggaagtgttacacgaaaaattcaaattcctttcaaagaactcgagacaccggttgtgacgaaagatgaggcgatagtgactccagttttttttctgataaccccgcatgatagtaattgtctgctgacgaaaacatcatctgatacaatatacaattacttaccggatggcactctcagtccgtttattgtacggactccttccattcattctatggatcctaaagtatttctttttccgaccattatcactgatcggtattattttatgcaaactcttgataagaagtttaattttgaaaaggggagaggtttcccgaccaatgatttagtgtatgataaacaggaaaaagcaatatttcaatataccgtatataatgatgacttttctaataaacaccgggttgcattgggacagcaacccgaaaaatctgtagatgaagaaattgtaacctgtcgtgctttaaatgcttcagaccttgtcgaggcgaacgaaaaaggagaactgaaaggtaagctaaaagaaattgctgccggactgaatgaagaatcgaattcggtgattatgttgataaaacgcaagaaataa

SEQ ID NO: 3172 - DNA, 312 bp, B.fragilis
gcggccgatcccagatgtcctacaatagtgacatcgaccagtcccaataacgggactgtgatattggaaataatagagggaacggctatttgcagaatccgtttgtttccgttactgatgtgcatttgtttattcattgacatgcaaagttacatgaaaaacagagaatatgaaaatgatgtgaacaatcatgtaattatattggttcgcaacgttctcgatacaggaattaatattatttttgtctgcatattgaaagatatcttacagacaattaacaaacatcgcagcgaggtagcattatcaatttga

SEQ ID NO: 3173 - DNA, 786 bp, B.fragilis
agaaatttaccaaaaaattacgtaccgaatatgatgccctaccctgaatctttccctgtcccccttattcatattgcaaaagcagactccaccaacggttatttaaatgccctctgcgaaaaggagaaagttagcgaactgaccacagtagtggcagacttccagactgcaggcagaggacagcgcggaaacagttgggaatcggaagacggaaaaaacctgatgttcagcttcgtgttgtatccaactttcctggaagcacgtaagcaattcctgctttcacaaatcgcctctttagcagttaaagagacacttgatctatacataggagacgtttctataaaatggccgaatgacatctattggaaggacaaaaaaatctgcggaatgctgattgaaaacgatctgatgggaatacatatcagccagagtattgcaggagtaggtatcaatatcaatcagaaagaatttcacagttctgctcccaatcccatctcaatcatacagatcacccaccgggagtctgaccgtatggaaatactcgcacaagttcttcagcggataaaagaatactataagatcttacaggaaggagatattgaatttatcaccgatcgttatcaggcagctcttttccgcaaagaaggcatacacttttataaagattcagaaggaacatttaatgccggaattgtaggagtagaagctgatggtcatttagttctacaagacgagacgggtaagatccgtcgatatctatttaaagaagtacaatacattctttaa

SEQ ID NO: 3174 - DNA, 318 bp, B.fragilis
aaaatggctttagagattactgacaacaactttaaggaaatcctcgcagaaggatcaccggttgttattgacttttgggctccttggtgtggtccttgtaagatggtaggtcctatcatcgatgaactggctaaagaatatgaaggaaaagtgatcatgggtaaatgtgatgtagacgaaaacagtgatctacctgcagaatttggtatccgcaatattcctactgttctattttttaagaatggagaattggtagacaaacaagtcggtgccgtaggtaaacctgcatttgtagagaaagttgagaaattattataa

SEQ ID NO: 3175 - DNA, 1332 bp, B.fragilis
agtggaagtacccaaataattatgttcctgaccaaacgtttctatatactcgtccttgtcgtcatcctcttgttaggtggcggatacctgttcggttctctgtttatcatcggacagttagggctgcttgcgctgctgcttgctctggctttcgatggatatctgttgtatcgcaccaagggtatccaggctttccgtcagtgtgccggacgtttttctaacggtgatgataacgaagtcagcctgcgtatagagagccgttattcctatcccgtccgtttgatcgtgatagatgaagtgccggtcatatttcagcaaaggaatgtacacttcgagctgtcgcttttacctaatgagggaaagacgcttacctatcggttgaggccgactcgcaggggagaatacggtttcggattcatccgcgtttttacgactacccgaatcggattaatatcccgcagggctacctgtggcagacctgaaaccgttaaggtatatccttcttacctgatgctccatcgatacgagctgctggctatgagcgataacctgaccgaactcggtatcaagcgtattcgtcgggctgggcatcagactgagtttgaacaaatcaaagagtatgtaaagggagacgattatcgcaccataaactggaaggccagtgcacgccgtcatcagttgatggtcaatgtctatcaggacgagcgcagtcaacagatatacagcgtgatcgataaagggcgtgtgatgcagcaggctttccgtggcatgacattgctggactatgccatcaatgcctcgttggtgctttcgtatgtagctatgcggaaggacgataaagccgggctggttacgtttaacgagtatttcgatacgtttgttcctgcttccaagcaagtcggtcagatgcagactttgcttgagaacctctataaacaggaaacaacatttggtgaaacggacttttctgccttatgcgggcacttgggcaagcatgtgaataaacgtagctttctggtgctttataccaattttagtaatatgaccagcctgaaccggcaattagtttacctgcaacaattggcccggcaacacagagtattggttgtattctttgaggatgccgatctgaaagagtatatagcgggcaagtcggtgactaccgaggaatattaccgtcatgtcatcgcagagaagtttgcgttcgagaagagactgattgtgtcaactttgaaacagcatggcatttactcgctgctgacaactcctgataagctgtcgattgatgtgatcaataaatatctggaaatgaaatcgcgccagttactctga

SEQ ID NO: 3176 - DNA, 867 bp, B.fragilis
tctataaacacacacaacatggaatggcccaaaagtaaaaataacaaaatggaagagctattggaaagaatgagccaatttgaagctaatcttgctcaattaatctcaaccggaatacccaatcacactccctctccagctaccgatgaggcgacatcctcccccaatgaacaggaacaactttctcccgaacaagaagaagaaatgaaattaaaaatccaagagcttcaacaaaaagaagaagagttgaatctacgtgctgaaaagttggataaattagcaaaagaacttgaagaacggcagcagaacctggagaataggaatccaaacgatgaacgctccatagagcctgcgacgcatcccgatcactcgttcccttctcaaatcggagatcaaataaatgcattaaaaaaactattggaagattcttcttacaaagataaaatcattaaggatcttcatgaagaactgcaaagtcataaccgggatcttcatgcggaaatcgtaaaacctcttctgaaaaacatgataaaaatgcatgagcgactcacgaaaacttataagttttatgaaaatacggaagctaaaagttcccctgaaacttatacgagattattgagagaagtggaaaattgtaaactgcatattcaagatattctagaagacgaatacgacttagagtattttgaaccgacaataggcagcgcatattcacctaaagagcaaacagccatccgaacagtgatcactgataccccggaacaagccggcactattaaagaatttcattacggaggcttccgaaatactaccacaaacaaaatatttcaaccctcaacagtcactgtatataaaaaatcagaataa

SEQ ID NO: 3177 - DNA, 723 bp, B.fragilis
tatcaattaactaccgaccgccttatgaatatatccgaattaagtatacgacggccagtactctcaacggtactgaccatcatcattttgctctttggactgatcgggtacaactacctgggtgtccgggagtatccatccgtagataaccctattatttcggtgtcctgctcctatccgggtgcaaatgccgatgtcatcgagaatcagatcaccgaacccctggaacagaacatcaatggtattccgggcatccgctcactctccagtgtcagtcagcagggacaaagccgtatcacggtagagtttgagctttccgtcgacctggaaacagctgccaatgacgtgcgtgacaaggtatcacgcgcccaacgttatctcccgcgcgactgcgaccctcctaccgtatcgaaagccgacgccgatgccacccctatccttatggtggctttgcaaagcgacaaacgttctttgctggaactcagtgaaattgccgacctgactgtaaaagaacagttgcaaacgatctctgacgtaagtagtgtctccatttggggagagaaacgatactccatgcgtttatggctcgaccccatcaagatgtccggttacgggatcactcccatcgatgtgaagaatgcggtagacaaagagaacgtggaactcccttcaggtagtatcgaaggaaatccaccagaactttccatccgtacttgggattaa

SEQ ID NO: 3178 - DNA, 1989 bp, B.fragilis
cctactgaaactgatatgaaaaaatcacgatgtataaagtcttatatatgggtagcattccttttaaatactcttatcttgttcggttgtatacaaccgaacaacagcagatacccagataagattcacgaagttctcaagttatctcataacaacagaaaagagatagagaaagctctggattttttcattaatcagaaagactctttgaagatcagatccatattctttttggttgggaatatggcagataaatacagcctcactccagccaatgaacaagatccttttcattctattatcttaaataaccacattaaagaaaaagaagcgtgggatcccggcaagtcccggttaggaatggcattggattccgtatataaaacatgtactgaccctccacgccccaaaatagtaagagacatcgaagttataaccggcaacttcctgatcaacaatgtagaagaagcgatcaagatctggcatcgtactaaaaagtttacggagtgctctttcgatgatttctgtgaatacattttaccctatcgtattggcaacgaatcactgagtgcttggagggaacaggcttgtcaaaaattttcttacctgttggattcaatcagcgatcctctggaattgacaaaagcaatagtgcaggtatccggcatttactataacgccggaatgagtaaatacccttttttcccgactttcagtgaattagatcagttacattggggaagttgtgaccacttggccgcatatctgaccttttcactcagggccatcggcattccttctaccatcgatgtggtacccgcatgggcaaacaggggcggcgggcatgcgtggaacgtggtgatgaacaaagacggaaagtttgtggatgtcggatttaacggagagggacacaacagcatctcgtataagattcctaaaatatacagaaccggatattcaagcaataagggcggtattggttacttagatcctctttggaaagacgttacgggagaatacccgatgcctatatcagatattgccttatccggatcggattccgacatgaaaggtgacgtgctgctcttatgtatatttaataataaagattggatacctgtagccgtttccgcaactgagaataaaaagacgatgactttcggaaacgtagcgcggggaatcccgttcggcgacaacaagatcgccggatatcaaaatgaaggtaagggcatcgtttatcttccggcatccgtgcgaaacggcgtaatggttccttttgcaacaccttttattttaaaagagaatggagatgtacataagttgactcccgatcattccgccctccggagcatttctttatatcgcaaataccctaaatacgggcatatctcagtttatgccgcaagaatggcagacggatgttttgaaatatccaaccagaccgacttcccgactcccaaaagaatctatacaatcaaagaacctcccaagcacgccatggcagaagtcaacttacacgctcctgccacctgccgttatatccgatataaggcaccggaccaatcttgggtaaacatcagtgaactacaatgctattcgcccgaaggaaaactgtccggaacaccttttgcctcagataaaaacaagtctccggaagagctcgccaaaatatgtgacgggaatattgacactttctatgccggtgaagtccgtaacgcttatgtaggaatagatttcgggaaagaggttgaaattgaccgaatcatatattctccgcgaacagacgggaatgatgttatcccgggagaagaatacgaactgttttattgggaaaaccggtgggtttctttgggacgcaaaaaagcggacagcttccgtctgcagtatgacagtgtgccggacaatagccttttatggctgcataaccggacaaaaggagttgaagaacgcatttttacttatatgaataacgaacagatatggtggtga

SEQ ID NO: 3179 - DNA, 2796 bp, B.fragilis
atggataagactttattaaaactggaaatcggcaagtggaacgaagcttgtcgatttcttaaaagcaaacaaacagaactctctacagcagaatggactgctatagagacactggccgactattggcgaaaaaaatttgatccggatgctaccagcgaatgcatggacctgataagcactcttgaacaatcggataaattacacagcaataataaagaaattattgtatggagtaaagagtttcgtaccatcgccaggaagtattacactaaagacgaaactacatttttagtattccaaaatgcgttaaaggaattatatcagagttctgcaccccgctcttcggctcctcttcagacacctgtcaacagtgaatctcaaaatatcatattaaaacaaaatgcaaaaaaatgggtaagcacttattcgcagttatacgagaatcagaatgaactggaccgagatgaatggaatgctgtccgtttcttagccaatttctggaaaaacggtacatttaacgaaacgtcccgaaaagaatgtgagcagtatatctccattctaatcgcatcagacaaattgcatagcaataacaaaaacatcattacctggagcaaagattttcgtggaatagccaaaacatattatacaaaagattctaaaacttttgagggcttcaaaaagttcatgacgaaatatactcgcgaaaacccgatacaagaaaggacccctcaggaaagaataccacaaactcctccccggcaaacatccccttccattgaaataaccggattggtaattgccaatactgacgaaaaaggtgatcccattccttcgaatcaggccgagctcgatactcgtagctgctatttacagcctcgaattgattatcgagtattaagaggagggagcagtgtagatatatggtacaaattatacgctcccgacaggacactcatgacagccagcaacagcaagtccggttatacgtggtatggtaatgtccctctcacaggttcccgatctgcatatcccttgaatggcttcggaagtatgtctggaaatgtattctccgctggccaatggattattgaattctttgagaatgatctgcaaattgcaacgtacacattcactatcaaacaacaccggacctctactccccccccacaatcacgggtaacgccgccacctcctccaagaactccatctaaccgacgaacatctacagtttcgcctaaaaaggggcacggaggtttgtggtcgttcttgattatcgccgctattataggcttttgcggctatcaatattggtataaacctatgaccattgatcgggatgcagagcgtacctatgtatacgtatccagcttgttgcaacgttccgataaaaatgcaaatgtagaatataatcgtatccaatctctgccctatggttcggagctcatcacttaccaaaaagaaggagatggatggtcatacattagagctaatgagaaaaagggatatgtatctaccaattataccctaagtaaaactgattttgaattgttgaataacttatggggaagcaaagaagctatggaaggagcaccgacagcaaaatgtcggctggcactcgtagactttataaagaaaaacaactataaaacagggacggggcaatggcagttgtttgcacaacctatagaagtcaaacctaatgcagtactttaccctcgactggctaacggatatacgaagtttacagaatttgcatttgtcttatccaacagctccacacatgaaggtgtattggctatttattcgtttgcagatgacgaaactcccgtttttatatatcaagagcaaacaacagaaaatgccaaaataaaagatgttagatattatccatggaaaacagataaatataaagttatctatgctaccccaaatgctatggttagccgctcgcctcaactcccaaccaaccagcaaccgtcaaaagcaaagagtgagaacggactaaaaataacgaaggcactttttggaaatactgataaaagttacaatattcttactcaatttgggacacagctccccaccaccactcagtacttgtctccacgtattttctatgaaaatcctgcggggaagagttcagtggtcatcaaatataaaattatcactccacaggggaacttaatgactggaacaggatcaccctccggatatactaatgaacaaaaagtaactctaaacagatccggatatattaatttagccggttggggaaatacaaccggagatgcgtacacttctggaacttaccgaatagaattctggtccgaaggagaattattgtattcaaccggagtgcaaattcagggcaattcagaaaaggctgtaactgtttcttcaaacccagttgagtgtcccatcaaaatccgaacaatgttatttgccaactcaaacgataaagggactattttagaagattatgggaagccgctttacggaaataaattacaatacctgaaaccaaagattatttattcaagtctaaacggggccagaaatattacattgtatgccaaaatctatcgtcccaatggtgtactcattgccaacaagaactcgccgaacggatacacttacaaacatggtatgtatacacctgctgtcggagctgataacaatgtttcttatttaacaagctggggaagtccagagtgtgacgtgtattctccaggtacttatcagtacgagatatggtacgagggaagtaaaatcttctcctgccaagtaattgtacactaa

SEQ ID NO: 3180 - DNA, 1326 bp, B.fragilis
ggtacggctgcggtatgccattgcctccgttgtaattcccattctgtctgtttgggctattacgaaactctttactctgctataatggaagttctatacgagatttatctttcaatcaggcaaaataagatccgcacctttctttccggattcggcatctcgtggggaatcctgatattggttgtactattgggtacaggaaaaggatttcaaaactctgtgatggatatattcagcatcttcgcccagaaaagcatgtatgtatatggaggagccacttctatgaagtataagaatatcagagaaggggaacaattgcatttcgatttgcattttcttaaccgcataaagaaacagttcccggggataaaagctatttcgcctgaaataacaggaccttattcgcaagtgatgaataaagctaaaagcggactttttaagattataggaatcaatgaaaactatatgggaattaagatacttaaaatcaacgaagatggacgatattttaataaaggagatgacgagaatacccgtaatgttaccattatcggcgaaaatgtcagtacgaccttatttaataatcaaaaagcgttgggtaagtcgatcaacattgccggtattgattttaaggtgataggcgtactaaagaatgatgatattttcagcgcttcggaaatcaattcggtatatgtgcccttctcaagttacataaactgtattgacaataagactccattgcgcgctttctgtttatatctgaacaaagaagttgattccaagcgatttgagaatgagctgagagccttcatcgctaataaataccaatttgcttatcctgataagcaagccttacagataatcaattttgagacacaaacatctgcttttgagggactctttgatggattgaaaatgtttatctggatcgtaggaatttgttttctgataagtggtattgttggagtaagcaacatcatgtttgtcgtgatcaaagaaaggagtagcgaaataggcatccgtaaggctgtaggagcaactcctaaatccattcttgtgttaatgctgacggaatctgtcatcataactgtaatctctggtatcatcggattgatatcaggtgcaggtattcttgagattataaattggttgctcgaaagcgcccgtcacgcgacaatgataaagcatgtagaaatagatataaatgtagctgttctcgctttggttatcttgattctgtccggtgtcattgccggagcatttccggcaatgaaagcatctgttatacaacccattgacgccattagaaacgaaaatataggataa

SEQ ID NO: 3181 - DNA, 738 bp, B.fragilis
tcagaaatggcagaatcgactatcatcacaggacaattcgtacgaatcagtcaggtacccgccagccttggcgaacggatactggctcgtattattgactattttctgctgtttatctacattcttgccacttcttatatattggggaaactcaatatacatgctttttccggaagtacgtttttcctgttgttcctgttcatctatctgcctgtactatgttactcgttactttgcgaagtttttaaccaaggacagagtgccggaaagaaacttatgaatatccgtgtggtaaaagcagacggtacgacacccagcctgagcgcctatctgctaaggtggttgctctatgggatagacgtaactattaccggaggattgggcgtactggtcatactattgaccaaaaacagccaacgtttgggagatctggctgccggtacaatggtaattaaagaaaagaactatcgcaaaatacaggtaagtcttgacgagttcgattatctgactaaaggatatcatcccagttttccatcagctgccgacctgtctttggaacaaataaacgtaatcagtaaagcattagaattacatcataaggatcggacaagacatatcgcacaattggcacccaaagttcgtgccctgctatctgtagatcaaacaaatataaacgatgaaaaatttcttcagaccgttgtaagagactaccaatactatgcattagaagaaatttag

SEQ ID NO: 3182 - DNA, 1809 bp, B.fragilis
aacaaaccggcaatgaaaaataaagtcttaaaaataacggctgcgctattattcctattgccacatgcaggcctggataataacagatttccggtaatgctctttttgttctatatatgctcttttgtctttttcgcaacgacatggagcggaatgaaagaagattggagcagaaacagccgcacttgttttattgtctccggcattgtcctgagcctttttttacggtatgtctcaggaaatatatatggaacctatcgtttatatacgatggcggtactatggatattgttcttctctttttatgccgcacagtccctgcccgggaaaaacagacgcttccttgcctgggtagtcatagcgactgtcgcagtggaaaccgttttgggaatcgcccagtccatcggtctactggagaatagcgacccacagttcatcataggcgggtctatgaccaacccgggagcctatgccggttatcttggggtgaccaccccgttgattctttcactattagtatcttataaaaaaaacaaacggttcgagaatatttgctacatcttgggcgggctttttatcttagtatgctatctgttaatactcagtcgctcacgcggagcatggatcgcatgtggcgcaggctgtctttgtgtactttgctatcggtatgcccgatttctacgcggtaccaactattggagtaaaaaagcgattcggactccgacaatcattctgtcagccgttttaatcatcgcaagcggattctttgtattcaaaatgaaagaagattccgctttgggccgtatattggtatggaaagtaaccctatccactcctcatccccatgcgagcttgttatggggaaacggaatcggttattttgaatctcaatatggaaagtggcaagccgactacttccgggaaaaagaaggtaccgagaaagaacgtcacatcgcaggatatgtaaccaccgcatacaacgaattccttgaacttggccttgagcaagggattatcgtgacagcatgcatcgcggcccttttggttatggcaacgggcaccggttggaaaaacctatcaaccattgaactcggagccaaagcatccatcgtttccataaccatattgatgttctgttcctatcctctgaaggtactccccaccactctttatctgatgttctgcctgtcggtggctctttatggaaaaaagcggttgctttccaccggacatcgcatgataagcaacggtgtaagatcccttgctggtcccctgatctgcgtattcgcacttgccggtatgataaatgcatacggatactatttctgtcatcggggacaacagcgagtgatgcgccatgatctgaaaggaggtatagagatgtataaaaaggcgcaaggcattctcaggaaagacggcatcttccatttttatcttggatcagcctattttttatcggctgaatatcaaaaagcgattgaagagctgtcagtttcctgcacccaatgttccaaccctagcagtttcatcctcttaggaaacgcataccgggaaaacggagatacggctaaagccatcgatgcatatacaacagctgtctatatacagccatccaagttataccccaagtatttgttggctaagctatacgaagctgcaggcgattacgggagtgctggagaatgggcttctaaaatattagctaccgacgagaaagtaccaactacagcggcaaaagagataaaagaagagatgaggttactgttgaaacaagtagtaataaaaacaaaaaaagatgattataaataa

SEQ ID NO: 3183 - DNA, 711 bp, B.fragilis
agtatggaggcaaaagttaaaattctttttattgatgatgatattacgtttggacgtatttgtaccatcatcttacaggaaaaaggctacgaagttttttatcaaaccactttaaacggagccaaagcttgtatagcggaagctcatccggatatcattgtacttgatgtggagatcggaaatcagaatggcattgaagtcgctccagaaataacagtgatagcaccgaatgttcctgttctgtttatctcttctcatacggagagccattgggttgtacaggctttggaagcgggtgcggtggcttatcttaaaaagccctttcatgctgaagaattaattgcgtatgttgaaaggtttgctgtacagcgtccatcccaactccggataggttccttgtcgcttgacaccgaaaccaggatcttatttgctgatgactcgacagttattaagcatttgagtgaatccgaatataagttagtaaggcttttacttattcataaaaaccacatagtgggcagagggcaaatagaaatggagctatggggaaatactgaaggaaatgaacagagtactaataatttaatattcaagatacgaaaataccttgttgccgatcccgacatcgcacttgaaacgataccgaggagcggatataggctttctgtgaaattagaaaaacagaaaagaagagtgagtgactgtttttaa

SEQ ID NO: 3184 - DNA, 756 bp, B.fragilis
aattgggtttatctgcaaacaaaactcaaaaaatacatgaaaaaaatctatctttttttatcgttcctaattgtcatacttgcatatcccttaattagtcttttaacggtattaattattggaaacttagtgcaaaatacaactccatggatacgccccatgacgctattcagtctcgctacatttatcttaatattcagaaaaaatattcgatgtcattcgtctttcaataggagtctttctttgaaaacaattctttctgtttgcattttaactatatccatgtgtatagctatagggatgattaccccaattcctcaaaacatatcattggcgaaacaagaactactcaattttccgagattcatatatagtctattcttaatccctattttagaagaattatgctttagaatcattattatcaataaattcaaaggtaaaatgaatcaatggattataatcacgggaacagcactactctttggtataatacatacgagtagtatctatacaatgatttcaatggcatgctttgggtttatattagcctatttgtacgttaaatcagaaaatggtttccttcttatactggttcattctttgtacagtattagcgtctactgttcatacagtgttttttggtccattacatcaagagttttaaattatgtatatagtcctatatattacattatagttgctatttcaatcatgtatattatttatttttttcttaaaaagaaatacgtttaa

SEQ ID NO: 3185 - DNA, 1098 bp, B.fragilis
aaacgaaaatataggataatgaagacatttaagattatattaatttgcatcttttccgccacactggcatttgttgcttttcgttcttcgctaagaggtacaaaggcaatttacgaaactacacaaccacaatatcgcgagatcaaagaggaaataaacatatccggcaatgtttttccgatgaaggagatcgaaataaaatcgcagatatcgggagtcctggacaagattaatgtttcgataggagataaagtgcgcataggagatcctgtcgcctccatcatgctggtcccaaacgcatcggatatggaacgactggaatataacttgaacactgcccaaattgagtataaagcccgactggaagattataaacgagaacacaaattgtactcaaaaaaccttgtggcacaggcagagatggactcttacacacaggcatacgaattatctaaggagaagctcgcctctgcccaaaatcaattgaacatcttgaaagaagggcgtatctctcctgaaacggcatctaacatcgtaaggtcgagtattagcggcgttattattgatacccctctggaaacgggggcctctgtaatagaacgcaataattttaatccgggaacaacgattgccgttgtggcggaaatgtctcggtttcgttttaaagcccttgtccctgaaaaatatctgaaagatatcgctttacaagacacgatctcactcttattcaatgcctatgataatttacgaacccgggcagtagtaacaaaaatttcatccaaaggaaatgcagagaacggaattatgaaatatatgcttgaggcagaatttcccgtctcggaaaatatgcctgttataagatcgggatattctgcaacggccaatatggtgataaaacagaaaaagcacactttatccattgatgaaaaatatgtcttatacgagaatgactctacatacctctatctgctggatactgtgacacaacagaaaacaaaacaaatcatcaacatcggtatttcagatggaaattatgtggaagtgataaaggggatttcattaaaggataaaatagtaactaactcaaccgataaataa

SEQ ID NO: 3186 - DNA, 1062 bp, B.fragilis
tggccggatttatcgaaggttttatcacgcgtcataccgaattacccgatgttttgcggttgggcatcattctattgtcactgtcatttattatctattactatatttatttaccaaacagaaaaactcatggaatcacaaaaacctaaaattgctttatatgtgaagcgtccttttggtgataaactgaatgcgaccatggactttataaaagagaactggaaaccgatgttgaagttctgtacctatttgattctgccgttatgtctgattcaagccatcagcatgaatggaattatgggaggagcaatgggaattgcagctgccaaagaggccgggaccaattctttagcggccatcggaatgcaattctgggtaaattacggactgatgtttctctgctatctggtaggttctatattgctgacttctattatttacggactgatgcaggtttataatcagcgcgaagaacggttggccggtgtgacgtttgccgacttgaaaccttttctgttcaagaatataagacggctgctggttatggtactgttctgtataggccttactatagtggtgggcattgttatggggattctggttgtagcttctccgttcacgcttttgcttactattccgttgctgatagcctgtgcagtgccgttagccttgtttactccgatttacttgttcgaggagatcggcatccttgcagctttctggaaaactttccgtctgggatttgccacatggggcggtgtctttttagtatctctggtcatgggtttgatatccagtgtattgcagggagttactacgactccgtggtatattgccactatcgtaaaatacttctttatgctgagcgatacacagaatgaactgaccatctctgccggatatagtttcatggtctacctgttggctatcgtccagacttttggtgcctatctttctatgatattttctttgattggtatggtatatcaatacggtcatgccagtgaggtggtagatagcatttcggtagaaagcgagatagataaatttgagcaattatga

SEQ ID NO: 3187 - DNA, 291 bp, B.fragilis
cccatgtttcacattttaggatttttattcattattgtcatagccgttataatcattggattggcccttgtaggcagcgtattaagagccgttttcggacttggaaaacgctcgccctcgtcaggttcagatcgtaacggacccaataataattcaggaagcagaagatattaccaccaaactcaggctaatgataaagaagaaatcatcactgggacaggagccaagcacaaaaaactgtttgatgataacgaaggagaatacgtagactacgaagaaataaaagaatag

SEQ ID NO: 3188 - DNA, 729 bp, B.fragilis
accaacaatcagaatcgtatggcaaaatacaaaagagtcctgttgaagctcagcggtgagagcctgatgggagaaaagcaatacggcatcgatgaaaagcgattggccgaatatgccgcacaaatcaaagagattcatgaacaaggcgtacaaatcggcatcgttatcggtggtggtaacatcttccgtggactgagtggagccaataaaggtttcgatcgggtaaaaggtgaccaaatgggtatgctggccacagtaattaacagccttgccttaagttcggcattagttgcggccggtgtgaaagcacgtgtacttacagccgtacgcatggaacctatcggtgaattctacagtaaatggaaagctattgaatgcatggaaaatggcgaaatcgtcatcatgtcggcaggaaccgggaatccgttctttactaccgacaccggctcatcgcttcgcggtatcgagatagaagcagacgtcatgttgaaaggtactcgcgtagacggtatctatactgccgacccggagaaagatcctacggcaaccaagttccacgacatcacttacgatgaagtgctgaaacgaggactgaaagtgatggacttgacagctacttgtatgtgtaaggagaataatctgccgatcgtagtattcgatatggatacagtaggcaacctgaaaaaagtgattaccggagaagaaatcggtacattggtacacaattaa

SEQ ID NO: 3189 - DNA, 1410 bp, B.fragilis
accgccggtcagccaaaggtcgttctccttattcttgcgctcgccggaaatggactgggtagccaccatattcgtccaactgccctgaccggaaaagtttccgtccggatgatataccggcatcatcgggcgaaggtcggcaccgtagaatgcactgttgatctgtgctgtctcgtcactgttgttacttccgtaaggagcatcccggtaagtgttgttgtagacggtcttcaaccgcacctgcaaccaattggtgacgtccgaagtcaggttcaggttgacattgaaacggcggtacttatcgtcgtaatgtttcagtgttcccccttggtcgaggaaacctatcgaaccgtaataggcggtcttgcccgaacctccgttgagagacagggtgtactgctgcatcagggtgttgtctttgatggtttcatctatccagtcggtgttgccgcaatacagatacttgttgggattggacggatcgatgaataccggcagattgtgtttcgggtcggtataataggcatagatatgatccatatagttcttatcgtagtaatcgcctccacccgagttgcggttggtcagattatggaaattggcaaatgtccacgaatccatatactccggtttgcgtgtaggcgaattgatagaccagttggacgagaacgagatcttggctttctcgtctttacctttcttggtggtaatcagcacgacaccataggctgcctgtgttccgtaaatagaagccgaagccgcatccttcaatacagatacgctttccacatcggccggattgatcatgttgggatccatctgcacaccatcgaccagtaccaaaggtccggaagagtttatagatgtagtaccacgaacgttgaacccgtatcctttgcccggcgcaccgttgtcggcggaaatgttcaggttaccgatcggaggctgcagtccctggctaagattggtgatcgggcgactctccaatgtctctgccgaaacactggctacggctccggtgaggttggctttcttttgtgtaccataacccaccaccacgacttcgtccaaggttttgctgtcctctttcagggtgatctgcagacgggtctttgcggaaacggtcacgacttgtgtttccattccaataaaggagatctcaagttgctctccctgttccgcttcaaccgagaagttaccatccatatcggtgattgctccacgtccgggagcaccctttaccaatacagaagccccgggaagcggagaacccgtaacgtcaagaacacaaccggttattttctgtttctgctgttctacctgcaccactccggcaggtgctgcattgtagctgtgagaagcaaggcaaggttgaagtcccatacccgaaagaaggacaaacatccctga

SEQ ID NO: 3190 - DNA, 624 bp, B.fragilis
atgacgttgcaagctgatacattggtctgcgataccgcaagggttgctttttggcaatccaatccggattatgactataaccgtgaactgatgactcctgagattgatatctacgggtggctcagtatgcagctctccaagttacttcgtgccattttcggaagtcgttttgctgaggagtattccggcattatcctgattattattgctattctcatcctgttgctgatcctctggtttctttataaaaagcgtcccgagctttttatgcgttcacgcagaggtcctgtaaactatagtgtccacgaagataccatttacggagtcgattttgatgcagagatcaggcgtgccatagaccgcaaggattaccgggaggccatccgtctgctttatttgcagacccttaaactgttgagcgatgacggccggatagattggcaactttataagactcctacagaatatatttatgaggtaaagcaggagatacttcgtactcctttcaggaatctgacccatggtttcttacgggtacgttatggtaattttcccgcttccgagtctctttttgaagagctggcagctctgcaaactcaaatcaggaagggaggggatgtatga

SEQ ID NO: 3191 - DNA, 258 bp, B.fragilis
cttcttttcctgaaagaagttaatgttttgatgataaaaccggaatatttatccgagaagataagaaaattcgcatacaaataccctatttatgtatttcactcctctattaggacgatttcgaaaaaagaccgcgttattaaaagagagataaaaatatctttttcatgcaaaaacgcaaataaacaaatctatttgcacaactatttctctctgcgtactcgtgataagatttatccatataaccaaaagacatag

SEQ ID NO: 3192 - DNA, 498 bp, B.fragilis
ttgtacactaagcataatacaatgaaaaagaaaattatacggtatctaattgtatcgcatctaacatttatcctttctataggcggtatggcagtagctttctactactaccatactgcccaaatggcacaaattaagaatgcgaacattcttctcatctcaaaagatgaaatgaaattacgcttaatagactataagggccaagaattattcactgccgacatagcttgtgggaagaattatggcaacaaggaaaaacaaggagatttaaaaactcctgaaggaacttttaaaataatcgatatccaagatgcttctaaatggaaacacgattttggagatgggaaaggtgaaatagagggtgcatacggtaatcatttcatccggttagaaacacccggacataaagggaattgggattcatggcacccacgacccattatctattgggacccggagcgacccgaggatgcattcgaatcaaaaattcagaattag

SEQ ID NO: 3193 - DNA, 573 bp, B.fragilis
atacttaataagatggtagacgtaaaaacgattatcgaagaatcacaagagaagatggatatggcagtgatgtatctggaagaagcactggcacacatccgcgccggaaaagcaagcacacgcttgctggatggtatccgtgtagactcttacggaagcatggtacccatcagcaacgtagctgccgtaaccactcccgatgcacgcagcatcacgattaaaccttgggataaaagcatgttccgggttattgaaaaagccattatcgactccgatctcggcattatgccggagaataacggtgaaattatccgcatcggtattccacctcttaccgaggaacgccgtaagcaactcgccaaacaatgtaaagctgagggtgaaacagccaaagtcagtatccgtaacgcacggcgcgacggcatcgatgcactgaagaaagctgtaaaagacggtttggctgaagatgaacaaaagaacgcagaagctaaactgcagaaggttcatgacaaatacattgccaaaattgaagaaatgctggctgaaaaggacaaagaaattatgaccgtataa

SEQ ID NO: 3194 - DNA, 1302 bp, B.fragilis
caaaataataattttattattactgaaaaccaagaaaccttactaattatgaaaatacttttttccctagacgtctccaaccagcgacaagttgacttttgtaatagaatactaaagattctggataataaagatgatagcaatgatatcacccttatatgtaaatctcaaaatcatctcagtgattatctatatatccccccgtcaagtcatataaaaacagaagaagcagagattattcttacttatggcaaaacaggtttgagccacattagtcaatttgcaagaaaatcaaatatcccaatcatacacttcataaatacagagtatttaaaagacgaatatttaagtgaagaccaacaagtagaaaaaataatactttgtgattgcttcaatcagctcttggagagtttctttcaaaaagacaaaatgtttgtcttaccatatttttctataccagtcgttactaaaaatgtagaaataagaaataaaaatagccccaaactattaatagctatcgcacaccctaaccttaaaaattcaccggtctattatatcagtaacttattaaatattttatcagactatagaatcacaatactttataatggagatcctcttatccctatattcaattctaatattacacttatcaatgtaaaagaatcgaatatcgaaaaagtaattctatcaaatgatataatcatcggggatggtatttctatttacacaggaataatgttaggtaaaccatgtatcgtgattggagagcaaggatatggaggacttatcacaccccaaaacctcagccaacaattcgctaataagtttcagggacggatagggggaagcttaaacgaatacatccctttgaatttgatcatgaacgatattcaatatgtacaaaatacagaaaagagcaaaaacatagactgcattattattaaaaacaaaaaattgttggacaatgagtatcgccaaacccagcaatcgcttaacgacttaattttagaagtagcagccaaccacaaacaattatatacgttccctatggaaattcaccttaggttatcggatgcttttcaccttattaaattttctgataccaaatttgtattagcttatacagccaacaacaaagtccattcaagttttggtaaagaagaagctgaaattatagccctttttaaaagaagttgcttaataaaagatgctataaatatgagtccatacaaaaaggaacctaaaatatttgtggagtttatccaaatgctgtttaatgaaaaaatactgatagcatga

SEQ ID NO: 3195 - DNA, 1086 bp, B.fragilis
gacatggataaaaaggtaaaatggggcatcgtcatcttggttggtgccggactgataggttggggaatttactcccgacttcctaaagcaaatgaagagttggcagcagccgacaaagtgatgacaggcaaacagatcaataaaagggttctgaacgtaaacgccaaaatcataaaaccacaattgctgacagaccagattcaaatcagcggtagcttgatgcctgacgaggaggtggatctttcttttgagacttcgggaaaaattgttgagatcaactttgacgaaggaacaaccgtaaagaaaggacaactactggcaaaagtgaacgaccggcaattacaggcccagttgcaacgtcttgtagctcaactaaaacttgccgaagaccgtgtgttccgccaaaatgctttgctcgaacgggatgccgtcagtaaggaagcttacgagcaggtaaaaacggaactggccaccctgaatgcagatattgatttggtaaaagcgaatattgccatgaccgaacttcgcgcacccttcgacggggtgatcggactccggcaggtcagcgttggctcttatgcttcacctactaccatcgtagccaaactgacaaaaatcattcctctgaaaatagagttttccgtacccgagcgttatgccagtcaggtaaaaaagggaactaacctcaacttcgaactggaaggaaagttaagctctttccccgcaaaggtatatgccaccgaatcacgaatcgatcagtctactcgtacactgaccgttcgtgcactgtatgctaacagtaacggggcaatactaccgggacgttacgccagcatccaactgaaaaaagaagaaatcccgaatgccatcgccatcccatcggagtccatcgtacctgagatgggtaaggataaagtattcctctataaatcgggtaaagccgaaccggtagaaataaccgcaggtatccgtaccgaagctgaagtacaagtcataaagggcctacaaatgggtgataccatcatcacttcgggaaccctgcaacttcgtacaggtctgcctgtcacactggataatatcaattaa

SEQ ID NO: 3196 - DNA, 204 bp, B.fragilis
tttattaccaagattttttgcattaagatagaggctattattgataataatataagaatggcagataacggaaaatactgtattggaattacatatattgatagaatgatagaaataggactcagtatatttaatagtatcttattccttttagtcgttaaattgataatagatcctgataagttatttttttgtaaaatataa

SEQ ID NO: 3197 - DNA, 201 bp, B.fragilis
tgcagctgtttaccctcttttcatatattatggatggatttgcctatgcaggcgaggcacttgccggtcgttatatcggcgccggtaatcgtatggagcttcaccgtaccgtccgacagttattcggatggggtgtcggattatcagccgggttcacccttctttacggtattggtggacaatcatttctgggattactga

SEQ ID NO: 3198 - DNA, 351 bp, B.fragilis
tattttaacaatatgaaaaaactgaatataaataaattgagtgaatatcctgtagtgaatatagaagagcagacttctcttaaaggaggagttagccaagatgagttttttagaatgttagagaataacacttggcaaggtggttatgttgatggttatggttatgcagccccggctgtaacaatctatggaacttcttggaacgaaaccgggagatgggatatagacggatgcccggcctgcggtaacggattaggatatgatcaaaccaagcctaagccggaacatgatatcgtgacgatttggactcatttcttttgccataaacacatttattatggaagcaaataa

SEQ ID NO: 3199 - DNA, 561 bp, B.fragilis
atggttaacaaatattttttcattgctgcttttttattttggttgttaccagccatagtacgactgtgtgtaatagatatttctgaaatagcaataagtcatacgacaacttttgaaatcaatagtcccgccaacaaaaccttatattttttgtataacaaagataaacacagtgcatttattaccattttaaaaaacaatatgcaaggttgcatcctaaatgtattaggaggagggttattaggaataggtacactttttaacttgttattaaatggtttttgttttgcggatgtatgttgccgaacatacaaactaggcatgagtataaccgatattttcgctttaaccttgccccatagctttgaacttatcggtttttggatatcaggaggaataggactttatatagcttggaatattattttgtttatgtatacagataaaatgcctacatttaaattttacaaaaacataggcatcaatttattgatcattttcataattattctttcagctgcctacatcgaaacttatgtatcaataaatatgttaacatga

SEQ ID NO: 3200 - DNA, 813 bp, B.fragilis
aaatccagcaagcatttgcaggtagaaatgacttatgttgataactttttgaagtttatctttgttagtagctgtagacattgtaattttatggcttcaaattatcaacctataactatgcaggatttcgttcatttacacgtccatacacaatattctcttctggatggtcaggccagtgtcagtgcattggtcgataaggctatgaaagacgggatgaaaggtattgccgttacggaccatggaaacatgtgcgccattaaagagtttacgaactatgttaataagaaaaatggaggtccgaaaggagaaataaaggacctgaagaagcggattgcagctattgaagccggtgaagtggagtgtgcggataaagatgccgagattgctgactgtaaagctaaaatagcggatgcggaagggcgattgttcaagcctatcataggctgtgagatgtatgtggctcgccgtacaatggataaaaaggagggaaagcctgaccagagcgggtatcacctgattgtgctcgccaaaaacgagaaggggtatcataacctgataaaattggtttcgcgggcatggaccaaaggctactatatgcgtccccgtacagaccggaacgagttggagaaatatcacgaaggtttgattatctgttctgcgtgcttgggcggtgaagtgcccaaaaagataactcagggattgttggcggaagcagaagaagccatccaatggtataagaacctgtttggagacgattattatctggaaatgcagcgccataaagcgacagggcctaaagccaaatcatga

SEQ ID NO: 3201 - DNA, 1257 bp, B.fragilis
attgggataaagtggttgaaatatctaaggcctctttccttaacgtctggaatctggctaacgaaaaggattattaagaacgaaatgaaaactaaactaactaattgtgtaaaaaccgtattactttcttttatgctgggagtgctgtttgcttgttgtcagggggcggcctcttccggcaatgcaggaaaaaatgcttcccgggtgaggattgcttccaatgactctgcgaagctggttcctgataaagccctgaatgatgcgtcttgcgtacttgcaggtttgccggttgataaagcaagcggaaagctttacgcactgactcggaccaaggaatggaagaaccatgcccgttacatggatcagatatggaatgttttccggcagacggctccccggctggtagctttctcacagacggaactggaagacatcaatactcgttgccatactctgttttatccttttggcggtcctgactttttgtttgccaatgcgttcttccccgagatggacacttatgtactgatcgggttggaacctgccggcactgctccgaaagtgaagcatccttctgccgaaacttaccggttgtatcagaatgccgtatcgaacgtactcaatctgagtttctttaacgatatggataaggaactggccaatgataccatcgacggggttgtccccatctattcgttattgatggcccgggggaaccgtaagatagtcagcattcaggaagtgtggttatcggaaaccggagatcttttcgaaagaaaagagggggataccatccggaacacatgcagtgcagggatggaagtccggtttttccgtccgggcgcttcccgattgcagaccctctattatttctgtacagatatcagtaacgaggggttgcaagccaaccgaccgttacaggcgtttatggaccgttttgatgcggagaccacagcaacatttgtcaagtcggcttcctatctgatgcacgaacctgctttttcgcgcatacgcgagacgattcttcagaaatcgtctgctgttgtacaagatgactcttccattccgttgtcctgttttgatccggaggtgtggtcggttactttgtacggcaccttctacaagccgatctccactttctctcagtatcttcagccgcaattgcgcgatgcctatcaactgggtgatccgaaaccccttaatttcaggattggctatgcacggcaatccaatttgcaggtcgcaagaagaaaatag

SEQ ID NO: 3202 - DNA, 663 bp, B.fragilis
attttacaaaaacataggcatcaatttattgatcattttcataattattctttcagctgcctacatcgaaacttatgtatcaataaatatgttaacatgaaaaggataatcaatacacttgagaagatgcctaaatggtatggctttttaactatattactatatagcttattactcgcagaatttttgataactactaatcatcttgtgaataataacaatttagagactgacagattatttgtaattctggcacggatgagttatattataatagtcttgtcagctattgtaatatggcttatctccacttttctctttcacctaacagccatactctttaatggttatgctccattcaaacatcttttatatatttcgtcttatttctatattattcctgccatttctgtttttatttccatcttccttcttaatcagaaaacggaatatagtacttctaatgcggtaacgaccttacaaaataattattctcttggtctccccataatgttggttaactattcttttatcccctattatttgctgtgcatgatattaatccatcatttatataaggtacggctgcggtatgccattgcctccgttgtaattcccattctgtctgtttgggctattacgaaactctttactctgctataa

SEQ ID NO: 3203 - DNA, 318 bp, B.fragilis
cattctaaaaaactcatcttggctaactcctcctttaagagaagtctgctcttctatattcactacaggatattcactcaatttatttatattcagttttttcatattgttaaaatattagtaagacgttggttgtttcttgactttttcgtgaagcagtattttttgcttttcgacctgttgggcggcatggtatgtcagggaaaccatggcagatataaacataacttttgtcttaatctgcattgcaatgttctgtttttattagcagtgtttacatgtttagttattcttattttattatttatttccttatga

SEQ ID NO: 3204 - DNA, 306 bp, B.fragilis
atttcaaaaaaggtgaaaacaaataaaaaggcaattttaggaatgttggttgccatcgttatatctttaggtgtaatgggaggaatcaacgaaaacaaatgtgattataacttacaagaagcaactgttgcaatgacttatgctgccggaactggtgaatatggtcctgaagcatcaggaaagttagctgttggagcattagcaatgggaaaagtaacagaaacattaggtacttgtgctgttggtctaggctggtgtccggcaggttggatagccggagtaggagccgcagcagcaggattataa

SEQ ID NO: 3205 - DNA, 2223 bp, B.fragilis
aaaaggaaaaaccatctgcaaatctcgaaaaagaaaatccaaagaacaactatgagaataaactttccatcttacattcaacatgaccaaatggattgtggaccagcctgtctgaagattatagcccaaaattatggcaagagattttcattgaaatatttgagggatcgctgttatgcaactcgcgaaggcgtatcattgttcgacattggccgggcagcagaagagattggtttccgaacactggctatcaaagttacattcgaagatttaatagagaagatgccattgccattaattgtacactggaaacaaagtcatttcgtagtagtccataaaatcacgaatagaaaagtttatatatcagatcctgcacaaggacttacccattacaaccataaagaatttagggaagcgtgggagatgtgcaacggacttggaaccatcatgatattagaaacgactcccgaatttcacaacatgaacgaaatggaaacccgagcctctttcagccattttatgaaatatctgaaacctcatcaccgatatttaggacaagttatagtaggtatggttgcagggatattgatcgggctactttcccctttcatatcccaatccattgtagatttcggcattgggtccggtaatatccaatttgtgaacaccatgctgatagcaggtatgattttggcatttagttcaatggcatctgactttatccaaagccgccttatgctgtatgtgtcagagcggattaacatgggaatggtcagtgatttcctccgcaaaaccatgagtttacccattactttttttgagcgtaaaatggttagcgacttactaacccgaatagatgaccacggacgtatacagtcatttatcatgtccacttttctgggaatcttcatcaatatcctactctttgtcatttacagcctgcttatgctctattacgaaagtaatatgtttcttgtatttatgatcggtaacacagtttataccggatggatatttctttttctaaagcaacgaaagaaactagataatcaactattcggatgcagggccactaatcagaacgatctattggaattattagaaaatgtgaacgaaataaagataaataatatcgcgaacaaacgaagatggaaatgggaactcagccgctttaaaatttatggtttgcgggtaaaaaacatgaatctcgaccagatagaagcgaccggagcctcttttatcatccatttacaagggctttttattacttatattgcggctctaaatgtaatagaaggaacaatgacgctaggtatgatgatggcagctcagtacatattagggcaactgaatgcccccataaaaagtatgattggttatgtacattccctacaatttgcccgcatcagccttaaacgtgtaaacgaggtcatttgggaagaagaaccagaaatatctgaatcaaaagtttccattcctatagaaaaaggcgttaaggtgaaagatttagatttttactacaaccctaatttaaacaaagtattagacaatataaatttagagataccggagggaaagattacagctatcgtaggggaaagcggaagcggtaaaaccactttactaaaattgttactcaggttttataaaccaacaaatggtgaaattgaagtcggaggagtgccattagataatatcgatttatatcgttggcgtaatagttgcggtgccgtattacaagatggtaaactttttaatgacactatcttatataatatcacattggaagatgaagaaatgaacgtaaatcaaaaacaactagtgaaagcgattcaactggcaaacgcagaaaatttcattaatgctcgccctttaaagctatacactccacttggaactaatggttcaggattaagtcaagggcaaaagcaacgtatactaatagctagggcgatatacaaaaacccagacttcatattcctggatgaagcgacaaactctcttgacacgaataatgaaaaacagatttccaaaaatttggaaaccatcttagaaggaaaaaccgccattgtaatagcgcaccgattaagtactgtaaaaaatgcccataatatagtggtcatggaaaagggaaaaattgtggaacaagggactcatcaagaacttataaatttaaaaggaatatattacgacctaatttctagtcaattagagattggataa

SEQ ID NO: 3206 - DNA, 1338 bp, B.fragilis
ctaaatgaaaaacatatgaggcaatttattctaataatgatttgtatattactacaagtcattcatgtgcatgcagggtccaaggacataacgtggaaatgggattattccgaagcagatgatatttttattgatttgcttggcaaggcggctactggatttatggaaacgaatacgcctaactgttatggggggaaattagtagtaaaacttcccgagggattacattttaagcaaacagaggcacctgcttttttgttgattggcaatgcggaagaaatagcttttaacgttgacgtaaatgatagtatggctattctttcattaaagacatcttcagtacaaactgttccgtcagaagctattaatattacacttaatcctaaagcgattaaaggcaaactcagaaaaggtatgaacacaaccggtaggttgagttttcatccatcagagattcctaccgtatttaaatcgccgataacgggtagaacgtatcatttagtgtttaatgatgagttcgatgatggagtgatagatactttaaaatgggatacgagaagtagaagaagtccttttacccgtagaggtatgtatcaagagaaaccttactatgtgctgtgtcatgaggattggaccaaagagttgcatggcgaacttcgtttggaagtctctaaatactcgacacaaaacaatgttgtgatgaccggtgggattttatcactgggcaggttcatggcacgttatggttattatgagacaaaggcttcatttagagactgtattggtgaaggttactggcctgctttttggatacattttgatgaagccgataagtatggaaaaggaactgaaattgatgtttttgaatatattcctaaagataaacaaatctttcagacacttcattggtataaaaaacaagcaatggaggagcagcaatcagaagtgcaacatgcagctctggattacgataaaagtgggcaatttaaagaacaccgttcgtctaccgagtattttgtattggatgaagctcagagtaaagagcatacatttgctgtggaatggacccccgaagaactgattttctacacagatggtaaggttacccgtcgggtgaatcggaaagatgatcccaaacaagtgccaagtgcttaccaaatggtttatttctcttgttccgcaggagaatggggaggtaatgtgatggaaaatcaagtacctgcctatgtctattttgattattgcagatgttatcaggaaagtgatcaggatgctatttacaccgttaaaggtaatgggatgaaagtttcggcgagccggcgtgtgggaaagctctga

SEQ ID NO: 3207 - DNA, 450 bp, B.fragilis
atttgcagaaataatatgtccggtcggccgatacacatccatgttttatcaccggaccgacctataaatataaaaatcttctttatggcagaacacaaccttctaggaaaagccggagaggacgccgccgtcgactatctggaacggcatgactacgtaatccggcatcgtaactggcgtaaaggacatttcgaactggacattgtggcagctaaaaacggagaactgattattgtagaagtaaaaacccggagcgatacggactttgcacttcctcaagacgccgtcactccacaaaaaatcaggcgcactgtaatagcagccgatacatatatcaagttattccaaatagatgaacctgtacggtttgatattatcaccgtgataggcaaaaccggaaattttagaattgaacatataaaagaggcgttttatccgccattattttag

SEQ ID NO: 3208 - DNA, 363 bp, B.fragilis
agttttatgaatatagaatcagcaagagaatactgcctccggaaaaaagcagtcacagaatgcttcccattcgacgaatattcactcgtcatgaaagtaatggataaaatgttcgccctgatcgatctggaaggggccaatacgatttcattgaaatgtgatccggactatgccatcgaattacgtgagcactattcggccatcgaaggagcttatcattttcacaagaagtattggaatcaagtctactttgaccgggatgcggatgacaagctgatcaagcaactgatagatcattcttacgacgaagtaatgaagaaatttaccaaaaaattacgtaccgaatatgatgccctaccctga

SEQ ID NO: 3209 - DNA, 699 bp, B.fragilis
ataaaaatgaagaagatgaaaaccttgactttatttctttccttgctcttttctttcccgtttgtgctttcggctcagatggtgggagagactttgcagaaggtctctgctgcccttgataacagacagtgggaccaagctgttactttgttccgccaagcggtaaataccaatgtagagaaagccgaaatgttctattggacaggtgtggataagagtctggaagtatcatccaggatggggcgggaactggctgcttattacaaaaaatcacgcagctatgacaaagcgtatcttttttataaagagttgcttcaaaaatctccgaatgatgttaattgtcttgtgtcatgtgctgagatggaagtatgccgtgggagggagtctgaagctttggagacttaccggaaagtactgtcattggatgcggataatctggcagccaatatttttatcggtaattatctttatttgaaggcggagagagagaaaaaacagttagaagccgattataaaaagattagtgctcccactcggatgcagtatgcacgctatcgtgatggtcttagccgtgtgatgagtaccggatacggaaaggcaagggaatatcttcaaaaggtgatcagtcaattcccttctactgaagctcaaaagacattagaaagaataaagcttatagaaaaagaggtgaacagataa

SEQ ID NO: 3210 - DNA, 2070 bp, B.fragilis
  unsure (135),(1301),(1345),(2035),(2048),(2049),(2050),(2051),(2052),(2054),(2058),(2059): Identity of nucleotide sequences at the above locations are unknown.
tatcgaaggaaatccaccagaactttccatccgtacttgggattaatgcacactgcagaagagttcaacaacctgatcgtcaaagaagagaaacgaccgcatcatccgttttcagtgatatcggacgagccgaantggggccctgccgacatcaaaagctacatgaagatgaatggtgtacccatggtgggaatcgttgtaatcccccagcggggtgccaaccatataaagatagccgatgcggtatatgaacgcatggagaagatgcagaaggacctcccggaagacgtgaagtattcttacggattcgataacaccaaattcatccgtgcctctatcagcgaagtgaaagaaaccgtttacgtagctttcatcctggttatcattattatcttcctttttctgcgcgactggcgtgttacgctggttccctgcatcgtgattccggtatcgttgatcggtgctttcttcgttatgtatctggcggacttctccatcaacgtgctctccatgctggctgttgtgctggcagtgggtctggtggtggacgacgctatcgtaatgacggaaaacatctatgtccgcattgagaaaggtatgcctccgaaagaggccggcatcgaaggggctaaagagattttcttcgctgtcatctctaccaccattacgctggttgccgtattcttccccatcgtctttatggaggggatgacaggacgactgttccgtgaatttagtattgttatttccggttcggttatcatctcctcttttgcggctctgacctttactccgatgctagccaccaagttactggtaaaacgggagaaacagaactggttctatctgaaaacagaacctttcttcgaaggaatgagccgcctctacagtcgttcactggctgttttcctccataaacgttggattgccctgccctttgtagcaattaccattggcatcattgccttcttgtggaattacatcccggcagaaatggctccgttggaagaccgttcacaaatcagtatcaatacccgtggagccgaaggtgtgacctatgaatacatccgggactatacggaagacatcaatgacctcgtagactcgattgtaccggatgccgaatcggtaaccgcccgtgtatcgagtggtagcggtaatgtgcgcatcacgctgaaagacatgaaagaccgtgactacacccagatggatgtggctgaaaaactgtcggcagcagtacagacaaagacgatggcgcgttcattcgtccagcagtcatcttcttttggcggacggcgtgncggtatgcccgtccaatacgtattgcaggccactaatatcgaanagctacaggaagtactgcccaagttcatggcgaaggtttacgagaacccggtattccagatggcagacgtagacctgaagttcagcaagccggaggcacgtatcaatatcaatcgcgacaaagccagcatcatgggggtaagtacacgtaacatcgcacagaccctgcaatacggtctgagcggacagcgaatgggctacttctatatgaacggcaagcaatatgagatcttaggagaaatcaaccgccagcaacgtaacacacctgccaatctgaaatccatctacattcgtagtgacaaaggcgatatggtgcaattggacaacctgattgaactgaccggtggcatcgcgcctccgaaactgtatcgttacaatcgtttcgtttcggccactgtttccgccggactggccgaaggaaaaaccatcggacaaggattggacgaaatggacaagatagccaaagagacgctggacgacacgttccgcacagcattgaccggtgattcgaaagaatatcgcgagagttcttcaagtctgatgtttgcttttattctggccattgtactgatttacctgatcctggcagcacagttcgagagtttcaaagacccgctgatcattatgctgaccgtccccctggctattgcaggcgcattggtcttcaccacggggctggaaggttccgacnggtgctcatgtgnnnnntnccannggcgctctatc

SEQ ID NO: 3211 - DNA, 561 bp, B.fragilis
gctatgaggaagaatttttcaactatcctaattgtcggtgcagcccttttagtggcttcgtgtgtacaacaaaaagggtctttcagccctgtagactatgtgaatcctctgatggggacggagtctacttatgctttttcacatgggaatacttatcctgcggtggcggttccctggggaatgaatttctggagtccgcagaccggagagaacggtagtggctggatgtacacgtataccgacagcctgatacgggggttccgccagacccatcagcccagtccgtggattaacgattacggtactttctctgttatgccgctgtccggtgtgctgaagatggatcataaagaacggggagtacctttctcacatacccaagaggaggcggctccctacagttacagcgttacgtttgccgacggactccggacagaactttccgctacttcacgcggagcggtattcgaagtcacctttccgcaggactctgcccagtatatcgttgtggatgcctacaacggtggaagtgcgttgacgatagaccgggagaatcggtag

SEQ ID NO: 3212 - DNA, 1578 bp, B.fragilis
aaaaatactgatagcatgaacgtaaataaacccacaacagaaaagaaactcatcgatttaaataatgatattattcataacttcgatgtaagtatcgttatgtctttctataaaagatatacagagttcaaaaaagtattaccacataatgcaccctatttacaacgaaacggtattgaggtaatcattgtcctagatgaccccgatgaaaagtcagaacttctaatgctgcttcaaaattatccattcataaattggaagctaattattaatgaacgaaaacatgctcctcgcaaccatgcttccgtactaaatgtaggactcaagcatgctaccaaaaagtatatcctacaaatagatcctgaagtagaattcctcactgatattatatggcaaatgagagatgccatagagaaatatcccatgcactatatcctcgcaatgatggcatatgtaccctatgagcaggaacttacagaaaataatataaaagagttggattttatcccgtggggcaatttgatggtagaacgtaaccatctatacaaattacatggttatgatgaaacattcatcacatggggtggagaagataataatatgcgtgcacggttggatatgtctggtatcaaaaaattcatcctcccagaggcaaagactattcatcgggaaaaaaattatgatcccaacgaacgctctaaacgtatcaataaacatagcatttcagattggagaaaaatgaattatccttcggaagcaattgctaacaaagatatttggggaagtgaatttaacaaagtcatttacgactggcaagacaatcaatatgcaaaagacttgtgctatacatatctacagcaatttatcggtttcgaaatcagacaccccgccgcatttcggaaaaggcacaaaaagatagtcctctgccaagcgtacaacgaagaaaaactgatagaaggttttctaacaaatatggcaagctattttgacggtatcattttgctggatgatgaaagtacggatcgaacttgggatttagcaatccatgacaaaattttattaaaagtgaaaaagaaaagaagtgggttcaacgatttagagaatagaaatatattactcgatttaagtgccttcttccaatccgaatggttttgttttatggatattgacgaaagatttgatgagagatttaccaatttttcagaatttgagaataataaagagatacatgtggtaagttttaggggtgtgtatttatggaacgatgaacaaagttataaaggtgatattccgaattctaacaaaggtatcctcacagtttaccgaatgttcagacctatagggcatactcacataaacacccataagaaattacacttcatagcgactccgtatttcacgaacacatggcaaagcaatatattatttaaagactatggatccatgaaagaaaatgatcgaattagaaaatatgaaaggtatatacaagaagaccaacaaaaggacatgtcgtcagggtatgattacttattgaatagcgaaaatctatatcaactggataaaattgaagaatattaa

SEQ ID NO: 3213 - DNA, 225 bp, B.fragilis
gagaattatgatatatttgcaaccaaaactaaaaaatgtttaaccggaaatgacagaatcgactatgattgtcacactttagaagaaatcggattaactctgcttaaaaacagtcactcactcttcttttctgtttttctaatttcacagaaagcctatatccgctcctcggtatcgtttcaagtgcgatgtcgggatcggcaacaaggtattttcgtatcttga

SEQ ID NO: 3214 - DNA, 468 bp, B.fragilis
gataggaaagagccttttcagaaagaaacaataaaccaacatacaagtatggaaatcaagattcaatcactggaacaaattcacgaagctgcccgcgagttcatctcagccatgggcgataacacggtctttgcactctacggaaagatgggagcaggtaaaacgacttttgtcaaggcactttgcgaggagctcggagtatcggatgtcatcacttcaccgacttttgccattgtaaacgaataccgttcggacgagaacggagaactgatctatcattttgacttctaccggatcaagaagttgagcgaagtatacgatatgggatacgaagactacttctatagcggtgcactttgtttcatcgaatggccggagctggtagaagaattattgccgggagacgccgtgaaagtaaccattgaggaactggaggacggaacaagaaaaatagtgatcaacgactaa

SEQ ID NO: 3215 - DNA, 1596 bp, B.fragilis
ataactatggacaataccagaagtgtatatggtatcgatttgggtaccacctacagttgcattgcacaagtagataaattcgaccaagccattgttctccgcaatttcgaaggagatgccactactccatccgctgtatattttgaggatatggaccatgttgtcgtgggaaaagaagccaaaggtatgttggccactgaacctaccaaaacggcagtattcataaaacgccatataggtgtagatgacagtttcgataaaaatacaaacgaatttccctatcattacgacccaacagaaatttcggctttcatcttaaaaaagctggttaaagatgccaacgatttgggagataatccggaaccgatcaaagatgtcgttatcacttgtccggcctattttggaaccaaagagcgtatgcaaaccaagcaggccggagaaatagccggcttaaatgtactttctatcatcaatgagcctacggctgccgcgatctcttacggtgtaaagactgatcagaaaaaaacggttttagtatacgacctcggaggcggaacatttgacgttaccctgattaacgtgaacggtggtgccattaaagtaatagccacaggtggagaccatcatttaggaggagtagactgggataccgcattagctgaatatatgctggcagcttttaacgaacaaaataacacttcttattcgttcgaagaccgattagacctaaaatatgagttgttattacttgcagaagacaagaaaaaagtattgacagccaagcagacagcgaaagcaacttaccaatatgaaggcaattccgcacgtatagagattagccgtgagttattcaattcactgacagaaaggaaactggacgaaacgattgatgccaccaagaaggttattgctattgccaaagaaaaaggttacaataatattgatgaaatactgttggtgggaggcagtagccgcatgccacaaataaaggaacgggtagataaagaattcaattgtgatgccaaactaaccgacccggatgaatgtgtagccaaaggagcggcaatttatgctatgaatgccgcctattcacaagcagttcgcgactatgaagaaggagaaagtgatgataaaccggctcctctccgtggagatcgcaccacagtggtcaatgtcaccagtaaaacatatggtaccgacgtaatcattgaaggacaaagcatggtgcaaaacctcatttttgcaaatagttcgttacccacaaaacgaattgaaacctttactacttctattcctaaccaacgaggtgtatctgtgaaagtatttgaaagtgatttcacaaatatggaaacagaaagtatcgtggaagaaagattctgcacactaattgacgaccatacgcttaaactgagcaaagactggcctcaaggtacccagatttcagttacatatcagattgaccaggaaggtatcttgcacggattagcttatgtagaaaatgataaacttgaattcgatctcaaaatcaccggtgtaaaatgtgaagaagaactcagaaaatcaaaagcaatcatcgacaaagcatcagtagagtaa

SEQ ID NO: 3216 - DNA, 1254 bp, B.fragilis
aaacacccggacataaagggaattgggattcatggcacccacgacccattatctattgggacccggagcgacccgaggatgcattcgaatcaaaaattcagaattagagcaattagtatctttaatccgagtgccaacaactgttatcatcacgccctctgtaaaagacataaaaacccagtaaataacaaaccgatgaaaacattcaaacgattcctgttcatttgtatcggactattcattatagtcctctctacccaagctttggaaaagtatgaagtgaccgccaatacttttctaaacatacgtagtcatggaagcacaaatgctcctgtcatcggaacaataaatcatggaggaatcgtaaatgtagaatcaatagatggagaatgggcaaaggtatccttcaatggcggatatggatacgtaagtacgacctacatacgacctgttactccaacacctcccgcaaaagctccaacaaatacactcagcgactggtttcgacaaacaaattatgattgccgccctttagtttatatcatattaggactttctattgtgctattcatccttagaatgcgtcgtggagaaagtactccgctagaagacagcgaacatacgataaacctcagtttattcattaccgtctgtttgttagaactattttatgtgttttcaatgggcgcaaatagtatttggttttgcactcccgataaaataggatggctatggaccatcattaatttctttatattcggtgcagttgtatttaatcaatggatgtgttttttcaataccttgaatgatgtgcaatacaattcctacgcaactttcaattggacatggggaatatatacttggggcatctgtatcataggcgctatcatttgtggctttttctttgtaggctttttgcctgtggtaggaattggatttcttgtcggacaatctgtgcaaacaggtattattttcaataaagtacttcccaaaggtggatggaaacatgcgtgtatctgtacattaacttatttaattggttcaacagccactgtcttaattgtagctcatttcctcatccttttactaattgtactaatcgctctctttctgctttcacttttaggaaaatcatcttcttcatccggcggtaaaagatgctccaattgtagccacctcagtggttccagttgtaacttaagcggacgttatatcagcagcccgtctaccacctattgcgataattaccaataa

SEQ ID NO: 3217 - DNA, 3219 bp, B.fragilis
ctcagggattgttggcggaagcagaagaagccatccaatggtataagaacctgtttggagacgattattatctggaaatgcagcgccataaagcgacagggcctaaagccaaatcatgaagcttatccgttgcaggtgaatgtaaataagcatttgattgaatactccaaaaagtataatgtcaagttaatctgtacgaatgatgttcactttgtcaacgaagaacatgctgaggcgcacgatcggctgatctgtttgagtacgggaaaagatctcgacgatccgaaccggatgtattatacgaaacaagagtggatgaagacgaaggcagagatgaatgaactctttgccgatgtgcccgaagcattgagtaatacacttgagattctggataaagtagagtattattcaatcgatcacgcaccgattatgcctacttttgcaatccccgaggactttggaacagaagaaggatatcggcaaaaatatacggaaaaggatctttttgatgagttcacccaagacgaaaacggcaacgtggtgttgagtgaggaagcagccaaagataaaataaaacgtttgggaggctatgataaactgtaccgtatcaaactggaagccgactatctgaaaaagctgactttcgacggagctaagaagttttatggtgatccgttgtcaccggaggtcaaagagcggctggtctttgaattacatattatgaagaccatgggtttcccgggatactttcttatagtacaagattttattgccgccgggcgtaatatgggagtctccattggtccgggacgtggttccgctgccggttctgccgtagcctattgtttgcagatcactaaaatagacccgatcaaatacgatttgctgtttgagcgtttcttgaatcccgatcgtatttcattgcctgatatcgatattgacttcgatgatgatggtcgtggcgaagtgttacgttgggtgacggagaaatatggacaggaaaaggtggcgcatatcattacctatggtactatggctacgaaactggctatcaaagatgttgcccgtgtccagaaacttccgcttgccgaatcggatcgcttggccaaattggttccggataaaattccggataagaaactgaatctgaagaatgccatagaatatgtgcccgaattgcaggcggctgaagcatctcccgatcctttggtgagggatacgatgaaatatgccaagatgcttgaggggaatgtgcgtggaacgggtgtacatgcctgtggcactattatttgtcgtgatgatatcacggattgggtaccggtcagcacggctgatgataaagagaccggcgaaaagatgctggttacccaatatgaaggttcggtgatcgaagataccggattgatcaagatggactttctggggctgaaaacattgtctattataaaggaggctgtcgaaaatattcgtttgagtaaaggaatggaactggatatcgattccatttcaatcgaggatccggctacttataaactttacagtgacggacgaacgatcggtactttccagtttgagtctgccggtatgcagaagtacctgcgtgagttgcaaccttctacgtttgaggatctgattgcgatgaatgccctttaccgtccgggtccgatggattatattcctgactttattgatcgtaaacatggacgtaagcctattgaatatgatattcctgtcatggagaaatacctgaaggatacatacggtattacggtctatcaggagcaggtcatgcttttgtcacgtctgctggccgactttacgcgtggtgaatcggatgccctccgtaaagcgatgggtaaaaaattgcgtgataagttggatcacatgaaacccaagtttgtagaaggcggaaggaaaaacggacacgacccgaaagttcttgaaaagatttgggcggactgggagaaatttgcatcgtatgcgttcaataaatcacatgccacctgttattcttgggttgcctatcagactgcttatctgaaagccaattatccggctgaatatatggctgctgtcatgagccgaagtttgtcgaatatcactgatattaccaaactgatggacgagtgtaaaatgatgggagtacagacgttgggaccggatgtgaatgaaagtaacctgaagtttaccgtaaaccggaatggaaatatacgtttcggattgggagccgtcaaaggtgtgggtgaggctgccgtgcaaagcattatggaggagcgaaaagagaacggtccctttaaaggtatcttcgactttgtgcagcgtgtcaacctgaatgcttgtaacaagaaaaatatggaatgcctggcacttgccggtggattcgatagctttcctgaactgaagcgtgaacagtattttgctgtgaacagcaaaggagagacttttcttgagacattgatgcgttatggcaaccgttaccaagctgataaggctgccgccgttaattctttgttcggcggagataacgttatcgatatagcgactcccgaaattctaccggcggaacgttggaacgatttggagagactgaataaggaacgcgaactggtaggtatttatttgtcggcacatccgcttgatgaatatgccattgtgttggaacatgtttgcaatacacatatgagcgagcttgatgataaatcggctttggcaggaagagagattacgatgggaggcattgttaccagtgtccgccggggtatcagtaagaatggaaatccttatggtatagctaaaatagaagattattccggttcggcagagattcctttctttggaaatgactgggttactttccaaggctatttaggtgaaggtactttcttgtttatcaaagcccgttgtcaacctaaacaatggcgtcccgatgaacttgatgtcaagattacttcgatggaattgctgcccgatgtcaaggaacaactgatagagaagattacgattctgattccccttgccgaacttaattcggctttggtagccgagcttgcttctttaacgaaagaacacacgggaaatacggaactttatttcaaagtaacggatacggaggggaagatgtatgtagacctgatttcccgtcctgtgaaactttcggttggcagagaattaatttcctatttaaaggaacgtcccgaacttgcgtttcatataaattga

SEQ ID NO: 3218 - DNA, 822 bp, B.fragilis
ctgctgaaccgtatgaatttactacaatatacattttttcaacacgctctcctggggagtcttctggcaagcattgcctgcggcattatcggcacgtatatcgtgactcgccggttggtgttcatcagcggcggtatcacccatgcctctttcggcggcatcggactgggattgtatgcaggcatatctcccattttatcggctgctgtcttctccgttttatcggctttcggggtagagtggctcagtaaacggaaagacatgcgcgaagattcggccatagccatgttctggacactgggtatggcactgggaatcatgttcagctttttgtcaccgggattcgcacccgatctttcagcctatctgtttggcaatatcctcacaatcacacagacggacttactcttgctgggcattcttgccatcctgctgatcctgttctttaccctgtttatccacccgatcatatacgtggctttcgatcgtgaatttgcccgttcgcaaggcattccggtcgtagtgctggaatatatcctgatgatgttcattgccctgaccatcgtttcctgtctgcgcatggtggggattgtactggcaatctcgttactgaccattccgcaaatgacagccaacctgtttacgaacaagtttaaacgcattatctggttatcgattgccatcggctatctgagttgcctgggaggtctgctgatctcttaccgcctgaatgttccttcgggagcatccatcatcttcttttctattcttatctatattgcctgtaagataggaaagagccttttcagaaagaaacaataa

SEQ ID NO: 3219 - DNA, 261 bp, B.fragilis
gagtctacacggataccatccagcaagcgtgtgcttgcttttccggcgcggatgtgtgccagtgcttcttccagatacatcactgccatatccatcttctcttgtgattcttcgataatcgtttttacgtctaccatcttattaagtatttataaaattggcactttgattcattttgaaaacaaaagtagattattttttgattatctgcaactatctatagagagaaatgcgttgcctgacgtttctctttctaaatag

SEQ ID NO: 3220 - DNA, 450 bp, B.fragilis
ggcgttagacgtatgttggatgattcttattttatgaagcaggccttgatagaggctgttaaagcaggagagagaggagaagtccctgttggtgctgtagtggtctgtaaagagcgaatcattgcccgtgcgcataacctgactgaaacactgaatgacgtgactgcccatgctgaaatgcaggccattactgccgctgccaatgttcttggtgggaaatatctgaatgaatgtactttatatgtcacagtggaaccttgtgtgatgtgtgccggtgctattgcttgggctcaaacgggaaagctggtgtttggtgccgaagatgataagagaggctatcagagatatgctccgcaagcactccatcctaaaacagttgttgtcaaaggaatattggctgatgagtgcgccgggctgatgaaagacttttttgctgctaagaggaggtga

SEQ ID NO: 3221 - DNA, 1293 bp, B.fragilis
agagctggcagctctgcaaactcaaatcaggaagggaggggatgtatgagaagcagtcgttggtttattatcgggatcgttctctttttgctgatcatgtttgtggtagaatctcatctgccgaagaaattcgtctggaatcccacctttgcacaacatgatcaccagccactggggtgtgccgtgtttgatgatgtcttgaagtcctctcttccggatggatattctctttcgcgcaagacgttctatcagttcgctgctgacagtgactcctgccagagtattcttgtcattactcaacatgtaaatctggtggaggcggatctcaatgctttgctcgatctggcccaaaggggaaacaagatattgatagccgcttcctctttcagtacttcgctgtctgatacgttgggattcgacaattcgtatgcttattttaatccgagacggatgaaagagtatgcgggcaatttattggagcgtgacagtgtctgctggattggggattcagcagtatatgataagcgtacttttcgtttttatcctcatttatgtggcatttacttcacaaagtacgattcgttgtctctaccgttagctaccaaacggattgattcgatgcaaatgttcaatgacagtttgccggattgttttccgcccgtggcccttagtcgtccggtagggagcggagagattgttttggtcactactccgttattgtttaccaactatggaatgctcgatggcgacaatgcagcctaccttttccgtctgctttctcatctgaaaggtttaccggtagtccgtaccgaagcctatggggcgggagcacaggttgaggtatctccttttcgttacttcctttcccagcgtcctctgaggtgggcgctttacctgacgatgctggtattggtgctctttatggtatttaccgcccgcagaaggcaaagggctattccggtgattcgtgagcctgcaaaccgtaatctcgagtttgccgagttgatcggtactttatattatcaaaagaagaatcatgctgatcttgtgcgcaaaaagtttatttactttgatgagagcctgcggaggaatattcaggtggatgtggaagatgacagtgatgacaatgccttgtctaggcggatttcccggaaaacagggactgatgaagaaaaagtccggaatctgttccgtaagctccgtcccgtgattcgcgggcagcaggaagtcggcgagacgttgatgaaagatctgattgacgggatgaacgagatagaaaagcctcaaccctga

SEQ ID NO: 3222 - DNA, 267 bp, B.fragilis
aattacagaagtaaaagtaaatttgcaaagaatatgagaaagagagataaaaaatgtaataaggcaactccggacgaacctaagcgggaacgacggatgagcatattgctgagcgaagatgagcagcagattgtggatcgttatctggataagtataagataacgaataaatcacgctggcttcgtgagacgattctcatgtttatacataaaaatatggaggaggattatcctactctttttggtgaacacgatatgaggcgttag

SEQ ID NO: 3223 - DNA, 255 bp, B.fragilis
ttaggaacgagattacatgctgtagaagaacttgctgctgtccaggagtcactacaggtaatgtttacggttaaagtagccccgtcactgctgatgttttcaaaagttgattgggataattcaagtgtagcatcggaggtggaatcctcacaactactgaaaccaataagtactaaaagtataacgaataaatattctgttttcataaaagaatgtttttttataaagaacacagggtcaaagataatggtttaa

SEQ ID NO: 3224 - DNA, 198 bp, B.fragilis
aggcggcaaggcaatagcccggcgaaccggtatatcgggaaagccctgctcaatgaaagtgaatttacccgtaactacctgacgcaccgtgagcttacttccggaggagagctggtgttatggatggacagcgtgcccgattcccggcgcggcactcagaaggaagacttgccttactcttactccaacgggcactaa

SEQ ID NO: 3225 - DNA, 279 bp, B.fragilis
ggaactggaggacggaacaagaaaaatagtgatcaacgactaatcatccgaagaatggcccctcaatattttgtacagggaatatttgccaccgcagggctcatagccctgctggcatctatactcaactggaactggttctttaccgctcaaaatgcacaactgatcgtacggaatgtcggcagaggacgtgcccggctgttctacggactactgggagtcattatgataggtatggctgtcttcttcttcctcaatacgcaacccgtatcagagtaa

SEQ ID NO: 3226 - DNA, 936 bp, B.fragilis
aacatgaagggattagtaataaagaatacaggtagctggtatcaggtgaaaactgatgacgggcagttggttgaatgtaagatcaaaggtaattttcggctgaaaggcatacggagtacaaatcccgttgccgtaggtgaccgtgtacaaatcatactcaatcaggaaggaacagcctttatcagtgagatagaagatcggaaaaattacatcatccgccgttcatcgaacctctccaaacaatcacatattcttgcagccaacctcgaccaatgtatgctggtggtgactgttaactatcccgaaacttcaaccacttttatcgaccgctttttagcatcggcagaagcctatcgggtaccggtgaagattcttttcaacaaagtggatgcttatgatgaagacgaattgcattatctggacagcctcatcacgctctatacccaaataggttacccttgttttaaaatatccgcactgaccggtgaaggagtcgatgccatacgcgaggaactgaaaggccgggtaaccctcttctccggacattcgggagtgggtaaatcaaccctcatcaatgcccttgttccggggctggaagtcaagactgcggaaatatcagcttatcacaacaagggaatgcacaccaccactttctccgaaatgttccctgtaccgggagacggatacattatcgatactccgggaatcaaaggttttggtactttcgatatggaagaggaagagataggtcactacttccccgaaatattcaaaacttcggcaaactgtaaatatggaaactgcacacaccgccaagaacccggttgtgctgttcggaaagcagtagaagagcactacatcagcgaatcacgctacacttcctatctgagtatgcttgaggataaggaggaaggaaaataccgtgcggcatactga

SEQ ID NO: 3227 - DNA, 3198 bp, B.fragilis
ttcattattattatgagagaacgaaaattagtagaaagagccgtaaggatttcagggatgtttgtccttctttcgggtatgggacttcaaccttgccttgcttctcacagctacaatgcagcacctgccggagtggtgcaggtagaacagcagaaacagaaaataaccggttgtgttcttgacgttacgggttctccgcttcccggggcttctgtattggtaaagggtgctcccggacgtggagcaatcaccgatatggatggtaacttctcggttgaagcggaacagggagagcaacttgagatctcctttattggaatggaaacacaagtcgtgaccgtttccgcaaagacccgtctgcagatcaccctgaaagaggacagcaaaaccttggacgaagtcgtggtggtgggttatggtacacaaaagaaagccaacctcaccggagccgtagccagtgtttcggcagagacattggagagtcgcccgatcaccaatcttagccagggactgcagcctccgatcggtaacctgaacatttccgccgacaacggtgcgccgggcaaaggatacgggttcaacgttcgtggtactacatctataaactcttccggacctttggtactggtcgatggtgtgcagatggatcccaacatgatcaatccggccgatgtggaaagcgtatctgtattgaaggatgcggcttcggcttctatttacggaacacaggcagcctatggtgtcgtgctgattaccaccaagaaaggtaaagacgagaaagccaagatctcgttctcgtccaactggtctatcaattcgcctacacgcaaaccggagtatatggattcgtggacatttgccaatttccataatctgaccaaccgcaactcgggtggaggcgattactacgataagaactatatggatcatatctatgcctattataccgacccgaaacacaatctgccggtattcatcgatccgtccaatcccaacaagtatctgtattgcggcaacaccgactggatagatgaaaccatcaaagacaacaccctgatgcagcagtacaccctgtctctcaacggaggttcgggcaagaccgcctattacggttcgataggtttcctcgaccaagggggaacactgaaacattacgacgataagtaccgccgtttcaatgtcaacctgaacctgacttcggacgtcaccaattggttgcaggtgcggttgaagaccgtctacaacaacacttaccgggatgctccttacggaagtaacaacagtgacgagacagcacagatcaacagtgcattctacggtgccgaccttcgcccgatgatgccggtatatcatccggacggaaacttttccggtcagggcagttggacgaatatggtggctacccagtccatttccggcgagcgcaagaataaggagaacgacctttggctgaccggcggtttaaaaatcactccgctgaaggactggaccatcaatgtggactatacctataatatgtatatcctctcgaagaagcagcacggtaaagagatattggagcatacggccaatccggacattgtaaccgtattcccgcataccactccgagccgcgtgaagtttaccaccgacgacaactattaccagacgttcaatgcctataccgactactccaagtctttgggtaaacacaacattaaactgttgctgggatataattacgaaaccaagagctaccgctggttcaatgccgaacgcgagaacctgatcagtaatgacctagccggtctgggacaggcttatggagagaagtacaacgggagcggccagcactcctgggccactatgggatattttgcccgtatcaattataactacgatgaacgctatcttctggagttgaacggacgttatgacggttcttccaagttccccaaggacaagcgtttcgtattcttcccctccgtatcggctgcctggagaatctcgagcgaggctttcttcgaacctgccaaaaagattgtagatgaactcaagatcagagcctcttatggttcgttgggcaatcagtcggttggcggcgactatccttatatcgctaccatgggcaccaatggcgagatgggatacctggtggacggaaagaaaatagccagcgtgagtcccggcggtatcgtcagtccttacttgacttgggagactgtacgccagattgacttgggtctcgactgggcattgctgaacagccgcctgtatggaaccttcgactggtacatgcggaagacactcgatatggtgaccaacggtacaccgcttcctgccgtactgggaacaggagctccgcaggccaatactgccgacctgaaaacaaccggttgggagctttcaatgggatggagagaccgggtgaacaaagacttttcgtatgacgtaagtttcgtattgtccgactatcaggcagaaatcacgaagttcaataatccgcagaatttgctctctacccattatgtaggcaaaaagtggggtgagatctggggattggtaaccgaaggacttttccagtcggcagaagaggtaagtgcccatgccgatcagtcggagatctatggcggtggctggtatccgggtgatgtgaagtacaaagacctgaacggtgacggcaagataaacaagggaaagaatacgcttgacgatccgggtgaccaaaagattatcggtaacagcgaaccgcgttacagttatggtattaaaggcggattgcagtggcgcgactttgactttgatgtattcttccagggcatcggcaagaaggatgtagtgttgggaggcaaccagttctggggcttcggcaacgaatggcatgtacctttcaaacatgcactcgactcatggaccgaagataaccgcaatgcttacttcccccggtctacctacgacaacgtgaccggtaaccgtgaaacgcagacccgttatctccagaatgccgcttatctgcgcctgaagtctatcacattgggatattctttgccgaaagcgctcctggccaagtggaagatagatcatgtgcgtttttacgtaagcggacaaaacctgctgacgttcgatcacctgtttgacatatacgaccccgaaacagtgagtctcagcacttatccgctgactaagtctgtttcattcggattaaacattaccctctaa

SEQ ID NO: 3228 - DNA, 432 bp, B.fragilis
ttcgtaattatgtggatacttatagttggtctggtgttgctcgccatcgtggcaatgattgccgggtatatccgcaacaaaagactgcagaagaaaatagataacggagaactggacagttttccggaagtaaaggaagtcgacgtagagtgctgcggacagcacgaagtttgcgaacgtgacagcctgctggctgccgtcagcaaacagatagagtattatgacgacgaagaactggatacatttatcggccgggcacccgaagattatacaccggaagaggcggataaattccgcgatgtcttttatacaatgcaggacaccgatgtagccggatgggtacgtagcctgcaactgagggggatcagccttcctgatgaaataaaagacgaagtgtttctggtagtcggcgaacggagaatccatccctga

SEQ ID NO: 3229 - DNA, 222 bp, B.fragilis
  unsure (11): Identity of nucleotide sequences at the above locations are unknown.
tgggcagactnccgctggtatgtcttttccgccatgggattctatccggtttgtcccggtgttccggagtatgccatgggatctccgctcttcccgaaactgacattgcatttgcccgggcggaaagaacttcactgtgaaggcggcaaggcaatagcccggcgaaccggtatatcgggaaagccctgctcaatgaaagtgaatttacccgtaactacctga

SEQ ID NO: 3230 - DNA, 201 bp, B.fragilis
cttattgctatttcagaaatatctattacacacagtcgtactatggctggtaacaaccaaaataaaaaagcagcaatgaaaaaatatttgttaaccatttataaactcttattaaaatatttgttaatgttgatttgtatcgttaaatgggattcactacttatatctataatttgtttatgtttgccgtttttctgttga

SEQ ID NO: 3231 - DNA, 723 bp, B.fragilis
cgaacagatatggtggtgacaaaaataaaaatatcagcgatgattttgacgtgcatgttgtataatgccctgaacacatgcgcacgaagcgtagacatttcccataaagggtgtaagtatagcatagatctcccttccggatgggataccattcctcatgacactctcaaaaagatatttccacggctcgatctcgacatggggctatatccggtatctcaaaaggaatattttacagggaattatgctttggttggttttatgcctgttttgcagtccctccattcttattctttcgaccgaatcgtttcggacatgaaggagatgaatgaccggacaaagaatacgtggaacaacgattcgatatccacacgccttgacagcatcgttccggtaaactcctccccgaattaccggataaacaattatctcacaatccggagagattccatactattgaaaggatgtcagtctttatatgtatcgaaattcggatacatcacactgatgctttatcaaaagggaaatgacgctctcccgatagactcacttcttggcaagtttaacgattcgggctgcttaaaagtggaccaagagtacagatatacccctccgcaaaaagaggggctttcattcacgcattttttatatgccttgggtataggtggaattgtctatctgctcatcgcgtttttcccaaaacgtaaaacaaaccggcaatga

SEQ ID NO: 3232 - DNA, 1356 bp, B.fragilis
accattatctttgaccctgtgttctttataaaaaaacattcttttatgaaaacagaatatttattcgttatacttttagtacttattggtttcagtagttgtgaggattccacctccgatgctacacttgaattatcccaatcaacttttgaaaacatcagcagtgacggggctactttaaccgtaaacattacctgtagtgactcctggacagcagcaagttcttctacagcatgtaatctcgttcctaatcaaggaacgagcaatcaatcactcagcattgttgtggaagctaacctggatgaagccgaaagaaatatgacagttgtcgttacttccggcggaatcaagaaaaccatcagcattagccagcaaggaagaagtacaacagcaggtgagtatcactataaccttccggttattttccatgtactatataaagataaaaacaatcctttacaatacgttaaacaagaccgtttagccaaaatactagatacagtcaacaagctttataaagataaaaccaaaagtgtggatatgaacttgacttttacgctggctactactgatgaagatgggaaacccttatcaactccgggagtgaaatatgttttatgggaggaaagttaccctatcgactgtgatgtcttcatgaatgacgaaacaggtaaatatgtaaaatacatctgggaaccgaataactatatcaacgtaatggtatacaacttcaaggacgatgagagtacgaacagtaccacactgggaattgcacatatacctttttccacagtaggaagcaattatctggaaggactgagcaaaacacaaaaatcttatttagagaaacaaaatctgaaatttccatatagtgtctccatcaacagtttattcattaatgaccagtcaacttcaacccaatatagtacagcagacatcaccgtaacattagctcacgaattaggtcattatctgggcttacaccatgctttttctgaaaatgacgaaggtatttatgacggttgctttgattcggattattgtgacgacacccctacttataataaagtggagtatgacgctgattacgcctacaccgcgaagaatgatccggcaaacttcacgtttgactatctggtaaaacgtgaaaattgtaagaccaatcagacatttacttctactaatattatggattattccgtaagttactcagaccggtttaccaacgaccaacgttcccgtatccgtcacgtcctgacatacagtccgctgatacccggtcccaaacaaggacaaacacaaacgcgttccgttgtcgaaggaccgattgatttacccatacgcacagcccggtaa

SEQ ID NO: 3233 - DNA, 1020 bp, B.fragilis
aacagaaacatcccgatcatgaaaagaaaacacctgattactgtccttatgtggtgtgttgccactaccttatgtgctcagaccccggtcgaaaaggggcttaaaagtattaaccgccaggctaccgaggcttatatcggatttttggccgatgatgaacttcaaggacgtgaagccggatttcacggttcacgtgtagctgcccggtatatcgcttcgctattgaaggaaatgggtatccgtccgttaggcgagagctattatcagccgtttgatgcttaccggaaagaacgccagcagaaaggacgactggaagtgcaccctgactccattgccaaactgaaacaagtggtgcatcagaagttgtctatgaacaacgtattgggtatgattcccggaaagaagacgaatgaatacgtgatagtaggtgcacatttcgaccatctgggcattgatcccgctttggatggcgaccaaatctacaatggtgccgatgataatgcttccggagtatcggcggtgttgcaaatagccaaggcctttgtggtaagcggacagcaaccggaacggaatgtaatttttgctttttgggacggagaggagaaagggcttctcggatcgaaatactttgtgcaggagtgtccgttcattaatcaggtcaaaggatatttgaactttgatatgattggccgcaacaatcagccgcaaaatcccaagcatgtggtttatttctatacagaagccaatccggctttcgggcgttggctgaaagaagacattaaaaagtacggcttgcagttagaacccaattaccgcccttgggacaagccggtgggcgtaagtgataacggctcgtttgccaaagccggtattcccatcatttggtatcataccgatggtcatcccgattaccatcagccttctgaccatgcagaccgtctgaattgggataaagtggttgaaatatctaaggcctctttccttaacgtctggaatctggctaacgaaaaggattattaa

SEQ ID NO: 3234 - DNA, 720 bp, B.fragilis
gaaacaataatggcaaatgctataacccgccacatacccaatacagtaacctgcctgaaccttttttcaggctgcattgccggcgtgatggcttttgaagctaagtatgaactagcttttatcttcattatattaagtgctgtcttcgactttttcgacggcatgctggcacgactgcttcatgcatattctccgataggaaaagaactcgactcactggcggatgacgtcagttttggagtagccccttctttacttgttttttcatttttgaaagaacccggattgatataccccgactttctggcaggattaagagattatatcccttatctggcattccttatctctattttttctgctttacgtttggctaattttaacgtagacgagcggcaaaccagttctttcataggccttccggtaccggccaatgccctctattggggagcgttaatcgtaggtggcaaagattttctgctggcacattgcaatgttatataccttattataatggtaatgctcttttcatggttgcttgtggctgaaattcccatgttctctctgaaattcaaaaatctttcttggaaagataataaggtaagtttcatatttctgattgtctgcattccattactactgtttctgggtatcagcggattctcagcagttattgtgtggtatatcattctttcacttttaacaagaaaaaataaataa

SEQ ID NO: 3235 - DNA, 696 bp, B.fragilis
atagcgcaaatgggtcgacttaagaaattaaaaaagataagaattcaccgtgaaggaacacatattttatggggtagtttttttctgctactgatcataaatctggctctttactggggaattgattgtaaaataccattctatctggtggctttggtaagtatcgtcgtctatctgttgatggttaactttttccgttgtcccatccggcttttcggacaggatacagaaaagattgtagttgcaccggcagacggaaaaatcgtagtcatcgaagaagtagatgaacatgaatacttccacgatcgccgcattatggtatctattttcatgagcatactaaatgtacacgccaactggtatccggtagacggagtggtcaagaaagtcactcatgataatggtaaattcatgaaagcatggcttccgaaagccagtacagaaaatgaacgttcaatgatcgtcatcgaaactcctgagggagtagaggtaatggcacggcaaatagccggtgcaatggcaagacgtattgtaacatatgccgaaccgggagaagaatgttatatcgacgagcatttgggattcataaaattcggttcacgtgtagatgtatatctcccgttaggcacagaaatctgtgtcagcatgggacaattgaccaccggtaaccaaactgttatcgccaaattaaaataa

SEQ ID NO: 3236 - DNA, 1512 bp, B.fragilis
  unsure (1420): Identity of nucleotide sequences at the above locations are unknown.
accgggagaatcggtagcgtgaccggtgtggcgcgtaatcacaatggcggtgtaccggataactctgccaactatttccgaatagagttcagccatcccattgcagaagaaggcgtatatgacggagatacactgatgcgccatcggccgacgttggagagtgattatacttgtgcctacctcaggtttaatgtgccggcgggagagaaattaaccgtccgtaccgcctcctcgttcataagtcctgcacaggcgcttgtcaatttcagtcgcgaagtgggaggcaagagccttgcccaggtgagagaagaagcccgaaaacaatggaacagttatctgggacgaattgaagcggagggaggcagcgaggagcaattgcgtaccttttactcttgcctctaccggaccctgctcttcccccgcgaattttatgagttcgacgctcaggggaaacctgtctattacagtccttacaatgggaagatacaggatggctatatgtataccgacaatggattctgggatacgttccgtgccgtccatcccttgtttaccttattatatccggaagtttccgagcgggttacccaatccatcctcaatgcttacgatgaaagtgggttcatgcccgagtgggcgagtccaggccaccgggaatgtatgattggtaataattccatctccttgttgacagacgcatggatgaaaggcattcgtaccatctgtccggagaaggctcttgaagcaatgattcatcagaccgagggccggcatcccggaatcagttcggtggaacgtgacggattcggttattatgaccgtttaagctatgttccctatcccgaagtgcacgaggccacggccaagacccttgaatatgcttacgccgactggtgtgtcgcacgttttgccgactccattggccggaaagagattgccgatacctattaccggaaagccctcaactaccggaacctttactatcccgactatggattcatgtgggcaaaagatgccaatgggaaatggagagacgcttttgacgcgacggaatggggaggccctttcacggagggcagttcctggcactggacgtggagtgttctgcatgatcccgaaggcttgtctcgattgatgggaggacatacagcgatggaagcccgtctcgactctatgtttacagctcccaatacctataattacggtacttacggttttgttatccacgagatagccgagatggtggctcttgatatggggcaatatgcacatggcaaccaacctgtgcaacatgccatctatctatacgactatatcggccggccctggaagacccagaagcacgtccgcgaagtgatggataagctttatcactccggcagcaaaggctactgcggtgacgaagataatgggcagactnccgctggtatgtcttttccgccatgggattctatccggtttgtcccggtgttccggagtatgccatgggatctccgctcttcccgaaactga

SEQ ID NO: 3237 - DNA, 912 bp, B.fragilis
aaaacccggatcgctttccgtaaggtggggcaggaacgtactgtcgatttggtgttgacagctattttggctaacggtcacgtcttgatagaaggagtgccgggagtagccaagactttacttgcccgcctgacagcccgtttgatagatgccgacttcagccgtgtacagtttacacccgacctgatgccgagtgacgtcctgggtacgactgttttcaatatgaaaaccaatgaatttgatttccatcggggacctgtctttgccaatatcatattggtagacgaaattaaccgtgcacccgccaaaacgcagtccgctcttttcgaagtcatggaagaacgtcaggccagtatcgacggaacaacttaccggatgggagaactatataccattctggcaacccagaatccggtggagcaggagggaacttataagttgcctgaggcccaactcgaccgtttcctgatgaagattaccatggactatccgtcacttgatgaagaaatcaatatcctggaacgccatcacactaatgccgccttggtaaaactggaagagatacaaccggtaattacccgtgaagaactcctttctcttcgtcgattgacggaaaaggtatttgttgaccgtactctgcttcagtacattgccttgattgcccaacaaacccgtaccagtaaagctgtgtatctgggagcttctccccgtgcttcggtggctatgttgcaggcatccaaagcctatgctctcttacagggacgtgacttcgtaacgccggaggatattaagtttgtagcaccttatgtgttgcagcatcgcctgattctgactgcggaagcaaaaatggaaggttattcgcctgtcaaggtgactcaacggttgattgataaagtggaagtacccaaataa

SEQ ID NO: 3238 - DNA, 1020 bp, B.fragilis
ttctcttacttttgcttccggtttcggacaaaacttatccggagccgaaccggttggatgaaagaggtaacgtttatacgtcggaatattgaaaaatggaaagagactgagaaggtggtggagcaggcagataaactgactcctgaccgtcttgccgacgcttatacggaacttacggcagatctcgcgtttgcacaaactcattatccgtcttcccgcattactatttatctgaataatctggcttcggctcttcataatgtgatttatcgcaataagaaggagaaatggacccgtatctttactttctggacgcaagaggttccgcaaacgatgtaccatgctcgtaaagagttgttggtttcggtcctgattttttgggccagcgtattggtgggcattgtttcagcagcgaatgatgataacttcgtccgcctgattctgggcaacggctatgtggatatgacactcgataacatagcgcgtggtgagccgatggctgtgtacaacggttcggaagaggtacctatgtttctgggcattactttaaataatatcatggtttctttcaatgtctttgcaatggggttgctcaccagctttggaacaggatggttactgtttaataacggagtgatgctcggtgcttttcagacctttttctttaaacatggtttgttgggcgaatccatgcttgcgatctggttgcatgggactttggaaatatgggccattatcgtagccggtgctgcagggttggctttaggaaacgggtggctgtttcccggaacttattcccgtaaagagtcttttatgaggggagccaagaaagggctgaaaattatagtaggtacagttcctatctttataatggccggatttatcgaaggttttatcacgcgtcataccgaattacccgatgttttgcggttgggcatcattctattgtcactgtcatttattatctattactatatttatttaccaaacagaaaaactcatggaatcacaaaaacctaa

SEQ ID NO: 3239 - DNA, 2679 bp, B.fragilis
tttttcgtatttttgttgcactatgaaacggatgacgcatttatcgaagaacagtatatgagaaggttgggatgtttgtttgctatcggaatgatgtggctttgcatagtcgattgcttctcgcagggacttcttttctatgggaacgaaaagcggattagtgagcgtgccacctattctgttttgcgtgaagggcacgagcgcactttcaccaacgctttccgtatctcctttgattatctggtccggaatgtggagagtcccggttacatcctttatctggaagaccgggatgccgggaaaacttatagttttacgtatctgcacaaacccggcgaccgttgttctttctccttcaacgaagacggcaaacgtatcttttgtactttcgaactggataaggaagactatgatcaccgctggttgcctgtttccatagctttggatatacccgcagactgtgcccgaattacgattggcaagcggagcaaggagatctccaacctgggactggagccgacaggattctcaccgcatatttattttggtaaatgcgaatacatcctggatgtggcttcgtatgccatccgtaacttgtctcttaccgacggtgaagagatcatgatatttcctttgaacgagagcagcggagaagatgtgcacgacagccggggacatgttgtgggacaggtcaccaatcctgtgtggctgattaatcagtcctactactggaaagaactttttacggactattcttccacgccttccggtcttaactttgacaagacacaccagaacatcctcttctttaatcaggactctctgtccgcgttcgacctttacacgcacgaattatcgaagacaccttataagacccctcttccggttcagcttcgcctgggtatgaactttctggatgaggcatcccgtgaactgtacacttatgaagtggccgattcgcatggcgatgccatggtggcggcgctggatcttactaccaaagagtggcgtccggccagttccgactatctttgccaacagctccatcatcattgcggattctttcatccgggcgaaagaaagtttttcctgtttggcggttacggaagccgtagatacagcaatacgttcctggcgtacgatttgaatacctgtcgttgggatacactggccttctccggcgaccgggtgattccccgttacttttcgggcatggctgtgagcaatgattacaagcgggtatacctctacggaggcatgggcaacgaagccggtgatcagaatgtagggcgcaactatctgtacgatttataccggatagatatgcagacccgttcggcgcagaaactctgggaagcgaaagcaccggcggccaatccggtgggaccccgtaatatgatactctctgccgatgaaaaacacctgttcctcctgggatatccagaatatctgcccaattccactttgcagttgtaccggttgtctgtgcgtgacggtgagtgtgaagcggtgggagacagtattcccattgtttcggaagagattgctaccaacgccaatctatacttcaatgaagaattaaatgagttctattgttccgtccaagagttcgagaagcacgggcaagtgactacccgtctatactccctgtctgctccgccggttacattggacgatgtggaatactatagccggaggcggaatgccctgaatgccggtctgctgggagcagtcgtgggtggagtattattgttggcggcctgtgtatggggcatcatgcaccataagcggaggcgggacaggacgtctgccgagaccgcatctgccggagtacgtccggaagaagtgtccgatataccggaagttccggctgtggagtcaccggaagtgaaagaagaagaagttgagaaagagccttccgagtgggaagaattgccggccgtattgccgcccgacaagaatgctattttccttttcggcatgtttaccattctcgataatgccggacgtgacattacctatatgctcagtcccaagctgcgtactatctttttgtatattctgctgaacagtgtaggcaagaggggagtgctttcgtctgacatgaatcagatattctggcccgataagtccggcagcaatgtgaagaacctcaaaggagtttccatgaatcatgtgaggaagatattgcaggatgtggacggcatcgaactcgtataccgcaacggatacttctgcatggtgtttggcgaagagttttattgcgattacattcgtctgatgaaccttacctctccggagaaaaagaagaaagagactcccggtgccatacgtgcggaatggttggaaatacttttgcggggtaagttcatacccgccgccgagtccgaccttttcgattactacaaacagaaagtggaaacgctgatccattctcttctgcccgggcagttggaactggcttacggggatgcccggttcagtatcgtcatccgtctttgtaacatcctctttatagccgatcctttgtcggatctggcacttgcttataccgtttgtacccttcggaagcagaacaaccaggaggaagccatcaggcgttatgccgcgtttacgaaagattatagacgggtgatgaacgaggagtacggcatagctttcgctgacatcaaggtctga

SEQ ID NO: 3240 - DNA, 1425 bp, B.fragilis
aattacgaattctttgttatattgaaaacttctcttatatttgtcaaaaaagaaataaccagacttaattctatgaggaaagaactattatttactgttttcgtttctgtagcttttatttttcttcaagccttttggatagttcgtatgtaccagagatatgaggagcaatataccgaacaagtaaataaagctttcttagatgctattggaaaagaagtagagcttagaatcaggtatgtagaggaatttaagacccctattcttatcaagcctaccggatgtgtctctgaaaaggaacgaaccggctacaaaggtgacaccattgatttagtacttttaaaacagaatgacatagttcgaaatgtttctgaatttcttgcacaattagagcaagacgaattactctctagtcgggtgtctcctgtattacctgttatagacagtcttcttcgggaagagttatcgggtttgaaaatagaccattacctgtccttatatgataaggagggaaagatggttgattctttggggaacacttctttgcggggggagcgtcgggtcatcaaagtacgggaagctatcgggacgaaggggctactttttatgcaaatagagtccaaactgccctatgacgctatcctgtccaaaatgttttattcccttcttgtttttgcattgattataatgtttgttgtgggatgtcttatccatcagttaagagttattcgtcaaaaagatgaactgctagagaggcgtgaagtgagtgtgaacgggattgttcatgacctcaaatcaccattgaatgcacttgtcactttaaccggctggcttatggaaacggaatcagatcttcggaagaaagaattgatggctgaagttataaagcgtgccggacaccagacggcgcaaattgagtctatattggtctgtgccagaggggcggcgcaacccattgttctgaacaaaaccgaaataaatccggaagaaatagtacaagcggcaattgatgacatctgtgttgaattgaaagctaagccacatagtattgaggttataaacgaagcatccggattaacgtgtttgggcgacagaggctatttggagaatgtgatgaagaacttgatagaaaatgcgttgaaatatgcggatgatggagtgaaaatacagattgaaataacaagaatctcacaaggaatacagattaaagtgaaagataatggttggggaattgctccgaagtatcaaaaaaaactattcaatcagtattatcaggtcccccgggaagcattgcgaatgcggaaagggtatggtataggattggcatatgtccggcatattatccgggcacatggtggtaaaatccagttcaagagccgtgagaatgaaggaagtgtatttacgttttatattccggaaaaataa

SEQ ID NO: 3241 - DNA, 642 bp, B.fragilis
agatgctcgtcgaacgggcgggtatcactccgaagcgcctggtggagatggccgtgtattctcccccgttggctggagatggtagaagaggctatcggatggaaaggcctgacttgtgcggcaaatttgttttatgcttacacaagggagtgttatgatgatgtggatgaggcaagaatcacgccttatacactcttgtcacctttggagatctcggtgggagtggtggatacggcatggttttggaaagcctacaatgcactgggacgcgaacgttacgaaaaagttttcgcggcttccaaggctgttacggaatcttccggtgtgtatagccgtttccggaagtatacggatgctcttgtgggaaagtatacgatagcacagttggaaagcctggtgatggataaccggaataaagattgggtgcgtgcctatccgcttgccccgtttgccggaaaagcccggaagaaagaggtagatgcgcggctccgcttcctcaaggctttctggctaagcagtgacaccctgtccggacgtcatactgctgaaaaggaggctgtacaggtggctcttgacaaccttaccggaaattccggactggggaatctggataccaggtggtttaaaaagaaggtctggtga

SEQ ID NO: 3242 - DNA, 297 bp, B.fragilis
aatcacattccgcggaagccggcctggcggacaactccatcaacgagccgcgtccggggcatgcccgagcattgggtaggctactgttatgcctggggatatgccgacaaccatccgaacaatacggaatattctcaattcaagatagactgggcggtagataaagacggaaagccggttcatctggacggcatcgacttcgtgaagatttatacagcggtcaaccagaactgcggttggctgggtgaagcctctacggagatacaggcggtggaagatttacactacaagaaataa

SEQ ID NO: 3243 - DNA, 1575 bp, B.fragilis
ctaaataatcctaataaaactctaatatatagattagtttcatgtctttgttgtacttttgccgttcaatatttggatgtattccaaacacacgttagaatgaaacgaagaaactatttcatattcagctgtttgatgctgatggctcctgcggctgtgcaggcgcaatttgacaaaggcctaaactataagattgaaaccagtgcaaccgtaagtggtgggcacaacacgcctttttggctcgtggcaaataagcacgggctttcgtctattcgaaaaaacaatgcttatttggatgcgggtatctttcgggatttggagaaggataaaaagttctcttatgcctttgggttggaaatggtgggtgcaagtcgcttcacttctaaattcttcatccaacaggcttatgtggatttgcgttatcgggggatggaaataagtgtcggcagtaaggagcgtggcaacgaaatgaaaaatgatcagttgagctccggtagtatgactttttctaccaatgcccgtcctattccgcaagttcgggtttctatacccgagtatattccttttccgtggactaaaaactggttgcatatcaagggacacgtggcttatgggatgtttacggatgaaaagttccaggagcgtttcactgccgggcgttctaaatatacgaaagagactctgtttcattcgaaagcagctttcctgaaggtggagaatttgcagaagtcacctgtttcggtggaattgggtatcgagatggcagctcagtttggaggcgattgctattatccggacgggacggtattgcgtacaccggacagttggaaagactttttccgtattttctttccaagcaacggagacagtggagcttcggagagcgaccagataaatattctgggaaatcacgtcggaagttacagtgccgctgtgggatatcattttccgacctggaaaataaaggcttactgggagcacttttttgaggaccgctcgggaatgacactgacttatggtatgtggagagattgtctggccggattggaggtgacgttgccggagaatccttttgtgaaaacgattgtcggagagtttttgtatacgaaacaccaatcgggagctttccattactttgctactccggccattgatcattcgtttaccggagctgataattattataataattcgcagtatgccggttgggaacattggggacagggtattggtaatccgttggttacctcacctatatataataaggatggaaacctggcttttgagagtaaccgtgtgaaaggattccatatcggtttgaatggcagtcctactccggagatagattaccgcattctggtaagtgttgctaagcattggggaacttacggtagtccgtaccggaatatcagaagaaaccagaacgggttgttagaagtgacttataaacccgaacagattcggggatggagtttcacgctggccggtgcggtagacggtggcaatatgttaggagaaagttggggaggtatgctcaccattcgtaaaacaggtttaattggtaagaagaaatga

SEQ ID NO: 3244 - DNA, 357 bp, B.fragilis
tattctttttatctttgcagtgcattggtttgtattctccgtgttccggggatgcaattaaaagggaatcaggtgcaaatcctgaacagtcccgctgctgtaagtttcacatcagattgttgtaagcaaccaccacttgccactgggaaacgtttcctgggaaggcgcttatcaacagaaacgagtcagaagacctgcctgtgcatctttttcattgctttcgaggaaaaagcgttgagtctaatgagccggaactattccatccgtcattttattcatcactctgattcagagaaagtaagttatgataataaactctgccaagtttatttagtgtgtccggccgaagtgagttag

SEQ ID NO: 3245 - DNA, 1794 bp, B.fragilis
aacattacatatatgaacctacctgtcacccaaaagcactttctctctttcagccggaagttattcctttcggtcatttccctgttcctggtgtttgccgcctgcttcatggcctatcagtatcagagggagaaagagtataaagtagagttactgaatatacagttacaagattgcaataatctgctgtacgagaagttgtacgatcacccacaggatatgactgaggtgatctccgactacctgcaacataacgtattgaaagatttgcgcatcactgtagtaaacctcgatgggaaagtgcttttcgacagtcaggaacagaatgtggagcagttgggcaatcatctcgaccgggaagaggtacaaaaggccttgtacaatggggtcggcttcgatgtacgccgcacctccgaaacaaccggagtcccctacttctactccgccaccttatataaggactacatcatccgctcggctctgccctacagtgtcagcctgatcaataacctgaaagcggacccgcattacatctggttcaccgttatcgtcaccctgttgctgatgatcatcttctataagtttaccaacaagctgggcacttccatcagccagctccgcgaattcgctatgcgtgccgaccgcaatgaacctatcgaaatggcgatgcagtcggccttcccccacaatgaactgggtgagatttcgcaacacatcattcagatatacaaacgtctccacgaaacgaaagaggcactctacatcgagagggagaagctgatcacacacctgcagatttcgcatgaagggctgggagtattcaataaagacaaaaaagagatcctggtcaacaacttgtttacccaatacagcaatctgatatcggactcaaacctggaaacggcagaagaggtattcaatatcagcgagctcaaagagataacggacttcatcaacaaagctcccaaacgtcccgtcggcaaggaggagaaacgaatgtccatcactatcaataaaaacgggaaaacttttatcgtagagtgcatcatcttccaggatatgagctttgagatcagcatcaacgacgtcactcaggaagaagagcagatccgcctgaaacggcaactgacacaaaacatcgcgcatgaattgaaaactccggtcagcagtatccaaggttacctggagaccattgtcaacaacgaaaaccttccgaaggaaaagatgaatgtgttccttgaacgctgttatgcacagagtaaccgcctgagccgattattgcgtgacatctccgtactgacgcgtatggacgaggccgccaacatgatcgacatggaaaagatggacatcagtgtcctggtgaccaacatcgtgaacgaggtatccctggaactggaagagaaacacatcacggtggtcaattcactgaagaaagagattcagatacggggcaactactcgctgctctactccatcttccgcaacctgatggacaatgccatcgcttacgccggaaacaatatccaaatccacatcaactgtttccgcgaagacgagaagttctactacttcagctttgccgacacaggcgtcggagtgtcgcccgaacacctgaaccgtcttttcgagcgcttttaccgagtggacaaagggcgctctcgcaaactgggaggcacggggttaggactagccattgtcaagaatgccgttatcctccacggcggaaacatatcggccaaaaacagccagggaggcggtctggagtttgtattcaccctggctaaggagaggtag

SEQ ID NO: 3246 - DNA, 972 bp, B.fragilis
aaatactatctttgtcccatatcaaaacaaaagattatgatgaacaatgtaaaatacctttcatttgccttgatactggcattcagtgcctgtaaaagcggttccgcctctagtcaggagccttccgaaaagcaagatacggttaaaattttcaatttaccccagatacctgtagtactgaataccgtagaacaacgtacggactatatggtaaaacactattgggatcgtttcgacttctcggacaccacctacatcaatcaggccgaagtgcccgaacaggcttgggtagactattgtgacctgctggaacatgtgcccttgcctgtggcacaaactgccatgaaagaaactttcaaccgggcggagaagaaccggaagatgcttcatttctttgaggaactggccgataaatatctgtacgatcccaactcgcctatgcgcaacgaagaattctatatcccggtactggaagccctgattgcctctcccgcactggacgaaacggcgaagatacgtccgcaggcacggttggagctggcacagaagaaccggttaggcactaaggcactcaacttcacctacacattggattcgggcgccaagggtacgctttatcagttccctgcggaatacacactgctgtttatcaacaatccgggttgccatgcgtgcgcggagatgatagaggggttaaaggcttctccggtcatcaacggattcacagccgccaagaaactgaaagtcctgtccatctatccggatgaagaattggatgaatggaaaaagcaccgcaacgactttgcgaaagaatggaccaacggatatgataaagaactggtcatcaaaaacaaaaacctgtatgacctgagagccattcccactctttatttactggataagaacaaaaccgtattgctgaaagacgccaccctgcaaaaggtagagcagtatctggcagagcgcggctga

SEQ ID NO: 3247 - DNA, 1899 bp, B.fragilis
tacactaaccacctattatcacattcgattattatgaccccttatttacaagtagataatcttaccaaatcttttggcgatttggttcttttcgaaaatatttccttcggtattgccgaaggccagcgtatcggcttgatcgctaaaaacggtacgggcaaaaccaccttattaaatatactctccggaaaggagggatatgatagcggcaatattgtgttccgccgtgacctccgggttgattatttggaacaagatccgcaatatcctgaagaattgaccgtgttggaagcctgctttcaccatggtaacagtaccgtggagttgataaaggagtacgaacggtgcatggaaaccgaaggacatccgggactggatgacctgctggtacgtatggaccatgaaaaggcctgggagtatgaacagaaggctaaacagatactttcgcaactcaagatacggaactttgaccaacaggtgaagcatctctccggaggacagcttaagagggtagctttggccaatgctttgattaccgaaccggatttgctgattttggacgagcctaccaaccatctggatctcgacatgaccgaatggctggaagagtatcttcgccgtacgaacctcagtctgctgatggtgacgcatgaccgttactttctcgaccgtgtctgttccgaaatcatcgagatagacaaccgtcaggtttatcaatacaaaggaaattacagttattatctggagaaacgccaggaacgcatcgaagcgaaatcggtcgagatagagcgtgcgaacaatttatatcgtaccgagttggactggatgcgtcgtatgcctcaggcacgcggacacaaagcccggtatcgcgaagatgctttttatgaactggagaaagttgccaaacaacgatttaacaatgacaatgtgaagctggaagtgaaagcttcttatattggcagcaagatattcgaggctgatcatctctataagagctttggtgacctgaagatattggaagatttctcttacatcttcgcccgttatgaaaagatgggaattgtggggaataacggtacggggaagtctacttttataaaaatattgatgggacaggtgcagcctgacagtggtacactggatattggagagaccgtacgtttcggatactattcgcaggacggattacagtttgacgagcagatgaaagtcattgacgttgtgcaggatatcgccgaggtcattgagttgggtaacggcaagaagctaacggcttcccagtttctgcaacacttcttatttactcccgaaactcaacatagttatgtatacaaattgagtgggggagaacgccgtcgactttatctctgtaccgtgctgatgcgtaacccgaacttcctggtacttgacgagccgacgaatgatctcgatattattaccttgaatgtgttggaggaatatttgcagaacttcaagggatgtgtcattgtcgtttcgcacgaccgctactttatggataaagtggtcgaccacctgttggtattcaacggacagggagatattcgtgactttcccggtaattacagcgattatcgtgactggaaagaagccaaatcccaaaaggagaaggaggcggagaaaccacaggaagaaaaaacagcccgtgtccgcctgaacgagaagcgcaagatgagtttcaaagagaaacgggaattcgaacaactggaaaaggaaatagccgagctggaaacagagaaactacagatagaagaactgctctgcagtggtacgctttcggtagacgaactgacggagaaatcgaagcgattgcccgaggtaaacgatctgatagacgagaaaaccatgcgttggcttgaacttagcgaaatagaatcatga

SEQ ID NO: 3248 - DNA, 855 bp, B.fragilis
ggttatcaacattcagaaagcaatatgatacaaggcaagaaatttatctccccggggacatggttctcaatgatatatccgtcagactggagcgaatttgaagacggcgaaggctccttccttttttataatcccgaacattggacgggtaatttccgtatatcagcctataaagaagatgctgccgcacctggcggtatgaattatggaaaggattccgtccgtcaggaactgaaagaaaacccttcggcctccctggtgaaggtgggacatctggaatgtgcctacagcaaggagatgtttgaggaagaaggtacctattacaccagccatctctgggtgacaggcattgacaatgttgctttcgaatgttcgtttaccgtaccgaaaggagaacatgtggatgaggcggaaaagattatatccagccttgagatccgtaaagacgggcaaaagtatcctgcggaaatcattcctattcgcctttctgagatttatcaggtgaacgaagcctacgagtgggtgacagatacggtgaaaacgcaattgaaaaaagactttcagggactggaagaagacctgcaaaagatacaggatgtgattgacagtggcgttctctctcctaagaaaaaagaaccctggctggcgttcggtatcgccatctgtacgattctggctaatgaagtggagggtatggaatggatgacgctggttgacggtaaccgtgaagtgccggtgttgcggtatgaaggttcggaacagttgattgatccgatgaaattgctgtggagccgggtgaaagccggagaagcctgcgaagtggcagaggcatataagcaggcactgatacactaa

SEQ ID NO: 3249 - DNA, 390 bp, B.fragilis
gaagaaatgaaaaaaggaatcctattgttgtttgtcgtcctgatgggtttcacgtcgtgtggaaagaaattcgggcatcgctatctggatggaatgtggcagatgcaacgtatagaatataaagatggtaatatcgatactccactggacacttatttcagttttcagatggatatcatccacttgaggaagttgggtaatagtgagttctatggaaaatatgtctacgagaacgactccatgcacatacaagtactcgacgctacggcggaacagatgaaagttttcggcatggatggccgggtacaggactttgccgtagagaagctgaacagtaacaaattggttcttcagtcggactatgcccggttggaattcagaaaatattga

SEQ ID NO: 3250 - DNA, 1749 bp, B.fragilis
gatactaaagatactccagacattgaatcagtaattatcaaaagaatcagcaatatgaaaacaacttcattcaataacggcagaagcaattcctcttccctctttcggagaggtatcggaggcgtgtccttctttttcctcctcttcctgcttctcttcgcctcgtgcgatgacctggaagacacggataccccttcgggtggcgacggcggtatgcccgtcgaaaccggaacagccgaactctacatcctcagcgaaggactcttcaacctgaacaacagctcgctggctttgtattccttcaagaacaatcagctgaacaccgactacttccgcagcatcaaccgacgcggcctgggagataccgccaatgacatgggcatttatggaagcaaactctatatcgtggtcaatgtatcgagccagatagaagtggtcgacctgcaaagcggcaagtctgtcaagcagatacccatgctgtcagaaaacggaagttcccggcaaccccgcaacatcgctttcgacggaggcaaggcatacgtgtgttccttcgacggaacagtggcgcgaatagatactgcctctctttccatcgacgcactgacccgggcgggcagaaaccctgacggcatctgcgtgcagaacggaaagctgtatgtttccaattccggaggactggactgggaaggcatcggggtagaccgcacggtctctgtgatcgacatcccttctttcaccgaaatcaagaagatagaagtaggtcccaatccgggagatatacaggccgggccggatggcagcgtctatgtagccacgcacggcgaaaacatagaggcgggtgactatcacttcgtacaaatagacggtcataccgatcaagtggtacggactttcgacgaaaaggtgttgagcttcaccattcacgacaacatggcctatctgtataactacgactaccgcacccaagattctcaaatcaaagtcttcaatctgaaagccggaaagacagagcgggaaaacttcatcacagacggcaccacgatacgcactccttacagcatcagtgtcaacccttacagtggaaacgtctacatcaccgacgcttacgactataaggtgaaaggagatgtgttatgctttagtccgcagggacaacttatatttaagctgcccaatgtgggaatcaactccaataccgtcctgttccggaacaaagcctcccaaggcaatcctgacgaaaatcccgcagacgcggaagcaggcgctttcgccaataaagtattggagtataatccggcgccatcacaatatatgaatacctcttatactgcttacgaagagggattcaccggtattcaagtgttggcacgcgccaccgaactgctgcaggaccgcaccacctgtctcttcacgctcggaggattcggaggtaacattaccgtgggattcgaccataccatccccaacgtccccggtgaatatgacttcaagatatacggcaacgcctactatgatatgtatggcactctgctggataaacccggaggaaactccgaaccgggaatcgtgcttgtatccaaagacacgaatggcaacggattgccggatgatgagtggtacgaattggcaggaagcgaatataactcgcctgccaccatccgcaactacgaaatcatttactacccgtccccttcggcagacggggatgtgaaatggaaagacaatcaaggcaaagagggatacatctaa

SEQ ID NO: 3251 - DNA, 1241 bp, B.fragilis
  unsure (13),(14): Identity of nucleotide sequences at the above locations are unknown.
ttgaaacctgtgnncctgaccgctgtcgtccttccagccccgtggtgaagactacagctgtatttctggccaatgtagagaaaacacagttcccgattcccgtttcgggcggaggaaccaactatgcggatgtgctgacgaactaccagacaacgcgtgcgaatgcccggatcgtgttacccggtgccgagtttaccgacacttcggaattttatctggccaatgtatctttctcggatacctctgctcaaccttatgtactgttgcagcgtattatcagtatgctgaatttgcgaagagtgtttgtggatgcacaaaccgctttgaattctctgaccaataatattgtgacgcaagtagggtataagaatataatccggacgacggtacaaggcattttgcccgggttactgaaaacggcaatgaacttggggccggttggtaatcttgtctatgacgttgttggcggactcgatgccgcagtcaatctggtggtggcagcattggtagaaccggtcgtggatgcactgtatgcacaacttttgcaagggctggtcaatcagatagggctgactctttccggtaatgccacgcagaacggtgcattgggagcgttgggcgatttactgaatccctggcggggcagtgatgctgcttatgctttagtgactataaacaacttcccgaagactatggacttagacctgaatgtaaaggatttctatacgggcaatcatcgtttccggtatggattcacacctacacccggtacgacaaatagtgagaaagatattctgatcagaggttttcatggactatatgatgtgcgggagattcatgttgccaaacccggactgatctccggactattggtggatgacgtgattgacggtccgttgttactgaacggagtgtttgtgaatatcacagatccgatacaagcaacagtcaatacgaattaccgatatcgttcgaactattcgtttgtcagcctggggctgaaatcgtatgcacagcagagcgacggaaaccattcgctgacactctctgtacagttgaagaatattgctaacctggatggtatcttgggaggaattcctgtgctcggtcctgtgttgaatggaaccgttagattattgattggcaatataacggttaccgttccggtgaatcttcctttgcttggaaccgataacctgacgctgtccggtagctggagtacaccaccggtacaatattaa

SEQ ID NO: 3252 - DNA, 2109 bp, B.fragilis
actctgccaagtttatttagtgtgtccggccgaagtgagttagtccggacattttatcaacaaaaaacaaagatgaatatactcagattacctaaactattatactcctgtgttgctttctgttgctgccaggctcttaccgtttcgctttccgcccagcagcagaaagcagataccgcccgtacttattcaatccccgaagtaaccgttgccgaagcataccacaccagcgaagtgagagccatggctcccactcaggtgttctctaaagaagaactcaaaagcctcaacgtattgcaagtgtcggatgccgtgaaacactttgccggagttacggtgaaagactacggcggcatcggcggactgaaaaccgtttcattgcggagtctcggagccgagcataccgccgtgggatatgacggaataacgatcagcgactgccagacgggacaaatagacatcggacgtttctcactggacaatgtagaccgcctgtcactcagcaacggacaaagcgacaacatctttcagcccgcaaggtttttcgcttccgccgggatactgaacatacagacactgacaccgcaattcaaagacaaccggcgtaccaacctgagtgcctcgttcaaaacgggttcgtggggactggtcaatccgtctctcctgctcgaacagaaactgagccgtaaatgggtgctctccgccaacggcgaatggatgtcggccgatggtcattatcctttcacattgcattatggcgaggacaatgacctgacctcccgtgagaaacggaaaaacacggaagtgaaaaacctccgtgccgaagcgggattgttcggcaacttctcggatacggaacaatggcggctaaaggcctattactatcagtcgtcccgcggactgcccaatgccacgacttattattacgactactcttcacagcacctctgggataagaatgtcttcgtgcaaagccaatacaaaaaagaattcagccgccaatgggtcttccagacttcggccaaatggaactggagctaccaacgttatctcgaccccgactataaaggttcggaaggcaaaacggagaacagttattaccagcaagagtattacctctcggcttcggcgctctaccgggtgctcagcaacctctctttttcgctttcgacagacgcgagcatcaaccggctgaacgcgaacctgaaagatttcgcatatcctacccgttattcgtggctgacggcttttgccggaaaatacgttaacgactggttgacggcatccgcctcggtactggcaacggtcatcaacgaagaggtgcgccaaggcagcgccgcagccaaccggcggaaactctctccgtacgtcagcgcgtcgttcaagccctttgccagcgaagagttccgcatccgcctgttctataaagacatcttccggttgcccagcttcaacgacctgtactacgggcaggtgggcaacacgaacctgaaaccggaaagcaccacacaatacaacctgggactgacgtacagccgatcgatcaatgaactgatcccctacgtatccgtcacggcagatgcttattataataaggtgaaagacaaaatcatcgccatccccaccaagaacctctttatatggagcatggtgaacctcggcaaagtggacatcaagggaatagacattgccggaaacatcagcctgcaaccctgggagaaactacgggtgaacctttcggggaactacacttatcagcgtgcactggatatgaccgaaccgggagggaaaacctacaagcaacaaatcgcctatactccccgtgtatccggatcgggacaagccggcatcgagactccgtgggtgaacctctcctactcgttcctcttttcgggcaagcgctatatgctgggacagaaccttcgcgaaaaccggctggacagttacagcgaccacagtgtatccgtcagccgcgatctgcgcatccgtaacgtaaacacatccctgacagtggaagtgctgaacttgctggacaagaattacgagatagtgaagaacttccccatgccgggacgctcggtgagagtgacgatgaaagtaagatactaa

SEQ ID NO: 3253 - DNA, 1452 bp, B.fragilis
agcctctacggagatacaggcggtggaagatttacactacaagaaataattatctcacttatttatatatttaatttttgtaacatgaaaaaaataaatgctttaattactaaaatgtgctttattgcactttgtgctttgccaataatcatctcttcatgtaatgacgatgatgataaatattattatcctacgaatttcgaaaatctgagtcttcccaatgacactatcattgctaaaggtgaagatttaactttaaagcctaccctaaacctaattaaccctaaaatctattcttggaaaatagatggcaaagaggtatccaatgaggttaactacactttcagcacttcggttggaggaaaacacgagatcattttcgaagcacaagactctaaagggaacacggataaagcccaaataacagtagatgttttcgcatattacggtggtttctatgtgattaacgaaggatgggcaggtcacgatccagcctccgtaaattattataaagatggaaaatggaactttaacattgttgaatcacttggccaaacaggaactgttggagtcattcaagattcatacatgtatatcgtagctaaagatgctccatatctaacccaaatcgagctggctaacttcaacatcaccaaacaattaagtacagaaatagaagaacaattagactacggacaagcaaacagtttctgtacaattaatgaaactacaggtatattgaccgcaagcagaggtgcctataaaattaatttaaatccattatctatcggcaatatgctcccacaactcaatagcgagtcagccaacgggaacggctgtaaagacatcttgaagtcaggcgattatgtattcgtaaataatatggatacaataaagatctacaaatcttccgacctctctttcgtaaaaaaactaaccgctttaatgaaaacgggattcgcgcagacaaaagatggaaatatctgggccgccaacggccaatcgttaataaaaatcgatcctaaaacgttggacgaaaccactgttgagctacctgataatataaatgtgttttataatcaatgggcatatactcctacaggattatgtgcatctacaactgaaaatgcattgtatatagttaatactactgtcgtgccaggtgcttatggcgatagttactacggaaaaaacatctacaaatacaacacggaaagcaagattgctcaagaatttttcaaagccccttccaaaatacaatcaatatatggtgcaggcatacaagtgaatcctcaaaatggagatgtctatcttatttacactgaggatggctatggtgcgcattatttaaatactaatatttatgtggctgatggtcaatccggaacacaaaagcaaataattgactatacaggtaaatattggttcccttcaagcatagtttttaaataa

SEQ ID NO: 3254 - DNA, 720 bp, B.fragilis
ctttgtagtattacattaacaaagaatacaatgaacgattaccgtattttagtggtcgacgatgaagaagacctctgtgagattctgaagttcaatcttgagaacgaagggtacgaagtagatactgccaactctgcggaagaggccctgaaaatgaatatcagcagctatcacctgctgttattggatgtcatgatgggggaaatttccggattcaaaatggccaatctgctgaaaaaggataaaaagacagcgcaggttcccattatattcatcactgccaaagatacggaaaatgacaccgtcaccggattcaacctgggagcggacgactatatttcaaagcccttctccctgcgtgaggtcattgcccgtgtaaaggccgtgctccggcgtactgctacctccgatacggaaaaagcacccgaacaactttgctaccagtctctggtgatcgatattaccaaaaagaaagtaagcatcgacggcgaagaagtacccctgaccaagaaagagttcgaaatcctcttcctgctgttacaaaacaagggacgcgtcttctcgcgcgaagatattctgagccggatctggagcgacgaagtctatgtactggaccgcaccatagacgtcaacatcacccggttacggaaaaagatcggtacctacggtaaacgtatcgtcacccgcctgggatacggttattgcttcgaaacggaatag

SEQ ID NO: 3255 - DNA, 1203 bp, B.fragilis
aatatcaaaatgattaagatagatttcaagcaacgcaaacgtgaggtgctttggacggttgtcgctttgttctttatagctataggagtgtctgtgttcaagttctcttccgcaacttccggctttgagataactgacgagctgggaggaaatatttttccttctgccattctctcggtggctacgaccgatgcccaggtcattcaaccggccgactccatatatctgggtaaccccaagtcgtgcattgccataaaagtaaaatcacgttcggcttatagccgtgtgcggatcgatgttgcggaaacaccattcttttcacgttcggtgtcggagttcgtgctcaataagcctcgtacggaatataccatttatcccgatatcatttggaactacgaagcgttgaaaaacaataatcaggcggaacccatcagtgtggccgttacggtagagatgaatggggaagatctgggacagcgtgtacgcactttttctgtacggagtgtcaacgagtgtctgttggggtatgtgactaatggcacaaaatttcacgatacggggattttctttgccgcatatgtcaacgaagagaatccgatgatcgaccagttgcttcgcgaagcattgaacacacggatagtcaatcgcttcctgggctatcagaatccggctcccggagctgtggataaacaggtatatgcattatggaatgttttgcagaaacgtaaattccgttacagttcggtgtccaacaccagtctgtccagcaatgtggtttattctcagcgtgtacgtacgtttgatgacgcattggagtcatcacagatcaactgtgtggacggcagtgtcctgtttgcttccttgctccgtgccatcaatatcgaaccgattctggtacgtactcccggacacatgtttgtggggtactataccgacaattcacataaggatatgaattttctggaaacaacgatgataggtgatgtcgatctggacgacttcttccccgatgaacaactggactccactatggtaggcaagtcacagaatcaaatgtccctgctcacctttgagaagtcgaaacaatatgccaataagaagtataaggaaaacgagaaaggcattcattccggcaagctgaactatatgttcctggagatttcgaaagatgtacgccggaagatacagccgataggaaagtga

SEQ ID NO: 3256 - DNA, 810 bp, B.fragilis
cgaaatagaatcatgaacctgaccaattatcatagtcataccctctattgtgacggccgtgccggcatggaggattttatccgttttgccatcagccggggatttacgtcctatggtatttcttcgcatgcccctctgccgtttccgactcattggacgatggaatgggatcgtatggacgactatctggatgaatttacccggatgaaagagaaatatgcttcggaaatcgaactggctgtcgggctggaaatagattacctgaacgaagacagtaatccttccgtccggcgtttccaagagttgccgctcgactaccgtatcggttcggtacatctgctttacaatgaccgggatgaagtagtggatatcgatgtatgtgcagaggtgttccgggatatcgtcgatcagcatttcggcggtgatctcgaccgtgtgattcatctgtattatgaccgtctgctacgaatggtcgaactgggaggctttgatattctgggacacgccgataagatgcatcacaatgcagcctgttaccgccccggtctgttggacgagtcttggtacgatgcattgatacacgactatttctccgctgttgcagccaaaggatatattgtagagatcaatacaaaagctttgcatcatttgaatactttcttcccgaacgaacggtatttcccgttgctgaaggagttgggagttcgtgtacaggtgaacagtgattcgcattatcccgaacggatcaatagcggacgtcccgaggcagtcttcagcacggcaaggaaggatcagcggcggtgtagggaa

SEQ ID NO: 3257 - DNA, 1419 bp, B.fragilis
tatttttattctatatttgtacttagtcatgaaaacgtcagacacacaacaagcaaattgaacatggagaataaaaaaggacaacctactacagaggcaatctttaggggaatacagtcaggaaaagtattagagctttttgacaaactacaatatcagatcgccattcatggtgatctgacttatagtgatccttggggggaagtacaccggttcagggatcaatttgaaagtgcgaaacgcgactcggattcaccaactgcgatagggcgctatccgtttgccgatgtatggatacaattttacgagatggaagtgaaggattattcgcttctactggaaatgtgcctgatggcatcccattcacggactagtgtctggcgtaaaggtttcgggacgttactcgataaattatacggaaaaatacctttggtggagtacgaacaggcattggaacatctggaacacccctatgccctgagtgaaattctctgggctttggagtgggactatcgggaccaggaggtgtatctgaagttttcacattacatcctgctccatcttttgcccttgcttactccccggaatatcacctttctgtatagcgtgcgcgagtggtttggttccaccagtgatcatcgtgtcgtgcttgttcattgttattggatagactgctggctgaagcacccgaaacgtttactgaccgatgatgaatttacggccgatttcaagatacgttacgaactctatcgtttgtgtaatttcttatcctataaggaagagccctatccgcttgagttccctattcgtgctgtcgacttcgggagagcctgtcagatggggcttctgtccgaagatacgttgatggtcgaactgatggatcgtcccctgtcgcctgtgttgatagaagaggctgtggactttttctataagaaagaccaaaaggagaaacggctgtatactgattgccgggattatgatttcagccgtttcaagaaagtattggaaaaagtaacggaacgtatcctcgacatcgagctggaaaggggagaagcctgtaccgatgtcacttcgttggctcggaaactggacggggtgaccggagccgaactgatgatccgcttgttgagtctgatgggtaaggagaaattcatacggctcgataaatggtactacgataccggcgaaagccgtacaggtatgttctgtcatctgatgttacattgcgctccctcgccgacagatacgccggactggttgaagatgctcgtcgaacgggcgggtatcactccgaagcgcctggtggagatggccgtgtattctcccccgttggctggagatggtagaagaggctatcggatggaaaggcctgacttgtgcggcaaatttgttttatgcttacacaagggagtgttatga

SEQ ID NO: 3258 - DNA, 1230 bp, B.fragilis
cctcaaaactcctattttatgagctctactcaaaaaaactttgctctgccgttagcatttatcggcatcatgttcttcgccatcggattcgcattaggaatcaattctgtacttattccggtattacaaggttctttaggcatcacttcagccgaatcttacctgataatcgctgccactttcgtacctttcctcatcttcggctatccggcttcgatgactatcaaagctatcggatacaaacacaccatggcactttcgtttgccatgttcgctgtagctttcggtttgtacattccatcggccagccaggagagttttcctctttttctggtagcctcttttgtcagcggcacggcaaacgcattcttacaagcatctgttaacccctatattactattctcggcccattggacagtgcagccaaacgtatcagcatcatgggcatctgtaataagttagcatggccaattcctcctttgttcctcgctttcctgataggcaaggaagtgagcgacattaccgtatcggacttattcactcccttttatgttattattgcagcatttattatattaggcatcatctcactgatggctccgctgcctgaagtaaaagcagccggcgaggacgacagtgaaggaggtgccgaggcatgtccgtatgcagccagcaaaacctcagtatggcaatttccgcaccttttgctgggatgtcttgccctcttcctctacgtaggcgtagaaacggtttcactgggaaccctcgttgactatgccaacagcctgcatttggagaatgccgcagcttatgcctggattgctccgatcggtatcgtgatcggatatatctgcggtatcatctttatacccaaatacatcaatcaggctacagcattaaaaatatgctcaatcctcgccattgccggttcaattctggtagtactcaccccggctgacatctcaatctatttcattgcattcatagcactgggttgctcactgatgtggcccgcactgtggccacttgccatggcagatttaggtaagttcaccaaagccggctcttctctgttgattatggctatggccggaggtgctgtcatccctactctgttcggctacataaaagacatagcgggagcacaaaatgcttattggatttgtctcccatgtttcctcttcattctttattatggaatggccggatataaaatcagaacaaaataa

SEQ ID NO: 3259 - DNA, 903 bp, B.fragilis
  unsure (91),(92),(93),(94),(95),(96),(97),(98),(100),(101),(102),(103),(104),(106),(107),(108),(109),(110),(111),(113),(114),(116),(117),(118),(119),(120),(121),(122),(123),(124),(125),(126),(127),(128),(129),(131),(132),(133),(134),(135),(136),(137),(138),(139),(141),(142),(143),(145),(147),(148),(152),(153),(154),(156),(157),(159),(160),(161),(162),(163),(170),(172),(174),(175),(177),(178),(187),(188),(196),(201),(203),(237),(238),(275),(319),(320),(346),(360),(361),(392),(439),(498),(511),(528),(550),(630),(634),(741),(747),(755),(878): Identity of nucleotide sequences at the above locations are unknown.
gcatatacttttatctttaaggttagttatcgttttctctgtactctctgtacgggaagcatagactttaggagtgctgacatgggggtgnnnnnnnncnnnnntnnnnnngnnannnnnnnnnnnnnntnnnnnnnnncnnncncnncttnnncnncnnnnnccccccncncnncnnccctccccnnccccttcnccctncncctccccccccttctctttctctcttccttctcnnccctctttttctttttccccttccccccctttttctncctcttttttttcctcccctttcccctttcttctcctttttttnncccctttccttttctcttccttttcnttcctttctttccnnttcccctccttttctccttcttccctttctnttcccttccttccttcctttcctctcctttttctccttatccctccnccttcttcctttttctcttccctcctctctttccctctccctccccttctctccctttnttccttcttcccncttctcctttttttccnttcttcccttttcttcctttcncttcttctttctttttttttccttttttccccctttttctttttttcctctctccctttcctttttttttctccttttcncttnccttcccttttttccctcttcttttcttttcccttcccttccttttccttcttctcttttcctctttcctttcctccttcttctttccccctttcccctttcctctncccccncttctttntctttttctcccccttttctctttttctttctctctcttttttctttcctctctctctttttttctttctttccctttttctcttcttctttcctcctccttttcttttctttctttctcctntctcttctttttcccttctctcccc

SEQ ID NO: 3260 - DNA, 765 bp, B.fragilis
accctattaccggactcactggatatcgggaggcagagtacgcaaataacctttattgaaataaaaaattcactatctttgccgaaaattccgcaaatgaaatacactgtttatttattcgactttgactatacactggcagactcttcgcgtggcatcgtaacctgcttcagaagcgtactcgagagacatggctacaccggtatcactgatgatatgatcaaacgcaccattgggaaaacgcttgaagaatcgttcagcatccttacgggaattactgacgccgaccaactggaatcattcagacaagagtattccaaagaggcagatatatacatgaatgcaaataccattcttttcccggatactctccccacgcttacacacctgaaaaaacagggaatccgtatcggaatcatttcaaccaaataccgattccggatactgagtttcctgagaaatcacatgccggatgattggtttgacatcattatcggaggtgaagatgtgacacatcataaacccgatcctgaaggtttgctacttgccatcgaccgattgaaggcatgccccgaagaagtattatacatcggtgacagtacagtggatgcaggaacagccgccgctgccggagtttcttttaccggtgttaccagcggtatgactactgcccaagagtttcaggcctatccctacgacagaatcatcagtactcttggccagctaatctccgttccggaagacaaatccggctgtccgctctga

SEQ ID NO: 3261 - DNA, 435 bp, B.fragilis
aagtatatgcctataaactatgtagtcaggaagaaaaaagatcagagcggtaatgaagttaaagagctctactatgccgtgcccagtgccattcagaacaaaggagtcagtgaaaaacaattagcggaggacctgcacgacaacagttcactctcggcaggcgacgtactgtctgtactcgaacaactcccgaaagccatcgcacgacatatgaaagaaggaagaaccgtcactatccgcggattgggaactttctacccggccttaagcagcgagggctgcgaaactcccgaagaatgtacgcccaacaaagtcagattgacacgcatttgcttccgggccgatactgcgttcacctacgacgtgaaacattgcgaattcgaaagcatgcaactgcgatttacaaagaggccgaagcccggtaaggaagagtga

SEQ ID NO: 3262 - DNA, 423 bp, B.fragilis
tggcgttggccggtgaatacgggttggtttatacgagatatgccgatgatcttaccttttcgggtgattatttgccgaaagatgaagttttggtacgaatccacaggattattcgggaagaagggtttcacgatgaacgtcaaaaagacccgcttcttgtctgaacataaacgtaagattattacgggagtatcggttagctcaggcaagaagatgactctgcctaaagtgaagaagcgggagattcgtaagaatgtgcactacgtcctgacaaaagggttggtcggacatcaggaacatattggttctaccgatcccgtttacttgaagcgtttactgggcagtttgtgttactggcgttccatagaaccggacaaccgatatgtatccgattccatcacagctttgaagagattaatgtga

SEQ ID NO: 3263 - DNA, 564 bp, B.fragilis
tttgaatacactgctattgaccccccggtgaagaccattggttctattcctattatcatcaatctgaaagagaaagggaaggacgtaaatgctacgaaagcaaccgttatttcgtttgcattgatgattggctttttctatgcgggtgactttatgttgaaactgtttcatgtagatattgaatcttttgctgttgcaggcgcatttgtcattttcctgatgtcactggaaatgatcttagatgtggaaatttttaagaatcaggggccgataaaagaggcaacgctggtgcctttagtattcccgttgttggccggtgccggtgcatttactacactactttcattacgggccgagtatgccagtatcaatattgtaattgctttgatcctgaatatgctatgggtttattttgtcgttagtatgacagggcgtgtggagcgttttctggggaaaggtggcatctatattatccgtaagtttttcggtatcattttgttggctatttctgtcaggctgtttactgcaaatatcacattattgattgccgcattgcagaagtaa

SEQ ID NO: 3264 - DNA, 1293 bp, B.fragilis
acaggcacgacgggaaacacatcaataaaagttatgaatataaaaaatcgtttgattattatgaacttcctgcaattctttgtatgggggtcgtggttaatttcactaggtggctatatggaaagaggcctccattttgaaggtgggcaaatcggagccattttcgcaacaatgggaatcgcatccattatcatgccgggaataacaggcattatagccgacaaatggttcaatgccgaacgcctttatggtatttgccacttgctgggagccggctgcttgttctacgcttctaccgccaccgactataatcaaatgtattgggccatgttactcaatctaatggtttacatgcctactctttcgctcgccaatactgtttcgtacaatgcactcgaacaatataaatgcgatttagtaaaagacttcccgcctatccgtgtatggggaaccatcggtttcatttgtgctatgtgggcagtggaccttaccggattcaaaaactcgagtgctcaactttatgtcggagcaagctcagcattacttctcggactgtattctttcactctgcccccatgcccccctgcaaaaaatcagagcaaaaccctattgtcttctttcggtctagatgccctcagcctattcaaaagaaaaaagatggctatctttttctttttctcgatgttgctgggtgcagccttgcaaatcacaaatacatatggtgatgcatttttggggagtttcgccaaaatacccgaatttgcagactctttcggtgtcaagcactcggtaatcctgctgtccatctcacaaatgtccgagacactgtttatcctggccattcctttcttcctgaagcacttcggaatcaaacgtgtcatgctcatcagtatgtttgcctgggtattccgattcggactgtttggctttggtgatccgggatcaggcatctggatgctgattttatcaatgatagtatacggtatggcatttgatttcttcaacatttccggttctttatttgttgaattggaaaccaaacctgagacaagggccagtgcacaaggtttgttcttcattatgacaaacggattgggcgctgtcatcggaggatatgccagtggagccgtagtggatgcattctctgtatatgaaaacggaatgttggcaagtcgcaactggccggctatctggttcatatttgcagcatatgcactggctatcggtattttgtttgcaattgttttcagatacaaacatcaaccgggagaacttaagaaagtgaacaattaa

SEQ ID NO: 3265 - DNA, 720 bp, B.fragilis
cacagttttgcaacagatatggtaaagatgaatttgtcagaaataaacgttcccgaacgtattgcagagatgtgggctcctctaaacgcagagcaaagggagttcctggccaataatttcacccttcaaaattacaaaaagaatgaaacaatttattgtgaaggtgaatcacctacctatctgatgtgtctgcttagcggcaaagtaaaaatctataaagacggtgtaggaggcagaagtcagattatacgcatgataaagcctacagaatatttcggttaccgagcttactttgccaaagaagactatgtgactgccgcttctgcgttcgaaccttcaaccatctgcctgattcccatgagtgctatcatgacactggtaagccagaacaatgacctgggtatgtttttcattcgtcaattgtctatcgacctcggtattgccgatgaaagaaccgtcaatttgacccaaaaacacattcgcggacgcttggccgaatcactgcttttcctcaaagaaagctatggactggaagaagatggctctacgttaagtatctatctttcacgcgaggatttggctaacctatcgaatatgactacttctaatgccatccgtacattatccaacttcgcaaccgaacgactgatcaccatcgacggacgaaaaatcaagatcatcgacgaggaaaaacttaagaagatcagcaaaataggataa

SEQ ID NO: 3266 - DNA, 756 bp, B.fragilis
ccggtccttgcgtcatcgaaggcgaagagatggctatgcgaattgccagaaaaaatagtaaatatcaccgataaactgggtattccctatgtatttaaaggttcataccgtaaagccaaccgttctcgcttggattcattcatgggaattggtgatgaaaaagcgttgaaagttctcgagaaagtacacaataccttcggagtgcctaccgtaaccgatattcacgcagccgatgaagcagccatggcagccgattatgtagacatcctgcagatacccgctttcctctgccggcaaacggacttactggtcgctgctgctcaaaccggaaaaacgattaatatcaaaaaaggacagttcctctctccgcttgccatgcagtttgcagcagacaaggtgatagaggccggcaacaagaacgttatgctgactgaacgtggaacaactttcggttatcaggacctggtcatcgactaccggggcataccggaaatgcaatctttcggttatccggtcatcctagatgtaactcattcattacagcaacccaaccagacgaacggtgtaacaggcggtatgccgcaattgatcgaaacggtagccaaagccggcattgccgtaggagccgacggtctctttattgagacacacgaaaatccggcagtagccaaaagcgacggtgccaatatgttgaaacttgaccggttggaaggcttattgactaaactggtgaaaattagagaagcaatcatgtga

SEQ ID NO: 3267 - DNA, 987 bp, B.fragilis
gagtttaacgcctgcttttcacttcctttttcatatctttgtaacgttattaataaagatatgaccatgccggactatgatctgattgccattcttggccctaccgcttcgggtaaaaccccttttgctgccgcattggccgcagagttaaatactgaaatcatcagtgccgattcacgccaaatctatcggggaatggatcttggtacaggcaaagacctggaagactacactattaacggccgacaaatcccttaccacctgatagatattgctgatccgggctataaatacaatgtatttgagtatcaacgtgatttcctgacagcttacgagactattaaacaaaaaggatgtctccccgttctatgtggagggacaggcttgtatctggagtcggtactaaaaggctatcgcctgattccagttcccgaaaaccaagagttgcgtgtacgcctggccgaaaaatcattggaagaactgactgctattttaagcagttataagacacttcacaattcgacagacgtggataccgtcaaacgggcaatccgtgctatcgaaatagaagagtattatgcaaagacaccaatagaagaacgggagttcccacaactgaacagcctgattatcggagtggacatcgaccgtgaattgcgacgggagaaaatcacccgccgccttaaacaaagactggacgacgggatggttgaagaggtacgtcgtctcctggcagagggaattcagccggatgatctgatttattatggattggaatacaaatacctgactttgtacgccattggcaaaatgacatacgatgaaatgtttaccggtctggaaactgccatccaccagtttgccaaacggcaaatgacctggtttcggggaatggaacgaagaggtttcaccattcattgggtagatgcttcactcccaatggaggaaaagattaactttgtaaagcagaaactcaaagagttttag

SEQ ID NO: 3268 - DNA, 2832 bp, B.fragilis
aacagtatagcaatgaaacatttattccgtggtttacttttggttgcagtcatcttatgctgcaacttccaacaggcctttgcacagcaaatgccgcccatccctatcgacaagaacgtacgtattggaaagttggacaatggtctgacctactacatccgtaagaacaatctgcctgccaaccgggctgacttctacattgcccagaaagtgggttctattcaagaagaagaaaatcaacgcggattggcacacttcctggaacacatgtgttttaatgggacaactcacttccccggtgatgccttgaagcaatatctggagcgtatcggcgttaaattcggtgaaaacctgaacgcatatacggctatcgatgaaacggtttacaatatctccaatgtacccgtcaaaactcccggtgcagtagactcctgcctgctgattctacacgactggagcaatgacctgacactcgatccgaaagagattgataaagaacgcggcgtcatcaatgaagaatggcgtacacgcatgagtgccatgatgcgtatgcaagagaagcttctgccaatgatgtatccgggtgacaaatacgcccatagcttccccatcggcaccatggacgtagtgatgaattttaagccgcaaaccttgagagactattacgaaaaatggtatcgtcccgacttacagggaatcgtcatcgtcggtgatatcgatgtagatgccgtagaagctaaaatcaaaacaatgtttgccgacatccctgcacagcctaatgcggcagaacgtatctactatcccgtcgcagacaataaagaaccgattatctgtatcttgaaagacaaggaacagcctcatgtccaagttctactcttcaataaacacgaagcagttcccgataaccagaaaggaaatgtggactatctgatacagcaatacgccaagaatctgatcagcattatgctgaatgcacgtttgaacgaactggttcagacagccaatccaccctatatttatgcaggagcagacgatagcaacttctttgttgccaaaaccaaagatgcatttctggggatcgtggtttgcaaagaggacagcatcgaaaatggtatcgccgccatgctccgcgaattagaacgtgcccgccaattcggcttcaccgaaacagaatacaatcgtgcccgtgccgaatacttgcgtcagttggaatcttcttacaatgaacgtgacaaacagaaaaacgaaaagtatgtaaatgaatatgtccgccactttcttgataacgaacctataccgggcatagagaacgaatatacaatcatcaaccagatcgcccccaatattccggtggcagcaatcaaccaattgatgaaaggactgattacagacgacaatcaggcgctggcccttttcgcacccgaaaaagaggatctgaaactaccatccgaagccgctatcgcaaaactgctgaaggatgcaaaaaccgaaaagctgactgcctacgtagataaagtatcagacgaacccttaatggctgaagcgccgaaaggtggtaagattgtttcggaatcaaaagacgacatctttggagcaactactttgaccctttctaacggagtaaaagtgattataaagaaaactgatttcaaggcagatgaaatccggatgaaaggtgtcagcctgggaggtagttccgtattcccggattcggaaatcatcaatataaatggtctggatgcagtcggagtcggtggtttgggtaacttcagtgctgtaaaccttgaaaaagtgctcgccggaaagaaagcatcggttagttacgatatcgcaaacaagaccgaaagcgtttcaggaagttgttcacccaaagatttcgaaacgatgatgcaactcacttaccttacatttacagcaccgcgtagagacgatgatgcatttgcttcatataaaaatcgtaataaagccgcattaaagaatcaggaattgaatccgaatgtggccttcagcgactctatccaagccggcatctatatgaaacacccgagaatcatacgcataaaagccgacatggtggatcaaatggattacgacaaaattctgtctatgtatcaggatcgcttcaaagatgcaagtgacttcacatttatctttgtcggtaacgtagatgtagagaagatgaaaccggtaattgccgaatatctgggtgcgctccccgccgttaaccgcaaagaaactttcaaagataacaaaattgaaatgcgtcaaggcatttacaagaacgagtttaccaagcagcaagagacaccgaaagcttccgttttcgctttctacaacggagattgcaaatatgacctgagaaacaacctcttgcttagcatgacaagccagattctggatttggtctacacagaaaaagtacgtgaagacgaaggaggtacatatggtgtatatgtaggcggaacgctacaaaaatatccaaaagaaaaagcaatcctgcaaatcatcttcgatacggctcccgaaaagaaagagaagctgatgaagatcattttcggagaaatcgataatataacgaaaacaggcccgtcggaagccaacttgaacaaagtgaaagaatatatgctgaaaaagcataccgaagacctgaaagaaaacagctactggctgggaagtatcgacgaatacttatataccggcatgaaccgcatgaatgattatgaaaagatagtcaatagcattacggtgaatgacatccggaaattcgctgacgacctcttcaaacagaaaaatgaagtggaagtgacaatggtcagcccggaaaagaaataa

SEQ ID NO: 3269 - DNA, 276 bp, B.fragilis
gaagaaatggcacataagaaaggtgtcggtagttctaagaacggccgcgaatcacagagcaaaagattaggcgttaagatatttggtggcgaagcttgcaaagcaggtaacatcatcgttcgtcaaagaggtactgaattccacccgggtgaaaacatcggtatgggtaaggaccacactcttttcgctttagtagatggaactgtaaacttcaaagtaggtagagaagacagaagatatgtttctatcatccctgctgaagcaacagaagcataa

SEQ ID NO: 3270 - DNA, 1113 bp, B.fragilis
aatataggggcaggaatatgtacttttgttccccgaaaggaagaagaagcaatgaaaaacaggaaacgaatcatacggtactctgttttagggactttaatagcccttgtctggctcactcagatgctcccggcattgggcgaagggtatgcccgtacggcctatccggtcatttcatatatcttgtccggtttttcgaacattatcccctttgcattgggtgacttatttatagcactgagcattggaggaatgatcgcctatccgttttatgcacgaatccgactgaaattaagctggaaaaaaatactgagaagggatgtggaatatttgctatggatctatgtttggttctatctggcatggggactcaactattcacaaaagaatttttatgaacgaaccggaattccatatactgcctacactcccgagattttcaatgaatttgtagacaactatatctcaaaactgaacgaatcgtatgtgccggtcaatcggatcgataaagaagtaatccgcaaagaggcagtccgacaatataacctgatcagtgatacactaggtatacaccgtcccacacactcccgtcctcgggtaaaaaccatgatgttcactccattgatttcgatggtgggcgtgacgggtagcatgggacctttcttctgtgagttcacactgaacggagacctgcttcccccacaatatccggcaacctatactcatgagctggcacatttgctaggtatcaccagcgaagcggaagcaaacttttatgcatatcaggtctgcacccgctccgtaaataaagaaatccgtttcagcggttatttttctattttaggccatgtacttgccaatgcccgccaattgatgacagaagaggaatataaaaagttattcggcagtatacgtccggaaatcattgagctggccagaaaagaccaggaatactggatggcaaagtatagtccgcttataggtgatattcaggactggatatatgatttgtatctgaaagggaacaaaatagaaagtggacgtaagaactattcggaagtgatcggtctgctgatttcatataatgaatggaaaaaagaatcaaataaataa

SEQ ID NO: 3271 - DNA, 1023 bp, B.fragilis
accataatttaccatataaagaagaaatatcgtaaattaatgcaaaagaagacgaaggagagtcctaagcaacaggacgatttatcactgaaaaacaagcacttaacaattcataaggaattataccgccagagaacttgctttaatgcccgtttttttttatatctttgcagaatatttacgagaacgattgttattatgacaaaggctaacaaggttttatttattacacaagagattactccttacgtttcagaatccgagatggccaatataggcagacatctaccacaagctatccaggaaaaaggcagagaaatcagaacatttatgcccaaatgggggaatatcaacgaacgcagaaatcaattgcacgaagtgatacgtctttccggcatgaacctgatcatcgacgacaccgaccatccacttattatcaaagtagcttctatccagtcagcacgtatgcaggtttatttcatcgataacgatgattattttcagaaccggctgcagacagctgatgaaaatggggttgaatacgatgataatgatagccgggctatcttctatgccagaggagtgctggaaacggtaaagaaattgcgttggtgtccggacgttattcactgtcatggctggatgacggcattagcccctttgtatataaagaaagcgtataaagacgaaccttcgttccgcgatgcaaaagtagtattctccgtatacgaagatgatttcaaaggtacattcaccaatgctttggcaagcaacctgatgttaaagggtattaataaaaaagatgtagctaccctgaaagatccggtagattatgttacactttgcaaattagctgtcgattactcggacggaatagtacagaatagtgaacatgtaaatgaagatgtcatgaactacgcgcgtcaatcgggcaaattggttcttgactatcaagctcccgatgctcttgcagatgcttgcaacagtttctacgatcaagtgtgggaagctgaacaaaaataa

SEQ ID NO: 3272 - DNA, 267 bp, B.fragilis
gttttcctccataataatcttaaagcctgttatttcgataacgaaggtgtggcaaccgaactttgtccggtatttgaggggacgatttcagcggactctaaaaccttttgtacgcttctcatacgaaaaatgaatttcgatcttccatcttccactcttcgttttagtagagaacgtaaacgtaacggtttgacatatggtgtgatgtatctgttatcttatttgtttatgcctataaaagcattttgttttccttcgtatctttag

SEQ ID NO: 3273 - DNA, 588 bp, B.fragilis
gaaagtgaacaattaacaatggataagaaagtagaattacaggtattgaacatttctaacagccaggcgcaggtaggtgcctatgcaatggtattgggagaagtagatggcgaacggcagctacctattataataggacctgccgaggcacaagctacagccatttgcctgaaaggaataaaggccccacgcccgctgacacacgatttattctattcgtgtctgaatgttttgggagcaactctgctccgggtactaatatacaaagccaaagaaggcgttttctattcgtatatctactttaaaaaagacgaagaaattattcggatagatgcccgtacctcggatgcagtggcactggccgtcagggcagattgtcctatctttatatacgaatctattcttgaacgcgagtgtatacggttgacagacggggacgaacgtcccgatactccggaagaggatgaaaactcacgcacggagccggtcagcattatttctcttgaagaagcattgaataaagccattcaagaagagaattacgaactggcagcccgacttcgtgacgaaataaaccgacataaataa

SEQ ID NO: 3274 - DNA, 1197 bp, B.fragilis
aaacaacataataaatttatgcataaagtatatcttaaacccggcaaagaagactcattgaaacggttccacccctggattttttctggtgccatcgcccacttcgacggcgaacccgaggaaggtgaagtagtggaagtgtacacctcaaaaaaagaatttattgccaaagggcatttccagatcggaagtattgctgtacgtgtactttcgttcaaacaagaagagattaaccacgatttctggaaacacaaattggaagtggcctacgacatgcgacgcagtattggcatcgctaccaatccgactaacaatacctatcgcctggtacatggagaaggcgataatctgcccggactcgttatcgatgtttatgcccggactgctgtgatgcaggcacattctgcaggaatgcatgtagaccgtatggccattgccgaagctttgtccgaagttatgggtgatcagattgaaaatatctattataaatcagaaacgaccctcccatttaaagcggaccttttcccggagaacggtttccttaaaggaggaagcagcgacaacatcgctcaggaatatgggctgaaattccatgtagactggctgaagggacaaaaaacaggattttttgtagaccagcgtgagaatcgtgctctactggagcgttatgccaaggggcggtcggtattaaatatgttctgttataccggaggcttttccttttacgccatgcgtggaggtgccaaacaggtgcactcggtagacagttctgcaaaagccatcgatctgactaataaaaatgtagaattaaacttcccgggagatacccgtcatgcagcctttgctgaagatgctttcaaatatctcgaccgtatgggtgaccagtacgacttgatcattcttgatcctccggcatttgccaaacataaggatgcgctgcgcaatgcccttcagggctaccgcaagctcaatgccaaagcatttgagaaaatcaaaccgggtggtatcttattcaccttctcatgttcgcaagtagtgaccaaagataatttccgtactgctgtatttactgctgccgccatgtcgggcagaagtgtacgtatactacatcagttgacccagcccgcagaccatccggtgaacatctatcacccggaaggggaatatctcaaaggattggtgctctatgtagaataa

SEQ ID NO: 3275 - DNA, 2292 bp, B.fragilis
ataatgaacaaaatcattagcaaagaacacttttcggagaaagtattcaaacttgtcattgaagctccgttgatagcaaaatcacgcaaagcaggtcatttcgtgattgtgcgtgtcggtgaaaagggagaacggatgccactgaccattgcagccgccgacccgaaggcaggaacgatcaccctggttgttcaggaagtagggctctcttctacccgcctttgcgaactaaacgaaggagactatatcaccgacgtagtaggtccattgggacaagctacccacattgaaaacttcggaacagtagtatgtgccggaggtggcgtaggtgtagctccgatgctacccatcgtacaggccctgaaggcagccggaaaccgtgtgatcaccgtactggcaggacgtagcaaagaactgatcattcttgaaaaagaaatgcgtgaaagttcggacgaagtgattataatgaccgatgacggatcatacggtcgcaaaggcttggttaccgaaggagtagaagaagtaatcaaacgggagaaagtgaacaaatgttttgctatcggcccagctatcatgatgaaatttgtttgtttgctgacgaagaaatatgaaattccgacagaagtatcattaaatacaattatggtggatggcaccggaatgtgcggcgcctgccgtattactatcggaggaaagaccaaattcgtatgtgtcgacggtccggaatttgacggtcaccaagtggacttcgatgaaatgttgaagcgcatgggagctttcaaaaccatcgaacgtgaagagttgcataaactcgatgaatgtgaagcaaccaaagtcatagacgaaaacggacgtacagccccttggcgcgaagcactccgtaaagctatcaaagctaaagaccgtgcgaacattgaacgctgccaaatgaacgaactcgatccggagtaccggtcacacagccgtaaagaagaagtcaatcaagggctgactaaagagcaggcagttacggaggcacagcgctgtctggattgtgccaacccaggctgcatgacaggttgcccggtaggcatcgacattccccgtttcatcaagaacatagaacgtggagaattccttgaagcagccaaaacactgaaagagaccagtgccctgcctgccgtatgcggtcgtgtatgtccgcaggaaaaacaatgcgaatcaaaatgtatccatctgaaaatgggcaaagaagccgtagccattggtcacctggaaagatttgctgccgactacgaacgagaaagcggacaaatctccgtacctgaagtaggcgagaaaaacggtatcaaagtggctgttatcggttccggtcctgccggactatcctttgcaggggatatggccaaatatggatatgatgtaacggtattcgaggcgctacatgaaattggcggtgtactgaaatatggtattcccgaattccgtctacccaacaaaatagtagacgtcgagattgagaaccttgccaaaatgggagttacattcatcaaagactgcattgtagggaaaacgatcagcgtagaacagttggaagaagaaggttttaagggaatttttgtagcctcaggagccggacttcccaactttatgaacatcccgggtgagaactcgatcaacatcatgtcttccaacgaatatctgactcgtgtaaatctgatggatgcagccagtcccgattccgatactccggtagccttcggaaagaacgtagctgtaattggtggcggtaacactgccatggactctgtccgtacagccaaacgtcttggagccgaacgggctatgatcatctatcgccgttcagaagaagaaatgccagcacgtctggaagaagtgaaacatgccaaagaagaaggtatagagttcctgaccttacacaacccaatcgaatatttggcagacgagcaaggacgtgtcaaacaagtaatcttgcaaaagatggaattgggtgaaccggatgcctccggacgacgtagccccgtccccatcccaggagcaacagaaaccgttgatatcgatctcgccattgtcagtgtcggggtatctcccaatcctatcgtccccagttctatcaaaggtctggaattgggccgtaaaggaacaatcactgttaacgatcagatgcaatcgtctattcccactatttatgcgggaggagatattgtacgcggaggagctactgtcatccttgccatgggagacggacgccgtgccgcagcagcaatgaacgaacaattgagttccaagtag

SEQ ID NO: 3276 - DNA, 1524 bp, B.fragilis
acaaaaataaataagaacctagatacgacgatcatgaaagcaaaatatgtatgggtagcactgcttgccttgactttcttcggatgcgatgataatacaggtactatcggatgggatatgcttccggatagcgaccaaaatatcaatggaagatatacgacttacgagttaactacgaattccgacctatcaggtcctgtttttgccaaaaccagcgtaggttatgtgggaaaattcactgataaagaattcggagaatacgaagccagtttcctcgcacagttgaatagtccggatggaatttcttttccttcggtctacgatccggaaactaatcccaaaggggtaatggcaggagactctattcacaccgctgaattgatcttatactataaaagttattttggagactctatcaatccatgccgaatgactgtttatgaactggacgaaaacttgacccagaactattatacagacatcgatccattgaagtattacaatccaaacaacttactcgcacgaaaagcctacacagctgttgaccaatcactcagcgattccatcagaaactcagatgacttttatcctaatgtccgtctaacttctgaagagatcacgaaactaggtaaacgtatctatcgtttgaacagagatcaccctgaatattttaaaacttcggaagcatttattaataacgtattcaaaggtatttatgccaagaatgactatggtaacggaacgattctttatgttgaccagatcaacctgaatgttgtaatccgatgccacgaaaaagacagcttgggaaataatctgaagaaaaaaaatggtgctgactctttatactacacaacccgtactttcgctacaaccaaggaagtaattcaagccaataagtttgttaattctgaaaaactaaacgaaatcgctaaaaagacagactgtacttatttgaagtctccggccggtatcttcacacaagctacattgccgatcaataagatttatgaagaattaagccatgacaccattaatgcagtgaaactgactttcaatagctacaaccaaccggacaatgggaaatttagtatgaaagcacctacatatgtgttacttttacgtgagaaagaacggcaaagtttcttcgaagagaacaaacttacagataacatcacttcttatctggccgtacacaatgctattatttccaataaacctacaaccaatcagtatgtgtttaccaacttgactcgcttgattaatgcatgtgtcaacgaaaagcaggaagccaagaaaaaagcaggagacagttggaacgaagcagcttgggaagcagcaaatccggattggaataaagtggtacttatcccggtactggtacagtacgatagctcttccaataagaatatgatcagcatccagcacgatctacaaccgggatacgtaaaactggaaggtggtccggacggtacgaaactgaagttagaagtaacttataccaacttcaacggtaagcagtaa

SEQ ID NO: 3277 - DNA, 918 bp, B.fragilis
aagatggaaaaatttgaattacatatattgggttgcgggtccgcattgcctactacccggcattttgctacctcacaggtagttaatttgcgtgataaactttttatgatcgattgtggagaaagagcacaaatgcaattgcgtaaatcacggttgaaattctcacggttgaatcatatctttatctcgcatctgcatggtgaccattgcttcggattgatgggacttatttccactttcgggttactgggacgtacagctgaattacacattcattctccaaaaggattggaggagttgttgactcccatgctcaatttcttttgccatacattggcctataaagtcatttttcatgaattcgataccagacagacttcagtggtttacgaagatcgttcgatgacggtcactactattccgcttcagcaccgtattccttgttgtggctttctgtttgccgaaaaagcacgccctaatcatattatacgtgatatggtcgatttttataaggtgcctgtttacgaactaaaccggataaagaatggatctgattacgtgactcccgagggagaagtgattgccaatacacgtttgacccggccttcggatcctcccagaaagtatgcctattgttccgatacgatttttaggccggaaatagtggaacaactttccggtgtcgacttactttttcatgaagcgacctttgccgaatcagagttggcacgtgccaaagaaacctatcatactacagctgctcaggcggcacggatagctttggaggccggggtacgccagttggtaatcggtcacttttctgcccgttacgaagacgagagtattttgctgaaagaagcttcggcggtattcccgaatacgattctggcaaaagaaaatttgtgtataagtctttaa

SEQ ID NO: 3278 - DNA, 480 bp, B.fragilis
agcgaaatgaagaaactgattattctattgattatagtttgtggctttacccctgcgctgcgtgctgtgggaagtcctaatcaacatttgtcacccaaagaattcagggccaaacaacaagcatttataacagaaaaagctggcctgactcaagaagaggctgcgaagttttttccggtttattttgaactgcaggatcggaaaaagcaattgaatgacgaagcatggaaattgcttcgtagcggtaaagatgaaaagactaccgacactcaatacggagaaatcctggaaggagtttatgatgcccgtatcgcttcggatcggctggataagacttattttgagaagtttaagaaaatcctttcgtgcaagaaaatttatctggtgcaaagagccgagatgcgtttccaccgcgaactgctgaaaggagtacgtgataataaaggtggaaacgaacgtccacagggaaagaggaaatag

SEQ ID NO: 3279 - DNA, 699 bp, B.fragilis
aatttaaagaaatatgctaatatgaggccagaaattcgacaaatcctgctgacaatggtacttccgctgtttctaatttttatcctctacatgataaaggttttagagataggtatggactgggactttatcagtttaggagtataccctttgtcaaaaaaaggtatgtttggtattttcactcatcctcttatacatagcagcttcaaacatttattgaccaacactttaccactattcttcctttcatggtgtcttttttacttttacagaagcatagctccctctatttttcttataatctggataggatgtggagccattacattccttatcggcaagcctgcctggcatatcggtgccagcggtattatctatggactggctttctttcttttcttcagcggactgttacgaaaatatatccccttgattgccatatctctattagttacctttctctatggaggtcttatatggaatatgctcccctattttacaccatccggcatttcgtgggaagggcatttaagcggagctatcataggtaccatctgtgctttttcttttatgggttacggcccgcaaaagccggaccctttcgcaaatgaacaagaagaggaatccgtctcagcaacagatgaaacagataatatcgaaatggataaagaagaagaacacgaaatcgatgcagaatag

SEQ ID NO: 3280 - DNA, 791 bp, B.fragilis
  unsure (26),(149),(157),(163),(270),(274),(354),(376),(393),(406),(465),(512),(543),(544),(558),(584),(585),(629),(666),(667),(701),(703),(708),(716),(717),(726),(727),(729),(730),(732),(734),(741),(742),(743),(744),(745),(747),(748),(750),(751),(752),(756),(757),(759),(761),(762),(763),(765),(766),(767),(768),(769),(770),(771),(772),(773),(775),(776),(777),(778),(779),(780),(781),(782),(783),(784),(785),(786),(787),(788),(790),(791): Identity of nucleotide sequences at the above locations are unknown.
ggggagagaagggaaaaagaagaganaggagaaagaaagaaaagaaaaggaggaggaaagaagaagagaaaaagggaaagaaagaaaaaaagagagagaggaaagaaaaaagagagagaaagaaaaagagaaaagggggagaaaaaganaaagaagngggggnagaggaaaggggaaagggggaaagaagaaggaggaaaggaaagaggaaaagagaagaaggaaaaggaagggaagggaaaagaaaagaagagggaaaaaagggaaggnaagngaaaaggagaaaaaaaaaggaaagggagagaggaaaaaaagaaaaagggggaaaaaaggaaaaaaaaagaaagaagaagngaaaggaagaaaagggaagaanggaaaaaaaggagaagngggaagaaggaanaaagggagagaaggggagggagagggaaagagaggagggaagagaaaaaggaagaaggnggagggataaggagaaaaaggagaggaaaggaaggaaggaagggaanagaaagggaagaaggagaaaaggaggggaannggaaagaaaggaangaaaaggaagagaaaaggaaaggggnnaaaaaaaggagaagaaaggggaaaggggaggaaaaaaaagaggnagaaaaagggggggaaggggaaaaagaaaaagagggnngagaaggaagagagaaagagaaggggggggaggngnagggngaaggggnnggggagggnngnngngnggggggnnnnngnngnnnaagnngngnnngnnnnnnnnnannnnnnnnnnnnnntnn

SEQ ID NO: 3281 - DNA, 1221 bp, B.fragilis
cagaatattgaaattatgaacaacttagtctggaagctgctccgtcagcatatcagcatcggtcagttgaccggtttcttctttgccaaccttttcggaatggttattgtgctactcagcgcacaattctacaaagatgtagttcccatctttaccgaaggggatagctttatgaagaaagattatatgacagctactaagaaaatcagtacgctgggatcttttgcgggcaagagtaacactttttcgtctgaggaaatagaggaactgaagaaacaaccgttcacccggagcgtaggtgctttcactccttcgcaatttaaagtctccgcaggattgggaatgcaggaagcaggaattcacctttctaccgaaatgttctttgaggccgttcctgataagtttgtagacgtcagcctcgataaatggcattttgatgaaaacacgcacaccatccctatcatcattccgcgcaattatctgaatttatataacttcggatttgcccagagccgaagcctgcctaaactatcggaagggttgatgagcctgatccaaatggatattctgatgcggggcaacggacgggttgagcaatataaaggaaacatcgtcggcttttccaaccggttgaatactattttggttccacaatcttttatgaactgggctaaccaaaactttgcaccggatagccagccggacccttcacggctgattattgaagtagacaatcccgctgatgcctccattgcaaagtatttccaacaaaagggttatgagacagaagacggaaaactggacgccgggaaaaccacttattttctgcgtctgattgtgggtattgtccttgcagtgggactatttatcagcatactctctttctacattctgatgctcagcatttttctgcttttacaaaagaacaccgtgaaactggaaagtttacttctgataggttacagcccttcaagagtagcactcccctatcagattcttacattaggactcaatattgttgtactgttactatccgtcggcattgtttcgtgggcacgcacctcttatcttacgacactgaacctgttgtttccacaaatgtctgtcggatctctctggccaactttcgccataggtatatttttattcttattggtgtcttccatcaacgttattatactgaaaaagaagatgttgtcaatatggatacacaaagcatag

SEQ ID NO: 3282 - DNA, 1170 bp, B.fragilis
acaataactgaaatgaaacaaacaaaaacgattttagcagtcattctgttggtggtattagtggggtgtggagaaaatatacagtcaaacaatgatttaatcattgttgacgtttcgaaaagttatcctaaaaaagaattgattcttcaggactttatggatgtagaatatgttgcgttggagaccactgacgagtttcttacacaaggtctggtgcaggatgtgggaaaagaatacatattggcaacaaataggaataatgatggggatatttttatttttgacagaaaaaccggtaagggagtgaggaagataaatcgtcgggggcaaggagcagaagaatatgcgaggattaatgagattattcttgatgaaaacaatggtgaaatattcgtaaagtcaccgggaaataaaatcttagtgtatgatctttatggaaagttcaaacggtgtttgagtcttgatcgggaagtttcatctattttcgattatgacaaagataatttgatttgctatgatatgtcagattatcacagtaaaggagaggatagaaccaaatcataccatattatcctatcaaaacaggatggaagtatcacccgtgatatttttattcctttcaaaacgattgatacaccaattgtgaatgatggagataggtttatagcaaattattcttatcagatacgcctgagtaacgggaaatgtacacttatggatacatcggctgatacattgtataactatgcgtcggatggtacattaagtccttttgttgtaagaactccttctgcacataccatggaaccggaagtttttctttatatgggtatccataccgaccgttattactttatggaagccgttaaaaatgtatttaactttgaaaagggcaacggattctatgctgatgaactggtgtatgacaaagaagaaaaggcggtatttcaagttaccatatacaatgatgactatgtggacaaaagaacagtggctatgacagcgaaaccaattaatcgtgaaattgaagacgtcacaagtctaaatgcagcccgacttgttgaaatttataagaaagaccaactgaaagatggtaaattgaaagaaatagcctctaggttgaatgaagaagataatccggtgattatgttagtaaaacaaaaaaaataa

SEQ ID NO: 3283 - DNA, 531 bp, B.fragilis
aagaagaatgaatgtatgaagaaatacctttttaatctgttacttttcaccgtcctagttatcggcctgagtggctgccgcacctctgctcccaaactagactataagaaattggcccgtgcttctgtacgcttgggcgtagacatcggaatggaggataaccataaactctacctggaagcagccgaatggataggtaccccctaccggggaggcggagagaccaaacgtggcacagactgctcgggaatgacctgccagatttataaaaaggtatatcatatcaaactgcaacgaagcacagacggtcagaagaaagagagcagtaaagttgcccggcgaaatcttcgggaaggtgatctggtatttttcagtagccggaaatcgcgcagaaaagtggcacacgtgggcatctatctcaaagacggaaagtttgttcatgccagcaccagccagggagtcattgtcagcagtctcaatgaaccctattaccggactcactggatatcgggaggcagagtacgcaaataa

SEQ ID NO: 3284 - DNA, 1401 bp, B.fragilis
aacaatatagatatgagaacaatctgtctttattttgagatacatcaaattattcatctgaaacgttaccgcttcttcgacattggtgccgaccattattactatgatgattatgccaatgagacaggtattaatgaggttgccgaacgttcttatattccggctctcaatacattgattgaaatggtgaagaattccggaggagcatttaaagtagccctttctatttcgggagtagcattggaacagctcgaaattcatgcacctgccgtaattgacctgttacatatattaaacgatacgggttgctgtgaattcctggcagagccatactctcatggcttatcatcattggccaatgaagactgtttccgtgaagaggtaatgcgtcagagcgaaaagatgaaacagatgtttggtaaagctccgaaagtgttccgtaactccagcttgatttattcggatgaaataggtgctacggtggctagcatgggtttcaaaggcatgctgaccgaaggtgctaaacacgttttgggttggaagagtccgcattacgtgtatcattgcaatcaggctccaagtctgaaattgttattaagagacttcaagttatcggatgatatcagtttgcgcttctctaactctgattggagtgagtatcctttatttgccgataagtttatcggttggattgatgctttaccacaagaagaacaagtgatcaatatctttatggaactgaaagcattgggtatggcgcagccattatcatccaatattttggagttcttgaaggcacttccttattgtgcaaaagaaaagggcattactttctctaccccatcggagattatttcgaaattgaaatctgtttcccaattggatgtaccatatccaatgtcgtgggtagacgaagaaagagatacgagcagctggctgggtaatgttttgcagcgtgaagctttcagcaaattatacagtgtggctgaacgtgtacacctttgcgatgatcgtcgtatcaagcaggattgggattatctgcaagccagcaataacttccgttttatgacgaccaagaataccggtgtgtggctgaatcgtggtatttatgattctccttatgatgcctttactaactatatgaatatcttgggggatttcattaaacgtgtaaattctctctatcctgaggatatcgataatgaagagttgaattcattgttgacaactatcaagaaccagggagaagagatcgccgaattacataaggaggttgataagttgcaggcaaaagcggaaaaggctgcaaaaacagtaaaggccgaacccaaagctgcacctaaaaaggccgctgcgaagaaacctgctgcaaagaaagcaacggcaaaaaaagaagattaa

SEQ ID NO: 3285 - DNA, 186 bp, B.fragilis
gggttaacagatgcttgtaagaatgcgtttgccgtgccgctgacaaaagaggctaccagaaaaagaggaaaactctcctggctggccgatggaatgtacaaaccgaaagctacagcgaacatggcaaacgaaagtgccatggtgtgtttgtatccgatagctttgatagtcatcgaagccggatag

SEQ ID NO: 3286 - DNA, 366 bp, B.fragilis
gtgattaaagaccacccgacggagctaacttacatttatttatataagatgtacgcaattgtagaaatcaacggtcagcaatttaaagctgaagctggccaaaaattgttcgttcaccacattcagaatgcagagaacggtgcaacagtagaatttgacaaagttcttttggtagacaaagacggaaacgttactgtaggtgctcctactgtagacggtgcaaaagtagtttgccagattgtttcaagcctggttaaaggtgacaaagttcttgttttccacaagaaaagaagaaaaggtcacagaaagttgaacggtcaccgtcagcagttcacagagttaacaatcacagaagtagtagcttaa

SEQ ID NO: 3287 - DNA, 475 bp, B.fragilis
  unsure (26),(149),(157),(163),(270),(274),(354),(376),(393),(406),(465): Identity of nucleotide sequences at the above locations are unknown.
ggggagagaagggaaaaagaagaganaggagaaagaaagaaaagaaaaggaggaggaaagaagaagagaaaaagggaaagaaagaaaaaaagagagagaggaaagaaaaaagagagagaaagaaaaagagaaaagggggagaaaaaganaaagaagngggggnagaggaaaggggaaagggggaaagaagaaggaggaaaggaaagaggaaaagagaagaaggaaaaggaagggaagggaaaagaaaagaagagggaaaaaagggaaggnaagngaaaaggagaaaaaaaaaggaaagggagagaggaaaaaaagaaaaagggggaaaaaaggaaaaaaaaagaaagaagaagngaaaggaagaaaagggaagaanggaaaaaaaggagaagngggaagaaggaanaaagggagagaaggggagggagagggaaagagaggagggaagagaaaaaggaagaaggnggagggataa

SEQ ID NO: 3288 - DNA, 1800 bp, B.fragilis
ttattaatggaaaacttaaagaacgttgctcctattgaagacttcaactgggatgcgtatgaaaacggcgagagcttcgctggtgccagccacgaagaactcgaaaaagcttacgacggtacgcttaacaaagtaaatgaccgtgaggttgttgacggaactgtaatcgcaatgaacaaacgtgaagttgttgtgaacatcggttacaaatcagacggtatcattcctttgaatgaattccgctacaatcctgatttgaaagtaggtgatactgttgaagtatacatcgaaaatcaggaagacaaaaaaggacagttggttctgtcacacagaaaagctcgcgctactcgctcttgggatcgcgttaatgctgctctggaaaacgaagaaattatcaagggttacatcaagtgtcgcactaagggtggtatgatcgttgacgtattcggtatcgaagcattcttgccgggttctcagatcgacgtgaaaccgatccgtgactatgatgtattcgttggcaaaacaatggaattcaaagtggttaaaatcaaccaggaattcaaaaacgtggttgtttctcacaaagctcttatcgaagctgaactggaacaacagaagaaagaaattatcggtaagctcgaaaaaggacaagttcttgaaggaaccgttaagaatatcacatcttatggtgtattcatcgacctgggtggcgtagacggattgatccacatcactgacctgtcttggggccgcgtaagcgatccgaaagaagtggttgaactggatcagaagttgaacgttgttatcctcgacttcgatgacgagaagaaacgtatcgctttgggtctgaaacaactgactccgcacccatgggatgctttggatccgaaccttcaggtaggtgacaaagtgaaaggtaaagtagtggttatggctgactacggtgcattcatcgaaatcgctccgggtgttgaaggtctgatccacgtttcagaaatgtcatggtcacagcatttgcgttctgcacaagacttcatgaaagtcggtgacgaagtagaagctgtagttctgactttggatcgcgaagaacgtaagatgtctttgggtatcaaacaactgaaacaagatccatgggaaactatcgaagagaagtatcctgtaggttctaagcatactgctaaggttcgtaatttcactaacttcggtgtattcgtagaaatcgaagaaggtgttgacggactgatccacatctctgacctttcttggactaagaaggttaaacacccgtcagaatttactcagattggtgctgatatcgaagttcaggtattggaaatcgacaaagaaaaccgtcgtttgagccttggtcacaaacaacttgaagagaatccttgggatgtattcgaaacagtatttactgtaggttctgtacacgaaggtacaattatcgaaatgctggataaaggcgctgtagttgctcttccttacggtgttgaaggtttcgctactccgaaacatctcgttaaagaagacggttcacaggctcagatggacgagaaactggaattcaaagtgatcgagttcaataaagatgctaagagaatcatcttgtctcacagccgcattttcgaagatgttgctaaggcagaagaaagagctgaaaagaaggctgcttctaacgcaaagaaatcttctaagagagaagaaactcctgctatccagaaccaggctgcttctacaactctgggtgatatcgatgctttggctgctctgaaagaacagttggaaggtaagaagtaa

SEQ ID NO: 3289 - DNA, 1941 bp, B.fragilis
tcatacctttgtttccgctcaaaagaaacgaacatacaaatgaaacagacaccattcagatgcctttgcctccttcttatattgttgggagctgttcattcccggctatctgcccatgcagataaaacaagggaagacgtattgtttctaaattctatcaatttcaaccttccatgggcaaaggatgtgttctggtatacgcaccaagccctgcaaaagaagaatatctccgtaaaggccgagtccctttcggtgcccgctttgtgtaaccgtaaagaagcagcagccgtagtagagcagttacggcggaaatacgatgtgcctccccgactgatcgtctttatcggcgatccgggatggattgtttgccgtgaactttttgatgatgtctggaaggatgtaccggtcatcattaccaacgcccgcgaccgtctgccggctacactcgacatcttgctttcacacgaagagctgaccgaatcgaatactgtccccgcttatgaatggcggaaaggatataacgtgactactctggggcaagtatattatgtgaaagaaaccatcggactgatgcggcagctgatgccggatatgaagcgtctggctttcatctcagacgacagatacatcagtgaggcagttcgcggagatgtagagcaggcaatgaccggatcttttccggagttggcctttgaacagctgtccaccaggaatatttctaccgagatgttactcgataccttgaagagttatgataaaaccacgggactcatttattattcctggttcgagactcataaccaggatgataacaattatctgttcgatcatattcaggagattattactcgcttcgtacattcccctctgtttttgttggctcccgaggatctgtccaacaatactttcgccggaggatattatgtttcagtggagtccttcggcgattcattgttacagctgattcatcgtgtcctggaaggtgagtttccgcgagacattcctcccgctctcggaggaaaacctgctgcttacctctgttatccggctttgcagtcgtatgacataccggtttccctttatccgaaagaggctgtgtacattaatctgcctgtcagcttcttcgagcagtataagaaggagattctgatgactgttgtcttgctgctggtggtggtcagtgccgtaggctattatattcatattcttaaaagagcccatcagcgaatgaaagaagcgcagctgaaagccgaggaagccaatcagcttaaatcggcctttctggctaatatgagtcatgagatacgtactcctctcaatgccattgtcggtttctcgaatctgctttctatggtagaagataaagaagaaatgctggagtatgccggtattatcgaaaccaataccgaacttttgcttcaactgattaacgatattctggatatgtcgaagatagaatccggaatgtatgactttcatgtgactcaggtggatgccaatcagttgatgtcggaagtcgaacaggtagcccgtttgcgtatcaggacagacgaagtctccctctcgtttgccgaacgtttaccccaatgtgttttccatactgataagaaccgcttgatacaggttcttaccaatttggttgtcaatgccataaagttcacttcgcagggagagattcagatcgggtatcggctgcaagatgcccatacgttatacttctatgtatccgataccggttgtggtatgtccgtcgagcaatgcgaacatgtttttgagcgctttgtcaaatacaacacttttatacaaggcaccggattgggactgtctatctgcaaaatgattattgagaagttggggggcgagatcggggttcagtccgagtccggaaaaggttctgtcttttggttcactcttccttaccgggcttcggcctctttgtaa

SEQ ID NO: 3290 - DNA, 657 bp, B.fragilis
tcttcaacgtgtatggacagcattcacctacagcaaacacttccccaagtgtttgctgaccgtaattcgataacttcggatgtatggcatcggaatcttgttttccataaaggaaaatcttacctgatcgaggctgcctccggtaccggtaaatcatcgttgtgcagctacatctacggctaccgaaacgactatcagggaatcatcaacttcgacgaaaccaatatcaaagcatacccggtgaagcaatgggtggaaatccggaagcattcactgagtatgctttttcaggatttacgcatttttacggagttgaccgccatcgaaaacatccgactaaagaataacctgaccggatataaaacccgaaaagaagtattatcactgttcgaagccttgggactctcggacaaactgaacgtgaaggcaggcaaactttctttcggacaacaacagcgagtggcgttcatccgatcgctttgtcaacctttcgacttcattttcctggacgagcccatcagtcatttggacgacaacaatgcacgtattatgggagaactggtaatggaagaagccagcaaacaaggggcgggaatcatcgtaacgtccatcggcaagcatatcgagttaacgtatgacagaatattgaaattatga

SEQ ID NO: 3291 - DNA, 2223 bp, B.fragilis
tatttgaggtgcaatatattaatatggtgtttttggttattctcgctctgttttgttcaaaagggagtggctaacgttgttcttgatcctcagaccaatcgtcccatctctgccgattctattttgaataatgtgatgactttcgctcctttttacgaaaagttagtgaccgactatcgggccgatctatatataaaaggtacgatggacatcaaacgaaagaattttattctccggtatgtaccttccatgttccgtcttcaaaaaggtgtacggcagtatatggtggagacgtatagtgatctgcattttacagctcctaatatctatgaccaaaaggtgaaagcttctatgggcactgtgcataatagccggggagtaccggggatgctcgagtatttcaatatcaatctttattcttcaacgctgctttacgaccgattgctttcgcctttggccaaaaacgggcggaaatattataagtacctgatcgattccataatgggtgggacggacaaccgacaatataagatacggtttatccccagaagtaagagtgatcagttggtgggtggatatatgattgtgagtagtgacgtgtggagtgtccgcgaaatacgtttttccggcaggtcggaactgctattgttcagttgcctgataaaaatgggtagtgtaggaaaggatgatgagtttcttccggtcagctataatgtcgaaggacagtttaattttttgggtaaccgtattaatggagtttatgtggcatcgctcaactatcacgatattgtgcttgaagaaaatcagaataaatggaaagagaaggtgagggcgagaataaaaggaaaaagtaaatatgatctttcagactcttataacttgcaatgcgagactacctctttccatacggatagtgcttattttgaaacattgaggcctattcctttgtcggaggctgagcgcagactatacaaagaagatgcgttgcgtaaagataccattcaacgcaacatcaaaccaaagagtaagagtcaggtgttttggggacaggtgggagacgtactgatcagtgactataaattgaacctctccaatctgggaagcgtgaagtgctcaccacttatcaaccctttcttgttgagttatagcgggagcaatgggctttcctacaggcaatcgtttaaatataaccgactttttaagcatgatcggctattgcgtgtggtacctaagttgggctacaactttacacgaaaagaattctattggtctgtcaataccgaatttaattacctgcccgagaagatgggagctgttcacattgactttggtaacggcaaccggatttacagtagcgatgtgcttgatgatttgaaagccatacccgacagtgtatttgattttaatcagattcatttggactacttttacgatttatattttaacttccgacacagtatcgagattattaatggattagagttaagtgtaggcttatctacccataggcgaaaggcggtaaagtcctctaagttggttccactgacaaagagtcgggagacactcaatgaagatatccagaacaaaatcaggaatacctatttgagttttgcccctcgggttcggttggagtggaccccttgtttatactattacatgaacggacaccgtaagattaatctccgttctaagtatcccactttttcgatagactgggagaggggaatcaagggggtatttggcagtaccggacaatatgaacgtttggagtttgatttgcagcatcatatacccttgggactgatgcgtaatatctattatcgttttggatttggtatgtttaccaatcaaaaagaaatgtattttgtcgactttaataactttacccgaagtaatcttcctgaaggttggaatgacgaaatcggaggagtatttcagcttctcgaccgtcgttggtataatgcttcacggaaatatatacggggacattttacttatgaagctcctttcctattattaaaacatctgattaaatacacacgttatgtacagaacgagcggttgtatgcgagtatattgtcagtaccccatcttcagccgtatgtggaattgggatatggaatcggtactcacatctttgattttggcgtttttgtaggtagtgagaactggaagtataccgaggtcggctgcaagtttacgttcgagctgtttaaccgctaa

SEQ ID NO: 3292 - DNA, 963 bp, B.fragilis
aatataaataggagtatggaaacagaaagaattaaatgccttattataggttcaggaccagccggctatacagccgctatctatgctggacgtgcaaatttgtcaccggtgctttacgaaggaatacagccgggtggacagttgactaccactaccgatgtagaaaacttcccgggctatccgcaaggaatcagcggaccacaattgatggaagatcttcgtacacaggccgaacgttttggtgctgacatccgctttgggattgctaccgcttctgatcttggtcaggctccttacaaaattacaatcgatggtgaaaaagtaatcgaagccgattcattgattatcgccaccggagctacagccaaatatttaggactggacgatgaaaagaagtatgccggtatgggggtaagcgcttgtgctacttgcgacggttttttctatcgtaagaaagtggttgctgtggtaggtggtggtgacactgcttgtgaagaagcgatctatttggccggactcgcttccaaggtttatctggttgtgcgcaagccttatcttcgtgcttcgaaaattatgcaggagcgtgtgaggaaacatgataagattgaagtactttttgagcataatgtagttggtcttttcggtgagaacggtgtagaaggtatgaatcttgtgaaacgttgggaggagcccgatgaagaacgctattcattacctatcgacggtttcttccttgctatcgggcataaaccgaattcggacatctttaaaccctatctggatactgatgaagtgggatatattaccaccgacggtgacagtcctcgtaccaaggtacccggagtatttgctgcaggtgacgtagctgatccgcattatcgtcaggctattacagcagccggaagcggatgtaaagctgctattgaagctgaacgctatctgtctgaaaagggattgatctaa

SEQ ID NO: 3293 - DNA, 714 bp, B.fragilis
tgcaaaagtagtaaaaaaaagaatttcattggactacccacaactttttcttacctttgcgtttcaattcaagcagatatgaaaaaagagagtcaagtaatatttgataagaatgtgatagaattcgttacagtagccgccgagttctgcgcttttttggaacgtgccgaaagtatgaaacgcagtacgtttgttgataccacccttaaaatacttcctttgctttatctaaaagcatccatgcttccgaaatgcgaaatgataggtgatgaatcacctgaaacgtatgtaacggaagaaatttacgaagtgttgcgcatcaacctggcatccatattggcagaaaaagacgattatctggaagtatttctacccgacatggcttacagtgacgaaccgatcaaaaagaatatttcggaagatctggccgatatctatcaggatatcaaagactttatcttcgtattccagctgggattgaacgagacgatgaacgattccctcgccatctgccaagaaaacttcggactcttgtggggacaaaaactggtaaacaccatgcgtgccctgcatgacgtaaaatatagtccgaaagcccggggagaagacgaagaggaagaagagtacgaacccgaaaacaatgaagactgtcactgtgaagatgacgactgccattgtcacgatcatggctgccattgccatgatgatgaataa

SEQ ID NO: 3294 - DNA, 909 bp, B.fragilis
  unsure (26),(149),(157),(163),(270),(274),(354),(376),(393),(406),(465),(512),(543),(544),(558),(584),(585),(629),(666),(667),(701),(703),(708),(716),(717),(726),(727),(729),(730),(732),(734),(741),(742),(743),(744),(745),(747),(748),(750),(751),(752),(756),(757),(759),(761),(762),(763),(765),(766),(767),(768),(769),(770),(771),(772),(773),(775),(776),(777),(778),(779),(780),(781),(782),(783),(784),(785),(786),(787),(788),(790),(791),(793),(794),(795),(796),(797),(798),(800),(801),(802),(803),(804),(806),(807),(808),(809),(810),(811),(812),(813): Identity of nucleotide sequences at the above locations are unknown.
ggggagagaagggaaaaagaagaganaggagaaagaaagaaaagaaaaggaggaggaaagaagaagagaaaaagggaaagaaagaaaaaaagagagagaggaaagaaaaaagagagagaaagaaaaagagaaaagggggagaaaaaganaaagaagngggggnagaggaaaggggaaagggggaaagaagaaggaggaaaggaaagaggaaaagagaagaaggaaaaggaagggaagggaaaagaaaagaagagggaaaaaagggaaggnaagngaaaaggagaaaaaaaaaggaaagggagagaggaaaaaaagaaaaagggggaaaaaaggaaaaaaaaagaaagaagaagngaaaggaagaaaagggaagaanggaaaaaaaggagaagngggaagaaggaanaaagggagagaaggggagggagagggaaagagaggagggaagagaaaaaggaagaaggnggagggataaggagaaaaaggagaggaaaggaaggaaggaagggaanagaaagggaagaaggagaaaaggaggggaannggaaagaaaggaangaaaaggaagagaaaaggaaaggggnnaaaaaaaggagaagaaaggggaaaggggaggaaaaaaaagaggnagaaaaagggggggaaggggaaaaagaaaaagagggnngagaaggaagagagaaagagaaggggggggaggngnagggngaaggggnnggggagggnngnngngnggggggnnnnngnngnnnaagnngngnnngnnnnnnnnnannnnnnnnnnnnnntnncnnnnnnannnnngnnnnnnnncacccccatgtcagcactcctaaagtctatgcttcccgtacagagagtacagagaaaacgataactaaccttaaagataaaagtatatgcctataa

SEQ ID NO: 3295 - DNA, 531 bp, B.fragilis
agagatgtcggagatattcggcacttcagtcggagctttgaaagcttcttaccatcatgccgtgaaaaaaatcgagaagtttttggaagaggccaattaaaccttttaatatgtacaatgtctaagaagaagagaggagaagaacgtatgaaagaagaagataacatattgaagaaagtggggaagaagaattcctttaaagtgcctgaagggtactttgaaaacttgacttcagaggtcatggggaaactgccggaaaaagaaggtcctgcctttgaagaagtgaagcaacccacgatgtggatcaggatgaagcccttgctctatatggcggctatgtttataggggctgcattgatcatccgtgtagcttcttcgaaccaccaaccgacaactgccggtgatcatctcactgcaaatgaagcagcgacagaagtggtttcggatgaatatattgatgtagcattagatcgctcgatgttggacgattactcattgtacgtctaccttagtgatgcgacagccgaataa

SEQ ID NO: 3296 - DNA, 225 bp, B.fragilis
ggtagcaacggattatatatacccacattaaaaaaacaaattattaatcatacttttgcaggtttatttctgacatttagtcatttatacaatagaagtaagtcatttggaatagaccgctttcttttttatagacctttcattctctgttttttccgattttcttttcccattttccttttctcatttccttttattccatgctttttccactctgtcaactaa

SEQ ID NO: 3297 - DNA, 402 bp, B.fragilis
  unsure (37),(68),(69),(83),(109),(110),(154),(191),(192),(226),(228),(233),(241),(242),(251),(252),(254),(255),(257),(259),(266),(267),(268),(269),(270),(272),(273),(275),(276),(277),(281),(282),(284),(286),(287),(288),(290),(291),(292),(293),(294),(295),(296),(297),(298),(300),(301),(302),(303),(304),(305),(306),(307),(308),(309),(310),(311),(312),(313),(315),(316),(318),(319),(320),(321),(322),(323),(325),(326),(327),(328),(329),(331),(332),(333),(334),(335),(336),(337),(338): Identity of nucleotide sequences at the above locations are unknown.
ggagaaaaaggagaggaaaggaaggaaggaagggaanagaaagggaagaaggagaaaaggaggggaannggaaagaaaggaangaaaaggaagagaaaaggaaaggggnnaaaaaaaggagaagaaaggggaaaggggaggaaaaaaaagaggnagaaaaagggggggaaggggaaaaagaaaaagagggnngagaaggaagagagaaagagaaggggggggaggngnagggngaaggggnnggggagggnngnngngnggggggnnnnngnngnnnaagnngngnnngnnnnnnnnnannnnnnnnnnnnnntnncnnnnnnannnnngnnnnnnnncacccccatgtcagcactcctaaagtctatgcttcccgtacagagagtacagagaaaacgataa

SEQ ID NO: 3298 - DNA, 1296 bp, B.fragilis
tttataggaggagggacgaagatgaaagttttaatgtttggatgggagttccccccgcatatcttaggaggtttaggaactgccagctatggtttgacaaaaggtatgtctcaacaagaggatatggagattacattttgtattcccaagccttggggtgacgaagaccagagttttctgagaataatcggtatgaacagtacaccgattgtgtggagggatgtagattgggaatatgtcaaagggcgtgtaggctcttacatggatcctcaattatattttgacttgcgcgaccatatttatgctgatttcaattatctgaatgcaaatgatctgggatgcattgaattttcagggcgttatccggataacttacatgaggaaatcaataactactcaattgttgcaggagttatagcacggcaacaggagtttgaaattatacactcacatgactggttgacttatccggccggtattcatgcaaaacaggtatcgggcaaaccattggtgattcacgtacatgctactgactttgaccgtagtcgtggtaatgtgaaccccacagtttatgccattgagaaaaatggtatggatcatgccgatcatattatgtgtgtgagtgaattaactcgtcaaacagtaatccataaatatttccaggatccgaagaaagtatcaactgtgcacaatgcagtttctcctctttcgcaagagatacaggatattgtacctaataagaacccgaaagaaaaggtagttaccttcttgggacgtattacaatgcaaaaaggtcctgagtattttgtagaggcagctgcgatggtattgcagcgtacgcggaatgtacgttttgtgatggccggtagtggtgatatgatggatcagatgatccgtctggcagctgaaagaggcattgccgatcgtttccattttccgggattcatgaaagggaaacaagtatatgaagtcttgaaggccagtgatgtatacattatgccttcggtatccgaaccttttggtatttctccgttggaggctatgcagtgtagcgtaccaagcattatttccaaacaatccggttgtgccgagatcttggaaaaatgtatcaagaccgattactgggatatccacgctatggcagatgctatttattctatctgtacctatccggctatgtacgagtatctccgtgatgaaggtaagaaagaggtggacgaaataaagtgggagaacgtaggctacaaggttcgcggcatctacgacgaggttataaaaaattatggaaaacaataa

SEQ ID NO: 3299 - DNA, 2460 bp, B.fragilis
cacacatttattaccatgaaaaaaggaattactctttttcttttgtctctgcttttcatcacccccggatgtaaacagtcaaaagaaaccatcgtgaacgaatacaatatcgttccgttgccaaaccaaatgattccccaacagggacggttcgaaataagtaaaaaagtaagagtcataacaaccgcttgtacaccggacgtacaaatcattgccgacagcctcatcaaccgattgaagctgacatcaggaattaccataaagcaaactttcgagaacgtaacggacgagcctgttattcgtttcgtgccgcaagacggaatgcccgaagaaggatataaactctctgtcactcctcaaaatatcacccttacagcttctacccccaagggatttttctatgcagtgcaaacactttatcagttattgccacccgttgtatatggtaatcaaaaggtgaagaacgccgaatggtcggtaccggctgtcgaaatagaagatgctccgcgctttgcataccgtggtctgatgctggacgtatgtcgccacttctccccggtggaatatatatataaattcatcgatatgctggccatgcacaagatgaacactttccactggcatctgaccgacgaccagggatggagaatcgaaatcaaaaaatatcctaaactgactgagataggttccaaacgtaaagagacattagtagattattactatgtaaactacccgcaagtctttgacggcaaagagcatggcggatactatacacaggagcagatcagagccattgtagactatgcagccagcaaatttatcacggtgatccccgaaatcgagatgccggggcatgcaatagcagccattgcttcttatccggaactttcatgcaccccggacagtacatgcgatgtgacaggaacctggggtgtatttgagcaggtattctgcccttcagacaccactttccaattccttgaaggagtgatggatgaagttatggatctcttccccagcaaatacatccatatcggtggtgatgaatgcccgaaaacagcctggatcaacagtgaatactgccagtcgttgatcaaacaactgggactgaaagacgatgttacccccaacgttatcgatgggaagaaacataccaaagaagagaagttacaaagctacttcatcacccgcatggagaaatacttgaatagtaaagggcgtaacatcatcggatgggacgaaattctggaaggcggactggccccgaatgccaccgttatgtcctggagaggagtagagggtggattaaatgcagccaaagccggacacaacgccattatgacaccaaatccatacgcatatctggatcagtatcaggaagaaccggagatagctcccgtcaccatcggtggatataatacgctcaaaaagacttacagctacaaccctgtaccggacgatgcaaacgaactggtgaaaaagcatatcatcggtgtacagggtaacatctggacggaatacatgcccggcaatgacaaccgcgactatcaggctttcccacgtgcagtagccatcgccgaaacgggctggacattgaatgcaaacaaaaactggaataacttttgccaacgcatggtagaagacttccgtcgtatggatgtgaaaaatgtcaaagcttgccgcaatttcttcgatgtgaatatcaatacacatgtagacgaaactaatacgttgaaagtagtactggaaagtttctaccccaatgccgaaattcactatacaacaaatggaagcgttccaacagtagaatctgccatttacaatcagcctttcgccttatccggcgaaatggacgtgaaagccgctgctttcaaagacggaaagatgttgggcaaggtcagtggaaagaagttgtatggcaatctgatcagtggtaaaagtttcacagtgactccgcccatcggagcggccaaaggcgacattttgggtgaaaatgatgttctcggtactgatataagcactttcggactgaccaacggtaaacgtggcaacatcgcttcgatgactccgtggagcggattccggatgaacgacgcctgcaataaactggtatttatcgttgaattcgaacagcctactactgtcagcaaagtggtcttcggttcgttatacaaccccgcatcagtcattctccctcccagtgtagctactgttgagacctcttccgacggacggaagtatgataaaatggcagaagcttccttcaaacggaactatcctgaaagaggcagaaaggcattcactgacacattaggctttgcccccaaagaagtcaagtatatcaaaatcactcttcaaaatggtggtactttacgaaacggcattgatttcgtgaaagacccgaatgaaaaagatgtggttcaggctaacatctatttggacgaaatagaagtatattaa

SEQ ID NO: 3300 - DNA, 258 bp, B.fragilis
tatacccctatttttataggggtattttgcaaaataaatatgttttttctttgtacacccctatttgtttgtgggcgaaagaacttttttgtatactttacctatccggagattactataaaatatgaatttattagtcgcataatcggattttttttatatttgccttcaataaggagattagtatttgaggtgcaatatattaatatggtgtttttggttattctcgctctgttttgttcaaaagggagtggctaa

SEQ ID NO: 3301 - DNA, 1950 bp, B.fragilis
tgcacaactatgagttatttacattttgacaagaccctgatgataaatcttgaggaatctttaccaagggagattctccggacgaacaaatcaggagcttatcattgtacaacgattgtagattgtaacacacgcaaatatcatggattgctggtgattcccgtacccaatctggacgatgaaaatcatgtgctgctatcttctttggatgaaacggtaattcaacacggtgctgagtttaacctgggattgcataaatatcaaggaaatcactttagccccaatggacataagtatatccgtgagtttgactgtgaacatattccggcaacaacttaccgtgtgggaggagtcatacttcgcaaagagaaaatctttgtacatcatgagaaccggattctgatccgttataccttggtcgatgcacactcagctaccactcttcgttttcgtccgttccttgctttccgtagtgtacgcgaatatacccacgagaattcgcaggcgagtcgtgactaccagttagtagaaaacggcattaagacttgcatgtatccgggctatccggaattgttcatgcagttgaataagaaaaacgaattccattatgaaccgaattggtatagaggaattgaatatccgaaagaacaggagagaggatatgatttcaatgaagacctttatgttcccggatattttgaagtcgatataaagaaaggagaaagtataattttctctgccggtatttctgaaatttctccccgcagattgaaacaaacttttgaggcggaagttgccgaccgtacgccacgtgatagtttctatcattgtttaaagaattccgcccatcaattccataacaagcaggaagaggaccattatattttggccggatatccctggtttaaatgtcgtgcccgggatatgtttgtatcgctgcccggattgacgcttgctgtagatgagataggtgaatttgaagacgtgatggaaactgcccgcaaagcgatcaataactacattaaaggtgaaccgataggctgtaaaatctacgagatggatgatcctgacgtattattatgggccgtatgggctctgcaacaatatgcaaaggaaacaagtcgtgaacaatgtcgtgccaaatatggttctttgttagaagaaatcatcgattttattcgtcagcgcaaacatgataatctgttcttgcacgaaaacgggttgttgtatgccaatggtgcagatagggcgatcacatggatgaattccacggttaacggacgtccggttattccgcgtacaggttatatcgtagagataaatgctttgtggtacaatgccttgcgttttattgccgacttagttcgtgaaggcggtaatggattgctggcagattcactggatgcacaggctgaggtaaccggaaagtcttttgtggaagtctttcgtaatgaatatggttatctgttggattatgtagacggaaatatgatggattggagcgtacgccccaacatgatatttacggttgccttcgattattctcctcttgaccgggtgcaaaagaaacaagtactcgatattgtgacgaaggaattacttactccgaagggactccgaacattgagtccgaagagcggcggatataatccgaattatgtaggtcctcaaatccagagagactatgcttatcatcagggtacggcttggccatggctgatgggattctacatggaggcgtatctgcgaatctataagatgagtggaatttcgtttgtagagcgtcagttgattggacttgaagacgagatgaccagccactgtgttggttcgttgccggaattgttcgacggaaatccaccttttaaagggcgtggagcagtatcgtttgcaatgaatgtggcggagattttacgtatcttgaagctgttgtctaaatataatttatag

SEQ ID NO: 3302 - DNA, 2238 bp, B.fragilis
aaaaaacatataattttgtgcccaacaaccaataaaagagacaccatcatgtcaaaaatgagatttttcgcactacaagagctatctaacagaaagcccttagaaattactactccctctaataaactatccgattattatgccagccatgtattcgatcgtaagaagatgcaagagtaccttcccaaagaagcatacaaagcagtagtagacgctaccgaaaaaggcacccctatcagccgagaaatggccgacctgatagccaacggcatgaaaagctgggcaaaatcgctcaatgtgacacactacacgcactggtttcagccactgacagacggaacggccgagaaacatgacggctttatcgagttcggtgaagacggtgaagtaatcgaacgtttttccggcaaattactgatccagcaggaaccggacgcttcttctttccctaatggtggaatccgtaatacattcgaagcccgcggttacactgcatgggacgtttcgtcaccggctttcgtagtagacaccactctttgtatcccgacgatttttatctcatatacaggtgaagcactcgactacaaaactccattattaaaagcattggcagccgttgacaaagctgctaccgaagtatgccagcttttcgacaaaaatatcacccgggtattcaccaatttgggttgggaacaggaatattttttggttgacacctctttatataatgcccgccccgaccttcgactaacaggacgcaccttgatgggacattcttcggccaaggaccaacagttggaagatcattacttcggttctattccaccacgcgtcacagctttcatgaaagaacttgaaatagagtgtcacaagctgggcataccggtaaagacccgccacaatgaagtcgctcccaaccagtttgaattggctcccatttttgaaaactgtaatctggcgaatgaccacaatcagctggtaatggacctgatgaaacgtatcgcacgcaaacatcattttgctgttcttttccatgaaaagccctacaatggcgttaatggttcgggcaaacataacaactggtcgctctgcaccgatacaggcatcaacctctttgcaccgggtaaaaatccaaaaggaaacatgctattccttactttcctggtaaacgtattaatgatggtccacaagaatcaggatctgttgcgtgcttctattatgagtgccggaaacagtcaccgtttgggagccaacgaagcacctcccgctatcttgtccattttcctgggttcacaactgtcagctacactcgatgaaattgtccgtcaggtgaccaactcaaaaatgactccagaggagaagacaactttgaaattaggtatcgggcgtatacccgaaatcctgctcgataccaccgaccgtaatcgcacttctccttttgcattcacaggaaatcgttttgagttccgtgccgccggctcctcagccaactgtgctgctgccatgattgccataaatgctgccatggccaaccagttgaatgaatttaaagcatcggtagacaaactgatggaagagggtatcggtaaggacgaagcaatcttccgcatcctgaaagaaaatatcatagcctccgaacctatccgttttgagggtgacggctactcagaagagtggaaacaggaagcagcccgccgcggactaaccaacatctgccatgttccggaggccctgatgcattatatggataaccaatcgagagccgtactgataggcgaacgtatcttcaacgaaaccgaactcgcctgccgtctggaagtggaattggaaaaatataccatgaaggtacagattgaaagccgcgtattgggtgatctggccatcaaccacatcgtccctatcgctgtcagctaccagaaccgtcttttggaaaacctttgcagaatgaaagaaatcttctctgaagaagaatacgaagtaatgagtgccgatcggaaagaacttattaaagaaatctctcaccgtgtatctgctattaaagtactggtacgcgacatgacagaagcccgcaaagtagccaatcacaaagagaacttcaaagagaaagcttttgcttacgaagagaccgtacgtccttacctggaaagcatacgcgaccatatagaccatctcgagatggaaattgacgatgaaatctggccgttgcccaaatacagagaactgttattcacgaagtaa

SEQ ID NO: 3303 - DNA, 717 bp, B.fragilis
aaaaagaatatgattaccatacataacctccggaaaaacttcggaacccaaacagccgtcgatatcgagaattatacaatcaatcagggagagatggtcggcctggtgggtaacaatggagccggaaaaacaactttgttccgtttaatgctggacctgctgaaagctgataccggtgaaatcattatcaacgacattcatgtgaaccaaagcgaagactggaaaagttttaccggtgcatttatcgatgacggattcctgatcagttacctgactccggaagaatatttctattttatcggtaaaatgtacggactcaaaaaagaagaagtggatgaacgcctgatccccttcgaacgttttatgaacggggaagtattgggacaaaagaagtttatccgtaacttctcggcgggcaataagcagaagatcggtatcgtgtcggccatgctacattatccgaaactgatcattctggacgaaccgtttaattttctggacccaagttcacaatccgtcattaaacatctgctgaaaaagtataatgaggaacataatgccacggtcattatttcgagccataacctgaaccatacggtggatgtctgtcctcgtattgccgtgcttgagcatggagtcattatccgtgaccttgtaaacgaaaacaattcggcagaaaaagaactggaagattattttaatgtagaagaagaatga

SEQ ID NO: 3304 - DNA, 1284 bp, B.fragilis
agtatagatatgcttaccattaaacaaattacagaaaacaccgacgcggtaatccgcggtctagagaaaaaacacttcaaaggagccaaagaaacaattgcccaagtaatcgaagtgaatgacaaaagacgtaatacacaaaatcaattagataaaaacctggcagaggtaaattcactttcgaaaacgatcggtcagttgatgaaagaaggcaaaaaggaagaagctgaagttgcaaaagcccgtgtagccgagataaaggagagcaataaaacactgcaggccgacatggaccaggctgccaacgacatgctgaatctgctgtataccattcccaatattccctacgacagtgtgcccgaaggtgttggtgccgaggacaatgtagttgagaaaatgggaggtatggaaactcaacttcccacagatgcactcccccattgggaactggctaagaaatacgacttgattgactttgatttgggtgtaaaaataaccggtgcaggttttcctgtttacaaaggcaaaggagctcaactgcaacgcgcactgattaactttttcctggatgaagcacgtaaatccggatataccgaaatcatgcctccaacagttgtaaacgctgcttccggctatggaaccggacaacttccagataaagaaggacaaatgtaccattgcgaagtagacgatctctatctgattccgacggctgaagttccggtaaccaatatctaccgtgacgtcattttggatgaaaagcaacttcctattaaaaactgcgcttatacacaatgcttccgtcgggaagccggctcttacggtaaagatgtacgcgggctcaatcgccttcacgaattctctaaagtagaattggtgcgtatcgacaaaccggagcactcccgtcagtcacatcaggaaatgctggatcatgtagaaggcctgctccagaagctggaactcccttaccgtattctccgtctctgtggtggtgatatgagttttaccgctgcgctttgctttgatttcgaagtatattctgaagcacagaagcgctggttggaagtcagctctgtatctaacttcgatacttaccaagccaatcgattaaaatgccgctatcgtagcggagaaaagaaaaccgaactttgccacacactgaacggatcggcactggcattgccccgcatcgtagcagccttgctggaaaaccatcagactccggagggtatccggattccgaaagcattggttccctactgcggatttgacatgatcgactga

SEQ ID NO: 3305 - DNA, 699 bp, B.fragilis
ataaaagatatgcacgtattttatacccctgatatacaaaccagcacagaacttcctgaagaggaagcacagcactgtgtacgtgtgctccgcctgacagccggagatgaaattagtctcaccgacggaaagggaaacttctatcgggcagagatcagcgtggcaacccataaacgttgcctggtgaatattaaagaaacaatttaccaagagcctttgtgggacggacatctgcacattgctatggcacccacaaaaaatatggatcgtaatgaatggtttgctgaaaaagcaactgaaatagggttcgacgaattaacattcttgaactgccgcttctccgaacggaaagtaattaaaaccgaacgcattgaaaagatattggtgtctgccatcaagcaatcgttaaaagcacgtttaccgcgtctgaacgagatgactgatttttgcacatttatcgaaaaagactttaaagggcaaaagttcattgcccactgttacgaaggagagaaacctttactgaaagatgtcttgacaaaaggagaagatgccctggtgttgatcggaccggaaggtgacttcagcgaagaggaagtcaagaaagcaatcgagaaaggatttgtccctattagtttaggcaaatcgcgactgcgcacagaaacagcagcattggtggcttgccacacaatgaatatgtaa

SEQ ID NO: 3306 - DNA, 1491 bp, B.fragilis
aacggtaccatgctattcaatgaactacgcctgcacggcaaacttgcagccaaacgacatccgatgtacgaaaagaataaaatcggcaaatacatcatgtatgcgtcctttattttctggggtgcttactttatatttattggcatcggtctggcaaaagccatcagcacagaagttcccaatatggaagcctatcatattttgaatagtggattgatatttgcgcttgccctggactttgtaatacgtttcccattccaaaaaactcctacacaagaagtaaaaccttacctgctacttccggtaaaacgaagccgtatactcgactttctgcttctccgccacgggctcagttctttcaatcttatctggctgttcctgttcgtgccgttcgcagcactcacagtctttcctttttatggaatatcaggagttctcacttacagcatcggcatttggttactgatggttttcaacggatattggtatctgctttgccgtacgctgattaacgagcatatttggtgggtgttacttcccatcgttgtctacagtggaatcgccatcgctatttttattccccaaacgggatttataagtaactttttcatgaacctgggagaaggttatatcgaaggaaatctacttgcttacctaggtacattggcagccactgttctggtatggtgtatcaaccgtaaagtgatgaccggtttaatatacaacgaaatcaataaagtagaagacacaaaagtaaaaaccgtatccgaataccgtttcctggaacgcttcggagaggtaggcgaatatatgcgtctggaattgaagatgcttctacgcaacaaacgctgtaaggcctcactccggtcggtagcaatgctcgtaatcatcttctccatcatactgagtttcagcagtacgtatgaccacatgaagagttttgtccaggtatactccttccttggattcggtatggtgattctgatacaacttatgggatttgaaggaaactatatcgacggactgatgactcgcaaagaatccatcaaaagcctgttgacagccaaatattatatctatagcttggcggaaatcattccgctgatcctgctgataccggcttttgtgatgggaaaagccagcctgctgggtgctgtcgcactaatctttctgacaacaggtcctgtctattgcatcttgttccaactggcggtatacaaccataaaaccgtaccactcaatgaaagcatcacaggcaaacaaagtatgaataccggaatgcagatgttaatcagtttcggacttttcatcgtaccaaccacactctatggcacgctccccatgctgctgggacaaacatgggcctacattgtcatattaatcatcggattaggcttcaccttgacctcccctatgtggataaacaatgtatatgtccgtttcatgcaacgccgttacgaaaacatggaaggattcagagatagtaaataa

SEQ ID NO: 3307 - DNA, 795 bp, B.fragilis
ataataaacatgcatacaagagaagaacaaatggaagcgttcggacgctttctggacatcctcgacgaacttcgggtaaaatgtccatgggaccgcaagcagactaacgaaagcctgcgccccaacactattgaagaaacttacgaactttgcgacgcattaatgcggaacgacaaaaaagatatctgcaaagaactgggagacgtcctgctgcacgtagctttttatgctaaaatcggttccgaaaccggtgatttcgacatgaaagatgtatgcgacaaactttgtgagaaattgatattccgtcatccccatgtattcggggaagtaaaagcagaaacagccggacaagtatccgaaaactgggaacaattgaaactgaaggagaaagacggcaataaaagtgtgttaagcggtgtacctgctgctttaccctcacttataaaagcttacagaatacaggacaaagcacgcaacgtaggattcgattgggaagaaagagagcaggtttgggataaagtaaaagaagaaatagccgaatttcaggtggaagtagccaatatggataaggataaggcagaagcagaattcggagatgtcatgttcagcctcatcaatgctgcccgactttataaaatcaacccggacaatgcattggaacgtaccaaccaaaaattcatccgacgatttaactatctggaagatcataccattaaagaaggtaaaaatctaaaagatatgagcctggatgaaatggatgccatctggaacgaagctaaaaagaaaggattatag

SEQ ID NO: 3308 - DNA, 651 bp, B.fragilis
gtgtatacaatgaagcagattataattagcatttggatagctttactgactttgcctgtgtttgctcaacaacaaatgcaggcaaaagttgtgcttgataagacggcggccacatttgaaaaggcaggcggtatctgtgcggaattcaacgtgacagtgtttaacaaaagcaggatggccggacagtctgccggagtcatcgaactcaaaggggaaaagtttgtactgaaaacagacgatggtattacttggtttgatggtaagacccagtggagctatctgagaagcagtgatgaagttaatatcagtaaccctaccgggaccgaattgcagggccttaatccgtatgcgcttttacagatataccgtcatggcttcgactataagatcggatcattgaagaactttggtggcaaaccggtctatgaggtagtattgactgctactgataagaagagagatttatcgcgaattgtgctttatgtgagtaaagacacttatcaacccttgttcattatgatggaacaacgtgataagagtcgtagcgagatcactgtgaccggttatcagacaggtttgaaatatgccgatggtatgtttgtgtttgataagaaacaatatcctcatgccgaagtgattgatcttcggtag

SEQ ID NO: 3309 - DNA, 2655 bp, B.fragilis
actaataaaatagatagatataacatggaattagcaagtaagtacaaccctgctgacgtggaggggaagtggtatcagtattggctggaccataaattattcagttcgaaacccgatggacgtgaaccttacaccatcgtcattccgccccctaacgtcaccggtgtgttgcacatgggacatatgcttaataataccattcaggatattcttgttcgtcgtgcacgtatggaaggtaagaatgcttgctgggtgccgggaaccgaccatgcctctattgctaccgaagccaaggtagtgaataagttggccgcacagggtattaagaaaaccgatctgagccgtgacgagtttctgaagcatgcctgggcatggacagacgaacacggtggtatcatcctgaagcagcttcgtaagttaggtgcatcgtgtgactgggaccgtacggcttttactatggatgaaaagcgcagtgaaagtgtgctgaaggtatttgtcgatctctataataagggacttatctaccggggagtacgtatggttaactgggacccgaaagcactgacagccctgtcggacgaggaggtgatttataaagaagaacatggaaagctgttttacctgagatacaagattgaaggagaagacggatatgcagtggttgccactacccgtccggaaacgattatgggtgacacggccatgtgtatcaacccgaacgatccgaagaatcagcatctcaaaggaaagaaagtaatagttcccttggtaggccgtgtgattcctgttatcgaagatgactatgtggatatcgaatttggtaccggttgcctgaaagtgactccggcacatgacgtaaacgactatatgctgggcgaaaaatataatttgccgagtatcgatatattcaatgataacggtacgatcagcgaagctgccggaatgtatatcggtatggatcgctttgacgtccgtaagcagattgagaaggatcttgaagcagccgggctgctggagaagacagaggcttacaccaacaaagtgggatattcagagcgtaccaacgtggtcatcgaaccgaagttgtctatgcaatggttcctcaagatggaacatctggcccagatcgctcttgaaccggtgatgaaggatgatattaaattctatcctgccaagtataagaatacctaccgtcattggatggagaatatcaaggattggtgtatcagccgtcaattgtggtggggacaccgcatcccggcatatttcctgcccgaaggcggatatgtggtagctgtgacggatgaggaagccttgaagctggctcgggaaaagactggcaatcctaacttgaagatgaccgatcttcgtcaggatgaagactgcctggacacttggttctcttcctggttatggcctatctctctgttcgacggcatcaataatccgggtaatgaagaaatcaattattactatccgacaagcgatctggtgaccggaccggatatcatcttcttctgggtagcccgtatgattatggccggttacgaatatgaaggaaaaatgccgttcaagaatgtatatttcacgggtatcgttcgcgataaactgggacgtaaaatgtctaagtcactcggtaactcgcccgatccgttggaattgattgaaaagtacggagcagatggtgtacgtatgggcatgatgctctcggctcctgccggaaatgacattctctttgatgacgcgctttgcgagcagggacgaaatttctgcaataagatatggaatgctttccgattggtgaaaggttgggagaacggaatgggaacaatcgatattccggcagatgctcacctagctgtacagtggtttgaccagagactggatgccgctgctgtcgaagttgccgatttgtttagcaaatatcgtctgagcgaagcattgatgctgatttataaactcttctgggacgaattctcttcatggttgctcgagattgtgaagccggcttacggacagcccgttaacggattcatttactcgatgacgttaagtgctttcgaacgtctgctggctatgctccatcctttcatgccgtttattacggaagagttgtggcagcagttgcgcgagcgtgaaccgggtgcaagcctgatggtacagcctttgggagaaccgggagaggtaaacgaagaatttctccagcagttcgaaacagccaaagaaatcatcagcagtgtacgtaccattcgtttgcagaagaatatcgcattgaaagaaccgcttgaattgcaggtagtcggagccaatccggtagaaaagatgaatcctgtcattcgtaaaatgtgtaatctgtctgccatcgaggtagtggacgcaaaggccgacggagcttcttcgttcatgataggaaccactgaatttgcggtgcccttgggcaatatgatcgatgtcgatgccgagatagcacgcatggaagccgagctgaaacacaaagaaggtttcttgcagggagttttaaagaaattgagcaatgaaaagtttgtaaataacgctccggcagccgttatcgagatggagcgcaagaaacaggcggatgccgaaagcatcatccagtcgctcaaggaaagtattgcttccctgaaaaatgtataa

SEQ ID NO: 3310 - DNA, 954 bp, B.fragilis
aagtacgaaataataaatataatatccatgagcgtagaacctggaaaatggggtgtaatctacaatcccaaagcaggcacacgaaaggtgcagaaacggtggaaagaaataaaagagtacatggactctaagggagtgtcatacgactatgtgcagtccgagggtttcggatcggtagaacgactcgccggcattctggccaacaacggttatcgcaccatcgtagtagtgggcggagacggtgcattgaatgatgccattaacggcattatgagttcgaacgcagaaaaaaaagaagagatagccatcggtatcatccccaacggaataggaaacgactttgccagatactgggaattgaatctggaatacaaacaggcagtagactggattatcaataaccgccaaaagaaaatagacgtgggttactgcaacttttacgatggcgaaaaacaccaacgacgttacttcctcaatgcagtcaatataggattaggtgcgcgtatcgtaaaaatcacggaccagaccaaacgtttctggggagtaaagttcctctcctatctggcagctctcttcctgctgatattcgaacgcaagctttatcgttcacatctcaaaattaacgacgaacacatccgcggacggattatgacagtctgtgtgggaagtgccaccggatacggacaaaccccaagtgccgtaccctataatggctggctggatgtatcggtcatctaccgtcccgagttcctgcaaatcttgtccggactgtggatgcttattcaaggacgcatattgaaccacaaagtggtgaaatcctaccgtacccgaaaagtaaaagtattgcgtgcccagaatgccgccgtcgaccttgacggacgcttgttgccacgccatttcccgattgaaataggaattatcccggaagcaaccacattgattatacccaattga

SEQ ID NO: 3311 - DNA, 1581 bp, B.fragilis
tttacagaaataaaaaagatagtaattatggtaaaacgaatgatttcccaactttcggtactggcagtactgatcgttttcatggcagcctgctccaagaaagcggaatatatccatgtgattccggccgatgcttcggctgttgcttccattaatctgaattctcttgctgacaaagccggcttgaatgataaacagaatgaagggatgaaacaaaaaatgatggaagccctgaaaagcggaatgaatgcagctgctttccagcaactggaaaaaataatgaaaaatccttctcaatcggggattgatgtcaaagctcctgtattcgtatttacttccaagactttcattagtcccactatagttgccaaagtcagtaatatcgaggacttgcgtgcttcgctcgacttaatggccaaagaaggaatctgccagcctatggcagaagaagaggggtacagtttcacatccttgcagaagaacaatctattggtctttaatgaaaatgcagcagttttgacagaagcctacggaacttctcaaatggatgttgccaaacaaaccatctccacactgctcaaacagaccgaagagaacagtatcgcctcaaacggcagtttccggaagatgcaggatcagaaaggagacatcaacttttttgcttcaatggatgcggttcccaaaatgtatactcaacaaatcagtctgggactctcttcacaaatcgacttgagtgaagtaaaagctgtgggtaacctcaactttgagaaaggaaaaatcgctctgcagatcgaaacctactcggataatgcagagacggatgcgttactgaagaaacaggctcaagctgttaaaaagttaaatacaactttcctccagaacttccccgaatcgactctcgcattcttaaatataggagtcaatggagcagcattctacgatttgctgttcaataatgaagaattccgtagaaatgtgtctcttgcgaaagccgatgaagtaaaaagtttattcgcctctttcgatggagatatttccatcggactaattaatgtaaccttgaacagtgttcctacttttgctgcttatgcagatgcaaaagacggaaatgccctgaaagcattgtacgacaataagaaacaattaaaattaggtaaaaacgaagatattatccaattgggcgaaaacgaatatgtttataagtcaagagcaaccaacgtattctttggcatccgcaacaagcagatgtatgccactaatgatgaacttctgtacaagagtatcagcaaacctgtagagaaatcaatcaaagatgccggatatgtatcggatatgaaaggcaaaaatgtattctttgttatcaatatggatgctattctcgatctccctgttgtgaaaatgatggccggattcggcggcgaagaatatcaaacttattataaactcgcttcaaaaatttcgtatatcgaggcattcagtgacagcgaaggtaagaccgaaacagccattcttctgaaaaacaaagacgacaatgctttaaaacagatagtagactttgccaagcagttcgccggcatgtaa

SEQ ID NO: 3312 - DNA, 576 bp, B.fragilis
catatacgaattacaaacgaacctatgaacccttataatgaacgagaggttttggcgctccttcaggatgagagaacacagaagcagggatttgaaaggattgtctcacaatatagcgaacagttatactggcaaatccggcggatggtgctttcacacgatgatgccaatgatcttcttcaaaacactttcattaaggcgtggataaacattgattatttccgggctgaggcaaagctatctacctggctttaccgtattgccctgaacgaatgtatcactttcctgaataaacagcgggctatgaatacggtcgccattgacgatccggaggccgatgtcacccagaaactggagagtgatccttacttttcgggagatcgtgcagaacttttgcttcagaaagcactgctgacccttcctgagaagcagcggatggtgtttaacctgaaatactatcaggagatgaagtatgaagagatgtcggagatattcggcacttcagtcggagctttgaaagcttcttaccatcatgccgtgaaaaaaatcgagaagtttttggaagaggccaattaa

SEQ ID NO: 3313 - DNA, 657 bp, B.fragilis
aagaatatgattttaaaaagaaccataagcaaagaagaggtgaaggagatgcccaaagcagcatttcccggacggattcatgtaatacagactgaaagtgaggcgcaaaaagcggtggcttatctgcaatcccaagccatcttgggaatcgacagcgagacacgtccctcattcaccaagggacattctcataaagtagcattacttcagatttcatctgacgagtgttgctttctgtttcgcctgaacatgaccggcctaacccaacctatcatagaactacttgaagatccgaaagtaatcaaagtgggcctttcgctaaaagacgacttcatgatgttacacaaacgagcccctttcaatcaacaggcatgcattgagttacaagagtacgtccgtcctttcggcattcaggataagagcctgcaaaagatatacggtatcttgtttagtgagaaaatctcaaaatcacagcgtctttctaattgggaagcagatgtactgacggatgctcaaaagcaatacgcagctacagatgcttgggcctgcctcaacatatatcacttattggaggaactgaaacgaacaggaaactacgaattggctccggaagaggaagccacagagaaagtaaaagtaggttcagatcaacaataa

SEQ ID NO: 3314 - DNA, 864 bp, B.fragilis
tgtataaggatggaactacttttgggtattgtgattgtcgttacctgttggatggttgttcgtattattcgttcaagcaaaaatcaggaaggatataaaaggtggagggccggtaactatgccagtgaaaatccttatgccaaagaaaaagcaagtggtccgctttcccaaggtctttttagtaagagagtcagaactaccggtgcgaggcggttcgatgacggagctatcaggtggtgtgccaatctgctggcaaccgaagaatccagattgagggaagtgttggattatataccgcgccaatatacctgttttcatgttcggaaaagaagtggcggatttcgttatatttcggctcccgcaggtgattttcgttccatgcaacaaactatctatcaccgtattttattgttagctaacatacatcccgctgttaccggattttgtccgggaaagtccgtatccgataatgcacgggtgcatctggggcgaaagaatgtattaaaagtagatcttcacgacttttttccttccatacgttcacccagggtgagagcagcttttagggagatggggtactcacgtcccatcgcgaaagttttggcggaactttgttgtctcagatgttttcttccgcagggagcgcctaccagtccggctctcagtaatattatagcctatccgatggataaaaaaatgatggcgttggccggtgaatacgggttggtttatacgagatatgccgatgatcttaccttttcgggtgattatttgccgaaagatgaagttttggtacgaatccacaggattattcgggaagaagggtttcacgatgaacgtcaaaaagacccgcttcttgtctga

SEQ ID NO: 3315 - DNA, 2517 bp, B.fragilis
tcatatagcttaagattcatcatccacatggcaaaaaagaaatcagataaggaagcagaacagaagccggcttccacaaaaaaatatgtggctttcttcaggaacgaaacaattcactttgtaatcgggttggtactggtcattttctcagtctatttgttactggcctttacctctttctttttcactggagcagctgaccaaagtattattgatagcggaaatgcccaggaccttgctgctgtgaacaatcacgtaaagaactatgcaggttcccggggagctcagttggcaagctacctgatcaatgattgttttggcatttcctctttctttattttaatctatttggctgttgccggactcaaattaatgcgtgtgcgtgtggtacgcctttggaaatggtttatcggatgttcattgctgctcatttggttttctgttttccttggtttcgtttttatggaccattatcaggactccttcatctatctgggtggattgcatggttataacatcagtaactggctgatttctcaagtcggcattccgggtgtatggctgattcttctggcaacaggtatttgtttccttatatatatgagtgcccgcaccatcatttggctgcgtaagctttttagtcttagtttcttgaagcgtaaacaaaaagaagaacttgctgaagttactcaggctcctcaatcacatgaatatgataacccaaaacctcaggaagtggaatttgatgtaaatcgtactttccgtcaggaagtaccggtgaaaaaggtggaaactactgttgtgtctgaaacacctgtcgaatcttcaaccgaaatgcctgtgactccggaagacagggatgtgacatccgatggtgatgtgactatgacttttgaacagacagctcctgatcccgtacctccttttcgggcagcgtcggcagataaagagcctgagttcgagatagagcctgctgccgatgatgaaaattatcagggtgcggagaccgaaccttacaaccctaaattggatttagagaactatcattttcctactatcgatttgatgaaacactatgaaaatagtgagcctaccatcaatatggaggaacagaatgcgaataaagaccgtattatcaatacattgcgtagttttggcattgaaataagtacgattaaagctacggtaggacctacggtaactctttatgagatcactccggaacaaggagtacgtatttcaaagattcgtggcttggaagacgatatcgctttgagcctttctgcgttgggcattcgtatcattgctcccatacctggaaaaggtacgatcggtatcgaagtgcctaactcaaatccgaagatcgtttcaggacagtctattataggtagtaagaagtttcaggagtcaacctatgatttgcctattgcacttggtaaaaccattacgaatgaggtattcatggttgatctttgcaaaatgccgcacgtattggtggcaggtgctaccggacaaggtaaatctgtcggcttgaacgctatcatcacttcactgctttataagaagcatcctgccgaattgaagtttgttctggtggatcctaagaaagtggaattcagcatttattctgtcattgagcatcattttcttgcaaaacttcccgatggtgaagatgctatcatcactgacgtaactaaagtggtgcagaccctcaattctgtttgtgtagagatggacagccgctatgatttgctgaaaatggctcatgtgcgcaacattaaagagtacaacgagaagttcatcaatcgccgcctgaatccggaaaaggggcataaatttatgccttatatcgtagtggttattgatgagtttggtgatttgattatgacagccggtaaggagatagaactaccgatcgcccgtattgcgcagttggcacgtgccgtaggtattcatatgattatcgcaacccaacgtccgactaccaatatcattacaggtactattaaggccaacttcccggcacgtatcgcatttcgcgtgtcagcgatgatggactcacgtaccatcctcgaccgtccgggagccaatcagttgatcggtcgcggtgatatgctcttccttcagggagccgatccggtacgtgtacagtgtgcatttatcgatacgcccgaagtggaagaaatcaccaagtatatttcacgtcagcagggatatcctaccgccttcttcctgcccgaatatgtgagtgaagatagcggtagtgatttgggtgaagtcgatatgggacggctcgatccgttgtttgaggaagctgcccggttgattgtgattcaccagcagggatctacttcgctgatacagcgcaaattctccatcggctacaatcgtgccgggcgtttgatggatcagctggaaaaggccggtattgtaggtccctcacagggaagcaaggcacgcgatgtgctgtgtgtggacgaaaatgaccttgaaatgcgtttgaacaatattcaataa

SEQ ID NO: 3316 - DNA, 405 bp, B.fragilis
ttgataatattaaatacaaagaatcttaaacttaaaaaagacgaaccccttatgatgattgaagtgttgaagtcaaaaattcattgtgcccgtgtcacggaagccaatctgaattatatgggtagtattacgattgatgagaatctattggatgcagctaatatgattgccggtgagaaggtgtacattgccgacaataataatggcgagcgttttgagacctacattatcaaaggtgaacgcggatcaggtaaaatctgcttgaatggcgctgcggcccgtaaagtacaaccggatgatattgtgatcattatgtcgtatgcgttgatggattttgaggaagctaagtcgtttaagccgactgttatttttccggatccggctacaaatagtgtagtgaagtaa

SEQ ID NO: 3317 - DNA, 933 bp, B.fragilis
tttacgatatttcttctttatatggtaaattatggtttattttgcaccgtttttcgaacaactaagaatcataaaccaattaaaatgaaagtaatacatacgatcaaggacttgcaggctgaactttcggttttgaaagcccagggtaaaaaggtggggttggtgcctactatgggtgctttgcatgcagggcacgcatctcttgtaaagcgtagtgtaaacgagaatgaagtaacggtggtaagtgtttttgtgaaccctacccagtttaatgataaaaatgatcttgttaagtatcctcgcacactggatgccgattgtaaattgctcgaggcttgtggagcgacttatgcttttgctccttcggtggaagagatgtatccggaaccggatacccgccaattcagttatgctcctttggatactgtaatggagggggctttccgtccgggacactttaatggagtatgccagatagtaagtaaactgttcgaagcggtgaaaccacatcgtgcatactttggtgagaaagattttcagcaattggctatcatccgtgagatggttcgtcagatgcagtttgatcttgaaatagtaggttgtcctattgttcgtgaagaagatggtttggctctgagcagccggaatgcgcgtctgtcggcagaagaacgtgaaaatgcattaaaaatatctcagaccttatttaaaagtcgtacctttgcagccactcacacagtgagtgaaacgctgaagtttgtggaagatgctattgctgctgttccgggattgcgtctggagtattttgagatagtagacggaaacactttgcagaaggttgataattggaaccaaacatcgtatgtagtaggctgtataacagtgttctgcggtgatgtcagactgattgataatattaaatacaaagaatcttaa

SEQ ID NO: 3318 - DNA, 867 bp, B.fragilis
aatcgcttatctttgctcaggtctattatatgtaatatgtgtaatctgtctgatgagtcgaagcagtttgagatgacgcctccgagcagcaatctttcgtcactttttcctacagggagagccgtgcgcaatcctcttggtaaggtttatttcgtggttatattaaaagggaaggccatggtacggatagatggcaaaagcatgctgttgcccgaacggactttcttgtttcttccgccggggcatctactcctccggctttcgtgtacgcaggattttctttttcagtatctttcattcagtttcgactttctgtccgattttcccctgttgttgaaggcagacatatcgaatcaggttactaatgcaccttgtctaccaatgtccccggaggatttcagtttgataaagatgtattatcatttcatttatcatcgttattcggatgccgaatgtccgtcagaagttatcaaagggatgctgttctctttggtactggaagtgtgccggatgtattcgggtagaaatatttcggtagagatgtcccggcaagataaattggtagatggtttcttcagtctgttgcataaatattgcacacaagaacggatggcagccttttatgcgagccggttgtgtatatcggataaatatctgatgaggagtataaagaaacaaaccgggcaaacgtttcactattggatggcggattttatactgagagaagccaaactgatgctgagatcgacggatttgagtgtcacagagatagcggataaacttagttttccgaactcttcttctttcgcgcgttttttccgtaaatatacaggcttctcgcctgttcagttcagaaatgaagcataa

SEQ ID NO: 3319 - DNA, 972 bp, B.fragilis
aaaaccgtatctttgcaccccgaaaaaatgaatataataatgaatattaatagtaaggctaaaggatttgtgtgcggggctgtggctgccgccacttatggcatgaatccgttgtttacactgccgctttataaagagggaatgtcagtggactctgtcttgttctaccgctacgggtttgccgtgctcattctaggcattctgatgaaagtacaaggacaatcgttcgctctgaaaaagaacgaggttctgccgctgattgtaggcggactgctcttttctgcttcctcattgttgttgtttctgagttataagcacatggatgccggcattgcttccaccattctgtttgtctatccggtgatggtggcgcttatcatgttcttgtttttccatgagaaagtatcgttactgaccgtgttctgtattctgttggccctttccggcatcggactgctttacaaaggagaagggggtgagacgctgagtctggtagggatgttgctggtcattctttcttcgctgtcttatgcggtctatatagtcggtgtcaatcattccaccctgaagttgatgtcaacggccaagttgaccttttatgccctgctgttcggtctttccatttatatagtccgtttgaatttttgttcggacttgcaagctgtgccttcacttcctgcctggggtaatattctggcaatggctttcctgcctaccgtgatttcactggtatgtaccgctgtgtccattcacaccattggctccacgtcgaccgctatcttgggagcactcgaaccggtgacggctctcttctttggtgtcatgatttttggtgagcggctgacgcccaggctgatgctgggtattctgatgattctggtggccgttacgtttattgttgtgggaaagccgttgatgacttttctcaaagaagaagtggccggaggaatgaagagaaaactgacaagataa

SEQ ID NO: 3320 - DNA, 810 bp, B.fragilis
tctatgcaatcattcagagtcataaagcccacagcggcactcgttccttatgtccggcattactgggtgttgagcgacgatgcgcttgcaccggtatccgaacggacgctgcccgtggggtgcgtccaaatggtctttcaccgggggcgccaactgttttcgctgaccgaaggccggttgcaaccctcttctttcatcagcgggcaggcgttcggctattccgatgtcgagtctacggggatgctggagatgatcgtagtcgtttttcagccttttgccgcaaaagcttttctccatatgcctgtcagcgagtttcgtgggatgaatgtaaataccgaagagacgggcgatcctctgttggttgatctgggcaggcggatagccgatatgccggatcgggtagcgtgtatccgtctgatagaggagtttctgttaagccgtctctatgcttttcccgaatataacctgaagcgggtttcgaccgtttgggaggcggtgaacctccatccgcacatccgtacggcacaactggcagacgtagcctgcctgagcaataagcagtttgggcgggtgtttgcggagtatgtaggcgctactcccaaggagtttctgcgcattgtgcggatacagcgggcgttgtatactctacaatgccagccgggcatttcgtttgcgcaactggcctacgaatgtggtttcttcgaccaatcacacatgattaaggagttcaaactcttttcgggatatactccggcggaatatctggctgtttgcgctccttattccgattatttctctgtggaggaatga

SEQ ID NO: 3321 - DNA, 498 bp, B.fragilis
gaaatcagatctatgaagcaacaagaaactaatccagacagcctaattgaaaactatcttccggcagattattatgactccttttcaaaagagttgcataataagaatgcaatctccactgacgagtttgcagatatagtttttaaccaactaccctcctggattatccggcttctaaaagtaagaaattgtatagtcaagccttttggactcaatacaaacagacgaatcacggatatggagtgtgaaagaaatcaacacgaaataatctttggcatgtccgataaacacttgactttttacgtatccctttggtgtaaggtttccgaagccaacagccaaactttacgaatcaccacgatagtcaaataccacaaccgtttgggaaaactctactttttcgtggttcgtcctttccataaagttattattcgatcattattggagagagtagaaaaaaggtataaacttatatctctggagagagaagcgtcttga

SEQ ID NO: 3322 - DNA, 876 bp, B.fragilis
aagatagatcccaattctttttcttacctttgtgtgttgtggagacataaatccgacaactataaagccgcaaatgaccgaaatactgaaaaacaaaaatcagcttatagaatgaatactcccctccaaccctacagaataggcaacagtacacttctatcgaacaggaaaaccaccgctttcctatgctcccgacaagttcctgagaataaaataccacccatttataattggataaatcaattatctccggaaaaagactgtatcctatgcggtaatcattcaaggatggaacaagaggtcttcaatatactattggaaaagaaaataccagtcattttggcattggctgaaggcatgaaaaaagaatgggacaataaggttaagttagcactcgaagaaaacagaatgcttatcgtaacaacttgcgacgacaaaatacataggatcaatcatcaatcggcttatgaccggaatgaaacgattctctcactcgctgacgatatcataatcggctactgcacacccggaggaaatattgatagacaaactaaaggaaagaccaatatcacgtacttacaaaaatcggattatctatcaacagaattaatattcacggataaagtggctgacagtgatgtaatgatctatagaacatcgactaagaaagggaagattttcttagatatcaaacaagaatcaagtggacaagaatatctgaaaatcacccaaagtaaacctcagggaaatagcgctttccacagagagaccatttttatagacaagaatgaagtgctccaattcaaagaagaattggagaaagttattgattattggaagatatctaccattaaaaagaatcagactcctatatga

SEQ ID NO: 3323 - DNA, 1293 bp, B.fragilis
agacaggtacctaccattcctcgtatcgatatggtgtacgatgctttcaaggcctatgtgatagggggaaaagctcccgatactatcagcgaagtagtcaaagacatttatacttattccggatattacgtcaacatggttcttcacaaagagccggataagctgctttgcggggctttcaaacgcatcagccagttgagggttgacgttagttacccgtttttattaccgttgtacaacgattatgtcaacgaagttatcagcagggacgagttctacgaagctctttgtctggttgagaattatgtgttcagacgtgccatttgcggcataccgacaaatagcttgaataagacgttcgctactctctataagtcattcgataaagcgaattatatggatggtctgaaagctgcattcctattgctggatagttataagcgctttccgaacgatacggagttcactactttcctacaaaccaaagatgtttataatttccgtaacaggaactaccttttaaatcggttggaaaattttcagcgtaaggagatggtgaatatttctgattataccatcgagcatgttatgccccaaaatcctaatctatcacacgaatggcaagagatgttaggggaaggttgggtagaagtccagggtaaatatttacacacacttggtaatctgactctgacaggttataattcggaattgagtgatcgtccgttccaagaaaagaagagtatggagggaggtttcgacgattctcctattcgcctcaattcatatctgaggagaatcagttcgtggaatgaagagcaaatacttgtgcgtgcggggcaattggctgagaaagctaaagaaatatggaggtttccgttattatcgccggagacacttgaagtttatagatctgcggagagagatcctgcagagtatacgttggagcactatgaatatctgaagggagacatacttactctgtttcaggccttgcgcagaaggataatgaatatagatccttccgtaaaggaggaactcaagaagttgtacattgcctttaaagcttatactaactttgtggatgtcgtgcctcagaaatcccggttgcgcctttctctaaatgtagcatttgcagatatacttgatccaaaaggtttgtgcaaagatgtatccaacttgggacgatggggcaatggcgatgtagaagtcggtatttcgaatatgaatgaattggatgatatcatggagttgattcaacaagcgtttgataagcaaatggaagcgaactga

SEQ ID NO: 3324 - DNA, 852 bp, B.fragilis
attctttcgcccatgatagaagctcccgaagcccgcctactgtgcgagcaactgaacaagaccgtatgcggcaaacgaatcacggatgtgttcgctcaatacacaccacataaatttgcctggttttatggtaaaccggaagagtgtgccgaacgcctggttggcaagaccattgacagagcctgtccacaaggcggaatggtcgaactaacggcgggagacacgatgttggttttgacagacggggtcaatcttcgttatttcgaaccgggagcgaagttaccctccaaacatcagctgttagtagcattcgatgacgaaagttgcctgttagcatctgtacggatgtacggagcactgttgtgctttacccaaggacattttgacgcaccgttggccgcttactacgaaacggccagaacaaagccacaagtgatgacagacgcctttgacaaggagtactttcttggattggtaaatgcgccggaagcacagaagaaaccggcaaaagcttttctggccacggaacagacaattcccggactgggcaacggagtgttgcaagacatcctgtaccatgcgcatatccatcccaaaacaaagatcgacaaactgggcgcaaaggaaaaggagaaaatgtacgaacaagtgaaagagacactacaagatatctaccacctgggcggacgaagcaccgaaaccgatttattcggagttcccggccagtacgtagcctccctgtcaaaagatacagcgggacatgtgtgcccgaaatgtggtgaaaccattgtgaaagagaactatctgggaggaagcatttattattgcaggggatgccaagtaatgaaataa

SEQ ID NO: 3325 - DNA, 1017 bp, B.fragilis
atatcgtcgccccgtgtcaagactttctcttgggaactcgatttgtggggaaatcttcgttgggcccgttccgccagcattgccgagtaccttcagtctgtggaggcacaacgtgcccttcgcatgactatcatagccgaagtagcgcaggcatactatgaacttgtagctctcgatacggaattggatattgttcgccaaacattgaaagcacgtgaggaaggcatgcgtcttgcccgcatccgtttcgaaggaggtttgacatctgaaacttcttatcgtcagtctcaggttgagttggcacgtactgcaacactggtgcccgatctggaacgtaaaatatctctgaaagaaaacgatatagcttttctagctggtgaatatcccaacaaaattacccgtagccgtttgttgcaggagtttaactttccacaagagttacctgtcgggttgccttccggattattggaacgtcgccccgatattcgtcaggctgaacagaaattgattgctgccaatgcccgggtaggagtggcttatacgaatatgtttccacgtatttcacttaccggtagggtagggtcggaaagtaccgctctctccgaactgttgaaatcgccttatagcattatggaaggtgctttacttacgcctatttttggttggggaaaaaatcgtgccgctctcaaagcaaagaaagccgcttatgaagctgaagtgcacagctatgaaaaggctgtcctgactgctttcaaagagacgcgcaattcgattgtcaacttcaataagattaaggaggtatacgaccttcgtgcgaaattggaacgttcggctaagagttatgtagacttggcacaattacaatatatcaatggggtgacgaactaccttgatgtgctcgatgcccagcgtggatatttcgatgcccaaatcggactcagcaatgcgataagggacgaattgatcgctgtagtacaagtgtataaggctctggggggcggatggcaggtgcaatga

SEQ ID NO: 3326 - DNA, 1683 bp, B.fragilis
gttcgaattactaacacctttaaatataagataaagaaaatgactaaaagtgcattgcaaattgccagggctgcttatcagcccaaacttccgaaagcgctgaaaggctcagtaaaagcagttgaaggcgcagctacacaatcagtagccgatcaggaagctatccagaaactgttcccgaacacttacggaatgccgttgattaaattcgaagaaggtgaagctatccagctccccgctatgaatgtaggtgttatcctttcaggaggacaggctccgggcggacataacgtaatctctggtctgttcgatggtatcaagacactgaacaaagacaacaagctgtatggctttatcctgggtcccggcggattggttgaccataattatatggaactgactgccgatatcatcgatgaataccgtaatacaggtggtttcgacattattggttcgggacgtaccaaactggaaactccggaacaattcgaaaaggggctggagattatcaataaattgggtatcaaagcactggtaatcattggtggtgacgactctaatacaaatgcctgcgttctggccgaatactatgctgccaagaatgccggtgtacaggtgatcggttgtccgaaaactatcgacggtgacttgaagaacgaaatgattgaaacttctttcggtttcgatactgcatgtaaagtatactcagaagtgattggtaacatccagcgcgactgtaactctgcacgtaaatactggcacttcattaaactgatgggccgttcggcttctcacattgcactggaatgtgctttgcaggttcagcctaacgtatgtatcatctctgaagaagtggaagcgaaagatatgtcattggacgatgtagtaacttacattgctaagatcgttgccgatcgtgctgctcagggcaacaacttcggtactgtgctgattcctgaaggtctggttgagtttatcccggctatgaaacgtctgatcgctgagttgaatgacttcctggcagccaatgccgttgagttcgcaaatatcaaacgttctcgtcagcgcgaatatatcatcagcaaactgtcaaaagaaaatgctgagatctatgcaagccttcctgaaggtgtagcacgtcagctttctttggatcgcgacccgcacggaaacgtacaggtatcattgatcgaaactgaaaagctgttgtctgaaatggtaggaacaaaactggctcagtggaaagaagaagggaaatacgtaggtaaatttgctgcacagcaccacttcttcggttacgaaggacgttgcgctgctccatcaaattacgatgctgactactgctactcactgggttacacagcttctatgttgattgctaacggtaagaccggttacatgtcatctgtacgtaatacaactgctcctgctgctgaatggatcgcaggcggtgtgcccattacaatgatgatgaacatggaacgtcgtcatggcgaaatgaaaccggtaatccagaaagcattggtgaaactggacggaaaaccgttcctgacattcgctgctaaacgcgatcagtgggcgttgaatacagattacgtatatccgggcccgattcaatacttcggtccgacggaggtttgcgaccagccgactaagacactgcaactggaacaagctaagtaa

SEQ ID NO: 3327 - DNA, 2907 bp, B.fragilis
aaaggaaatacaagtgaagtcttttatgagaacaaaatttgtatttcctttgttttatttatcttatgtttaatttaccctaataacatgaagaaacatctaattctaatgatttctgcagctattatccctctgctgctgtatgcttgttctgctgaagaagaaagagcgttaacatcgactactcttgaggtagcacagtctgccattgattttaaaagtgatgcagggacccgtgacatcgctattgttaccaatgcagaccattggacggcacggtctgataaagattggtgttcggttgctgtcaacgaaagtacattgacggtgaatgtgtccggatacgatggaaaagagacaagggaggcagtgattaaagttactgccgatggattggcagaaactgttaacgtacgccaattgggatcagagcctgctattttgatatctcaacagatctttaccgttgaggccagtggcagtgatatcgcattcgatgtaactacaaatgtttcggtgactatcacattgccggaatggatcaaagagaaaccggcaggtacacgtgcatccgaaatggtgactacgacgcataattacattgttacagccaatccggaagatagtgaacgtacgggcaatatcactgtgaaagaggtcggcggagaacttgaggccttggtatctgttactcagaaaggattgggagaatatgaatccggaaatctcgagggtatcaaagacgatattaaggttccggtagaatcaggtgaagcaagctcttttcagggtggctcgaatattgataaatcattcgatggtgatatgagcactatttaccattctaactggaataacgcgggagatcattatttccccattacgttgacttataattttgctgcgggttcggatatggactatcttatatattatccccgtacctcaggaccgaatggtaacttcaaggaagtggagatccgtgtaaagtcaaatgcgaataccagagggaccgatgaatggaatacggtgatgactaaaaacttcggggggacgaatgccgcagtccgtgttaattttccgaaggcacaaatcggagtcacgtcggttcagtttattgtcaaatcaggatcgggagacgggcagggatttgctgcttgtgccgagatggaattttataaaaagaatccggatgcattcgacccgctcactcttttcaccgatggtacatgctctgaattgaagcccggacttaccgatgaagaaatagagaactgtccgtattcattctacaagaacatagcttactatatgaagcagggtaagtatccggcagagttccgtattcaggaatataaggcttggccccatccggatgcccagtcagaaacacataagaccagtccttatagcctgcgtgataatcctacgggaatttcggttaaagatggagagcaactgatgatttttgtcggcgatacacatgggcagactgtcagtgcagtgattcagaatctggatgttcccggtggtgatggtttcggaggaacctcttatccgttgtctgaaggggccaacaagattacagcccggaataaaggattaatgtatattttgtatcacactcctgactatgaaactgctcagcctgtaaagatacatatcgcttccggacaagtaaacggctatttcgatgtagctaaacatcaggcttccgattggaataaattgttgagtaacgctgtggataagtatttcgatgtggtgggacattatgcacatctcacattcccgaccgagcgtttccgtactcatactccggacgggaaagcactgatcgatgcttatgatcagattgtgaattcggagatggaactgatgggattgtataaatacaataaactgttcaagaaccgcatgtacctgcatgtgatgtataccagctatatgtatgccaccagttatcatactgcttacaatgacggtactctggccgaactttgtaatgtggataaattgaagacatctgcatgttggggacctgcacatgaaatagggcattgcaaccagacacgtcccggattgaaatggttggggacaacggaggtaacgaacaatatcatgtccgagtacatccagactacaattttcggacagccttctcgcttgcaaacagaagatatgggagatggcagtcgtaaccgttattccaaggcctggacccagatcattgcggcaggtgcgccacatggaaattttggaagtgacagcgatgttttctgtaaactcgttcctttctggcaattggaactctatttcggtaaagtactcggacggacacctcttcagcaatctgacaaaggaggattctatccggatgtgtacgagtatatccggacgcacgataatctgagaacggccggggaacagcagactgagttcgtttatatctgtagtctgatagctaaagccaacttgctggatttcttcacgaaatggggatttctgactccggtcgacataacagtggatgactacggaacgggcaaactcaccgttacccaggcccgtatcgacgaaatacgaagtcgtgtagaggctttgggatatccgaaaccggatgttgctctggaatatataacggataattctgtagaactttataaggacaaacccggaattgtagccggtacagccacacggagcggttcgacatttaccatgaccaactggaaaaatgtggcagcttatgaagttgtagatgaaaccggcaagaaagtctgtatctctgatgggctgttagcaccttccggtactgctacgtttaccatgaaaaccgcttggaaagacggctttaaggtatatgctgtttctgctacgggagccaggactgcagtgacgttttaa

SEQ ID NO: 3328 - DNA, 531 bp, B.fragilis
accatcaaaaccatatattcagaattaacattgttaacaggaaaacaatacaccattatgaacctattaatcatcagtaacgccgatagctgccgcagccgaatcgcacaagcacttctttcttcgttcggaaaaggcatgaaagtatattctgcagggacaatgcccgcagcagagattcatccgttggtcctgaaactaataaaggaaacaggtatcgaaccgaacacacaacctccccactccatccgtgaatacaccaacgaaaactgggaccatatcatcgtactttccggtacggccgatgatatacgcaatctcttccggaaggaggtaaaacactggtatcatcttccctttgaagacttgttctccacagcggcaccaagcgaagcggaactgtgggatcgcctgatacgcctgaaagaagatatacaaagaaaaatgtacgaactataccgggacgatctgagagagcaattactaccgcgctgtagctgcggagccaatgacttttgcagatgtgagtga

SEQ ID NO: 3329 - DNA, 189 bp, B.fragilis
aagagactgacagatagtgccgaacaggcgaagagggtacggagtgctatggaattgcagaagcaaggatgtaaacttcgtgcccttcgtctgctctgtggcatacctgtagagaacaaaatcatcattttctttcataattcggaaaaaaacacgaaatttgcgacacttttaagttcgaattactaa

SEQ ID NO: 3330 - DNA, 1188 bp, B.fragilis
ccattttatttgagcgaaagtattgactcgttgactaatgctttcttcgagaccatgtcgggatttactactacgggagctacgattcttgatgatatcgaatcgctttcgcatggtatgcttttctggcgcagcctgacacaatggattggcgggctggggattgtttttttcacaattgccgtattgcccgttttcaccagtgggggagtacagcttttttccgccgagtctacgggagtaacccacgaccgtacccatcctaagattaatgtgatggccaaatggctatggacagtctacctgatattgacactggcagaaaccattttgctgatgctgggaggtatgagcctttttgatgctgtctgccagtcatttgctacgacggccaccggtggatattctaccaagcaggccagtatttcgtattggaattcaccgtttatcgaatatgtggtcgctatattcatgcttctttcgggagtcaattttgcattattcctgatgtgccttcgcggtaaagtcagtcgtcttttgagggacgaagaattacgttggttcctcggttctgtcgctatcctgacttttctgatcactttcgcactggtctttcaaaatcattatgactgggagacggctttccgtaagtcgctgtttcaggtggctacggcacatacttcttgcggatttgccacagacgactataatctttggcctgcctttacgtggttgttgttgctgattgccatgctctcgggaggatgtaccggttctaccagcggtggtatcaagaacatgcgtttgctgattattgcccgctctatccggaatgaattcaagcatttattgcatcccaatgccgtattgccggtaagagtcaacaagcagagcgtttcaccttcgattgtgtctactgtgggtatgttttttgctttttatcttatcatcgtcattcttggttgggcagttctcctgttcttgggtgtcggcttttccgagtccatcggtacggtgatctccagtatcggtaatgtgggaccgggattgggatcttgtggcccagcctattcgtggaatggattacccgacgctgccaagtgggtactttcatttctgatgctgataggacggttggagctctttagtgtacttttgcttttctatcccggattctggaaaagttga

SEQ ID NO: 3331 - DNA, 753 bp, B.fragilis
cttctttattttttatgtgatatagcattagttcctttagaactatggtatattgctgcttctgtagctcttgttttgattgtcggtggactttggatgcatttaaatgaaggtagtaccccgatggataaatatattgaaattacagctcagaaaagcagaatgtatttattaccagatagttcgaaggtctggatgcagccgggaagttctatacgttttgccgaagatttcaagaagcatcggaatgtatggctgaaaggtaattctttgttcgaagttcacaaaaatatgggtagaaaatttagggtgtatatcgataaagcctttatcgaagtgaaaggaacttgctttttgataaagcagaacaatcccagtgccaatgaaattactttgtttaatggaagcattgaatttaatgttgaatcgactcaacataaaatagagatgaaaccacttcaggaattggtatataatcctgctgatgcagggactcaattaaggcaaatagaaaatatagagtggcaaaacggccgttataattttacacaatttaatttggaacatttgactaggattataaaccaaatgtatggttcacgtatcattatcagcgataaagtgaataaaaattgtgcctttacagggagtatccgctatgatgagtctttggaagacgttattgataaaatttgttttagcctgaatcttcggaaaaaagaaataaatcacgagattattatttacaactaa

SEQ ID NO: 3332 - DNA, 951 bp, B.fragilis
tctatgaaagcatcttccaataatcttttaagcatcataaagggaccacgacagtttgtgattcccatttatcagcgtacatacagttggcaactggttcaatgcaatcaattgttgaatgatattttgcgtattagcaacgattctgccgttcaggggcactttatcggttctatcgtttattttcaggagagcatacatacagtgtccgatgtgcctaaacttctggttattgatggacagcagcgcttgaccactgtctctttgctgatagcggctattgccgattttataaaagagaatgcagtagagatagataccagcttcactaaacttcagaactattatctgatcaacccggaagaagataatgaattgcggtataaacttctgctgacccggagagataaagatacctatataaatttattgaaggggattcctcggtccgaggggatgtcacaacgcatcattgaaaactatgacttctttaaaagtaagataaacaaggagaatgtggtagctatttatagcggggtacagcgactgtttgttgtggatgtggctcttgaaaaggagaaggacaatccacaattgatatttgaaagtatgaacagtacgggacttgatttatcacaagccgacttgattcgcaattacgtgctgatgggacaagaagttcacttgcagacctcactttatgaatcttattggtaccctatggaacaaggatatggtagtgaatatgcggcgctgtttaatagcttcatgcgcgattacttatcagtgaagacaggtacctaccattcctcgtatcgatatggtgtacgatgctttcaaggcctatgtgatagggggaaaagctcccgatactatcagcgaagtagtcaaagacatttatacttattccggatattacgtcaacatggttcttcacaaagagccggataa

SEQ ID NO: 3333 - DNA, 1296 bp, B.fragilis; identical to SEQ ID NO: 845

SEQ ID NO: 3334 - DNA, 405 bp, B.fragilis
cttccggcatacagtattcatcttattaatataaagaatatggaaaagtttattgcgttttttgagattccggcggcagatttccaccgggcggtaggattttatgaaacagtgttggacatcaaattggcggtctcggagtatgaagaggagaagatggcctgcttcatggagcagggcgaagcagtgggagcggtttcgtgggcacccgattttctgccttctgagcggggaacgctgattcatttctattgcgaagagatcggcaagtcgctggaacgtgtcctgcagaaaggtgggaaagtcattacccccgagacggagattgacgctgaaggcaggggacatttcgctgtttttgccgatagcgaaggaaaccatatcggtttgtattcggataaatag

SEQ ID NO: 3335 - DNA, 771 bp, B.fragilis
aatcgtaaatatatagttgtgttagcaaaaagaatcataccttgtcttgatatcaaagacggtcagaccgtaaaggggacgaatttcgtaaacttgcgccaagccggtgatccggtggagttgggacgtgcttatagcgagcagggggcagatgagttggtttttctcgacattacggccagccacgaaggtcgcaaaacttttgccgagcttgttcggcgaatagctgccaatatcagtattccgtttactgtcgggggagggatcaacgagttgagtgatgtggaccgcctgctcaatgccggtgccgacaagatttccatcaactcttccgctatccgtcatccgcagttgatcgatgatattgccaagcatttcgggtcgcaggtatgtgtgcttgcggtagatgccaagcagactgagaacgggtggaagtgttatctcaatggcggacgtatcgaaaccgacaaggaattgacggcatggaccaaagaagctcaggagcgcggggccggtgaagtgctgtttaccagtatgaaccacgatggagtgaagaccggatacgccaatgaagccctggcggagctggcttcccaactctccatacccgttatcgcatcgggcggagcaggccggatggagcacttccgcgatgcttttacacttggtaaagcagatgccgcactggcagccagtgtttttcacttcggagaaattaaaattcccgaattaaaatcgtatctttgcggccagggaattaccgtcaggtag

SEQ ID NO: 3336 - DNA, 561 bp, B.fragilis
ttactaaaacagatgcaagaaaaagaaatagtcaggaaattaaagcatggcgatcaggaagcatttgcttttttatacaatcattactggaaacaagtttataatttcacaaggctctatttcaccgcctctatggatattgaggaaattgtgcaggaagtatttgtgaaagtatgggaatctcatcatttcttggatgaaaacaaaagttttgaaggctacctctttatcataacccgaaacgtgatcttcaatcattcacgtaggtattacaaagagacagccctcaaaataacagctatacaagcagtcgaagaatcttatgacatggagggagagttggatgccgccgatttaaagaaatatatcgatgaacttgttatgcaactcccccctcgccaacgagaagtattccgcatgagcagggaactgcacatgagcaacagagaaatagcagaacacttctctattactgaaaaagcaatagagcgccatatcaatctggccctgaaattcctcaaaaagaacctcaatttattcatgttgtttatggcagcttaa

SEQ ID NO: 3337 - DNA, 252 bp, B.fragilis; identical to SEQ ID NO: 860

SEQ ID NO: 3338 - DNA, 585 bp, B.fragilis
aatgaatttaaaaccattacagtaatgattaaacaaactgctgagatatttgaaatattgagtaaaggaggatttatctcttccgatagtaccaatcccaacatccggcaactttatacggtgattgaagacaaccagtcggagttgtacgacttctttgccgccatcaacttcgtgctcgaaagcggaaacgaatactattatttttcccgtcgcgagaataaagtcgacttggaacgtaagttggagattgctgtccgttggattgatgtactcgactttatcaagacttatgatgcggccttttcatccggattccgttttcagccggccgatatggttgtgaaagtgggaaccgacttagagttgaaagagaagcttaccggcctgaaaaagcttaccggacgggaaaagcatgaagagatgattgacaaaatagtaaacgacctgaaacgtgacggctttattgaactggaaaatgagattacttccacctataaggtagtggcggctttcggctatctggaagagttggtcgcttgcattaacataccagaagagatacagaatgagatacctgaataa

SEQ ID NO: 3339 - DNA, 618 bp, B.fragilis
tataactataaaaacaaaagaataatgaaacaagaagtattatttatcattctcaacgaatatgccgattgggagagtgctttcgtagcagcatcccttcattccggtctgatgccgggcagtgaaatcaagtacatagtcaaaacagtagcccccactttagatgcggtctgctctttgggtggtttccgtactctgccggactacagtttcgacaaccttccttccgattataccgccttggtcctaattggtggtatgcaatggcagtctgccgaagcagaacgtgtatttcccatcgtgcaggatgctttcgaaaaagggaaagtgattggcggcatctgtaacgctgcttcatttttgtgcgcccatggtttcctgaacaaggttaaacataccggaaacacccttgccgtgctcaaacaatggggcggggaacgatataccaacgaggatggttacctggaaaagcaagctgtcggcgataagaacatagttacggcaaatggcaccggttatctggaattcacccgtgagctgctattagcattgaaagccgatacgcaggaaaagatagaagcattttatgatttcagtaaaaatggacttgtgagatag

SEQ ID NO: 3340 - DNA, 3381 bp, B.fragilis
  unsure (2997),(3209): Identity of nucleotide sequences at the above locations are unknown.
agcatgaacaagtttttattttcttgtcagaagcggtgtctcaaatacatcgttatggctttgttgctttatccgctgtctgcacttgctgcgcaaggacagattgtggttaaaggtcagtctctcactattcctcaagccatccggctcatagaaaaaagcagtcaatatacttttttctataacgctaatgatttgaaaaacacaactcttaagagtatcgattgtaaaggttctattgatgacgtcttgaacgaagtctttaaagggagtaatatcagttatgttattaaagggaatgaagttattcttaaagttgagaaaacggaaagtacacaacagaaaaaggcaaaaatcattggtatagtaacagattcaaaaaccggtgaacctatcatcggtgcaacagtgcaattactgggtactaccacaggtgtgattaccgatgtagatggtaaatttgaattagcggcatttcctaaaaatgaaatacagatttcatatataggatatgttaccaagaaagttaaagtcggtagtcaaaaggtaatgtctatcactcttgcggaagatgcccagcaactggatgaggtggtggtcactgcttttggtacgggacagaaaaaggagactatcaccggatcgattcagtcggttcgtccttcggatcttctggtaccttctgccaacctttcttcttcatttgccggacgcttgtcgggtgtgattgcttaccaacgtagtggagaaccgggacagaattctgcggactttttcattcgtggtgttgcaaccatgaacggagcgacttctcctctaattattttggatggagttgaagtatccaaagcggacttgaattcgttggatcctgaagtaattgaaagcttttccgtattgaaggatgcgacggcatcggcgatgtatggtactcgtggagcaaacggtgtacttatcgttaaaacaaaatcgggaagtgacttggacagaccgatcatcggcgtacgtttagaaggctatgtaaatactccgactaagaaaccggaaattgttgacggacccacttatatgcgtttgtacaatgaagcggttaccaatcagggaacaggggctgtgctctattctgatgaaaaaataaatggtacgattcataatctgaatccttatatttatcctaatgtggactggtacaaggaggtcttcaaagatgcgacatttaatcaaaaagcgaattttaatgtacgtggaggtacatctaaaattacttattttatgaatgtcaatatgaatcatgaaaccggaatgttgaaagatcgttccagtgacttcttctcttataaaaataatatagactacatgaaatatgcgttccagaacaacgtggattttcatctctctaagtcttctaccatttcgcttcacctgaatgtacagttgaatgatatgcatggtcctttgacaactaaggatggtaatggcgtaggcgatatattcagtgctattatgggaaccaatcctgttgattttccggttatgtttccgcagggatctaacacatggtaccattggggaggtatccttgccggaaattatcagccgctcaatccggtagctctttcaagtgcaggctacaaggatacgtttgagagtacggtagtagccaatgtaaactgggatcagaaactggattttataacgaagggattaagcttcagagctttggtttcatttaagaattggagttataatcagaagttccgtctgcaaggatataatagttatcagctttccgattataaacagaatgaagacggttcctatgactttaccaatacacctatcggagaaccgagtaatcatacgatggatgcctttttcggtaccaacggtgaccgtcggttttatattcagggatacctgaattacgaacgttcgttcggttcgcacaatgtaagtggtatgttgctttataaccaggatgattataatacgaatgtaaacagcagtcttattgcttcgcttccaaaacgtaaaatgggtgtggcggcacgtttgtcttatgattacgatcatcggtatatgcttgaagtaaatgcgggctacaatggttctgagagttttgccaaagggcatcgttggggactgttcccatccatatcgttgggatggaatatcagtgaagaaaaattttggaaaccgataaaaccggttatttccaattttaaagtccgcggttcgtatggtttggtaggtaacgatcaaatcggcagtgaccgttttgcttatctggcaatcgtgaatttgactgaaagcccgtcttatacaaccggatatggtggtagtaccacttcattatcaggacctacttataatcgattccagaataatgaacttacgtgggaagtcggaaataaactgaatgtgggtgtcgatttacagctcttcaattcattaaatatcactgtcgacggattcagggagattagagataatatttttcagcagaaaaattccataccgaattatctgggaactgccagtactaaaatctacggcaatttcgctaaagtgaagaatacaggatttgaccttgctttggattatggaaaacagttgaaccggaacttttctatccagatgaaaggaacttttacctatgcacacaatgaggttttgaagtatgatgaagcggcaggacttcgtccggcattatcgcaggttggaaagagcctgaactcaatctggggatatgtagcagacggattgtatattgatgaagctgatattgcgaataatcctcagtcgactatcggtaatattgctattgcaccgggcgatgtgaagtatgtagatcagccggacgcgagcggtaattatgatggaaaaataacatcagatgacagagtggtattaggatatcccacaattccggagataatatacggatttggtccctctattacatggaagaattgggatttctctttcttctttcanggacaagcgcgcgtgtcatttatgatgagcggtttcgaaccatttggaacgcaaagtaaaaataatgttctgaaatggatttccgatgatcattggagcaaagataatcagaacccgaatgcacggtatccgcgattgacacaatataataacaacaacaatacggcgtcttcttcttattgggctgcgaatgcttcgttcctgaaattgcngaatgccgaaaatcgctatcgtttcaaatgggcaagaatctatgtgaacggaagtaacttgttgaccttttctccatttaagctatgggatcctgaaatgggtggaggtgccggtatgaaatacccgacacaacgtacatataatgttggtattcaattaacttttaaataa

SEQ ID NO: 3341 - DNA, 309 bp, B.fragilis
cagagattaaaattgagcaaaaaccgtattgatcaggaaaagagagtagtagagttgatgatccgcctttactgccgtaaaaaagaaaagaatgtcacgctttgcccccggtgcgaagagttgttgcactatgcacacgcccgcctggaccactgtcccttcggggagaaaaagaaagcatgcaagcagtgcagcatacactgctacaaacccgccatgcgggaacagatgagacgggtgatgcgcttttccggtccccggatgctgatttacgctccttgggaggcaatcaagcatctgttgggatag

SEQ ID NO: 3342 - DNA, 270 bp, B.fragilis
cacaaaataaatctaaatataattattaaaatgaataaaagtaacaaagaaactaatctgatcaagaagctattggcagatcaattggacaagaaggaacgcaagaaactctattattcaaatttaatagaaaaacaaatgagaaaacaatggaaagaaaataagaatactccggtagaaaatgagattggaaataagatatgggacaagatcgagaaccaatgcataaaagttcacaaaagaatagttcctttagaacttatccaataa

SEQ ID NO: 3343 - DNA, 291 bp, B.fragilis
cctattaaaaacagaaaaagaatggaacagaaattttgccagagctgcggcatgccgctcaacccggaagtattgggaacagaaaaggatggtagcaaaaacgaagagtattgcacctattgttatgccgacggacatttcaccgtggaatgcacgatggacgaaatgattaaccaatgcgcacagttcgtagacgaattcaataaaggctcggaagtgaaaatgacgaaggaagaggccattgcaaacatgaagcaattcttcccaatgctgaaaaggtggaaacagtga

SEQ ID NO: 3344 - DNA, 864 bp, B.fragilis
aaatcaatgaagtcttcacgaaacacttctacctccggcaaacccgcttccggtcgtcgtacaccggcacggaagacgaaagcgaaaaagaaaactacccgcaccatgcccgtttggatgcgcaatacccttgcgcttattgtggtcggagtattttctctcactttctattatttcgttatccgtccttattcttatcgttggaaggagtgctacggacggaaggagtatggcgtttgtatcccttgtggctatgaggtgcatggcatcgatatctcccattatcaggggaacatcgactggaaggagttgaaacaaaacagagaaacggattttccgcttcactttatttttatgaaagccaccgagggaggagatcatggtgacgatactttcaaagacaacttcgaacaagcacgtcgctatggctttattcgtggggcctaccatttcttcactccacgtacggatgccttgaagcaggcggacttttttatccgtaccgtgaaactcgatagtggagatttgcctccggtgctcgatgtcgaactgacaggtaagaggcctaaaaaagagttgcaacaaaatattaagaaatggctcgaccgggtggaggcacattatggtgtaaaacctattctctacacttcttataaattcaagacccgctatctggacgactcgcttttcaatgcttatccctactggatagcccactattacgttgattcggtgaggtacgaaggtaaatggcacttctggcagcacactgatatcggaagtgtgcccggtattcatcacgatgtagatctgaacgtattcaacggttcgctcgaagagctgaggaagatgacgatgagatga

SEQ ID NO: 3345 - DNA, 414 bp, B.fragilis
tatacaatgaaatcattaaacgaaagagcagcagatttgctgcaaggttgtgaaacggtaatactcagttcggtcaatcaagagggatatccccgtcctgtccctttgagtaagattgcttcggaaggtatttctgagatttggatggcaaccggggaacattctgtgaaaacgaaagatttccggagcaacccgaaagcgggtctttgtttctacgaacaagggaatagcgttgccctgaccggtgaaatagaggtagtgacagatgccggactcaaacagaagtattggcaagactggtttatcgcccatttcccaaagggaccgactgatccggaatacgttttactgaagttccgttctgagcatgccacgttctggatcgacggacaattcgtccatcggaacatttaa

SEQ ID NO: 3346 - DNA, 909 bp, B.fragilis
agagaaatgaagatgaaaaaaatattgcttggcctgtgtgtgatactgggcctgataaatatgatcggctgctccagcgatgagaagtatcccatgccgacctctatagatcagaattcactgtcggctgaagccaaagccggtgctatcaaattgaaatggaccgtaccagccgattctaattattattatgtaaaagtgacctatacattacctgaagacgggaagaaatgtatgagattggcaagtgtgaatagtgataccatgttggtggacaatctgctgcatcggtatggtgacattaactttacattgcaaccttgcaatcgtgccggggaagcttcgcaaagttgcagtatcatggcacaggcacttcctgctctgaaacagatcaagactgaccggaatcctataaccttgtctgcaaaacagttgtatacagatgatcaggagagtagtgaaggacctatcgcaaacctggtggatggaaggaatgacacttatttccacatgtcatggagcagtcctacgcctttccctcactatattgtggtcgacttgggtgaagagaatgctttgtccactttcctgttctcttatgtttgtcgtgacaataacaataaagacaatcccaaagagatggatattctgggcagcaatacttttgatggaaagaattatgatgagagccagaccactttgttggcgtctttgagtaatttgcctaatacaaaagctgcgtcttacgaatcggatataataaaagccggtgcatcttaccgctatctttggtttaaggtgaaatcttctacaagcggctccaactggattgcgttggcagaactcggcctttcgaaggtaattgtgaaaacctatgatccggaaaccggagaaactaccattgagtaa

SEQ ID NO: 3347 - DNA, 1083 bp, B.fragilis
aaagaatcagactcctatatgatgacattaaacgattttgagaactacgtcccctgtaaaatatgggcacggggagaagaatattacgaatgtgatgctgtaaaagatctggaagaaacagaaccgggagaatggatagccactgtagaggggacggaagattatgaagtggaaatctcactggaagggaaaaaaataattcattggtcttgcgactgtccttacgaaggagatatatgcaaacatgtggtagctacagtattagccatccgcaacaatcggtccggacaaaaacgttttttatccgcccgggaagctaagttgatggaaaaacaacaagcaactctaaaggataaaaaggtagaagatattttggcctttgtaccttccgaccagctatcggatttcgtactggagtatgcttccaaacatacggaatgtaaacaggcacttttggagaaattccttccaaagcctcaagctaatggtaaatcccctaaaaactacgggaacgacatccggaaatgttttaatgattcgtatgttgaaaccaaaggcagatatgggggatattatgaaccgacaatggattggaataaagtgggctgtgagttgaacaaatatctgaaaaaggctaaactgcttgttgaacaacactgttttgaagatgctgctgcaatcgcaaccggtatactccgggctatcggcgaaaattacatagaagaggacttggtataccataatgaatttgaggcaaacttctattgcgaatgctctggcgaactgttattggaaataatctatcgtcccgaaataaccggctcacagaagataatgatcctgaatgaagtaaggcaaatagaaaagcttgacacttacagggagtatgacgtgtatgatattgatctgttactgagtcagataacgatagcgacacaaacccaggaagaggctttaacgtatataaaccaattgatagaggaaaggaaatcaagctgggagctttataagcttattgaaaagaaaattaatatatccttaattccgcaacactataatttaactttatttataagttcctga

SEQ ID NO: 3348 - DNA, 267 bp, B.fragilis
aaaatggaagaatatgaagtaattcaccgcccggagcggaatcgttttgaattggagaagaatggaatgactgcctttgtggaatatgaagtcgaagatggagcactggatattatgcacactatcgtacctcctcccttggaaggaaagggaattgcggccgcactggtagaagcgacttataaatatgcctctgcgcaggggttgaagcccaaagcaacgtgttcgtatgccgtcgcatggctgaaacggcatccggcggaataa

SEQ ID NO: 3349 - DNA, 222 bp, B.fragilis
aaagtgagagaaaatactccgaccacaataagcgcaagggtattgcgcatccaaacgggcatggtgcgggtagttttctttttcgctttcgtcttccgtgccggtgtacgacgaccggaagcgggtttgccggaggtagaagtgtttcgtgaagacttcattgatttttattcttatttagagtttgattcaccacagattacacggattttcacagattaa

SEQ ID NO: 3350 - DNA, 705 bp, B.fragilis
cgactcatggacgaaacactgattcactataccgatgtagagatacatcagcaggaactctgtgtgctgagcgaagttaatttgcaactgcacaagggggagttcgtttatttggtgggtaaagtgggctccggcaagaccagcctgctcaaaaccctctatggcgagctcgatgtgactgccggtgaggccgaagtgctcggttatcggatgacatccatcaagcgcaagcacattccgcagttgcggcgcaagctgggcattgtttttcaggatttccaactgctcaccgatcgtacggtgaacgataatctggagtttgtgcttcgtgccaccggatggaagaataaacaggaaatcaaggaacgcatagccgaagtacttaaccttgtcgggatggagaataagggctataaactgccaaacgagctttcgggcggtgagcagcagcgcatcgtgatagcgcgtgccatgctcaactctccggagattatcctggcggacgaacctaccggaaacctcgatgtagagaccggaaaagccattgtagagttgttgcataacatctgtcagaccggatcgctggtagtgatgaccactcacaacctccagttggtagccgaatatcccggacaggtataccggtgcgccgaacatcgcattgtcaatgtgacggacgaatttgtgaagaaagaaaataattaa

SEQ ID NO: 3351 - DNA, 210 bp, B.fragilis
cggatagcggaagagttgatggaaatcttgtcggcaccggcattgagcaggcggtccacatcactcaactcgttgatccctcccccgacagtaaacggaatactgatattggcagctattcgccgaacaagctcggcaaaagttttgcgaccttcgtggctggccgtaatgtcgagaaaaaccaactcatctgccccctgctcgctataa

SEQ ID NO: 3352 - DNA, 387 bp, B.fragilis
ctatttacttgtactttttctttccgttttggcacgatattggctatatgcctttcgcaaaaaaaatcgtgtgttatggaagaatacctgtcggcggacatatacgttagtaaacggaataacagtctgataaacggcaaaatgatagggcgcgtacttgggatcttactctttatagaggcgggaatgtttgtactctgctccggcatatccgtggtttatggtgaaagcgattacaagtatttcctttatacggcgggtatcaacctcctgtccggtgcgttactggtgttttatggacgtggtgcggaaaatcggttgagccggcgtgacggttactgcattgagacactctcgtgggtgtttttcacgctattcggtatgtag

SEQ ID NO: 3353 - DNA, 774 bp, B.fragilis
aaatggacttgtgagatagctacatattcatcaagcatacgggacaacatgaaaaaaggattcaccatacttctatttttattctcgctggcagaagtatatgcacaaacggaattcacgacttgtctgtttgactcaagccggaaccggatagtgccggtagctatttatcaaccgcgaaaagaaacccccaaaacaagagtcattatattcaaccatggatatgacggaaacaagaacgataaatcgaaccggagttattcatatctgactcgttttttggcagaaaaaggatattatgtgataagtatccaacacgaattgtccgatgatcctcttctggctatggaaggaaattttatggaaacccgtatgcctaactggaaaagaggagaagaaaatattctctttacgatccgggagtttaagaaactaaaaccaaatctgcaatgggagaaactttgtgtgataggtcattcaaacggaggtgatataaccatgctcaccgcaacggatcatccggaactgataatgaaagctatctcaatggaccaccggagaatgataatcccaagaacacaaaagccacggatatacacgttgagagggtgcgattatgatgctgatccggatgtagtcccaaccagcgaggagcaaaagaaatttcgaatagaagttgtgcgactggatggagttacacacagtaacatgggagaaaacggatcggcagaacaacacgatcttattaaccgacatatatatattcttaaataa

SEQ ID NO: 3354 - DNA, 186 bp, B.fragilis
tccattccacgaataggctgggccacaagatcccaatcccggtcccacattaccgatactggagatcaccgtaccgatggactcggaaaagccgacacccaagaacaggagaactgcccaaccaagaatgacgatgataagataaaaagcaaaaaacatacccacagtagacacaatcgaaggtga

SEQ ID NO: 3355 - DNA, 198 bp, B.fragilis
gttaagcttagagcattgatactaagatacaaagaatctgtgttaatccgtgtaatccgtggtgaacccaaaaacggttcattctccgaacaggcctcaatccggacggtttattccgccggatgccgtttcagccatgcgacggcatacgaacacgttgctttgggcttcaacccctgcgcagaggcatatttataa

SEQ ID NO: 3356 - DNA, 825 bp, B.fragilis
agtatgtatagagaatatcaaccttgtggactactggctccttacgtcgataaaatttgggagttcaaaggaagtcctgagtatgggatgcgcatcaatgtcctgccggacgggtgtaccgatttgattttcgctttgggcgggataacacaacccgtaggcaacgaagggcggatcatgccgtcttgccgttcgtttttcgtgggaccgatgaaacgctattcggagttggtcgcgtataccgaaacggttcacatggttggtattcgttttcatccttgcggattattccgattcatggacttgcccgtgcaggagttgggcggtcagcgaatcagtagtgccgacttagggatcaagttgttcgatgattcgtttacggaacgactctacgagcttccggatttgcggagtaggattcagtgtattgagacagtactggtgcggtcgatgcacaagcacgatgtagtggacaaacagattgtttttgcggtaaaccacattcatttgtaccacggtcagcgggagatccgtttgctggcagaagatacctgtttgtgtcaacggcatctggaacggcggttcaagctgtttaccggatttacccctaaagaatacagtcggattgtgaagttcaggcaggcgatcgatctgctgaaaaatacgacggaggcaaataacctgctctcggtagcggtgaatgccggatattacgatgtttcgcacttcttgaaagaggtcaagacgctgtccggcggtacggcagaatcattcctttctccgaccttgccgcaagagggactgctgacgtatattgagaaataa

SEQ ID NO: 3357 - DNA, 735 bp, B.fragilis
attgaaaacagacagatgatagaattgattccggccattgatattatcgacgggaagtgcgtacgcctctcccagggagattatggcagtaaaaaggtatataatgaaaatccggtagaagttgccaaagagtttgaggccaacggtatccggcgtttgcacgtggtggatctggatggagccgcttcgcatcatgtggtcaactaccggacactcgacttgatagccagtcgcacatcgttgattatcgatttcggcggtgggttgaagagtgatgaagatctgataattgcttttgagaatggtgcgcagatggtgaccggcggtagtattgccgtcaggaaccctgacctgttttgccgttggatcgaccgttatggcagtgggaaaatcattttgggagccgatgttaaagatcgtagaatagctgtcaacggatggaaagacgaaagtacttgtgaacttttccctttcttgaaagattatacccagaaaggaattgagaaagtgatctgtaccgatatcagttgtgacggcatgctggcggggccatctttggatttatacaaagagattctggcagagcatcccactctttatctgatagccagtggcggtgtgagcagtatagccgatattgaagcgttgcacgaagccggggtacctgccgttattttcggtaaagccctttatgaaggacgtattactttgaaagagcttcaggcatttctttaa

SEQ ID NO: 3358 - DNA, 183 bp, B.fragilis
accttaccaagaggattgcgcacggctctccctgtaggaaaaagtgacgaaagattgctgctcggaggcgtcatctcaaactgcttcgactcatcagacagattacacatattacatataatagacctgagcaaagataagcgattctaccggaataacgacctgcttttggttactatttga

SEQ ID NO: 3359 - DNA, 1920 bp, B.fragilis
tatatacttatgaagataatatataaactcctatttttgtttttgctgacgataggatatagttcctgcgactttctggatattgttccggatgaaataacgactgaggcagatgcatttaaagaccggaatgcggctaagaattttgtttattcttgctatggctatttgccgcaaagtaatgtggcatcaggcagtctcgatttgctgacaggagatgaagtgataacggcttttgaacatgaaacgtttgccagttttccaaaaggcaactatacggcttcttcgccggtgatttcttattggaatacattttttcaaggattgcgtcagtgctatatatttctggaaaatgtagacaaggtacccgacctgactgaaagtgtaaaaacagactatatcgcacaggttaagtttctgattgcttattatcattatcagttggcacgttgttacggacctattatcctgatcaaggaactaccggatgtaaatgcttcgcaagcagaatatttaccccgaacttcatatgacgaatgtgtagactggatatgcaatttattggatgaagccgcaagttcattgcctgccatacgtaccaataaagaagattacggactggcaaccagtgtaggagctaaggctgtgaaagcgaaaatgcttttgtatgcagcttctccgttattcaatggaaactcaagtttctatagtaattttacagataaatccggtagtcagttaatgcctctgacttatgatcctaataagtgggtaaaagcaaagacagctattaaagaggcgattgaccttgccgagcagaacggacatgctttgtatgtaaagcaagactataagataggtaatgaggatgcgaatccctatccggcggcaggtcctgtccggtgtcttcgaaccagcttggtcgattgggattcgcgtaatccggaggttcttctggcagaaacgcgtagtgaaggctcgtatggtatacaaaacaaatcgttaccatttgtgactgacggctgggcgtggaatggtgtcggcccgacatggaccatgttaaatcgtttttatactaaaaacggtttaccttgggacgaagatccggagtataaagataaagacaaattaaagatcgtcaatgtggatgccagccatgctgacgaggctcatgaaggaagtaaaacactcctgtttaatttggatcgcgaacctcgcttttatgcttgggtagcttttcagggtggatattacgaagtgatgaacgggtcaactaatccggcctatgttatgagtaacggtaagaaagataattcggatagcagattgatatgcgattttgtattgggaggtaactgcagtcgtggtacggccaccgtacagcgaccgggtaactatactccaagtggttatctgaacaaaaaaggtgtcgatcctaatactgttgtttctacaaatgctacgaaattgaatcagtatccctggcccattattcgtcttgccgacttgtatttggcatatgccgaagcatgtgtggagactaatgatctggagacagccaaacaatatttgaacaaagtcagagaacgtgccggtatccctacagtagaaacagcatggagtggtgttgctgcattggatcagacaaaattacgtcagattgtacggcaggagagaatgaatgaactttatttggaaaaccagaatttctgggatatgcgccgttggctgctggctggacaatattttaatgtcaaggctaaggggttgaatattgctgctactaccatagaagattatgcgatagtgaagactattgactttgagcgtaagttcgaggcgccgactcaatatctgttgcccataccttctgccgatattaacagaaatgaaaaattagtaaacaatccgggttattaa

SEQ ID NO: 3360 - DNA, 1188 bp, B.fragilis
tcaaacaatataacaatgacgaaaagaataggaaactccaggctttacatcctgatatttatagggattgtatcagcattcggtccgttcgtgaccgatttttatctgccggccctgccagtgttgagcgaatatttcgatactacggcttcgctggtgcagcttagtctgactttcagtatggtgggattggcagtagggcaattaatcataggtccactgagcgacaaatatggacgtaaactgcctctaatggtctcattagtgatcttctgtatttccacagtaggatgcctttactcgccggagatccatggctttatcttcgcccgtttgttgcaggggttgtccggagccggaggagtcgtgatttccaagtccatagccattgacctttaccagggaaaagaactaacacgttttttcgccatgctgagttccgtacagggattagctcccgtctgtgccccggtattgggcggaatattactcggagcgatggattggaaaggtatcttctggatattattggctataggcatactattgattgtcgccctgtctgccttcaaggaatcgttggagattaagaaacgccaaaaagggaatgtcttttctacattcaaatattatctgccggtactccgtaacaggcaattcatgcgctatgtcttgatacaagcattcgccatgggggtcatgttcacctatatcgcagcatctccctttattttccaaaaccacttcgggacctcaccttttgcttacagcctctgtttcggtgtcaatgcattaggcattatgttgggcagtctggctgtctcccggtttaaagatgcgacagcagctctacgtttcggagtagcaggtttcacaaccatgagtcttccggttgctgctgcactaattttcagtccatccgtctggattgtagaaggaacactgtttttcctccttgcatttttaggattaatccttcccggttccacaacgcttgcacttgatatggaacgtaagaattcgggtaatgcatcggccctgttgggattcctgatgttcgtgtttggagggctgctgtccccgttgacgggaataggcaatatgctttactctaccggtatcattatcgtggcttgctgtgttgggacatggttctttacttataaagcaacctcatccgcccgctag

SEQ ID NO: 3361 - DNA, 318 bp, B.fragilis
ttaaaaaatatgtatctttgcaggcaaattaaaaagaggcagccgttggagttacttatcttatatctagtaatcgtgaataccgtttcttttgttatgtatggtatcgataaacggaacgcatcccgaaaacgatggcgtactcccgaagtccacctgttgggaatagccgtagcgggaggttcgttaggtgcgtgggcagggatgtatacgtttcggcataagacacggcatcttaaatttaagtatggtataccggtaattggggtattgcaggtggggatggcaatctgtctcctcttgtcagaatttacttag

SEQ ID NO: 3362 - DNA, 246 bp, B.fragilis
tcaatcagtataattaagatacatcgagaggatatctggatcagcatcaaatatttacgtcacttaatcgaattgttagtactggccagtaaaaccaaggatgtatcttttgtgatcaggcaaaaagaggaaacacagggaaatacggttgaaatatattccatcactttactaaaagatatccatacgaaccgaacagactacgcgattctattgaatgtgcccgatacggttatagcctattga

SEQ ID NO: 3363 - DNA, 744 bp, B.fragilis
ttgcggattttaggtatattacgttcgcttcgccgggaagaagaggtgcaggcaaccattgatacgtatctttatctgccggagatcaggaagcatgaagtgcagcggttcatagcaaaccggcaatacgattcagctattctactgttggacgaaggcatccgtatcgcccaaaagaaccggtatttaggaaccatacgggattggctggaacaaaaattatccatttatgaagaaacgaatcaaacagtaaacatcatagacttatgccagcaactgtttatcagtggaaatggtgatataacctattatcataaattgaagaaattaatcgctacgaatgaatggaaaaagtttctatccggattgatgaaacaaataacattctccggacatggctatagcgggcaatgtaataaaatggatatctatgtggaagaaaaggactatgaaaaccttttaaaaatgttgtcggatcatcacagttctctggatatgctgatgcactattcccaccatttagataacaattattctactgaaatcatgcagctcttcacggagcaaatcaatcggtatgccgaaatgaacataggtagaaatcactatgaatatatagagcaggtattgaaagaaatgaaaaagctgaaagatgggaagaaaacagtagaagacattgtaaaaaagttcagaatcgcctataaaagacgtcctgccatgatggaaacactaagtaaattctga

SEQ ID NO: 3364 - DNA, 621 bp, B.fragilis
ataagaaccatggatttagattttgataaaatgaacggactcgttccggccatcatacaagacaacgacacccgcaaggtgctgatgcttggcttcatgaataaagaggcttacgagaagactgttgaaaccgggaaagtaacctttttcagccgtaccaagaaccgtttgtggaccaaaggcgaagagagtggtaatttcctgaatgtcgtttctattaaagaagattgcgacaaagacacgttgttgattcaggtaaatcctgtcggcccggtatgccataccggcaccgatacttgctggggcgagaagaacgaagagccggtcatgttcctcaaactgttgcaggacttcatcgacagacgtcacgaagagatgcccgagaagtcgtataccaccagcttgtttcagtccggcatcaacaagatagcgcagaaagtaggcgaagaggcggtggaaacagtgatcgaggctaccaacggtacagatgaccgtttgatatacgaaggttccgacctgatttaccacctgattgtattgctgacctctaaaggataccgcatcgaagatctggcacgcgaattgcagataagacatagcgactcatggacgaaacactga

SEQ ID NO: 3365 - DNA, 1224 bp, B.fragilis
ccgttatacatgactacatttcattctattgacgagttgctgaaaatgatgagccgtgaacaacttttgttgaaacagatgttcggcaaacggaaacagcaatccttccggcgggagtatgcactggaactgactgaatacaaactgcaacgtatacagagcctgatcgaccacggagtgcttcgtgagaatggttcgtttctcgaaatggaggatatctacctgcactttttcgagcaggtgctcgagataaacgaggagatcaatacttcgtttgttaacgagcatatcagctatctcaaagataccatctcttattatcagcaagaaaaccatgagaaaaggaagaccacttacctgcgtaccattaagcgtatattgcgtaacattgccttgactaccttgcgtaatgtcatcgacctgaagcgcaacatcgacagcacattcaagaatgaaccgaactatcagatcaagaaaaagaaactggtccgcctggatgaaaaacggcgggatatcgaggcactgatacgagtgagtgaagaactccttgtcaccgaagaagaccgtttctttcgccgggttccggatgatgaactggttttggtggtggctaacgtacggatacaactcaatgaatgtttccataacctgatcgagatacagaagcaaatcatcagctacctgaaccggatagagtatcagaataagatacgggtcaaaatccgtcagctgaaatatctcaaagatcagttcgaactggaagaacggaccgatatctgccgggtgctgatgcagaaagacagtgtctggtttgagcctgcaccggcatatccgttgcgtctctcagtcgaatatctccgtaacgacgatgaagtgttagagagtatccgtaaggtgatagccacagtcggcaagcgagccatactggcccgtaatgtggccgacagcatcgctgaggagtcacttgagacccatatatccgaagaggcttacatcaacctggaagaagtgaagaagcggtttatgcaggctgatggggacttgttttcgtttgttgccgcttaccctttcacacaagaggtgtcttttgatgaaagaatcacattctattgccagatcgtatcccagttttacgaagaactccgcatcaccgacgagtatggcaggatggatggtgtggaatatgcgttgatttatccggaaaggacgggagaaatagtttag

SEQ ID NO: 3366 - DNA, 207 bp, B.fragilis
ttgaacataatagagacagagcttaatgattatccacaatttaaaaagaaagttagtttccatgataaaactacaaaattaaaaaaggaacttaaaactctgattaaaacatgggacaagtacacgaaggacttaagaatattcttgttcgtagacgatattgaccgatactctgaaaagaaaatcatccaatcgatcgattcttaa

SEQ ID NO: 3367 - DNA, 600 bp, B.fragilis
aacattaaaatgaaagtagcagttatcaaatataatgcaggcaacatccgttctgtggactatgccttgaagcgcttaggggtggaagcagtgattacatctgataaagaggtgctgaaagctgccgataaagtgatctttcccggggtgggagaggccgagactaccatgcttcatctcaaggagagtggcatggatcgtttcattaaagaactccgtcagccggtgctgggcatttgcctgggcatgcaactgatgtgccgcttctccgaagaggggaatgtcgattgtctgggtattttcgataccgatgtgaaacgttttgctcctcgaaagcacgaggaaaaagttccccacatgggatggaataccatcagctgcctgaagagtgacctgttcaaaggattcacccgtgatgaatttgtctatttcgtacatagttattatgtgcccgtcagcgaatttaccgctgccgaaaccgattacatccggcctttcagtgccgctttgcataaagataatttctatgccacccagtttcatcccgaaaaaagcggtgaggcgggcgaaagaattataaagaatttcctggagctttag

SEQ ID NO: 3368 - DNA, 1173 bp, B.fragilis
cttttcaaaatgaaaactgtattccccattcataaatttcgcgagttgccgactcctttctattattatgatacgaaagtgcttcgcgacacgctggcgtgcgtcaaccgtgaggtggcacgttacgacaatttcagtgtacactatgccgtcaaggccaatgccaatcctaaggtactgaccatcatccgcgaaagtggactgggtgccgattgtgtcagcggaggcgaaatccgcgctgccatcaaggccggtttccctgccgggaagatcgtttttgccggagtcggtaaggctgattgggaaatcgacctgggactcgattacgatattttctgtttcaatgtcgagtcggtgcctgagttggaagtcatcaacgagttggctgccgccaaaggtaaagttgccaatgtagctttccgcatcaatcccaatgtaggtgcgcatacccatgccaatatcactaccggattggccgaaaacaaattcggtatcagcatgcacgatatggataaggtgatcgacgtggctttggagctgaagcatgtgaagttcatcggtcttcatttccacatcggttctcagattctcgatatgggcgatttcatagcgctatgcaaccgtgtcaacgaactgcaggataagctcgaagcccgtcatatccttgtggagcatatcaacgtaggcggtgggctgggcatcgattatgatcaccccaaccgtcagcctattccggatttggccgacatttcccgtacatacgacgagcccctgaagtttcgtccgcatcagactttgcattttgagctgggacgtgccatcacgggacaatgcggttcgctgatttcaaaagtactttatgtcaagcaaggtaccaacaagcaatttgccatcctcgatgcgggcatgaccgatttgattcgtcctgccctctatcaggcacatcacaagatggagaaccttacttccgaagatcctgtggtcgaaacttatgacgtggtgggccccatctgtgagtcgtccgatgtattcggcaaggctgtcgatctgaataaggtgaagcgtggcgatctgatagcccttcgttctgccggtgcttatggcgagattatggcttcaggttataactgccgtgaactgccgaaagggtacatctcggaggagttggtgtaa

SEQ ID NO: 3369 - DNA, 1134 bp, B.fragilis
agaaagaaaataattaatatacatactaattttaacacagtaacgaaaatgaaagttttaaagtttggaggaacttccgtaggttctgcacagcggatgaaggaagtggccaaattgattaccgatggtgaaagaaagattgttgtcctctcggctatgtcgggcacaacaaacacattggtggagatttccgactatctgtacaagaagaatccggaaggtgccaacgagattatcaataagctggaggctaaatataaacagcatgttgacgaactttacgctactgaggagtataaacagaaaggcctggaggtcataaaatctcatttcgactacatccgttcatacaccaaagacctctttacattgttcgaagagaaagtggtgctggcacagggcgagctgatctccaccgctatggtcaattactacttgcaggagtgcggtgtgaagtccgtgttgcttccggctttggaatatatgcgtactgataagaatgcggaacccgatcctgtttatattaaggataaacttcaggcacaattggatctctatccggatgctgaaatttatatcactcagggattcatctgccgcaatgcttatggcgagattgataacttgcagcgtggcggaagcgactataccgcttcattggtcggtgctgccattcacgcttccgaaattcagatctggacggatatcgacggtatgcacaataatgacccgcgcattgtcgacaaaacggccccggtgcgtcagctgcactttgaagaggctgccgagttggcttatttcggtgccaagattctacatccgacttgtatccagccggctaagtatgccaacataccggttcgcctgctgaacacgatggatccgcatgccccgggtacattgatttccaatgataccgaaaagggcaagatcaaggctgttgctgccaagggtaatattactgccattaagattaaatcgagccgcatgttgctggcacacggtttcctccgcaaggtattcgaaatcttcgagagctaccagacttccatcgatatgatctgtacgtctgaggtagagtttccgtatctgtcgataacaccaagcatctcaacgagatcctggatgacctga

SEQ ID NO: 3370 - DNA, 1341 bp, B.fragilis
aaaaaggaaatacagatgaacatagcaataagcggggcctccggttttataggcaagcatcttacagagtaccttacagaagtgggacaccgggtaatccctctggggaggcctatgttccgtgaaggcacatcggggcatttaattcaggctctgtcacattgcgatgttatcatcaatctggcaggagcacccattggcaagcggtggacaccggaatacaaaaaagaactttatgacagccggattaaggtgacgcactgcatcatccgggcaatggatgcagtaaagacgaagccgcggttaatgatttccgcctctgccgtaggatattatccagaggagggtacattcgatgaatataccaatacccggggaagtggctttctggcggaactttgttatgcatgggagaaagaggcccgccgttgtccgtcgcagacaaggctggtaatcacccgcttcggcattgtgctctcacccgatggcggggcgatggaacaaatgcttcgtcccctccggataacgcgggtagccggtgtgatcggtccgggtacacagcctttcccctggattgctattcaggatctttgtcgagcgatggagtttattatcagccacgaagaggcaagcggagttttcaacctggtgactccgcaacaagtttcacagtatgcatttactcaggcaatggcagcacgctatcatgcctggatgaaggcggtcgtaccgcgttggttcttccggatgcggtatggtgaggcagcttccttcctggcatcaggacagaatgtgcgtcccacacgtttgctcgaggccggtttccgttttgcgaagccgacgatagaagatttcttcgaaggtacggatcatgcagctgtagatcgattggatttgcaccgctacatgggtacgtggtatgagatagcccgtttcgaccaccgctttgagagaggattatcggaggtgacggccacttatacgttgatgcccgacgggacggtccgtgtggagaaccggggatgtaagcataagaaaccctatgatgtttgtaagacagcggaaggacgtgctaagatacccgatccgtctcaaccgggtaaactgaaagtatcgtttttcctgtctttttattcagactattatgtattggaattagatcaggacgaatacaattatgctctgatcggtagcagttctgataaatatttatggatactgagccgtgcaccaattttgccggaagagattaagaagaagttgctggatgctgccacccgcaggggatatgatgtgaagaaactgatctgggtggagcaaagagaaaaaaaaataatgtag

SEQ ID NO: 3371 - DNA, 963 bp, B.fragilis
tcaggcccgatttgccggccggaagattctccgtatctttgccacatggcagagagaaacgaattacataaaaggaacaggcataacggacagtacgatttttcaagactgacggaggaatacccaccgttaaaaaagttcatcgtactgaacgcttatggaacaacaagcatcgatttctttaatccccgggcagtaaaggcactcaacaaagccctcttgataagttactacggcatacgatactgggatattcccaagaattatctgtgcccacccattcccgggagagctgattatatccattacatagcagatttgattcagccggatatatccgatgaatcgacagggttgaaaacagctgtcccaaatacccgtcaatacaggtgcctggatatcggtgtaggtgccaactgcatctaccccattatcggtcaaacggaatatggatggactttcgtcggttccgatatcgatccggtttccattgacaatgcacgaaagatcgtaacttgtaatccggcattggctcacaaaatagaacttcggctacaacaggatagccggaaaatatttgaaggaatcattgctccgaatgaatatttcgacgtaactctctgtaatcctcccttccacagttccaaagaagaagcagaagacggtacgctacgcaaactcagcagcctgaaaggtcagaaagtaaccaaagcccggctcaacttcggaggcaatgccaacgaactctggtgtgagggcggtgaacttcgatttctgctgactatgatcgaagaaagtcgcaactaccggaaaaattgcggatggttcaccagtctggtatcaaaagaaaagaacctgggtaaactgaccgccaagctgaaatcgaccgatatagccgaacatagaatcattgagatgcaccagggtactaaaaccagccggatcctggcatggagattttga

SEQ ID NO: 3372 - DNA, 912 bp, B.fragilis
caagatcggataaccgctctttcagtaaaacccgctacatttgtcccggaacccaacggaacaaaaacaatgaagagcgatactgaagagaaatatctgcaacaggtgaaccgggtgatagattatatcaactcacacctcaacgaacctttgcgggtggaaacactggcacgtgaagtatgcctatcggagtatcatttccatcgcattatgcgggcttacctgcacgaaccgctggctacgtacatcgcccggcaacgagtggaacgtgcggtaatgtacctgcaaatgaagaatatccgtctggcgcaagtggcagagatggtcggatacgaaacgccacaatcgttatcgaaagcattcaagcagtttttcggcatatcccccaccgcctaccgcaaacggcgtgcagaacgttacgaagaattcagcaccctgaaaaaggagtctctgaaaccggaaatcctgacagaaccggaattgaagctggtatatatccgcatcatcgggcgttatggtgaagaggaaccttacatagaagcgtggagaaaactgagagattttctccaaataaacggtcttctgactccttctacccgctggataggcatcagctttgacgaccccacagtaacgaaaaccgaacaatgccgcttttacgcttgtgcaacagtggaacacgatgtatcaccgcaaggcgcttttggcatgaagacgattccgcaggggcgctatgccgtctacacactccgcggaagctacagtggtttgcaagaaatgtatgaccggatttactcgcatccactgcctacagcatttcgtgatgcaacttcatttgaagaatatcttaattgcgaaccagatatggaagaaaaagattacgtgacaagaatatatatccctattgaataa

SEQ ID NO: 3373 - DNA, 771 bp, B.fragilis
agacctcttgttccatccttgaatgattaccgcataggatacagtctttttccggagataattgatttatccaattataaatgggtggtattttattctcaggaacttgtcgggagcataggaaagcggtggttttcctgttcgatagaagtgtactgttgcctattctgtagggttggaggggagtattcattctataagctgatttttgtttttcagtatttcggtcatttgcggctttatagttgtcggatttatgtctccacaacacacaaaggtaagaaaaagaattgggatctatcttttatcgcttttcattttcttttccttttattatttttgcatccattatcttcgaaacccaataccgcagtcattatgaaaagtatagaagtcgtagcagccgttatcagatctggaggaaaatatctttgtgtacaacggggacgaactaaattttcatatacttctttcaggtacgaatttccgggtggaaaagtggagaaaggtgaatctttgcaggaagcacttcaaagagaaattatggaagaaatggattatactattgaagtgggagagaagcttttgacagtccatcacatctatcctgatttcgaaataacgatgcacgcttttctatgtcatcctatcggggagcaatatgtattgaaagaacatattgccgcacagtggctctttcctggggagatggtaacattggactgggcggaagcggataaaccggtagtaaaaaagatttcagaacaataa

SEQ ID NO: 3374 - DNA, 960 bp, B.fragilis
gcaatatgctttactctaccggtatcattatcgtggcttgctgtgttgggacatggttctttacttataaagcaacctcatccgcccgctagccgactattacaagacaagatatggaaaatacagcttattcactttccacattccgtaccttgtcttatttttatttcttatctttgcctcaaacccctggacatgaattcagatatgaaacgagccattatcatcggagctacttcaggtatcggccgcgaagtggcaaaacaacttctcttacaaggctggcgcctcggcattgcaggccgtaggcttccggcacttgaagcactgcaaagcagtgctccggaccttatagaaatcgcagtcctggatgtcacccaaccggatgcaacacccaaactcaataacctgatcagacgggtcggaggtatggatctgttccttctaagctccggcatcggttaccagaatatggaactgaatccggacatcgaactggatactgcccgtaccaatgtagaaggattcatgcggatggcagataccgctttccaccacttccgtgagcatggcggcggtcagttggcagtcatcagttccattgccgggacaaaaggactgggggtagcccctgcctattctgctacgaaacggtttcagaacacctatatcgatgcgctggaacagctggccggaatgcaaaaactgaacatccgcttcacggacatgcgcccgggattcgtatctaccgacttgctgaacgacggaaaacactatccgctactgatgcggccggaaaaggtagccaaacggattgtacgggcactgaaccgccaaccaacgggtagtggtgatagactggcgctatgccattatcgtctttttatggtgaatgattccgcgccggatatggaaacaattacccatacggacaggacagaaaccgacagaaaaaaatag

SEQ ID NO: 3375 - DNA, 1719 bp, B.fragilis
atatccctattttatatgaaacgactttctaccctatgcctgctggcagcaggctttttcattccgggacaagcacaccaggcccgtccgacggtgcttgattcggtttacgctcccctgaaagtggctacacctccttccgatgcttatatcggcttatcgcttctcgataacggtgagatcagacactataattatggagaacaggctgtggcaggtactgtatatctgtccagtaccgatcatggtttgacctggaaacgggtgaaccgtcccaaagaaatgccttttgccgattgtcagagccctgtcagtaaggagtatattcgtctggtagatatgggggcaatgggtgtttattgcattcgtacttccggtggattgacaggaggacgtactcttacgaaggtggccgatcgtaactccatcatgattaaaccgcctgtatttatccgaaacggcaaacgtattgtcgtggctgctcacggaggggtaacaccgaaagggtgctatacctatttttccgatgatgacggtctgacctggaaatgctcgaatacagtcacatcccccgatcatcagggaggaggcttccataaaggtatccgttggaatcatggtgctgtggagcctacggtggtcgaactgaaggacggaactctctggatgttgatgcgtacttcacaagacttccattatcaggctttttctaaggacggcggacaaacctggggcgaatcggaaccatcgcctttttatggtaccatcacgatgcctactttagggcggttggccgacggacgactgttgcttttctggtgcaatacgactcctcttcccgaaaaggagggtacggatggtgtttgggatgatgtgttcaccaatcgtgatgtgactcacgtggcggtttctgatgatgatggaaagacttggaagggttttcgcgaactttacatgaatcccatgcgcaatgatatcgactatgccgttcatggtggcgggattgaccgtggcgttcatcaggcacagtttgtagaagtagctccgggtaaggtgctggcatctatcggtcaacatcctcttcatcgtgctatgatgatgttcgatgtgaattggttgtacgagaagagccgcttcaacgactttaccgactctctttcacaatggagtacattcaactacatgaatggtatcaaaggacattgcgcttataatcgtatacagggttgtatgctcgaaccccatccccggaaggaaggtcggcaagtgcttcatctgacttaccggccggatgcttcactggtggcagatacacgtggtgcggtatggaactttccggctatgaagaaaggaacgttcaccgttagtttacgtattcccgaagggagtcattcggtttcgttgttattgaatgatcgctggatgaatccttcggacaccgtagcccgttaccagtctatgtacgaacttccacttacccgtaagcaactcggagtgaaggatgatcgttggcacgaggtttctttggaatgggatttgttgcagaagcacccgcaggcacgtgtccgggtagatgggcggcttcgtccgttgcgccttccgctcaagaacaaatctcagaatggaattagttatgttcatttcatcgctccccctgctgaggctaatccgggtgtttatctggagtgggtgagggcagaagctgatggagccatctag

SEQ ID NO: 3376 - DNA, 3729 bp, B.fragilis
tggcggctttcggctatctggaagagttggtcgcttgcattaacataccagaagagatacagaatgagatacctgaataagattatttttatcaatagtgcccgtatccaatatgccgaaatacagatagacggcaatgttcactttatcggtacacagggagtggggaaaagtacggcgttgcgtgcattactcttcttttacaatgccgataagacaaagctgggcatttcaaaagagaaaaagagttttgatgaatactattttccgtacgtcaattcatacattatttatgaagtggtggtggatgatgcttcgtattgcgtattggctttccgttcgcagggaagggtctgcttccgctttctgggcacgggctataagaaagaatatttcatttcacccgagggaaaagcatacgaagagtgggatcagatacgtgatgcgcttggcagttttgtctataagagccgtcgtatagagacgtatgaggagtatcgagacattattttcggtaatggccgggggcttcctccggagtttcggaagtttgctattaccgaaagccggcagtaccagaatataccccggacgattcagaatgtttttctgaactcaaaacttgatgcagagtttatcaagcaaaccattatcatgtctctgaacgaagaagatgtgcgtatcgatctggggcagtatgcccatcatctgcgccggttcgatgaagaagtgaccgacatcagtaagtggttccggaaaaataagaacggtgaggtaactgtccgcaggcaagccgaccgggtgattgaactttatcgggaaatgcattatctggagcaacaggcccgtacattggccggagaattgaattacgcttttcggacagcgcgggaagtactcccttctctgcaaaaacaaaaagaagagctgttgaaagaagtggcaaaggagaaacgtcagttggaagaactttccgggaaatttcagagtgagcgtgaccgattgttgggagtggtcaaagtgcagaacgaaaatctgaaaacagcacgggagcgaaaagaacggtacgaatcgcaggatattcatcatgtacgggaacgggtgaatgcggagtccgaagctgtgcttcacaagcaaatgctggaagagcagctgaccatgctgactgcacgctttgacgacatcaacagccagtataaactgctgaaagaacaggcggccagtgcctttgagcgtttccgtaacgggaaaaacgccgagctgaataccctccatctgcgtgccatcgagcgtaaggaagccatacgtaaggagtttgataaaatattgaaagaggtaagggaacaggaagttgggaaactgacccttctgcgtgagcagacagaaaagaaaaaggaaggcatctatcagttgaaaatggaacgggagaagtgtttgcaccggactcttcatgaagaggagttgcaagcctgccggacggagcgtgccgcactggaaaaggagaaccatgagtataggctgaagcagaaagaagctgaacaacagatggagctggtgcgccgccggtgggaattggatcagactgcctgtgagcagcagttcactgcccgccaaaaggatatcgaacagcagattacacttgctaaagagagggtagcggagatagaccgtttgctcgacaaccgtcagggttcattctatgaatggctgagtcagaactgtcaggggtgggaagataccattggcaaggtcgtggacgagaaacaggttttgttcagcaaggaactgaagcctcagtctgttccggatgccggtcaagactctttctatggcattaaactcgacctctcggctatccgtaaggaggtgaaaagtgtacaagagtatgcggcggatcaggaaatagccggtaaggaagtatcagagtggcaacagcagcttgagaagttgggagaggaaaaagaaaaggaactggccttgattcggaaaagacatcaggccacgcttagtacctgtaaggaggatgtggctcaatccacttattgtatggagcagaacgataagcgtatccggctcctgaaagcggatgaaatcaggtgggaacagaaggcaggggaggagaagcgtgtcctgctggaacaattggataaacagttggccgaggctacccgtagcctgcaggggacagtggcggaattggaacagttcaatcatctgctcgaaactcgtgtacgtcaaaaggagaaggaacgtaaccagagaatgcaagaagaggatgccctgatccgtaacaaacaagaagaaattcacctgtccattgcttccgaaaagcagaaaaccgatgaactgctggcaaccatggacaaagacttgctgcacgaactctccgggaaggagtggatacggagcgtatcactgcttttgcgtaatgaagtggcccgtacggaacaggagctggtgtttattgaccaacatcgtcgcctggtctacgattacgagaaggacaagagagaattctttgaccggatggacgaattcagaaacgaaaagcagttggccgagaaagaactggaaggcgagaaagaaaagttccgtttgaaagaggaagaattgaatctgaaaatgacgggactgaacaagcagctggctgagacaaacacccgcctgaaacatttggacgaggatattcgggagacggagaacttcaaaacgctcaatatctgtccgcctgtgttacaaacgggggtggaaacagagaatgccaagcgctgtaagaaggtgattgaggaactgactcaaaaccattaccggcagattgaacaggaaaaagacttcagggaggccgtcggtcggttttccggtaatttctccgagcagaatacgttcaatttccgtacgcggcttacgaagcgggaagagtttatgacttttgccgccgatctgaaagaatttattgataatgataagattattgattttgaacgtcgttcaaacgaggcatacaccgacttgattcatcggattggaaaagaaacgacggacatgctttcaaaagagggactgattcgtaagaccatcagcgatatcaacagtgactttgtggaacgcaactttgccggagttatcaagagtatagccttgcagattgtgccgagcggtaatcgtatcatgcaacattttgtcacgatcaaagagttctgcgaccggaatcagccgggtgccccgggcatgttcagcctgttcggacaagaggattttgtagaacggaatcggcaggcggtaagtttattgcagtcattggtgaaagaactggcattgaataaagaaaaagaacttaccctttccgataccttcgaactccagttccgtattgtggagaacgacaacgatagcggatgggtggagaaactggcaaacgtgggttccgacggaacggatatcctggtgaaggccatgattaatatcatgttactaaatgtgtttaaggagaaagcatcgcatcagttcaacgactttaagctgcactgtatgatggatgaaatcggaaaacttcaccctaataatattaaggggattctggactttgccaataaccggaatattatcctggtgaatagttcgcccacctcttatcgggcaagcgattataaatatacttatattctgaacaaggataagcggaacatcacaagtgtgacacggctgataaagcaggaagtgagggaataa

SEQ ID NO: 3377 - DNA, 207 bp, B.fragilis
  unsure (178): Identity of nucleotide sequences at the above locations are unknown.
ggtagagtttccgtatctgtcgataacaccaagcatctcaacgagatcctggatgacctgaagaagtacggaaccgttaccgtcgacaaggatatgtgtatcatctgtgtcgtgggtgacttggaatgggagaatgtaggtttcgaagccaaagcgctcgatgccatgcgtgacatcnccgtgcgtatgatttcgtttggcgggtag

SEQ ID NO: 3378 - DNA, 336 bp, B.fragilis
acaagctcacccacgagcctaaaaaaggaggtaagtatggaaattagaattcaatcgattcactttgatgcaacagaacaattgcaggctttcattcagaagaaagtgtctaagttggaaaaatattacgaagatataaagaaagtggaggtgtcattaaaggtagttaaaccagaagctgcggagaataaagaagccggcattacagtgctggttccgaataatgattttcatgcaagtaaaatatgcgatacttttgaggaagcagtcgacttatgtgtggaagcattggaaaaacagttggttaaatacaaggaaaagcaacgaaataaataa

SEQ ID NO: 3379 - DNA, 525 bp, B.fragilis
aacagagtaacaatgagaaaggaagataaaaatacgattattgagcagattgctgctacagtacaggaatatggtcacttctatttggtagatacaacagctatgaatgctgctgcaacaagtgaattgagaagagcttgtttcaaggctgacatcaaattgatggtagtcaagaatacattgcttcataaagcacttgaaagcattgaaggtgatttctctcctctttacgattctttgaaaggtacaacagctgtgatgttttgcaatgttgcaaacgcacctgctaaactgatcaaggataaatctaaagatggtattccgggactgaaagccgcatacgcagaagaaagcttctatgttggtgctgaccagttggatgctctcgtagctattaagagtaaaaatgaagttattgccgatatcgttgccctgttgcaatcaccggccaagaatgttatttctgctcttcaatcaggtggcaacacccttcacggagttctcaaaactcttggtgaaagataa

SEQ ID NO: 3380 - DNA, 591 bp, B.fragilis
ctcagtccttactggctgcaaaatagttatttatgcaagtcagcggctgaatttgaaataagtataaaacaacaatctatggctttaataaaatcagtaagaggttttactcccgaatttggagaaaactgttttctggccgataacgccaccatcatcggcgatgtaaaaatgggacagaattgtagcatttggttcaacaccgtgttgagaggagatgtaaactcaatccgcatgggtgatggagtgaacatacaggacggaagtgtcttacacactctttacgaaaaatcaaccatcgaaataggcaactatgtatcggtagggcacaatgtgacaatccatggtgcaacagtaaaggactatgctttgatcggcatgggatcgaccttgctcgatcatgcagtcattggcgaaggcgcaatcgttgccgcaggctcacttgtactgagcaataccatcatcgaaccgggaagtatttggggaggtgtaccggccaagttcataaagaaggtagatccggaacaagctaaagaactgaaccagaaaatagctcacaactacctgatgtattctgactggtataaataa

SEQ ID NO: 3381 - DNA, 1782 bp, B.fragilis
tgtatgaaacagtctatcagtgaacgaatacatgcattacgcatgtggtttaaacccaacattcaagcattcatcattcccagcacagaccctcacctcagcgaatacgtagcaccgcactggaaatcaagagagtggatatcaggatttaccggctcggcaggtacggtagtgattactgaaaaaaaagccggactttggactgactcaagatattttctacaggcagcagagcaattgcagggaagcggtatcgatctatacaaagagatgttaccggaaactccaagtatcacaaaattcctttccgacgagctacagccgggcgaatccgtaggtatcgatggaaaaatgttctctgttgaacaagtagaaagtatgcaagcggaactttcagcaaagaacattcagattgtgttctgtcccgaccccatggacgagctttgggaaaaccgaccgcccatgccggagtctcccgcttttgtatacgatatcaaatacgccggcaaaagttgctctgaaaagattgcagccattcgtacagagttgaaaaagaaaagcgcagaaagcgtgatgctgtcagctttagacgaaatagcctggactttgaatctgcgtggcaatgatgtacattgcaatccggtagtagtgagctatctgcttataacagaaaaaaaagcagtattattcattgcaccggagaaagtgacagaagaggtacggaattatttagaaaagcaacagatagagatacaaaactattcagatacagagatttacttatctgatctcaatagttcaagtatcttaatgaatcctgcaaaaaccaactattctgttttctcttcggtaaatccccaatgccggattatacggggagaagcgccggtagctctattgaaagccatacgtaacgaacaagaaatcaaaggcattcatgcagccatgcaacgtgatggcgtagcattagtcaagtttctgagatggctggagtcggctgttccctccggaacagaaacagaattaagcattgaccgtaaattgcacgcatttcgtgcgacacaagatttatatgtaggcgaaagcttcgataccatcgcaggctacaaagaacatggagctattgtacactattcggcaaccgaggaaagcaacgcaacattgcacccgaaaggttttcttctcctcgactcaggagctcaatacctggatggtactacggacattacacgtaccattgcattaggcgaactgactacagaagaaaaaacagattatacattggttctgaaaggacatatcgcactggcgatggccgtattcccttcaggtaccagaggggcacagctggatgtcctcgcacgcatgccgttatggagtcataaaatgaacttcctacatggtacaggtcatggtgtaggtcatttcttaagtgtacacgaaggaccgcaaagcattcgcatgaacgaaaaccccattgtattgcaacccggaatggtcacctcaaatgaaccgggagtgtacaaaggcggtagtcatggaatccgtacggaaaacctgacactggtatgcagcgccggtgaaggcctgttcggtgaatacctgaagttcgaaacaattacgctctgccctatctgcaagaagggaatcatcaaagagttattaactgccgatgaggtcgactggttgaataattaccaccagcaggtatacgaaaagctgtctcccaagctgaacgaagaagaaaaggcatggctgaaagaagctacagcagtaatctga

SEQ ID NO: 3382 - DNA, 1200 bp, B.fragilis
ataacaagtaaagctatggctaaagagaaatttgaacgtaccaaaccgcacgtaaacattggtacaatcggtcacgttgaccacggtaaaaccactttgactgctgctatcactactgtgttggcaaagaaaggtctttctgaacttcgttctttcgattctatcgataatgctcctgaagaaaaagaaagaggtattactatcaatacttcacacgttgagtatgaaactgctaaccgtcactacgcacacgttgactgtccgggtcacgctgactacgtaaagaacatggttactggtgctgctcagatggacggtgctatcattgtagttgctgctactgatggtccgatgcctcagactcgtgagcacatccttttggctcgtcaggtaaacgttccgaagctggttgtattcatgaacaagtgcgatatggttgaagatgctgagatgttggagcttgttgaaatggaaatgagagaattgctttcattctatgatttcgacggtgacaatactccgatcattcagggttctgctcttggtgcattgaacggcgtagaaaaatgggaagacaaagtaatggaactgatggaagctgttgatacttggattccactgcctccgcgcgatgttgataaacctttcttgatgccggtagaagacgtgttctctatcacaggtcgtggtactgtagctacaggtcgtatcgaaactggtgttatccatgtaggtgatgaaatcgaaatcctcggtttgggtgaagataagaaatcagttgtaacaggtgttgaaatgttccgcaaacttctggatcagggtgaagctggtgacaacgtaggtctgttgcttcgtggtgttgacaagaacgaaatcaaacgtggtatggttctttgtaaaccgggtcagattaaacctcactctaaattcaaagcagaggtttatatcctgaagaaagaagaaggtggtcgtcacactccattccataacaaatatcgtcctcagttctatctgcgtactatggactgtacaggtgaaatcactcttccggaaggaactgaaatggtaatgccgggtgataacgtaactatcactgtagagttgatctatccggttgcactgaacatcggtcttcgtttcgctatccgcgaaggtggacgtacagtaggtgctggtcagattactgaaattatcgactaa

SEQ ID NO: 3383 - DNA, 456 bp, B.fragilis
attaataaaaaaatggctaaagaagttgctggactaatcaaattacagattaaaggaggcgcggcaaacccatcacctcccgttggacctgcattaggttctaagggaatcaacatcatggagttttgcaagcaattcaacgccagaacccaagacaaagcaggtaagattttacctgttatcattacttactacgcagataagtctttcgattttgtaatcaagactcctcccgttgccattcagttgcttgaagtggctaaggtaaagagtggttctgctgagcctaaccgtaagaaagttgccgagattacttgggaacaggttcgtacgattgctcaggacaaaatggttgacttgaactgttttactgtggaagctgccatgagaatggttgcaggtacagctagaagtatgggtatcgctgtaaaaggggagttcccggttaataattaa

SEQ ID NO: 3384 - DNA, 288 bp, B.fragilis
tccagaagtttgcggaacatttcaacacctgttacaactgatttcttatcttcacccaaaccgaggatttcgatttcatcacctacatggataacaccagtttcgatacgacctgtagctacagtaccacgacctgtgatagagaacacgtcttctaccggcatcaagaaaggtttatcaacatcgcgcggaggcagtggaatccaagtatcaacagcttccatcagttccattactttgtcttcccatttttctacgccgttcaatgcaccaagagcagaaccctga

SEQ ID NO: 3385 - DNA, 345 bp, B.fragilis
aattatcgactaaaaccaaatattaatcagttcccggtagtaatatcgggaactgattatgtacaaacgggagtagctcagttggtagagcaccggtctccaaaaccgggtgtcgggagttcgagcctctcctcccgtgctaatatttatgaaatgaaaaaagtagtagcttatattaaagaatcttacgacgaacttgttcataaagtgtcgtggcctacgtattcagaactaactaacagtgcggtagttgttttatatgcttccctgcttatcgcattggtagtgttcgcgatggacttctgtttccagaattttatggaaaaaataatttatccacattaa

SEQ ID NO: 3386 - DNA, 231 bp, B.fragilis
aacaaggcaagatggtctatcagagtgcatcaaagcggtattgttcatacttcaattggtaaggtttcattcactgcagagcagattcgcgacaacgcgaaagaattcatctctacattgaataagttgaaaccgactgcagccaagggtacatatattaagagtatttatctttctagtacaatgagtgcgggtatcaaaattgacccgaaatcagtagaggaaatctaa

SEQ ID NO: 3387 - DNA, 1233 bp, B.fragilis
ggatccggaggtatgttttacgatctggcaataggaatttacgaccttctggtgcatttggctgcaccattcagtcgcaaaccccggaagatgatgaaggggcactgggtggtgtacgatcttcttcgccaacaggtagagaaagacgagcgttacatttggtttcacgccgcttctctgggggagtttgagcagggacgtcctttaattgagagtatacgggagcgatatcccgattataaaatactgcaaacgttcttttctccttcgggatatgaagtccggaagaactatagaggagcagatattgtttgctatttgccgtttgataaacctcgtaatgtgaagaagtttctggatatcgtgaatccttgtatggctttcttcattaaatatgaattctggaagaactatctggacgaattgcacaaacgtcgtattcccgtttacagtgtttcgtctattttccgcaaagatcagatttttttcaaatggtacggagggacttatcgaaatgtactgaaagattttgatcatctgtttgtgcagaatgaggcttcaaagcgttttcttgccaagatcggtatcacaagggtaacggtagtgggagatacccgcttcgaccgcgtcctgcagattcgggagcaggcaaaagagttgccgttggtggagcagtttaaaaacggtgcatttacttttgtggcaggaagttcatgggggccggacgaagatcttttcatcgaatattttaatagtcaccctgagatgaagttgattatagctcctcacgtaatcgatgaaaatcatctggtagagattataggtaaattgaaacgtccttctgtacgctatacccgtgcagatgaaaagaatgtccggaaggcggactgcttgataatcgattgtttcggtttgctctcttcgatctatcgttatggggaaattgcttatatcggtggtggttttggagtcgggattcacaatacgcttgaagcggctgtatatggcattccggtaattttcggacccaaataccagaaatttatggaagctatgcaactaatcgaagccgggggagcctattccattaaggattacaatgaactgaaaatattgctcgacagacttttaaccgatgaagcattcctgaagaagaccggcacgaatgccggtaattatgtcattggtaattccggagcaacggagaaagtactgcatatgataaacttttaa

SEQ ID NO: 3388 - DNA, 927 bp, B.fragilis
attcttttcatacattcgttgcagaattatagatgtagcgatattatgttaacagattcttttcttgattatctccggtacgagcggaattattctgagaaaaccgtactggcttacggcgaggatatttcgcagttgcgggagtttgctcaggaaaggatggagaagtttgatccggcggaggtgaagccagaactggttcgtgagtggattgtttcactgatggatcaggggtatacttcaacttcggtaaaccgtaagctaagttctctccggtcattttataaatatcttctcaggcagggagaggtgagcgtcgatccgttgcgtaaaataacaggaccgaaaaataaaaagccacttccctctttcttgaaagagagtgaaatgaataaattgctggatgatacagattttggtgaagggtttaaaggttgtcgggatcgtctgattattgagatgttttatgctacgggcatgcgtctctctgagttgatcggtctggatgataaggatgtggatttctctgcttctcttctgaaagtaacgggaaagaggaataagcaacgtttgataccttttggcgatgagttgaaagagacgatgcttgagtatgttgatataagaaacgaaatgatttccggaaggtcggatgccttttttgtaagagagaatggtgagcggctttataagaatctggtctataatttagtgaaacggaacctttcgaaggtggtaacgcttaaaaagcgtagtcctcacgtgttgagacatacttttgccacaacgatgctgaataatgatgcggagttgggtgcggtgaaagagcttttgggtcacagtagtctggcgactacggagatttatacgcataccacttttgaagaacttaaaaaagtgtataaacaagctcacccacgagcctaa

SEQ ID NO: 3389 - DNA, 573 bp, B.fragilis
tttatccacattaaaaagagaggaattacgatgtctgagattgaaaagaaatggtacgttttgcgtgctattagcggaaaagaagctaaggtgaaagagtatcttgaagctgatattaaaaacagcgaccttggcgaatatgtgtctcaggtattgattcctaccgaaaaggtatatcaggttcgcaatggtaagaaaattgtgaaagaaagaagttatcttcctggttacgttttggtggaggctgctttggttggtgaggtttctcaccatctgagaaatactcctaatgtgataggtttcttgggaggttccgataaaccggttcccctcagacagtcggaagtgaatcgtatacttggtacagtggatgaactgcaagaaacgggtgaagacttaaatgttccgtatattgtaggcgaaactgtaaaggttacttttggtccttttagcggattcagtggcatcattgaagaagttaatagtgaaaaaaagaaactgaaggtcatggtaaagatattcgggcgcaagacgccgcttgaattaggctttatgcaagtggaaaaggaataa

SEQ ID NO: 3390 - DNA, 543 bp, B.fragilis
acttcaattgtaatgggtaaactgacaaaaaatcaaaagttagctgcaggaaaaattgaagcagggaaagcatactcactgaaagaagctgcatctttggtaaaggaaatcacttttactaagtttgatgcttcattagatattgatgtacgtttaggtgttgatccacgtaaagcaaaccaaatggtgagaggtgtcgtttcacttcctcacggtactggaaagcaagtacgtgtattggtactttgtacaccggatgctgaagctgctgcaaaagaagctggtgctgactatgttggtcttgacgaatatattgaaaagatcaaaggtggatggactgatattgatgtgattatcactatgccatctatcatgggtaaaattggtgcactcggtcgtgtactcggtcctcgtggattgatgccgaacccgaagagtggtaccgtaactatggatgttgctaaagctgtaagagaagtaaaacaaggcaagatggtctatcagagtgcatcaaagcggtattgttcatacttcaattggtaa

SEQ ID NO: 3391 - DNA, 270 bp, B.fragilis
ataaagaaagtatgtgtaattttgcggcgcaatttgactgcggaaattttaaaccataacatatttaataataacaaaatgattgtagtacctgtaaaagaaggcgaaaacattgaaaaagcgctgaagaagtttaagagaaaatttgaaaaaactggcatcgttaaagagttgagaagcagacaacagtttgataaaccgtctgtaactaaaagacttaagaaagaacgtgcagtttacgtgcaaaaacttcagcaagtagaagattaa

SEQ ID NO: 3392 - DNA, 417 bp, B.fragilis
cacattttatttagtaaattaaacattaaaatcatacaaaaaatggcagatttgaaagcttttgcagaacaattagttaacttgacagtaaaagaagttaatgaacttgcaactatccttaaagaagaatatggtattgaacctgctgctgcagctgtagctgttgctgctggtcctgcagctggtgctgctgccgcagaagaaaaatcttctttcgacgtagtattgaagagcgctggtgcagctaaacttcaggttgttaaggccgttaaagaagcttgtggtcttggcttgaaagaagctaaggacatggtagacggtgctcctagtgtagtaaaagaaggtttggctaaagacgaagcagaatcattgaagaaaacattggaagaagctggagctgaagttgaacttaaataa

SEQ ID NO: 3393 - DNA, 2871 bp, B.fragilis
  unsure (2274): Identity of nucleotide sequences at the above locations are unknown.
cagatgtcttcaaatactgtaaatcaaagagttaattttgcttcgactaagaatccgcttgaatatccggatttcctggaagtacaattgaagtcattccaagactttctacaactagataccccacctgagaagcgtaaaaaagagggattgtataaagtatttgccgaaaacttcccaattgccgacacaagaaacaattttgttcttgagtttctggactattatattgatccgccgcgctataccattgatgattgtatagagcgtgggctcacatatagtgttccattgaaagcgaaactcaagctttactgtacagaccccgatcatgaggatttcgatacagtgattcaagatgtgttccttggtcctataccttacatgactgacaaggcaacttttgtcatcaatggtgctgagcgtgtagttgtgtcgcagcttcaccgttctccgggcgtattcttcggtcagagtgtacatgctaatggtacaaagttgtactcagcccgtatcatcccgtttaagggatcatggattgagttcgctaccgatattaacaacgtaatgtacgcttatattgatcgtaagaagaaattgcctgttactacgctgttaagagctatcggctttgagaacgacaaggacattcttgagatttttaacctggctgaagatgtgaaggttaataagactaatctcaagaaggtagtaggtcgtaaactggctgcgcgtgtcttgaaaacctggattgaagatttcgttgatgaagataccggtgaagttgtttctattgaacgtaatgaagtcattatcgaccgtgaaacagtaatcgaaccggaacatatagatgaaataattgactcgggcgttcaaaacatccttattcacaaggaagaaccgaaccagtccgactactctattatatataatacccttcagaaggacccgagtaactcggaaaaggaggctgtgctttatatctaccgtcagttgcgtaatgcagaccctgccgatgatgccagtgcccgtgaagttattaataacctgttcttctctgaaaaacggtatgaccttggtgatgtaggtcgttatagaatcaataagaaattgaacctgacgacagacatggacgtgcgtgtcctcactaaagaagatattatcgagatcatcaaatatctgattgagctgattaactcaaaagcagatgtagatgatatcgaccacttgagcaaccgtcgcgtacgtactgtaggcgaacagttgtccaatcagttcgctgtcggtttggcacgtatgtcacgtaccatccgcgaacgaatgaacgttcgtgacaatgaggtgtttactccgattgacctgatcaatgcgaagactatttcttctgtgatcaattcattcttcggaactaacgcattgtcacagtttatggaccagacaaacccgttggctgaaatcactcacaaacgtcgtatgtctgctcttggtcctggtggtttgtctcgtgaacgtgccggatttgaggttcgtgacgttcactatacacactacggacgcctttgtccgattgaaacaccggaaggtccgaatatcggtttgatttcgtcactttgtgtgtttgccaagatcaatgatctcggctttattgaaactccttaccgtaaggtagataacggaaaggtagatctgtctgagaacggactcgtttacctgacggctgaggaagaagaagctaagatcatagcacagggtaatgctccgttgaatgatgacggtacatttatccgtaataaggttaagtctcgtcaggatgccgattatccggttgtagaaccttcggaagtagagttgatggatgttgctcctcaacagattgcttctatcgctgcatctttgattcccttccttgaacatgatgacgctaaccgtgcgttgatgggatcgaacatgatgcgtcaggctgttcctttgctgagaagcgaagctccaatcgtaggtacaggtattgaacgccagctggtacgtgattcacgtactcagattgctgccgaaggtgatggagtgattgattttgtagatgctactactattcgtattctatacgatcgtacagaagatgaagagtttgtaagttttgagccggcattaaaagaatatagaataccgaagttccgtaaaacgaaccagaatatgacaatcgaccttcggccaacttgcaataaaggtgatcgtgtgacgaaaggtcagattctgacagaaggttattctactganaatggagaactcgctttgggtaagaatctgttggttgcttacatgccttggaaaggttataattacgaggatgctatcgtgttgaatgaacgtgtggttcgtgaagacttgctgacttcagtacacgtagaagagtattcactcgaagttcgtgaaaccaagcgaggaatggaagagttgacttctgatattcctaacgtgagtgaggaagccactaaggatttggacgagaatggtatcgtacgtgtcggtgcacgtattcagccgggtgatatattgattggtaagattacaccgaaaggtgaatctgatccttctccggaagaaaaattgcttcgtgctatctttggtgataaagccggtgatgtgaaagatgcttctttgaaagcatctccttctctgaagggggtaattattgataagaaactgttctcacgtgtcatcaagaatcgtagttctaagttggctgataaggcgttgcttccgaaaattgacgatgaatttgagtctaaggtagctgacttgaaacgtatcttggtaaaaaaattgagtggtcaccacaggggctctcaggaaccgggctctcaatgggccgga

SEQ ID NO: 3394 - DNA, 1788 bp, B.fragilis
aagatgaaaactataaataaattattcaagggtatattcttttgcactttagttagtgtaagtgttagtagttgcgacttggaagtggagccgcctgctaatattgcggccgaaacatattggacatctgaaaaagatgcctggtataatctgaattcaatttattctgctgcgattccgggtattggaatttacggagatgcttattcggatgatgtatattgccaatatgcacatgaatctaacgcaaaaatattccagcaagatggttttagccctctttatgatgaaggttggaactttgagacaattcgtaaggaaaacttgtttttgcagaaagttggaaattgtgagatggatgaatctttaagagaaaggttcaaggcagaagttcgtgcaatgcgtgcctggacttatttgggcatgactatgacgttcggtaaagtgcctttgattactgaagtactggattataactctcctaatattccgcgtgacgaggtaagtgtgattcgtgattttattatgaaagaacttactgaggctgctgcaatattgcccgagaaatacgctggtggttatccaaatgaaaagggacgtatcacaaaatatgcttgtttgtcattgaaagcaagagcggccctgtattttggggactatgctttagcagaatctactgcgaaggaagtgatggataagggaggcttctctttgtttaaaatatcttctttgtcggatgcacagaagaaagaggcagaagaaatgagtttgtatattgattttgcagaaaaaggaatcgataaagacgaattcgttaagggtatgtttaattatgaagctttgtggcatacagaaaatgctaatccggataatcccgaatacattatgactcgtcaatatgctgcttccagttgggattatcaagatatgactcgttatacaagtatgcgcccgaatcagttgggtggctggtcttctgtaactccgacacagaatctggtagatgcttattggggagttgatggccacagtgtaccgcaattgcctactccggaagaacgtgctaaagcgtataaccagataaaggctgacttggatgcttatcaaaagcctgaaggagaagctaagtttattgctttctgccaggaaaagataaagaatggaacattgaaagattataaatatattcaagagttccgtaaccgtgatagccgtatgtatgtttctatcttgatgccattcaagagttggtatgaatctaattatggtgataagtttgtgtatgaatggataaagaatggtaataacgaatcaaagaccggatttaacttccgtaagatgctttcattggaaaatgatgctaatggcgacggacaggcgaccggtgattatccttgtatccgttatgctgaaattttattgatttatgctgaagcgcatacacagactactggttatgatgctgcaactgaagctgctttgaatcagttacgtgatcgttgcggtatgccggatgttccttctggcttgagcaaagaagaaggtctgaaactgattcagaacgaacgtcgtattgaattggccggtgaaggtttccgtggtgacgatatgactcgttatagcgatgattactggaaagagcacatgaacaatgtacctatcatgactcctgacggtgatacggaacttacaatgaaatggagctctcgtatgcgtctgaaaccaattccgcaaacagctattgacttaaatccgttattggctggtgatcagaatccgggatattaa

SEQ ID NO: 3395 - DNA, 234 bp, B.fragilis
aggttgaaaaagggggtggcggtaaaccggatagccataaaagcccaagtgctgaccggcgggcggggaaaagccggcggagtaaagttggccaataatgatagagatgtctaccaatacgctcaaactattttggagatgactataaaaggttatcccgtcaccaaaaattttcttaatgaggctggcaacattggcagccgaatattacatcaattttacgatagaccgtaa

SEQ ID NO: 3396 - DNA, 2007 bp, B.fragilis
cgggggactagaatagactgcttaagatactcctcgccccgcggtgaagacagcacttccgataatgataaaggaggagttgtttatacacacttgttgacaattccgtcaacttatgttgctcgtcaaagtaatggtgaatggggtagctatgaaggtggaaagccggctgcaacagtaaatatggagcgtaaccctttacgccgtttggaagaaggaggatggtcgaacagtaagactcagaatactttgataaatctggctttagatattaaacctgtaaaaggactggtattgacaggcgaaatgatttataaagcttgggattataaatctaagacttatactgcaaataaaagtaagattaaggatttccagaccggtactgagttgaatggtacagatgtaactaattctaagatggagtacagttgggaagaaaacagtcgccttacttataatgcattggctaattacgtttggagtaatgaaaaacataatgtgaatgtattggctggtgtatcttatgaacattataagtatcagaaacaaaaatcatatcgtctgaaattcccgactaatggtatgacggacatgaatggtggctcgagtgcgccagatgatacttatgctgaaggtggaagtaacgaagacaaactgatgtcttactttggtcgtgtaaattactcctttatggatcgttatttattagaggccaatatccgtgctgatgcttcttttcgctttcataaggataatcgttggggtgttttcccgtcattctctgcaggctggcgtattagtcaggagggatttatgcaagatatcaactggattaataacctgaagttgcgtgcatcttggggacagttgggtaatatcaatgacgtaggccaatatgattatttctcttcatatcaacaaggaggtaactacaactttgaagatgctattgtttcgggtatcgtagaatctaaacctgccaatccgactttaggatgggaaactgttactatcactgatatcggtgtggattttgacattttcaatggactgttgaattttacagccgattattataacaaaaaaacagatgatatcttgttggcatatccgagtccgaaagaaatcggtattggctctgatttcaaggtttcacaaaatattggtacagtaagtaataagggtttagaactgagtattacacataataaaactctgggtgactttgcatatacagttgggtttaacatgagtaagaactggaataaagtaaccaacctgggagcgaatgacccgattattgaaagcccatggattaaaaaggttggttatgcaatcggtactttctatggatatcgctctgatggtctgttgactcaggaggatattgataccggtaattacatcaccgatggtttggtgcctcaagcgggtgatatcaaatatgtagatttagatggtgatggtaaacttaccgataaagatagaacttatataggttgtgatgttcctgacattacttatggtgtgaacctgaatcttcgctataaaggatttgaattaagtatgttcggtcagggagttaccggtacaaaggtaaacttcagtatggaaaatgcctgggcattctcggattatgcaagtccgcgtaaatatcacttgaagagatggacggtagataatcctaacccgaatgcagcttatcctcgcatttatcctcgtacaagtaaacattcaacttataaccaatatttctctgattactggttgcttaatgccgattatttccgcatcaagaatataacttttggatattctttccaaaagccggtattacagaagctgagtctggaggcattgaaactctatgttgcggctgaaaatccgtttactattcgtgctgatcaccgtatggaagatttcgaccctgaaacggcttcaggacgcggcgttaatactcgtggtacgtcttcgattgcttttggtgtaaatctaacattctaa

SEQ ID NO: 3397 - DNA, 1218 bp, B.fragilis
gttaaacataatttgaagacaatgaaaaagagcattttaattgcagttctgacagcgtcgatagctacttccgcttttgcacaatggaaaccggcaggagacaaaatcaagacaaagtgggctgagcaggtgaatcctgaaaatgtattgcccgagtatccacgtccggtgatggaacggggagagtggaagaacctgaatggtttgtggaattatgccatcaccgagaaaggagctgctccttcagcttacgaaggtcagattctggttccttttgccatagagtccagcctttcgggtgttggtaagaaagtcggccccgacaaagaactttggtatcagcgtactttcacagtacccgcttcctggaaaggtaaaaaagtgatgctgaacttcggtgctgtagactggaaagctgatatttgggtcaatgacattaaggtgggacaacacaccggaggatttactcctttttcactcgatattacggctgctttggctactaaaggagacaataaacttgttgtgaaggtatgggacccgacagatcgcggacctcagcctcgtggcaaacaggtaaaccgtccggaaggcatctggtatacggctgttaccggtatctggcaaactgtctggatggagcctgtggccgaacgtcatattactaatgttcgtacgacttcggacatcgaccgtaagaaactcacagtggacgttactaccagtaccagctgtccttcggaagttgtcgaagtaaaggttttcgatggtaaacagctggttgctaccggaaaaggattgaacggccagactattgacattcagatgcctgctgatgctaaactgtggagtcctgcttctccgactctttattctatgcagattgccctgttgagcaatggtaaagtgaccgataaagtagatagctatacagctatgcgcaaatactctacccgccgtgacaaggacggaattgtacgtttgcagctgaacaatgaagatgtgttccagtttcggtcctctcgatcaaagatggtggcccgacggactgtatacagcttcgacagacgaagggggggttatgatattcaaaaaaccaaagacttcggatttaacatgatccgtaaacacgtgaagggtgaaccggcacgttggtattcacactgtgataaactgggtataatcgtatggcaggatttgcccaaatgggaaccgtaa

SEQ ID NO: 3398 - DNA, 2076 bp, B.fragilis
  unsure (654): Identity of nucleotide sequences at the above locations are unknown.
aaacacccaaacatgaaaaagatgaaaagtctgaaaggaggcttggccggaatcctatttacagccggattactggcagcatcgtgtacttccgatcaatcatcgtcggcagtaaccatcgtgaaccgccccgactgtacacaaaccaacgtaaactatgtaggaaaccgcttgccactgaaaccgatgaatttcattaaactgcccgtcggaagtattcagcccgaaggatggttgaagaaatatctcgaattacagaaagacggtctgaccggtcacctgaatgagatcagtgcatggctgggcaaagagaataatgcctggctgaccaaaggaggagatcacggatgggaagaagtcccctattggctgaaaggatacggaaacctggcttatatattaaaggatcagaaaatgattgatgaagctaaagtatggctcgaaggagcattcgccagccaacagcccgacggatactttggtcccatcaacgagcggaacggaaaaagagaattgtgggcacagatgattatgctctggtgtctgcaatcctattatgaatattcaaatgaccaacgggtaatcgacctgatgaccaattactttaaatggcagttaagtgtaccggacgaacaattcctggaggactattgngaaaacagccgtggcggagataacctgttaagcgtatattggctttataaccgcacaggagatcaattcttactggaactggctgagaagatacaccggaacacagcagactggacccgcccgtcggcactgcgaaactggcacaatgtaaacatcgcacaatgtttccgcgagccggctacctattatatgatgacaggagattcagccatgctgaaagcatcttataatgtacacaatctgatacgccgtactttcggacaagtaccgggcggtatgttcggtgccgacgaaaatgcccgcatgggttctatcgacccacgtcagggagtagagacctgcggattggtagaacagatggcttccgatgaattgatgctttgtatgacgggtgatccgctttgggcagaacactgcgaagaagtggctttcaacagttatccggctgccgtgatgccggatttcaaaggattacgttacatcacttgccctaaccagacggtcagcgactcaaagaatcatcatccgggcatcgacaaccggggacctttcctggcaatgaacccgttcagcagccgttgctgccagcataaccacgcacagggatggccttattatgccgagcatctgattctggctactccggataatggtgtagcggccgccatgtatgccgcctgcaaagcaacggtgaaagtgggtgacggaagcgaaataagccttcacgagcagacgaattatcctttcgaggaaaccatccggtttacggtaaatactccgaaagctgtaagtttcccgttctatctgagaatcccttcatggacagagggtgcaactatctttgttaacggcaaaaaagtagcggctaaccccgaagccggacaatatgcctgcatcaatcgcgaatggaaagacaatgaccaagtggagattcaactgccgatgcaactttcgatgcgtacatggcaagtgaacaaaaacagtgtaagcgtagactacggtccgttgacaatgtcactgaaaattgacgaagattatgtgaaaaaggacagccgcgctacggctatcggtgactctaaatggcaggaaggcgctgacgccagccaatggccgacatacgagatctatgcaaaaactccttggaactacgcattggtactcggtaagaacgaacctttgaaagactttaaagtagtacacaaagaatggccggctgacaacttcccgttcacggtcgcaagtacacctatcgaggtaaaagctatcggacgcaaggttccttcatgggttatcgatcaatacgacttgtgtagcgaacttcctgaaatggacgctccgaaaggggaaaaagaagaaatcaccctgattccgatgggagcagccagactgcgggtttcggctttcccgaacacaagagagtaa

SEQ ID NO: 3399 - DNA, 1587 bp, B.fragilis
  unsure (194),(1550): Identity of nucleotide sequences at the above locations are unknown.
ctctcacgactggtggccgcgtatggtgatgctgaaaatactccagcaatattattctgccacgaacgatcaacgggtcatccggtttatgaccgactatttccgttatcaactgaaaacgttaccggaaaagccgctcggcaactggactttttgggcagagtttcctggccttgcaaaaatatccaggccgnatactggctctataatatcaccggtgattcattcctactcgatctcggcaaactgattcatcaacaaagtttcagctttgtagatatggtgaaccggggagacctgaaacgtatcaatacgattcactgtgtcaacctggcacaaggtatcaaagagcctgtcatctattatcagcaagagcccgacaaaatgtatctcgatgcggttaaatgtgcttttcgtgacattcgccagttccacggacaaccgcagggtatgtatggtggtgacgaggcattgcatggcaacaatccgacccaaggttcagaactctgctcagctgtggaactgatgtactcgctggaaaaaatggtagagatcacgggagatatcgacttcgccgaccatctggaaaggattgcattcaacgcactgcccacccagatttcagacgattttatgacaaaacaatatttccaacaagccaaccaggtgatggtatcacgccatcgtcgcaatttcgatcaggatcacggaggaacggacaactgtttcgggctgctgacgggatatccttgttgtgcatcgaacatgcaccaaggttggcctaaattcacccaaagcctctggtatgccactcctgacggtggactggctgttacggcatacgctccatcggaagtgacggccaaagtagcggatgggtgtacggtaactttcagtgaagaaacctattatccgatggatgacaaaataagtttcaccctccaatcgatggacaaaaaacggaaagaagtaaacttcgctctccaattacgtatcccgaaatggtgtagacaagccggaatatcagtcaacggacaacttcttcaacatgccgaaggaggccggatggccattgtcaaccgcaactggaaaaaaggggaccgggtggaactccatctgccgatggaagtcactgccagcacctggtatgaaaattcggtaaccattgaacgcggtccgttggtatttgccttgaagatggaagaaaaatgggagaagaaagagtttgaagagccgtggtatggtccgtattattactcagtgactcctaccgaaccatggaactatggattggttgatttcaatcgtaacaaagcgaacgaacatgcccgtgtaacgattcatacggaaaagcaatcttccgtattcccctggaataaggaaaatgccccgatagaaatacggatgaaagcaagattggtaccttcatggaaactttacaacgaaatggcagggcctcaaccttattctttctgtagcggaggcgaaagggccggaaacagaaatcaccctgaattcttatggatgcactacattaagaatacggaatntccggtagtgggagccttccgattgagaggtgattaa

SEQ ID NO: 3400 - DNA, 735 bp, B.fragilis
  unsure (679): Identity of nucleotide sequences at the above locations are unknown.
agcattaatcgaaagacactcatgaagaaaaaaaatacatttacatatctgctcatcggactgggcctctgcttctcttccttgggaagcgggctccgggccgatacccccgagaactataccaacaaccgctatccattggtacgcaaacctttgatggaactaccgttaggcagcattaaggcaaaaggatggttacaggaaatgttggtaaggcagaaaaacggggcaaccgggcaaatggacaaactgtatccgctggtgatgggcgaacgcaacggctggctcggcggcgacggtgatcaatgggaaagaggaccatactggattgacggtttacttcctctggcatatatcctggacgatgcgcaactgaaagctaaagtgcaaccttggatagaatgggctttaaaaagtcagcgggaagacggtttcttcggtccggccaaagactatcccggagaggccggcatacaacgggataactctcacgactggtggccgcgtatggtgatgctgaaaatactccagcaatattattctgccacgaacgatcaacgggtcatccggtttatgaccgactatttccgttatcaactgaaaacgttaccggaaaagccgctcggcaactggactttttgggcagagtttcctggccttgcaaaaatatccaggccgnatactggctctataatatcaccggtgattcattcctactcgatctcggcaaactga

SEQ ID NO: 3401 - DNA, 183 bp, B.fragilis
  unsure (168): Identity of nucleotide sequences at the above locations are unknown.
cctttgggcggaaaaaagttttttcattggaaatgggggtttaagtcctttttccccttccatttcaaggcagggaaaaaggaggacttgtgtatgaatattaggttattattaatatggttcggaatgattaatcacctctcaatcggaaggctcccactaccgganattccgtattcttaa

SEQ ID NO: 3402 - DNA, 1116 bp, B.fragilis
cagaaagctatgaaaacaaagatctacctgctatttattactaccttattcttctgcgccggttgtggcaacaagagcggcggacagaaacaggagtcggtaagtgcggcaaaggatacatatgtaaatcctttgtttccggaaggggccgatccgagtgctcttttccataatggtaagtattattatacccatggaacggaagataagatcatgctttgggaaacgtccgatatcactgatatggctcatgcggtttgcaagatagtgtggaagcctcacgatccatccaacagttgtcatctatgggcaccggagattcactatatcaatgataaatggtatatatattatgcagccgacggcgacaatgcggataatcaccagttgtacgtacttgaaaactcttcacccgacccgatggagggaaagttcgaaatgaaaggaagtatcataaccaatcccgaatggaattgggggatacaggccaccactttcgaacataagggagtccgctatctggcctggtccggatggcccaaaaggagaaccaatgccgaaactcaatgtatctatattgccaggatgaaagatccgtggacactcgattcaccccgtgtcctgatatccaaacccgagtatgaatgggaacggcagtgggtcaatccggatggcagccgtacggcttaccccatttatgtgaatgaagggcctcagttcttccattcgaaagataataagacgttgattctatattacgctgccagcggttcgtggtcaccctattactgtgtcgggatgttgactgccgatgccgagagtgatttgttagatccggcttcctggacaaagagttcggttccggtatttcagcaatcgttggagaatgaagtttatggtccgggtggactctcctttgttccctcgcccgatgggactgaatggtatatgatttaccatgcccgtcaggtgaccaatggagacaccgggagtcctgaaacccgtaatccgcgaatacaaaaaataggatgggatgcccatggaatgcccgatttggggattccggttcgtgcaggggttgccttgccgaaaccttcgggtactcttttgaaataa

SEQ ID NO: 3403 - DNA, 2223 bp, B.fragilis
tattatgaatcaatgaaattaaattcttttcctcactatctccagttggatgctatggattgcggtccttcctgccttcgcatgattgcgaagtattatggtaagagctactccctgcaaactctccgtgcacgctcttttattacccgtgaaggagtttccatgctgggcatcagcgatgcggcggaatcgatcggtttccgtacttcgggggtgcgcatctctttggagcaactgaagaaggatgtaccgttgccttgcattctgcattggaaccagaatcacttcgtggtctgttatgatataaagaagaaacgtagcggctaccgtttctatatcgccgaccccgcccgtcagttgatttcgtacagtgaggaggagtttaagaaatgctggttgtctactaaggtgaatggagaggagaaaggggctgcacttgcgcttgaaccgggtccggaattccaagggcagggcgacgaagaagaatccggcagtcgcagtcttcgtttctttcttaaatatttgtctccttatcgtaaacaactgattcaactgattctgggaatgctgacagcgagcttgttgcagcttattttcccttttctgacacagtcattggtggatgtgggtattcgcgacggtaacctgaactttatcactctgatcctgatttcacaactggtgatttccgtttcacaactttcggtcgagtttatccgtagctggattatgcttcacatgaatacgcgtatcaatatttcgctgatctctgacttcctggcgaagttgatgaagcttccgctccattatttcgatacgaagatgatcggtgacattatgcaacgtataggcgatcacggacgtatcgagagttttctgacgggatcgtccatcagtacgcttttctcttttgtgaacttctttatctttgcttttgtgctggcttattacaatctgggtattcttgctatctttctggtgggcaattcactctatatctgctggattcttgtgtttatgaagtaccggcgcgaattggatatccgccgttttgcccaggcggcgggcgaacagagtagtttgatacagttggtgactgccatgcaggagatcaaactgaacaactgtgaaaaacaaaaacgctggcagtgggaacgtattcaggtgaaacttttcaagatcagcgtaaaaggtctggcactgggacaggtgcaacaggtgggttctgtcttttttaatcagactacgaatattgtcatctcttttattgctgctaaatcggttgtggagggaaatatgacgttgggtatgatgatgtcactgacgtatattatcggtcagttaagcggtccgatcggttcttttatcggttttgcacagcagttgcaggatgcgaagatcagtctggagcgcctgaacgagattcatgggcagaaggatgaagagcaggatattgcctctaagctgacggttcttccggaacggcgtgatatacgtatcgagaatctctcgttcagttatgacggtgcggatcgtgactatgtgctgaatgatgtgaacctgaacatacccgaacacaaggtgacggcgattgtgggtgcgagcggtagcggcaagactacgctgatcaagctgatgcttggcttttatactccgaataagggggatatcaagataggtgagacccctctggatgtggtaaatccgcacctctggcgtgcgaagagcggttcggtgatgcaggatggctttatcttgtctgacacgattgcaaataatattgccgtgggggaggaacaggtggatgtggagcgctttcgccatgcggtgacagtggccaacattcgtgacttcatcgattctcttcctttggggtataatacgaagatcggcatggagggaaacggcatcagccagggacagcgtcaacgcctgctgatagcccgcgctgtttataaaaatcctgagttcctgtttttcgatgaggcgacgaatgcattggatgccaacaatgaacgcgagattatggagcatctgcacacgttctatcgtggtaagacggttgtggtagtggcgcaccgtttgagtacggttcgtgatgcggataagatcgtggtgctggataggggtgctgtagccgaagagggaacccaccgggaactgacggaaaagaaaggattgtattatcagttggtgaagaatcagttggaattaggaagttag

SEQ ID NO: 3404 - DNA, 612 bp, B.fragilis
aaaaagaataagatggatgcacatatagaacaaatagcaaaatcgctttacttctcttgcaaacaatttgatatagggctattttatggaaagatgggacgttgccttttcttttttgattattcacgtgtcactgaattgagggcgtttgaggaactggccggagaattgctggatgaagtgatggagagtgtctgcttagggatgccggtcggtctgtctttcggatggtgtggtataggttggggggtggaatatctggtccggaagggatttgtggaagatgatgataatgaagggcgcaataagattgatgagaaagtgatggagtatgatgtcaggcgcttgggcgattactctttagctacagggttggaaggaatttcatggtatgtattgcttagactctattcgggagataaaggtgtaaggataggggaaaaaaactatctgtctgatttgaaaagtgcttgtgagaaagctttaaaaaaagggcggtatgaggggatacttctgttactggattttctgaatgggaaaagggcaaattatcctttcggggagtttttttcacaaattccgggagaagcgcattatattccggatatgtga

SEQ ID NO: 3405 - DNA, 672 bp, B.fragilis
tatgtcatgaaagatattacaatgctaaacaaaccaccattagacttcttcggatgcaacttttgtcttgtagagaagcatcgtatggcttttgtccttatttcgaaatgtggacttacttttttggaaaacatagctatttatgcgtcagcaggtatgattcctgataccgaagatcagactcatttttatatcgcccgggtaaaaccagaacgttttttggtaccggtttctgagatgtctggttatgaaagggagcataaatcgtatttgaaggtagcggtttggagggatccggtagaaaggctggtttctgcttataaatattttatacttgaacgtaccttcaatcaatacatgtacatgtgtaatctgtatcaggattgttcttttgaacgctttctttcgttcgttgagtttgaattggggaaggcaaatccgttgtggcaggatgaacatatacgcaggcaatctgatttttatacttctgctgatgtggactgtattgtacctctcagcaagttgaaccgttttttagccgagaggggagtggatatgccggaagaaaaggcaaatgccacatctgtccggtttgaactgaaggatgaaaaacagatagcaaagataaaagaactatatcgtcttgattatgaaatacctgttggttgttaa

SEQ ID NO: 3406 - DNA, 720 bp, B.fragilis
ccgctggtgaagacattggctggcagagaatgctttgcaggtgttatgtgctattgcacgaagacccgtactgatattgtttcgggaaacacactggcggtgcatgccgatggacaggtgcaaagttgggaaagaaggggcagagagttgtttgcgacaggcaccgtagtgtccggtagtacatatttttcaagagtgatggattgcaggtgttatgtccccatggtatacaattatttatataggagggattttattgaacagaatggatttcgctttgaaccggggttggttcatgaagatgaattatggactcctcaggtgctgacaaccgctcaaaaaataacggttgccgatattgatttttattattaccggcaacgggaaggatcgattatgacggcgacggcagcgggcaggcggattgcttccattcaattgattattgagaagttactggaatatagccgtaagcacttgtttgagaaaaaatatagagaggcaaaggaagcactctatgtaaggctgttgcagatatattctactgcctgtacattgcatccggacggaacttatacaactttgtacgatagggcgggagagatgcttcgtgtttgtgaggaactcaggcggcaagagtctcttgggagatggtatagtgaggaaatcctcaacaggatgaaactgtattatgaccggctccaaacgatggaaggatga

SEQ ID NO: 3407 - DNA, 627 bp, B.fragilis
gggtgctgtagccgaagagggaacccaccgggaactgacggaaaagaaaggattgtattatcagttggtgaagaatcagttggaattaggaagttagatatggaaaaggagcacacacataaagagatcgagcttcgtagcgaagaggtgcaggaagtgatgaatcgtgttccggcatggattcttcgcagtggcattacggtgctgtttgtcatagtggtggcattggttgccggaagctattggtttaaatatccggatgtgattgctgcggaggtgacggtaagcacacaagatcctccggcttacgtagtggcccgagcagccggaagactggagaatctgtatgtacaaaacgggcaggaggtggaacccgacacgaatctggggacaatagagaatacagcttgtgcgtcggatgtattctccttgcaagagcggatgcggaagtggaaacaggaaggatatacgcctgagtcgggtaaagggctttttctacattcggaaacagatcgctggcggctgggagagatacagtcggcctatgcggcgtttgtgagtactctctccgaaatggtgcgtatgaatgaattggggtattatgcaaagaagttacagtcgtcttaa

SEQ ID NO: 3408 - DNA, 768 bp, B.fragilis
agaccccagttggagagttttgagagtatcaccggaaaaggtatcaaggtggtatatcagggtgacacttattgggtgggcagccacaaattgctgaaagatttcagtgcttctctttctgacgtacttgccgagatgatggtgcaatacgaatcggacgggaacagtatcgtttactttggccgtggaacagaggtacttgccgttgtcgccattgccgaccagataaagccgacttctgccgaggcggtgaaggaactgaaacgtcagggcatcgacatttgcatgctgaccggtgacggacaacggacggcacttgccgtatcgggcaaattgggcatcgaccgctttgtggcagatgccttgccggatgataaagaagagtttgtgcgtgagctccagatgcagggcaaaacggttgctatggtgggtgacggaatcaatgactcacaggcgttggctttggctgatgtcagcatagcgatggggaaaggcaccgatatagccatggatgtggcgatggttacgttgatgacatcggatctgctgttgctgccccgtgcattcgaactctccaagcaaacagtaaaactgattcaccagaatctgttttgggcgtttatctataatctgataggcattcccattgcagccggaatcttgttccctgtcaacgggttgctgctcaatccgatgcttgccagtgcagcgatggcattttcaagtgtaagtgtcgtgctgaattcactgagtctggccagaaaataa

SEQ ID NO: 3409 - DNA, 204 bp, B.fragilis
  unsure (1),(2),(3),(4),(5),(6),(7),(8),(9),(10),(11),(12),(13),(14),(15),(16),(17),(18),(19),(20),(21),(22),(23),(24),(25),(26),(27),(28),(29),(30),(31),(32),(33),(34),(35),(36),(37),(38),(39),(40),(41),(42),(43),(44),(45),(46),(47),(48),(49),(50),(51),(52),(53),(54),(55),(56),(57),(58),(59),(60),(61),(62),(63),(64),(65),(66),(67),(68),(69),(70),(71),(72),(73),(74),(75),(76),(77),(78),(79),(80),(81),(82),(83),(84),(85),(86),(87),(88),(89),(90),(91),(92),(93),(94),(95),(96),(97),(98),(99),(100),(101),(102),(103),(104),(105),(106),(107),(109),(110),(111),(112),(113),(114),(115),(116),(117),(118),(119),(120),(121),(122),(123),(124),(125),(126),(127),(128),(129),(130),(131),(132),(133),(134),(135),(136),(137),(138),(139),(140),(141),(142),(143),(144),(145),(146),(147),(148),(149),(150),(151),(152),(158),(159): Identity of nucleotide sequences at the above locations are unknown.
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnncccccnnggacctctgtgttactctgtgccctctgtggtgagttcgttttga

SEQ ID NO: 3410 - DNA, 192 bp, B.fragilis
  unsure (1),(2),(3),(4),(5),(6),(7),(8),(9),(10),(11),(12),(13),(14),(15),(16),(17),(18),(19),(20),(21),(22),(23),(24),(25),(26),(27),(28),(29),(30),(31),(32),(33),(34),(35),(36),(37),(38),(39),(40),(41),(42),(43),(44),(45),(46),(47),(48),(49),(50),(51),(52),(53),(54),(55),(56),(57),(58),(59),(60),(61),(62),(63),(64),(65),(66),(67),(68),(69),(70),(71),(72),(73),(74),(75),(76),(77),(78),(79),(80),(81),(82),(83),(84),(85),(86),(87),(88),(89),(90),(91),(92),(93),(94),(95),(96),(97),(98),(99),(100),(101),(102),(103),(104),(105),(106),(108),(109),(110),(111),(112),(113),(114),(115),(116),(117),(118),(119),(120),(121),(122),(123),(124),(125),(126),(127),(128),(129),(130),(131),(132),(133),(134),(135),(136),(137),(138),(139),(140),(141),(142),(143),(144),(145),(146),(147),(148),(149),(150),(151),(157),(158): Identity of nucleotide sequences at the above locations are unknown.
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnncccccnnggacctctgtgttactctgtgccctctgtggtga

SEQ ID NO: 3411 - DNA, 186 bp, B.fragilis
  unsure (1),(2),(3),(4),(5),(6),(7),(8),(9),(10),(11),(12),(13),(14),(15),(16),(17),(18),(19),(20),(21),(22),(23),(24),(25),(26),(27),(28),(29),(30),(31),(32),(33),(34),(35),(36),(37),(38),(39),(40),(41),(42),(48),(49): Identity of nucleotide sequences at the above locations are unknown.
nnnnnnnnnnnnnnnnnnnnnnnnnnnnnnnnnnnnnnnnnncccccnnggacctctgtgttactctgtgccctctgtggtgagttcgttttgaaaggaattgttattttctggccagactcagtgaattcagcacgacacttacacttgaaaatgccatcgctgcactggcaagcatcggattga

SEQ ID NO: 3412 - DNA, 2304 bp, B.fragilis
cttgtgtcaccctgtgcagtctgcggtgaatcctatctgtttcttattgaatataaaccgaataaaaaagacaaacgaagaaatttaatgaaatacatgttattgaccggactgcttctcggcagtctgaccgtacaggcgcaagtgagcggtacggtgaaagatcaggcaggcgaaccgattataggcgccaacgttttctggaaaaacatttccggtggggtagccactcgtgaggacggtactttttccatatctaaacccgacaaatccaatcatctgatcgtaagttttataggttacgaaaacgacaccatacaagtgaacgataagaaagccgttctggacgtggtgctgcgcgaaggaatggaactgagtgaagtgcagattgtcagccgtaagttgagtacgctgaagttgcgcagcagtgtgatgaacgaagagatcattaccagcgacgagctctgccgtgcggcatgttgcaatctcggtgaaagttttgttaccaatccgtcggtagacgtcagctattcggatgctgcaacgggagcgaaacagatcaagttgctcgggctttccggaacctatgtgcagatgctgaccgagaatatcccgaactatcgtggtgctgcttctccttatgggttgggttatgtgcccggtccttggatgcatagcatacaggtttcaaagggaatctcgtcagtaaaaaacggttacgaggcccttacggggcagatcaatgttgagtttaagaagccacagttgcctgaggccgattgggtttcggccaacctttttgccagtactaccaatcgttatgaagcgaatgcagacgccaccgtgaaactgtccaagcggtggagtacttcattgctggcgcattacgagaatgaaacaaaggcacacgacggcaatgatgacggctttgccgatattccccggatagagcagtataacttctggaatcgctgggcatatatgggggatcattatgtgtttcaggcaggcatcaaggcattggacgaaagcagaaaaggcggtcaggtgagtcatagcggcgtgccggcagccgatcggtatgaaatagacatcgacacccggcgctacgaggcctttaccaagaatgcctatatatttaataaggagaagaataccaatcttgcactgattctgtccggtacgttgcacaatcaagatgcactttatggacggaagatctataacgtcgaccaatccaacgcctatgcttcacttatgttcgaaaccgaatttacgaaagagcacaatctatctgcaggcttcagctataattatgacggatacgaccagcattaccgactgaccaataacgctgaaacaccgttgacgaaagcttttgcacgtgaatcggtgggcggggcctacgcacagtataccttcaacctggataataagttcgtgttgatggccggacttcgtggcgaccatagcagtgagtacggattctttgtgactccgcgtgcgcacattaagtacaaccccaatgactttgttcatttccgtctttccgccggaaaggggtatcgcaccaaccatgtgcttgctgagaataattatctgatggcaagcagccgcaaggtgagcatcgccgatcatctcgatcaggaagaggcttggaattatggagcaagcatatcgggatatatcccgcttttcgggaagacgctgaacctgaacctggaatactattacaccgacttcctgaaacaggtcgttgtcgatatggatacgaatccgcacgaggtggccttttacaatctcgacggacgctcgtactcacaggtatttcaggtggaggccacttatcccttctttcagggattctcgctgactgccgcatatcgctggacagacgccaagactacctataatcatcaattgatggagaagcccctgacgggaaaatataaaggcctcgtcactgcctcttatcagactccgctgggtttgtggcagtttgatgccacatggcagatgaacgggggaggacgtatgcccaatccgtacacacttgccgacggaacctcttcgtgggatgcacgctacaaaggcttcagccaactcagcgcccaagtgacacgctacttccgccgctggtcgatatacatcgggggcgaaaacctgactaattttaaacagaagaatccgattatcgatgctgccgatccttggggcgaccgttttgactcgaccatgatatgggggccggttcatggagcgaaaggttatatcggagtcaggttcaatctggcgagagattaa

SEQ ID NO: 3413 - DNA, 573 bp, B.fragilis
ataatgaagacaaatgaagttttagagaccattaaggcacggcgtagtgtacgtgcgtatgatcgaaagcagattccggcggatgacttgaacgccatcctggaagcgggtgcttacgcgccgagcggcatgcattatgaaacgtggcattttactgccgtctgtaatacagtgaaactggaagaactgaatgaacggatcaaaggggcatttgccaaaagtgatgacaagcatcttcgggaacgggggcacagtgagacgtattgctgttactatcatgccccaaccttggtcatcgtgtccaatgaacccaagcaatggtgggccgggatggattgtgcctgtgctatcgagaatatgtttctggcagccacttcactgggcatcgcttcctgttggatcaatcagctcggtacgacctgtgatgatccggaggtacgggcctatctgacttctctcggagtgcccgaaaatcataaagtttatggttgcgtagctttgggatataaagcggaaggcgcattgttgaaagaaaagacagttaaagccggtacgataaccatcgtggaatag

SEQ ID NO: 3414 - DNA, 720 bp, B.fragilis
atagaatttgcaaagatgatcagaagtaaaatgaaaagcacttggatgttgggactgctgctcctcctgggaagctgtcagcagaaagggccggcaagtggccgggcggagatgaaaggagagtcggatagtttgagtgtccggcatgggcaagagaatgcattgtcggtttcggatgaatatccggaagggtatgttcctgttccgggcattcggtatcaggcgaactatcttaccggaaatccggagcgtcttgacgtgaaggctgcattgcggaatgtccgtccgctgaagttgagtcaattgggcagtcagcttgatttcatggtatttaaagatgtgaaaggaggcatcttccgcctgataccgattgaagagggctgtttgggagtggggattggtggcatctggctgctggatgggaacctgaaaatgattcggatgttgtttcgcaatgatgtggatattacggaagaaaatggatttaccaactttcagacgaagcgttacatcaatccggattattatgaaaagtcttcccggacgttgatcggcgtgctgtatgatcagagggataaaaagaatcccaaatcctttgtcaggctttctctgaaagatttgttaagcgcatcccggcctctgacaccggacgatatccataaacgtgcagggtcttcaccacggggctggaagaatgccgcatcgagtcagttaaaaccc

SEQ ID NO: 3415 - DNA, 918 bp, B.fragilis
tatgaactatatttgtcgatagtgaacgattatataaatgttgaatttaaagaagaaccccttatgaaaaaacaatatgtcagcctgcttgcgataatacttgctacaagtggctttttattttcttgcggtgacaagatgaacaagaataccggtgcactggaattcgacagtatacaggtaaacgaaacagcacatctcttcggagataccgcaaaaccggcatgtaatctgaccatcaatttcgcctatccggtgaagtcgacggacaataaactgaaagacagcctgaacagctactttatcgccgcctgcttcggtgaaggatatatcggagagaaaccggcgcaggtggtaaaggagtacaccgaacattacgtaaaagaatatcgcacagacctcgaaccgatgtatgccgaagacgaaaagaacaaagagagtgaaggctccatcggtgcatggtactcatactataaagggatagaaagccacgtgcaactttattataagaatctgttggtctaccgcattaactacaacgaatataccggaggcgcacacggcatttacatgacaactttcctgaatatggacctgataaacctgcgtccgctgaagctggatgatattttcactggtgattataaggaagcactgaccgacttgctgtggaatcagttgatggcggacaagaaagtgacaacgcacgaagcactcgaggatatgggttacggctctaccggagatattgccccaacggaaaacttctatctggacaaagacggcatcaccttttattataatgtatatgatatcaccccgtatgccatgggaccggtagaaattaagattccatacgaaatgatggaacacatgctgggcagcaacccgatcatcggagagatgaaatcaaaataa

SEQ ID NO: 3416 - DNA, 2016 bp, B.fragilis
actatacataaactacaaaaaacaattatgaaacaagaagaagacaagtttacgggcttacccgagaacgcattccgggaactgaaaccgggagaagtgtacaacccgctgatgagtccaaagaaaacgtatccggaggtaaacctctggtctgtagcatggggtatcgccatggccatccttttctcggctgccgcagcctatctgggactaaaagtaggacaagtattcgaagctgccatccccatcgccatcatagcagtcggagtatccggcgcagccaaacgcaaaaacgcactcggcgaaaacgtcattatccaatccatcggcgcctgctcaggcgtcatcgtggcaggagccatcttcacactgcctgccctctatatcctgcaagccaaatatccggatatgtcggtcacctttatgcaagtgttcatcagttcactgctgggcggtgtactgggcatcttgttcctgattcctttccgcaaatactttgtaagcgacatgcatggcaagtatccttttcccgaagcgacagccaccacacaggtgctggtgtcgggtgaaaaaggaggcagccaggccaagccattgctgatggcaggattgatcggcggtctgtacgatttcatcgtggctaccttcggctggtggaacgaaaacttcaccacccgcgtatgcggagtaggcgaaatgctggccgacaaagccaaactggttttcaaggtaaacaccggcgcagccgtactcggcctgggatatatcgtcggactgaaatatgcttccattatctgcttcggctccctggccgtatggtggatcatcgtaccgggcatgtcactcttcttcggtgattcggtactgaatcagtggaatccggacataaccgccacggtaggctctatgagtcccgaacagatattcagccactatgccaaaagcatcggtatcggcggcattgccatggcaggtgtcatcggcatcatcaaatcatggagcatcatccgcagtgcggtgggactggcggctaaggaaatgggcggaaagagtgatgccgaaaagaacattatccgcacccaacgcgacctctcaatgaaaatcattgccatcggttccattatcacgctgattctggtagtgcttttcttctatttcgatgtgatgcaaggcaacctggtgcatacactggtagctatcctgctggtggccggaatttcattcctgttcacaacggtagccgccaatgcaatcgctatcgtgggcactaatcccgtatcgggcatgactctgatgacattgattctggcatcggtcgttatggtggctgtcgggttgaaaggcccttcaggcatggtggcttcattggtaatgggtggtgtggtctgtaccgcactttccatggcaggaggttttatcacagacttgaaaatcggatactggcttggcagcacaccggccaagcaggaagcatggaagttcctcggaaccatcgtttcggctgctaccgtaggcggtgtaatgattatcctgaacaaaacttacggattcacaagcggtcagctggctgccccgcaggctaacgcaatggctgccgtcatcgagccgttaatgagtggtgtgggcgctccgtggatgctctatggcatcggtgccgtactggccatcgtattgacgctcctgaaagttcccgcactggcatttgcactcggtatgtttattcctctcgaactgaatataccgctggtggtgggcggtgcgatcaactggtatgtgactacccgcagtaaagacgcttcactcaacacggaacggggagagaaaggtacattactggcatccggattcatcgccggaggtgccctgatgggtgtagtcagtgcggcaatgcgcttcggaggcatcaatctggtaaatgacgcgtggctgaacaacactctgtctcaacttgcggccctgatagcttataccctgttgattctctatttcatcaaagcatccatgaaagtaaaatga

SEQ ID NO: 3417 - DNA, 2862 bp, B.fragilis
atcattaataacatgaaaaccgatttattagcctgccgccacatcggcgtcaacaaagcggatgccgaagtaatgctccggaaaattggagttgcttcgctcgacgaactgatcgataaaaccattccggccaacatccggctcaaagcacctctggcactacccgcaccgatgaccgaatacgagtttgcccgccacatcgctgaactggcaggcaaaaacaaactgttcaccacttatatcggtatgggatggtacaacacgatcacccctgcagtcatccagcgaaatgtattcgagaatccggtctggtatacttcttatactccttaccagacagaagtttcgcaaggaagactggaagccctgatgaacttccaaactgccgtatgtgacctgaccgccatgcccttggccaactgttcactgctggacgaagccaccgctgccgccgaagctgtgacgatgatgtatggcttgcgttcacgcaaccagcagaaggcgggagccaacgtggtgtttatcgacgaaaatatcttcccgcagaccttggcggtcatcaccacccgtgccatcccgcaaggcattgaaatccgtaccggaaagttccgggatcttgaatttacagatgacttctttgcctgcgtcctgcaatatcccaatgcaaacggtaatgcggaagactaccgcgaatttaccgaaaaagcacatacagccaactgcaaggtagctgtggctgccgatatcctgagtcttgcactacttacccctccgggcgaatggggagcggacattgtattcggtaccacacaacgcttgggtactcccatgttctacggtggtccttcggccggttatttcgctacccgtgacgaatacaaacgcaacatgccgggacgtatcatcggatggtcgaaagataaatatggcaaactctgttaccgcatggcactccagacacgcgaacagcatatcaaacgggaaaaagcgacttccaatatctgtaccgctcaggcactgctcgcaaccatggcaggattctataccgtctatcacggacaggaaggtatccgtaacatcgcttcacgcatccatagcattaccgttttcttggaaaagagtatcggtaaactgggattcaagcaagtgaacaaacagtatttcgatactctccggttcattttgcccgacagcgtatcggcacagcagattcgcaccatcgctctgagcaaagaggtcaacctgcgctattttgataatggagacgtgggactgagtattgacgaaacaaccgacgtagcagctgccaacattctactgtctatctttgccatcgctgccggaaaagacttccagaaagtggatgacatccccgaagcaactatcatcagcgaggaattgaaacgccagaccccttacctcacacacgaagtattctctaaatatcataccgaaacggaaatgatgcgctacatcaagcgtctcgaccggaaggatatttcattggcacaatcgatgatttcactcggttcctgcaccatgaaactgaatgcggcagccgaaatgttacctctgagctgtgctgagtttatgtgcatgcacccgcttgttccggaggatcaggcggccggataccgcgaactgattcacaacctgagtgaagagctgaaagtcatcaccggatttgccggagtaagcctgcaacccaattccggtgctgccggtgagtatgccggtctgcgcaccatccgtgcctatcttgaaagcatcggacaaggacaccgcaacaaagtattgatccccgcatctgcacacggcaccaatcccgcatcagccatccaggccggattcaccactgtaacttgtgcatgtgacgaacatggaaacgtagatatggatgacctccgtgccaaagctgaagaaaataaggatgacctggccgcactgatgatcacctatccctcgacacacggtatctttgaaacagaaatcgtagagatctgccaaatcattcacgcctgtggagctcaggtatatatggatggagccaacatgaatgcacaggtaggactgacgaatccgggatttatcggagcggacgtctgtcacctgaatctgcataaaacctttgcatctccccacggaggaggcggccccggcgtaggcccgatctgtgtagcggaacatctggtaccgttccttccgggacacggactgtttggcaactcacagaacgaagtatccgccgcaccgtttggcagtgccggtattctgcctatcacctacggctatatccgtatgatgggtgccgaaggactgacaatggcaaccaagacagccattctcaatgcaaactatctggctgcttgcctgaaagatacgtatggcattgtataccggggagccaacggctttgtgggacacgagatgattctggaatgtcgcaaggtatacgaagaaaccggtatcagcgaaaatgatattgccaaacgcctgatggactacggctatcatgctcctaccctctccttccccgtgcacggcacactgatgatcgagcccactgagagcgaaagcctctccgaactggataacttcgtccttacgatgttgaccatctggaacgaaattcaggaagtgaaaaacggtgaagccgataaggaagacaatgtactgataaatgctccgcaccctgaatatgaagtagtaagcgatcagtgggaacactgctatacgcgtgaaaaagccgcatatccgatagagagtgtgcgtgagaataagttctgggtaaatgtagcccgtgtagataatacgctgggcgatcgcaaactgctgcccacatgctacggctgcttcgactga

SEQ ID NO: 3418 - DNA, 2214 bp, B.fragilis
attatgagtaatataacaaagaaagcgtttcctgtactgaatatgcactgtgcagggtgcgctaataatgtggaaaaaacagtgaagaaactggccggtgtggtagacgcatcggtcaacttcgccacaaacacactgtccgtttcgtacgaggccgacaagctgacccccggagagatccgtgcggctgtacttgccgcaggttatgacctgatagtggaagaggccctgaaagaggaacgtcaggaggaggcacaggagaaacactaccggctgctgaagcggcaggttatcggtgcatggatcttcgttgttcccatgttgctgttttctatggttctgatgcatgtacctttctctaacgagatccagttgatactggccctccctgtaatgatcttttttggtggatctttctacgtcaacgcctggcggcaggcacgtctggggaggagtaacatggatacgctggtggcactgagtacctccatcgcattcctgttcagtgtcttcaatacatttttccctgagttctggtatagccgtggacttgagccgcacgtctattacgaagccgcagtagtcatcattgcctttgtactgaccggaaagttaatggaagagcgtgctaagggaaacacctctaccgccattcgtaaattgatgggacttcagccccgtgtggcccgagtgcttcgcgaagggatcgaagaagacatcctgatagaccagttgcaaaccggcgatctggtggtcgtacgtccgggcgaacagattcccgtggatggacgtctgtctgaaggagagtcttatgtagacgaaagcatgattagcggagagcctattcctgtagagaagaaggtcggtgaccgggtactggcgggaaccatcaaccagaagggagcttttgtaatcaaggcgtccggtgtgggaagtgagacggtgctggcgcgcatcatccgcatggttcaggaagcgcagggaagtaaagctcccgtacagcgtatcgtagaccgggtgacgggtatcttcgttccggtggtgctgtgcattgccgtgctgacatttgtcatctggctgttggtgggaggaaccgattatttctcacatgccttgctttcggctgtatccgtactggtcattgcctgtccgtgtgctttgggacttgctactcctaccgctctgatggtgggcatcggcaaagcagccagcaaccatattctgataaaggatgctgttgccctcgagcagatgcgtaaagtcgatgtagtggtgctcgacaaaaccgggacattaaccgagggacatcccactgtctccggatggctttgggcccaagtacaggaagagcatttcaagaatgttctgctggcagctgagcttaaatccgaacatccgcttgccggagccattgtctcttctctgcaagaggtggagaagatagttcctgcccagttggagagttttgagagtatcaccggaaaaggtatcaaggtggtatatcagggtgacacttattgggtgggcagccacaaattgctgaaagatttcagtgcttctctttctgacgtacttgccgagatgatggtgcaatacgaatcggacgggaacagtatcgtttactttggccgtggaacagaggtacttgccgttgtcgccattgccgaccagataaagccgacttctgccgaggcggtgaaggaactgaaacgtcagggcatcgacatttgcatgctgaccggtgacggacaacggacggcacttgccgtatcgggcaaattgggcatcgaccgctttgtggcagatgccttgccggatgataaagaagagtttgtgcgtgagctccagatgcagggcaaaacggttgctatggtgggtgacggaatcaatgactcacaggcgttggctttggctgatgtcagcatagcgatggggaaaggcaccgatatagccatggatgtggcgatggttacgttgatgacatcggatctgctgttgctgccccgtgcattcgaactctccaagcaaacagtaaaactgattcaccagaatctgttttgggcgtttatctataatctgataggcattcccattgcagccggaatcttgttccctgtcaacgggttgctgctcaatccgatgcttgccagtgcagcgatggcattttcaagtgtaagtgtcgtgctgaattcactgagtctggccagaaaataa

SEQ ID NO: 3419 - DNA, 645 bp, B.fragilis
ttcgtacgaaagcgtgcagtttttgtacgatatcgtacacagattacccaaactttttctctatctttgtcctgccaatcaacatactatactatgacactgaaacgaggcaaaatactgatagccgatgataatgaagacatccttttcacactgaaaatgctgttacgccccattgcagaatcaatcagcatcacgaccgatccgagagaactgctccccatcctgtcacgcacacactatgatgtcatcttgctggacatgaatttcaggaacgatgctgtcagcggacgggaaggattccactggttggaagagatcctgaaactggattcgggagcagtggtaatcttcatcacggcttatgccgataccgaaaaggctgtacggaccatcaagctcggcgctaccgacttcatcgccaagccctggcaaaacgataagatgattgcaacccgtatctgcggcattgcaactcagcttcagccgtacggaagtagaatcactgaaggagcagaaagaagctctgaccgaccactcgccggaaccggcccgaatcatcggcgaatcggccgccatgcaggctattttccagaccatccggaaatttgccgatacggacgccaatctgttgcttttaggtga

SEQ ID NO: 3420 - DNA, 399 bp, B.fragilis
aaaatgaagaaaatactattttttatcactatgatggtgctgagcatcggacttgcccaagctcaaggaaaagcagaaataaagtttgataagacaacccacgacttcggaacgttctcggaaaacaatcctgttgtgagttgcactttcaagttcacaaatatcggcgatgccccgttagtcattcatcaggctgtagcatcctgcggatgtaccgtacccgaatatacccaggaacctatcatgccgggaaaaacaggtacaatcaaggtgacttacaacggaacggataaatatccgggacacttcaaaaagtccataaccctgcgtacaaacgccaagacggagatgatacgtcttttcgtggaaggcgacatgacagccaaagacgcgaaataa

SEQ ID NO: 3421 - DNA, 957 bp, B.fragilis
cgcgtggctgaacaacactctgtctcaacttgcggccctgatagcttataccctgttgattctctatttcatcaaagcatccatgaaagtaaaatgaaaacattaatcacatccattcttctgttcatggctaccggcttgtcagcacaaaagcccgttgagctgcctttatggcccaacggcgctcccaatgataacgggctgaaaggcgaagaagtgatgtcggctccataccggctcactaacgtcacacagcccaccatcaccgtctatcgtccggcgacacctaacggcatgaccatcatcatgtgtcccggcggtgcttacgctctcttggccatggatcatgaaggacacgacatggcaccatggttcaattcattgggcatcacctatgtggtactaaaataccggatgcctaacggacactgcgaggtgcctttgtcggatgctgaacaagcgatacgaatagtgcggaaacatgccaaagactggaatattcgtacagaccgggtgggcattatgggagcttcggccggcggtcatctcgcctctacccttgctacgcattacagcagtgaggacacacgacccgactttcagatattgctctatccggtaatcacgatggaatccggcgacacccacggaggatcacgccacaatctgctcgggccggacgcaacgccggaattaaccagaaagttctccaacgaacagcaagtgacggatcacactccgcaggctttcatcaccctctcttcggacgacgaaggagtgcctcccgccaatggcgtgaattactatctggcgttgcaaaagcataaggtgcctgccaccctccacatttatcccacgggcggacacggatgggggttctatgacagttttgcctataaacgccaatggacggaagaattagagaaatggttgcgggacggagtcaggttccaatag

SEQ ID NO: 3422 - DNA, 438 bp, B.fragilis
ctcgaccatgatatgggggccggttcatggagcgaaaggttatatcggagtcaggttcaatctggcgagagattaagaataaaaagtgacagatcacagaatttatcaatactaatacttacatttatgaagactaaaaaaatgattgctaccctggtggtggctttgctctcggtgacggccgttatggcaaaagacttccgtactgtcgttttcaaagtggcacagatggaatgtgccaactgcgaacgaaaggtgaagaacaatatcaagttcgagaaagggcttaaaaactttacaaccgatcttaaggaacgaactgttaccattacctatgatgccgagaagacaaatgttgaaaaactgaaagaaggctttcggaaatttaaatacgaagctgtagtcataaaggaggcaaaggaaacggacaagaagtga

SEQ ID NO: 3423 - DNA, 321 bp, B.fragilis
gcatttacagaatatgcttacgtcttttcaaattatctctatatgttttcctactttacatctattgttagggtttcggaggttaaaagaaaaagattattctctggttgtactcccgaagcagacaagtccgaactaacagaaagagagccacatgctcttattacgcaccttttcattccgatagcttcacgacatcgccattatgacagcctgcaaagacatctgatatcaaaaacaaaatcgccaacccgcaaggaaggcgattttatccgttcagtgcatcattgggcggaaatagagcaatccagagaggtttga

SEQ ID NO: 3424 - DNA, 849 bp, B.fragilis
agaaatggttgcgggacggagtcaggttccaatagatacaacgaaggtattacaaaaacaatctttataaaaatgaaaacaattcgcacacttttattatgtaccagcctattggccggaacagttgcagcacaggagagcagcctggtgctgagtaacggactcgggtttgtcgacaccccctataaggcaggcaccctggaagtagatgacacagaagaccttattatcaattgtgacgaagtggattgtaccactttcgttgaatatgcactggcaatggccctctgcccgcagcaaggagacgaaatgcaggaaggcgatttcgcccgcaatttgcaacgcatccgctatcgtgacggaaaaatagacggatacacctcccgcctacactatatatccgactggatcaacaatgcagtccgccaaggcctgctcgaagatgtaacggctacctacagccccttcaaacaaaaactatcgctctcgtacatgagtacgcatccggaactctacaaatcgttgaaaaattctccggagaacgtagcccaaatggcaaagtatgaaaaagccttgagcggcaaagaggtacactatctgcccaaagacaaactggaaccggacggactgccttggatcaagaacggagacatcatcgccctgaccaccaatactccgggactggacgtaagccacatgggcattgccatttacatcaaggggcagttgcacctgctgcatgcttcatccaaagagggtaaagtagtagtgggcaaaaccgcactgagccaaatgttgaaagacagaaaatcactgaccggcatcagagtgctgagaatgaaaaaataa

SEQ ID NO: 3425 - DNA, 1404 bp, B.fragilis
cctcagaaatgctgggaatcacccggacatcgctatacaggcggatcgagaaacacggattataacctcaaacagttacacgacatgaaacaaaaatgggcgaggaaaccccttatattgacagcagcccttttgatctgctgttacaccaccgtgtggttaggcatgcacggtttctatatcagcctgccggtatccgtatgcctcttgctatacacagcctacagaatctatcgctacatcctccgctccacacgtgccatggcacagttcatctggtctgtccgctattccgagttcctctcctcccccgtgcaaagcgaagaaagcctccgttcactgccggcagagcttctgaacgaaatgaaccaagccttggatttctacaaacagaaccttcagaagaaagaaagcaaactacaatattttcaggctctggccaaccacatcgatatgtccgtattggtatataccccttccggacggatcgagtggatgaatgaagccgccaaaagactgctcgacaaccacaatctgaaaagtatcgatgaactgaaatactttcacagcgagctgcctgcccgcctttactccttaaaagcgggtgacatcgccgttctgcaggcgaaaaaagaggaagagaccatccaactggcactttccggaatggagtttgtgatacagggacgaccgctcacagtggccagcatgaaaaacatccattcggtattagacagccaggaaaccgaagcctggcagaaactgatccgtgtactgacacacgaaatcatgaattccatcactccggtcacgtctttgtccgaattgctggaacatcagatagaagactttgacggcaatgaagaagagcgggccgaaatacgccggatgttacaaaccatccgccggcggggcgacgggttaattcggtttgtcaacagttaccgggaagtgtctcacctgccacaacccctgctgaagatatatacatcacaagaattactgacaggtgtggtacggttgatgtacagagaaccgaatgacctgcacctgatacttccgcccaagggccaacgcctgatggcggacaaagatctgattgaacaagtgctgatcaacctgattaaaaacgcccgcgagaacgatgcgaccgacatccggatctcagccggattaagttccggagaacgcccctatataaggatagaagacaacgggacaggaattgagcaagaggtgctcgaccgcatctttatcccgttcttcacgactaaacccaccggatcgggcatcggcctgaccatctcacgacagatcatacatctgcaccgcggcaccatcaccgtttcatccgaaccggggaaaggcagtatcttcaccctcttgtttccgggcgtattctaa

SEQ ID NO: 3426 - DNA, 849 bp, B.fragilis
caaagatgccggctttcagcctgcatgattgtttgtagatatttaatatatcctcggttacatcattccatgccaaaatctcgcacggaagatctacttgtggaaagtcaaacttcatattactttctttttttgaatcacgcaaatatacacattttcttttatttttttatctttgtccttatgaaaacaattacaaccgattgggaacttattccatattctgaggcatggagccgccagacggaatggttcgatgcccttgtccatgcgaagcagaacggggagagttacgagaaccgtataattttttgtgaacatccgcacgtttacacgctggggcgtagcgggaaagaaaataatatgttgctgggagaggagcaactgaagactatcggtgccactctctatcatatcgatcgtgggggagacatcacttatcacggtcccgggcagttggtgtgctatccgattctcaatcttgaagagttcggattgggattgaaggagtatgtgcatttattggaagaagccgtcatccgtgtctgtgcgtcttacggcgttgtggcggggcggttggagaaggcgaccggtgtctggctggagggagatacgtcccgtgcccgcaagatatgtgcgataggggtcaggagcagccattatgtgacaatgcacggattggcattgaatgtcaataccgatttacgttatttcagctacatccatccttgtggtttcattgataagggtgtgacctcgcttcagcaagaacttggccgtagcatcgatatggcggaggtgaaagaacggttgggccgggagttgcttgctgaccttttgtcaaaatga

SEQ ID NO: 3427 - DNA, 666 bp, B.fragilis
cgatttaaacgatcaaacaacatagtcatgaaaattaagagatttgagttcaatatgtttcccgtaaactgctacgttttatgggacgaaacgaacgaggcagtcgtgatagatccgggctgcttttatgacgaagagaaacaagctttaaagaacttcatcgtcaccaacaatctgaacataaaacatctgctgaacactcacctgcatctggatcacattttcggaaatccattcatgcttcgcgagttcgggctgtctgccgaagccaatcaggccgacgagtactggatagacgaagcccccaaacagagtcgcatgttcggtttccaactgaatgaagcacccgtcccactgggaaaatatctccatgacggagacatcatcaccttcggaaacacaacactggaagcaatccatgtaccgggacactctcccggaagccttgtctattactgccgggctgacaactgtatgttttcgggcgatgtgctgtttcagggaagcatcggacgggccgacctggccggaggcaactttgatgaactgaaagaacatatctgcagccgcctgttcgtcctccccaacgaaacaatcgtatatccggggcacggagcaccgactaccatcggaatagagaaggcggaaaatccgttcttcaggtaa

SEQ ID NO: 3428 - DNA, 390 bp, B.fragilis
gttttgttcaggataatcattacaccgcctacggtagcagccgaaacgatggttccgaggaacttccatgcttcctgcttggccggtgtgctgccaagccagtatccgattttcaagtctgtgataaaacctcctgccatggaaagtgcggtacagaccacaccacccattaccaatgaagccaccatgcctgaagggcctttcaacccgacagccaccataacgaccgatgccagaatcaatgtcatcagagtcatgcccgatacgggattagtgcccacgatagcgattgcattggcggctaccgttgtgaacaggaatgaaattccggccaccagcaggatagctaccagtgtatgcaccaggttgccttgcatcacatcgaaatag

SEQ ID NO: 3429 - DNA, 891 bp, B.fragilis
aaaaataaaagaaaatgtgtatatttgcgtgattcaaaaaaagaaagtaatatgaagtttgactttccacaagtagatcttccgtgcgagattttggcatggaatgatgtaaccgaggatatattaaatatctacaaacaatcatgcaggctgaaagccggcatctttgctatttgtacggaaggcaagatgaccgcaaccattaatctgattgactacgagataaaaccgaacgacttgatcacactgttaccgggtaccattatccaattccgcgaacgcacggaaaaagtacgtttatgctttgcgggattctcatcggaatgcgtagaacgcatcaatctgataaaatcaatggtcagttccttctccaaaataaccgaatgtccgattgtagagttgcaggaggatatagccagctatctgatagattatttttctttgctggcacgcgtgacgtgtgacgaaaaattatctctcccctccgaaatgacagaggtgtctttaagatcgatcctgactgccgtcggactaatctatcagagatactcctcgaaaaaccacaatacgaaccgtaaggaagaaatctgccgtgaactggtaggactggtcacggaacattacaccgaggagcgtcgtgcccagttctatgcggacaagttgggaatatcgctgcaacacctcagtactacggtcaagcaggtgaccggacgtaacgtactggacgtcatagcctacgtggttatcatcgacgcgaaagccaaactcaaatcgagcaacatgactatccaggaaatcgcttattcactgaacttccccagtgcttcgttctttggaaaatatttcaggagatatgtaggcatgagtccgctggaattcagaaacagctga

SEQ ID NO: 3430 - DNA, 714 bp, B.fragilis
tctaactttattattaaaatacagatatattacaaccttatgaatacaacagaacaaacttcctccctcccctctgccggaggggaaaacggagtgaagcttcttcttaaatactttcccgacttgacggaagagcaacgcaaacaattcgctgcgctttacgaactttacattgactggaattctaaaatcaacgtaatctcacgcaaggatatcgagaatctgtacgaacaccatgtgcttcattcgctgggtatcgcccgtgtcatccgtttccgggccggcagcagtgtcatggacctcggtaccggaggaggattccccggaataccgttggccattctttttccggacacgaaattccatctggtggacagcatcggcaagaaagtacgtgtggcaaccgaggtagccaatgccatcggacttaaaaatgtcactttccgccatgcacgggccgaagaagagaaacaaacattcgacttcgttgtcagccgtgccgtgatgcccctggccgacctgataaagattatccggaaaaacatctcgcccaaacagcaaaatgctctccccaacggacttatctgcctgaaaggaggcgaactggaacacgaggcgatgccgtttaagcataagacaagtatgcataacctgaatgaagatttcgatgaggagttctttcaaaccaagaaagtggtatatgtaacgatttaa

SEQ ID NO: 3431 - DNA, 405 bp, B.fragilis
tataccaccttgataccttttccggtgatactctcaaaactctccaactgggcaggaactatcttctccacctcttgcagagaagagacaatggctccggcaagcggatgttcggatttaagctcagctgccagcagaacattcttgaaatgctcttcctgtacttgggcccaaagccatccggagacagtgggatgtccctcggttaatgtcccggttttgtcgagcaccactacatcgactttacgcatctgctcgagggcaacagcatcctttatcagaatatggttgctggctgctttgccgatgcccaccatcagagcggtaggagtagcaagtcccaaagcacacggacaggcaatgaccagtacggatacagccgaaagcaaggcatgtgagaaataa

SEQ ID NO: 3432 - DNA, 1017 bp, B.fragilis
ttgcaacccgtatctgcggcattgcaactcagcttcagccgtacggaagtagaatcactgaaggagcagaaagaagctctgaccgaccactcgccggaaccggcccgaatcatcggcgaatcggccgccatgcaggctattttccagaccatccggaaatttgccgatacggacgccaatctgttgcttttaggtgaaaacggtacaggaaaagatctgatagcgcgctatgtatacgaacagtcgccccggaaaggcaaaatatacgtcccgatcgatttgggaagcatccccgaaacactgtttgagagcgaactcttcggattcgaaaaaggtgcttttacagatgcgcggaaaaagaaacccggaaggctggaggtagcctcgggaggtactctgttcctaaatgaaattggcaacctgagcctgcctttacaggccaagctgctttcggtcatcgaacaacgcaaaagttcgcgactgggttccaccacttcttatccggtagacgtgagactgatatgcgcaacgaataccgacctgtatacagccatcgataacgggctgttccggcaagatcttctctaccgcatcaatacgatcgaaatacgtatccctcccttacacgaacggggcaacgaccttttcctgcttgccgatcactttttacaacgctatcggaaaaaatataaaaaagaagtccggggcatttcgaaagaagcgcgcagattgatgcaactctatcgttggccggggaatgtacgcgagctagaacataccatcgaacgggcggtcatcctctcaggcaatccaatgttgatgccgaacgacttcatgcttcgcacatcgcctcagggacaggtttcggagaaagagaaatacaaccttgaacgccaggagcgcgaaaccatcagcgaagtactccggctttgtgccggcaacattacgttagcctcagaaatgctgggaatcacccggacatcgctatacaggcggatcgagaaacacggattataa

SEQ ID NO: 3433 - DNA, 477 bp, B.fragilis
ttcatattagtgaatcgacagcataaaaaaagaaaaaagaatgtggcaggctggttaaatctgcttatctttgcaaccgttatgaagagattccgctatatacttgccgttattctttctctccttatagtatatgtaggagcgggagtctctgttgcccaatattgttgcagtggttgtgaaacggccaattgttgctgtgccgacaaatgcggcttctgtggtaagtttgactttgagttccataaatcatgccggggcgagggatgtacggcgaccatctataagcttgatctggtaaagcaggcattcgaatcctctgttcctgctcctgtcagcttgttgctttgtgaccaggtatcggacttgctatgcgctcttttccgcgatgaggtgttggatcctccttatgtgataccgccacccaagacaagttcccggcattatctggctctttattctactttgcttatttag

SEQ ID NO: 3434 - DNA, 1302 bp, B.fragilis
gaaaatatctccgtttcccccggaaagaaaaaacaaatgattgaaaaaatgaaggaacaagattgtgacaaaaaaaagagcatatctcagggaaagaaacacaatatcttttataagatgattatgagccgtagagccttcggaataacttattttgtatatggggcaacagtcctttctgtccttgccgaaagagcagagattctgtcctccaccccttccgtggggagccggatattcctcttactgagtatatgttttcctttcgcttatggtacatacctgctttgcaccaaagataaaaacagtataaaaatgaatgaaattataacttctgactactttaaaagagtcatttcccataagtggaatataatcatttgcctaatggtaatcgttgtgtgcctttctttcgtagtgatcttttcagatcgtaactgggaagcaccaataaacttcaacctgccgagtataatagtagggtcagttacaggctatttattgggagtattgattcgtcgagttttaaggagaaataataccggaaagaaaagctttaaattaatttttgaatgcgttggttcgctatgtcttaaagtatcggatcagttagaagaatcagtctttaccattgattgggactcttcaatcataccgccatccatcggagacgattttgagattgaagagtttattccagggttgaattggaatgaaaaacaacgtctttattctatttatggtcatgcaacagttattgaacgatcattttataaaaaagaacatgtgacctacatttctattgtgttaatggactctgacgaaatacaaacaatgaacgatcaggagagattattacggataaaagcccgaagaaaacctgcgacagcaacggggaaacgaaccggaggcagagcaggtgcggtcatgcctgataaaaaagaggatcttccaccggatgatcttaaggctgatctatatgccgaactaaataaagaagccagaaaggccgactacattccatattctcccgacaagctgataatcgggcaattcgggaaggtcatgcacggtaaagagaatctcattgaatatgtattgctatccgaccggttcctgaacaggcaggagagcttcgaaacctatttctacctgctaagcatcccgacaatttcctgcggttcctttcataaagagaccggagaaaggtcagagggttgcaaggttatagaaatggaggttatcgacgaagccagggcccgggaacggtacaggcgttttctggccgtatggaaagaatag

SEQ ID NO: 3435 - DNA, 801 bp, B.fragilis
agatgcagattccacacagattccataaacaacccaaactttttttattttgctgcaaaagaggttcatttcaaaattctcactcattcctttgcaactcatcagatgatgtgtatatttgcgaatcataaacatatcacaaatatgaaaaatgaagttgatggaaggcgggaaatagcctcacgaaacacggcctgggctaatatcattgcccgtaaacttactcattggggtgtcacacccaaccaaatttccatgatgagtgtattcttcgctatggtgggatgtctcctgctgattggcacagtcatttatcccggcttcaataaatatgtagcctatattctgtttatcgtttgtatgcagtcgcgattactctgcaatctgttcgacgggatggtagccattgaaggaggaaagaaaagtgccaatggagatctttataacgatatgcccgaccgctttgccgatgctctgttcatcattcccgtggggtatgtagctggtggattcggcattgaattgggatggctggctgctcttctcgctgttatgactgcctatttccgctggataggggcatacaagacacaccagcatttctttaacggcccgatggccaagcagcaccgtatggcattattgactcttaccttcgtggtcgccacttgcactatttattcaggatacgaccggatggtatgtttcatagctctaatcattatcaacatcggtcttatcgcaacactgatacaccgcttgtacctcatatcacacactacaaacactgaaataaaatga

SEQ ID NO: 3436 - DNA, 666 bp, B.fragilis
tcttttttatctacttttgcaggcatgaaaccgcttacagatactgattacatacacgcattgatagccgaaggggagcatcaacagcaagactttaaatttgaaatatccgatgcccgtaaaatcgccaaaacactgtcagcttttgccaataccgatggaggacggctgttgatcggcgttaaagacaatggaaaaatagccggtgtacgttcggatgaagaaaaatatatgatagaagcagctgcccaactttattgccggccggaagttgattattccatgcaaacatttcacgttgaaggacgttctgtattagtcgtacaaatagatgaaagtgaacacaagcccgtttttgcaaaagacgaaaacggtaaatcactggcatatattcggatcaaagatgaaaatatcctggctactccggtacatttgcgcgtctggcagcagagcggcagtccggcaggagaattgatccgctataccgaacgggaacaactgttgctggacttactggaagaaaatacttcgctttctcttaaccgctattgccggcaagcaggtatttcccgacgggctgcagagcatttactggctaaatttatccggtttgatattgtggaaccgatattcgagaaccataaattctacttcaggctaaaataa

SEQ ID NO: 3437 - DNA, 915 bp, B.fragilis
gaaagaatatccattatgacaggtgactacaaattccggtttatgccggggatattatccttgatattcacagcagtgctgttatccgggtgcatagccgagaataccgatgattgtttcaagggagtttcccttcaggtgaagctgcctgccgatgtctccggagaaacaatgaaggatataaacctctacgtgttcgatgataaagacctgttgttagacatcctgcctataagtcgctcggaatctgttgtattagattatccgggtattcccgtacttcattgtatcacttggtgtaataccggggatggtgctgtgtccgccagttcactgaaaaaaggcgatccgctctctgccggtttcatctctttgaaaccttctgctgctacaagagcacagatgagtctcttcaaccctcctgcggatttgttttacggagaacttattttagaaaatacttcgacgtctaatcatatggaagagcaggaactgtctgtctcccggatggttgcgtcaatgaatataacaatccgcggattggagcttttgggagaaagcaaccggggtgtttactcgttcgttgtgcatgaaaccgccagccgtctggattttgaaggccgttatggaggcgatcccgcttcctatgcattcactccctctttcgaggtgggaaaagattgtacgatgcctacctttaacctatttcctgttatggggagcggcggtataatcattgatatctaccatgacggtaagttattgagaagcgtaagtacggatagcggtaatcgccctcttgttcccgtagtgggtaaaaccctgaacgtgctgttgaacttcaaactcgatgtcgatgtgcaggtagagataaccggttggggagagaaatatatctggaaagagtataactga

SEQ ID NO: 3438 - DNA, 186 bp, B.fragilis
ctgtcgccatctcctgcacaacctgcgtgttatgagaacgtttattgtaatgtggacgatccggtccctcctgtctgccaggctgtcacactgatagaggacgtgatttccttcggcgtaaaggtaagggtgattaaatgtgattttccgacttcggtagtgaccgagatggtagattcgggataa

SEQ ID NO: 3439 - DNA, 909 bp, B.fragilis
gccatgacatcacaggaagccaattcaatccccttggaagatattctttcccgctacggttacgaaccttcccggcggtatggaggatatgacatgtaccgctcccctttccgctgcgacagctctccgagcttcaaggttttcaggaacgagaaccgctggtatgacttcggagacagcagccacggcagggtcgtggatctggtcatgcgcatccataactgctccttcccacaggctatgaaagagatcgaaggactgggcttttcctccggcatgattccgcaaccaaggccggtaccggtaacggtacagaaagcctccgggatgactctcctgaaaatcattccggtggaaaacgggcacctgcttgattatgccgcttcacggggcatcgacgcggatatcgtccgtgaacactgcgtggaggtgcattactgcttcgagaagaatccccgcgagaaatacgcgctggggttcgccaacgaccacggaggtttcgaactgcgtaacagcatgttcaagggatgtgccaccgccaaggacattaccggcctggccgcaggcaacaggtcctgtgccgtttttgaaggtttcttcgacctgttgagtttcaagcaatacgcgaaagagcatcccgagatgccggcactgggaaagctggacctgtgcgtcctgaactccacctccatcgttgagcggtcaaaggattttctttcaaggtatgaaaaggtacacgctttcctggataacgacgctccggggcgcgaggccctgagaaagatgcggcatttccttcccaaggacacggtattggtgaacgaggcggaacgcctgtatccgtcatgcaatgacttcaacgagtttttgcagaaaatcaagtgcccggcaagcgggcgggaaatgtga

SEQ ID NO: 3440 - DNA, 981 bp, B.fragilis
agtaaaacttttaaagtcatttttatggaacagttatcttttatagaatcattccggacttctcctttcattctcaccgaaggcgctatcgtagaacgtttgcgtcacgagtttcacatttcaccggacaaacacattgcacatgccgcactgatctacgatgactcccatcgtgagattctggcatccatctaccggcaatacctgcagatagccactgagttccgcctgccactgatgctgatgactcccacccgcagagcgaacatcgagcaaatagccgcgtccgattaccggcataaaaatgtactggcggatactatggcctttctctcccgcttccgtgacgaagcttccactcccgtatatatcggcggactggccggatgccgcggcaatgcgtacgacggccgctactatctgtcggtagaagaagccatggagtttcatttcccgacagtccgcacgctggtacagtcgggggcggactatctgtttgccggcatcatgccgcaactgacagaagccatcggaatggccaatgccatggctgcaacaggactgccttacatcatcagcttcatgatatgtcgtgacggacgcctgatagacggtactttcattcatgacgccatcgatgccatcgaaaaggaaacttccacccgtccactgtgctatatggccaactgcgtacatcccgatgtgttgcaccaggcgctgctgcatccccggaacgatacgcctttggtgcgtcagcgctttcagggtattcaggccaatgccgccaacctcagcccggaggaactggacggatgcgatcatctgatttcttcttcaccggaagaactggcagacagactgatgacactgctgtgggactttccgctaaaaatctgcggaggctgttgcggaaccaaccaacagcatatgcaccgtttcgcagagatgctggcttaccgccgtgacaataaagcgtggtaa

SEQ ID NO: 3441 - DNA, 228 bp, B.fragilis
acagtaactcccgagagttcttttttgtattcgggaataattgcctattcaatatgtgatatcgctatttcccgtgaattaaaagccgcctatctttgcaacatcagattgagacaactaaaagaagacccaaaacgttatgaaaaagaatttattaattttagtcgcactgctgacatcggcaacgatatcggcacagaacggaggaaccattatgaagaagtatga

SEQ ID NO: 3442 - DNA, 1542 bp, B.fragilis
attacaatgttagtaacaatagtagcatccattgcatgcttcatcgtaggaggaatcttatcgtacgtattgtttaaatacggactaaaggccaaatatgataatgtcctgaaagaagcagagacagaagcggaagtgattaagaaaaacaaactgctggaagtgaaagagaagtttctcaataagaaagcagatttggagaaagaggtagctctacgtaaccaaaagatccaacaggccgaaaataagttgaagcaacgtgaaatggtgcttagccagcgccaggaagagattcagcgtaaaagagccgaggctgatgcggtcagagaaaatctggaagctcaattgggtattgtagacaagaagaaagaagaactggacaaactccagcatcaggagattgagaagctggaagcactttccggtttgtcggccgacgaagccaaagaacgtctggtagagtcactgaaagaagaagcgaaaacccaggcacagtcttatatcaatgatatcatggatgatgccaagttgaccgcaagtaaagaggctaaacgcatcgtgatacagtctatacagcgtgtggctacagaaacagctattgaaaactcagtaactgtattccacattgaatcggacgaaatcaagggacgcatcatcggacgcgaaggccgcaatatccgtgctctcgaagctgctaccggtgttgaaatcgtagtagatgatacccccgaggctatcgttctttctgcgttcgaccctgttcgccgtgaaatagcccgtctggcattgcaccagttggttactgacggacgtatccacccggcacgcatcgaagaggtggttgccaaagtgcgtaagcaagtggaagaagagattatcgagacaggtaaacgcaccactatcgaccttggtatacacggattacatccggagttgattcgtatcatcggtaaaatgaaatatcgttcgtcttacggacagaacctgttgcaacatgctcgcgaaacggctaatctttgtgctgtgatggcatccgaactgggactgaatccgaaaaaggcaaaacgtgccggattgctgcacgatattggtaaggtgcccgatgaagaaccggaattgccacatgctttgttaggtatgaagcttgctgagaagtttaaggaaaaaccggatatttgcaacgctatcggtgctcaccatgatgaaatagaaatgaccagtctgcttgcacctatcgtacaggtgtgtgatgctatttcaggagcacgtccgggtgcacgccgtgaaattgttgaagcttatatcaagcgtctgaacgatctggaacaattggctatgtcttatccgggtgtgaccaagacttatgccattcaggcaggacgtgaacttcgcgtcattgtcggagcggataagatagacgataagcagacggagaatctgtcgggtgaaattgcgaagaagattcaggatgagatgacctacccgggacaggtgaagataaccgttatccgcgaaacacgtgcggtgagctttgcaaagtaa

SEQ ID NO: 3443 - DNA, 186 bp, B.fragilis
ggctatttcccgccttccatcaacttcatttttcatatttgtgatatgtttatgattcgcaaatatacacatcatctgatgagttgcaaaggaatgagtgagaattttgaaatgaacctcttttgcagcaaaataaaaaaagtttgggttgtttatggaatctgtgtggaatctgcatctctatag

SEQ ID NO: 3444 - DNA, 756 bp, B.fragilis
ttttatttaccggatgcaggctgctttcattttataagcgtatttttgcaggaatcaaaagagagagacatgcagcaaattaaagtgatcgcattcgatgcggacgatacattatgggataatcaggtgttttacgacaaggttgagagtgaattttgccatttacttgccgggtatggaacggcggaagaaatctcgtcccgcctattcgccatagagatggagaatatggatatctataaatacggggctaagccgttcacgctctccatggtggaggctgccgtgaagattagccggaaccgggtgcctgccgaagtgatcggacgcatcgtggagatgggaaaagaactgttggagatgcctatccgtctgctcggcggggtgacggaagcgcttgagacactgaaggatgattataaactggttgtagcgaccaaaggcgacctgctggatcaggaacgtaaactgcaacgttcgggaatctcccattattttgatcatacggagatcatgaccgacaaggcaccgcaggattatcagcggctgatctcttcactggacgttgctccacaatcttttttaatggtgggtaactcgctgaaatcggacgtgcttccggtattgtcattgggtgggcatgccattcatgtgccggccgaagctatgtggaaacacgaggtgatctccgggacggagcgagagtatttgatgattcattcgttggcggaattgccggcagtgctgagaggataa

SEQ ID NO: 3445 - DNA, 4338 bp, B.fragilis
ttaatctcgtttatcatgagtcaagagaatccttcttcacaattggatgtggaatttatttatttgcctgttatcaattattccatgcagcaaaaccggatacctgttgtccggttactttctattaaaaataatacagaacatccgcttgcggatttaaaggtatttctaactctggagcctgaatttgcatcagtttcaccggtaatggtagaaaaattagcttccggtgagattattacaataaccggattaaatctgatgctggacccttctttttttattcagcaaaccgaacgcctgtccggtactatcgttctggtagtttctgatgaggaaaacgtattttttcaagagaagtatcctgttgatatcctggcttttgatcaatggggaggcattcaggtattgcctgaacttttgtctgcatttgtggttcctaatcatccggtacttacaggagttctttcgcgggcgtcatctatcctgaaagagtggtccggtaattcttcattggatgcttatcagagttgtaatcccaatcgggtgaagttacagttggcagctctgtacgaggctattaaagagcagcatattgcatactgcacgcctccgtccagttttggtgatgccggtcagcgagtcaggctttcggataatgtactttccggtaaattagggacttgtttggatctgtcactgttgtatgcttcatgtgccgaagccatggggttgcatccgttgttggtgatcattcagggacatgcttttgtgggatgctggttgattgacgggacatttcctgatgcggtgaacgatgacccttcgttattgaccaaacgaacggcggacggtatcaacgaagttattttgctggaagccacttgtatgaccgatggaaacaatgtgactttcgataccgcagtcgggatggctaatgacaaaatgttggcagtgaatgactttacttgttttatagatgttgttcgcagccgttttgctcatattttgcctttacctcaacgggttatgcatgggaaagcatggactgtgggtccggaggtagctcagattcctaaaagcgggttgtacattagtcctgttagtgctccggaagagattaagcaatatgatttggataatcaggatagttatgtggaattcaccaaacaacttttgtgggaacgaaagttacttgacctgagtctacgtaataattttctgaacctgcgtattacccgtaatgcccttcaagtgatctctgcggatatagataagatggaagatgctttttcggacggaacagaatttcaaattttgggtaagccctctgattgggataatccgttgtatgacttcggactttatggcactttaacggaatcggatccgatgattggtttgattaagcaggagctgactcaaaaaagattgagaacctatcttaccgaacaggatctgaagaaatcgcttacttatctatatcgttcttccagaatagcattggaagaaaatggtgcaaatactttatatcttgccttggggctgctgaggtggtatgaaaccgaacatagtgagcgtcctcgctatgccccgatattgttacttcctgttgagatgatccgtaagtcggtatccaaaggatatattatccgtgcccgtgaagaagagagtatgcttaacattaccttgttggagatgttgagacaaaactttggcatcactatttctgggctcgattcattgccgaaagatgaaaatggaaccgatgtgaaacgtattttctcaatctttcggaaagctgtgatgaacgaaaagcgttgggacgtagaagaacaggctattttgggtactttttcattcagtaagttcatcatgtggaatgacattcactcgaatgccgaagagttgagtaaaaataagattgtcggcagtttgatgagtggtaaaatggaatgggaggttgcagaagtcgatgccaatgccatagaactggatcatgctttaactcctgctgatattgcgttgcctgtcagtgccgattcttcgcagcttgaagcggtttatgaagctgtaaatgagaaaagctttattttacatggacctccgggaactggcaagtcacaaaccattacgaatattatagccaatgcactgtatcagggtaaacgggtattgtttgtggccgaaaaaatggctgcactctccgtagttcagaaaaggcttatgaatataggtttagctccgttctgcctggaactgcattctaataaagcacgaaagacagatgtactgagtcagctgaaagaatcaactgagatctttcgttataaggaaccggaagagtttaaggaagagtcggaaaggctgtttaaaatgcgtcagcagattaatggatatgtagaggcattacaccgaatatatccttgtggcatatctgtctatgaggctatcacccgttatagctccattgacgaaacagaagaaataatgatacccgcttctttgcttgcttcgttgactaaggagcaattcaatgaatggaatcatgctgtggaagaattgatcggagttggaaaagtaagtggacattcccatcagcatcctctcacaggaatcaatataatggagtactcttctcaactgaaagaagaagcggataaacttctgaaagactatatgattctgttgcagaagatggaagagaagatgaatagatgcttctcaaattatggaatagggaataaatgcacagagaagctattggataactttgttcggttcatccgaatcctaatgcaacttcctggtatgaccggtaacttgatgttgttaaccgatcttgacgagaatgttgataagataggccggatcattgaacatggacgaaaaagagatgaattttgcaatctgctaaaacaatcatttgaagacacttttctcactttaccggtgcagcaaaagatctcggaatggaaagatattacacagagttggtttctgcctcgcttgttaaaacaacggaagttttgtaaggagctgtctctcttttcgcttcagggccgtgtcaataaagaacaagttcttcccgctttgcaacaattgctcttttatcagcagcaaaaacaggaagtagatagcagtagtcgttggtttgaggacttatttgggaataaatcccatcccggtgaagagcaatgggacgatatagaagtgatgagcaaggctatactccaattgaacaggcttctggtggaggtagtggatgatcctatgtctatacggcgagttaaggagaagctggcggaacaactctctgagggttattctttgttccggcaaatgaatcgggagttgttggaaggtttggtatacgactgggagtgtataaagcaattggaaaaatcgatgttgcaattattgggcgtttccaaagaggtgcttcatgcttgtgaagacgactggctggcaggagcgtcacgacaatgtgagatttgggcaagaaacacggataagctgaaagattggtatcgttggttgaatgtgtctcgtcggttcgaggcttgtggcttgacttctgtatttgcagcatatacggaacgtaacttgcctgccgaacggatgatgaatatttatttgaaagggttttatcatagttttattgaatatgccatcgggaaggagcaggttctgcaattttttaacggggagctgttcaatgacagtatccggcgttttcgtgaattgaatacggagtatcaggaattaataaaaaaggaactttatacaaaactggcttctaatatcccatcatttgtacttgcggctgcccaaagttcggaggttggtattttgcagaaatgtattcgcagtaacggacgtggaatgtctattcgtaagttgttcgattcgatttccaacttattgtcacgtatgtgtccgtgtatgctgatgagtccaatgtcagtagcgcagtatatcaatgtgaaccacgataagtttgatttggttgtatttgatgaggcttcacagatgcctacttgtgaagccgtaggtgctattgcccgtggaaatcatgtagtcgttgtaggtgatccgaagcaaatgcccccgactaatttctttaccagtaattcagttgatgaagaacatatagagatagaagatctggagagtatcctggatgattgcctggctttgtctatgccttctaaatatttgttatggcattatcgcagtaaacatgaaagcctgattgctttcagcaaatctcagtattatgataataagttgctgacttttcaatctcggatgatctggctgccaaagttactttag

SEQ ID NO: 3446 - DNA, 1032 bp, B.fragilis
tcagtcacacctaattgtcttatctatataaaggctataaaaatgaagaattatattcagagaatcatccgtttgtttgccacctccgaccccgacccaaagctcaccggagagatccaccgatggctgctcgatcaggagcatgccggggaaaaggagacggcactgcacgatttatggaacgaaacggaaggaaaggtggacaggactacttgggattctcttgcatcggtatataccaaagtcggagccaactccggggacagacatcagccacgtatccgtttcgcacattatgcggctgccatagcgttgctgatcgtatcagtttcggtcacttttcaaatgaccaaacagcactttgccgaagctccccttattgaaaacataacaccggacggacgactgagcagccttcgtcttccggacggcagcatagtacaaaccaactcgggcagtatcttgctctaccccgaaaagtttaaaggtgaaacccgcacagtttacctaatcggtgaggccaacttcaaagtaaagaaaaactccggtcagccattcattgtcagatcgggtaccatgtcggtgacagccttgggcactgaattcaatgtcgctgcttatccggaagagaacgaaatgattgcaactttgatccatggaaaaataaaagtggaatgcgacaatgggaaagagagttatatcgtcactcccggacagcaggtcacttatcgtaaaagtacgggagaaagccgactcgccgaagcaaacatcgaagacgtaacagcctggcaaaaaggaatgtacgtattcagaggcgtcaccatgtcagaaatcctgaacgagctggaaagacgctatgcagtcaccttccagtataacgccaatttatttaatgatgataaattcaacttccgttttcgtgaaaaatccactttggaagatatcctgaacattatgcaggaagttgtgggaggattcagtcatgaactgaagggaaatatatgttatataaaaccggagacaaaaaaataa

SEQ ID NO: 3447 - DNA, 192 bp, B.fragilis
atgccgaaaccacactgggtcatattggccaatactttaatgacagtagagttggtgatgacaaccttttgtaatagtaagaaggtagccaaagtcattagtagcacattggggctgcagaaggtaaagaagagttccatctctgtttccgtcgcattgggatttgacgctgtggtgctgaaccctgtataa

SEQ ID NO: 3448 - DNA, 870 bp, B.fragilis
ctccacagaccgtacgtagcttgttactgcccaaatctgctaagaaaaagacggatgaaaatcagttatcatttgtttttaacgattgagattgttatgattctttttatctacgataaaacacttgatggcttgctgacagcactattcgatgcttataaccgcaagacctttcctgatgtcttactctcgaaaggagatactttaccacttttctatgatgacatttttacggttatcactgatgaagagaaggcaggacgtgtctggcggggattgcagaagaagatatcggcatcagccctttcagctatcacctggtgttggctttcagagttaccggaagtaggtatgcttttgttccgatacatccgaaaggccattgactctcccgtctccattgagactaatttcggtgatccggatgttctcgctctttccaaaatatggaagcgggtagattgggagcgtttgcgtatgttgcagttcgtacgttttcagaaagcggtggatggtaccttttttgctgcttttgaaccacagcacaatgctttacctttgacggtaggtcactttaaagatcgttttgccgatcaacggtggctgatttatgacatgaagcgccgttatggtttttattatgatctacacacggtagaggaagtgacatttgatgatgatggtcaagcagcacatctgattaccggaatgttggacgaaagcttgatggataaggacgaaaaacttttccaacaactttggaagacttattttaaatctatcacaattaaagaacgactgaatcctcgtaaacataaacaggatatgccggtgcgttattggaagtatatcaccgaaaaacagaaataa

SEQ ID NO: 3449 - DNA, 1122 bp, B.fragilis
atacataagtttatgccaagaacagctaaaaaaggtttcacctattacgggttcgataccgatcatttttatgaccccaaagtcaagagactcaaaaataaattcggcatggagggctgggccgtgttccatttcatcgtgaacgagatccaccgcgtggaaggctattacatgatcatggactccgacggcctgttcgacgtctcggactattcccgcatggacgagcaacgcatcgcgggtattgtcgactattgcgccgagctggggcttttcgacaaagggctttggcggagccgtcaggtcctcaccagcgaggagatacagaacaggtatatgggcatctgcaagtctatccaccgcaagccttccatctcggatgactacctgcttttgaatgcggctgccccggccgccacctcttccccgcaggtggccgctccctgtcccgccacccatacggcacctgttgctgaacccgcgcggaccggcgaaaaagagaaggatacggaactgatgcaggccattgcggattttaaacgcaggctgcaagaaccggaaagcgccgccggggtagttcgcgaagaatcgggaataattcgcgaaaatagaccacaaaataaaataaaagaaaatatatcctccccaaacccctccggagagggaggctacactccggagagggaggaggagagaaactctctttcagggaagctccaatacctgggtgtggattccaacatcatccaatgggtacggctcctgaaaagccgttatccggatttccctatcgaaaaggcgatccgtgacatggagcagagcaatttccaactgaccaaggaaaattacctgtatcccctgattaagaactatatagccaagtataatgccgagcacggaagtgaagagcgtgccaggcaacaggagaagatcctgcgcacccggcgtaaaaccctcgagctcctgggcgttccggtgaaggaccagcaggaaatcctccagcttgcctccgttgcacccttggtactggatacagctctgaaggagacctggggaaacaaaaagatcaaaagccccaccatgttcctcctgagtcggatgcggagggctgtaccggcataa

SEQ ID NO: 3450 - DNA, 378 bp, B.fragilis
attatggatacggaaattttaaggaaaaaatacactttatggagtaatatcattgatcttcgttctcggggactcaatattacgagaacggcaaagcgtcttggtgtttcccgcgatacggtgaaacgtctgcagtctttgagttccgatgaactatttcggaagtaccaggagtcacgccggtgcaagctgcagaactatgagcaggccgtcgtatccttactcttcacttttccttccacttccagcagtcgtgtccacgactatttaaaagaacattatcctgattttccaaacgtctgtgataagactgtgcgcaattacgtgcagtttatccggaagaaacaccatcttccattccggtcctgtcgtttatga

SEQ ID NO: 3451 - DNA, 912 bp, B.fragilis
tatattggcacattgaaaagtgattcttggctccatcgttttttgcataatcagccgctaaagcataagctgtatgtcattatcttcgaatccgatacacccgcagggaaagcattcgacgtaacccttatcatatgtattctgctgagtatcctgcttgctataatcgaaagccttcaaggtctgccttcctggctttccactccctttatcgtgcttgaatatcttttcacagttttttttacctttgaatatgtcacccgcatctattgctcacccaatccacggaaatatattttcagttttttcggtattgtcgatcttctggctacattgccactctaccttgccttcttcctgcccggagcacgctatctgctgattatacgtgctttccggattatccgggtattccgaatattcaagttgttcaacttctggctcgaaggtgaacgtctactcacttccctgcgggaaagcagcaaaaagatcgccgtctttttcctctttgttgtcatcctcgtcgttgccatcggcactttaatgtacatgattgaagggactcaacccaatacacaatttaataacattccgaatagtatctattgggccattgtcaccatgaccaccgtaggctatggagacatcactcctgctaccgctcttggcaaatttctttctgcctgcgtgatgctgatcggttacacaattattgctgtccctacaggtatcgtctctgcatccatgatgaaagaatacaaaaaattaaaagacttacaatgtcccaactgtcataaaacggggcacgaagagaatgccacttattgtaaatactgcggacataaattgaaaaatgatgaaatttaccggcaggaaaacacggcaactgatccggatcggactacttcataa

SEQ ID NO: 3452 - DNA, 450 bp, B.fragilis
ttatatgtaacgggtatcggtagtatcggtgtcgatacttattttcgcagcctcaaaatgcacatgaagaagtttatattaatcaccttgacgttgctttatgccgttgtttcatcaggcataacgattaatttccattactgcatgggccgtcttgcggatgtagagtggggaagtgcgtccgtttgtgcatcgtgtggagagaagaagatgacctcacattgttgtaaagacgaggcgcattacgtcaaactggcggtagatcaggatgtgaaccacgtaccggtaactaatctattaccggcagtgacagaactgttacctgtgatgtatagtgcttttataccattggaggcagaaagtctgcgtcgaagtgttgcttctttcaatttcccaccttggcaaacagatattccgctgtttgttcatcattgtacttatctgatttag

SEQ ID NO: 3453 - DNA, 267 bp, B.fragilis
atgcggagaacatcggacataccaccaacaacaacgtttcccattgatccgcctcccatgccggacatgtctctaccggaagagctgccggcagaaacacctggagtacccgcaggcgccgggctgcccattcctcccataccggacatgccactccccgaagaaagtgcaggcggcatcgaagcaactgacgttacagaagtcgacgagggagctgcctgtgccgacgaagcggaaaagcggttcagtgccaactgctcgagttga

SEQ ID NO: 3454 - DNA, 207 bp, B.fragilis
aaaagtacgactggtagcacaagcatttataaagaaaccggcaacttcggtaaagggaaaggattgcttcataaaagagaaacgaatgctttgtcaaaggggagaaaacgccctgttgaaagggaatggcagacctctcccaaaggaaaaatcgcacgacccaaagaaggcagtcagcctgccgaagagaaaaaacctactatctga

SEQ ID NO: 3455 - DNA, 258 bp, B.fragilis
aacaggcggactgatgcggattccaggtggggtacataccctccggaggtccgtttcagtccgcctgttccgtatcagatgttcactgaacgcaaaatgtcggttgttttatttctcaacgattgttcccggaagacaaaaatattatcttttcggataaacaaacctactcaaaagaatgaaacctgttttgcatgcctgagtacagtaaaaaaatacgggagaagtcatgctgcgttgttctatagccgcttgtga

SEQ ID NO: 3456 - DNA, 417 bp, B.fragilis
accgtagacgcatcacgcggagaatggagatacaggataaaagacaggaacccattaaataacagccatatgtatttcatacactccatacagacctatgcatcggtgaaccggaagggaagcgagctccaggaatatgtcctgcagctcaaggacagcctgataaagaacagggagttcctggatgacctgaaagaggagctccactgccggatcggggagcttgacgccaagtatccgcgtacacaacccctgcatctggatgcggcaagttgccgggagatcatccaatggatcatccacgtgaaaggcaagccggataacctgatatgtattatttcgattacgaaagtcagaaacctgctgggagaaggaaccggtttctttccccgggcaaagacaggaggtaagggatga

SEQ ID NO: 3457 - DNA, 495 bp, B.fragilis
aatgctttagctatgataaaattgagattcagcttgttgatggctttgttggtagtggctgtgtcggtttttgcggataatgcacctgccaaagtgcagacagccctgaaaaaaatgtatcccaaggctgatggaatcgcctggtcgcaggacggtggttactattgtgccgattttatgatgaatggttatgaaaagaatgtctggttcaatgcacagggacaatggcagatgacgcagacagagtggggagataccgatgaactttctgccacggtatataatgcgtatgcttccggaccctattccggctggcaggtagaggacgtcacttacgtagaatttccgaaatggcaaccgattattgtcattaaggtgggacagcaaaatgtagacatccagtatcaactgttctatagttcgaatgggacattgctgcgtactcgcaatgtgagctatatggatgatatattgggccccggtacttttttgtag

SEQ ID NO: 3458 - DNA, 186 bp, B.fragilis
aaccatacagcaatgaaaacaaaatttgtaaaaacgacagaccgtaaaggcacttatatcattgaaggttcatctgatggccagttctttaatataaagaggttcatttgtcaagttcaaaaacaagaaaccgaaaaagagacgcaagaattagctgattttattttatcaaaacttaattcctaa

SEQ ID NO: 3459 - DNA, 360 bp, B.fragilis; identical to SEQ ID NO: 2147

SEQ ID NO: 3460 - DNA, 192 bp, B.fragilis
agcaatgcggcttctttggttattttagccatgattatgcgttttaataaaggttatcatttgcccgcaaatgtaggaataaaagttcgaaatcgtagtctatctgatataaattctattaaattaataacaaaaagccacaaaaagatgaaaatgtatccggttttttgcgctcttattgcatatttataa

SEQ ID NO: 3461 - DNA, 1353 bp, B.fragilis
accaataattttctctacttttgcgtcgatataacttttttaaggcaatataatcgtaaactcaatatcattatggcaaaacaattcaagcccgaaaccctgtgcgtacaagcaggatggactccgaaaaagggcgagccgcgcgtgctgcccatctatcaaagtactacttttaaatacgaaaccagtgagcagatggcccgcttgttcgatcttgaagacagcggttacttttatacccgtctgcaaaatccgacgaacgacgctgtagccgccaagattgccgctctcgaaggaggagtgggagctatgttgacttccagtggacaggctgccaatttctatgccatattcaacatttgccaggcgggcgatcattttgtttgttcgtcggccatctacggcggaacgtttaacctctttggcgtgacgatgaagaaattgggtatcgatgtcactttcgtcagccccgatgccggtgaagaagagatttcggcggctttccgtccgaatacgaaagcactgttcggcgagaccatctccaatccgtcacttgaagtgctcgacattgagaaattcgcccgcattgcccatagtcacggtgtgcctttgattgttgataatacatttccgacaccgatcaactgtcgtccgtttgagtggggagccgatatcgtggttcactccactactaaatacatggacgggcatgccaccagtgtaggcggctgcatcgtagacagcggaaacttcgattgggaagcccatgcggacaagttcccgggactctgcacaccggatgaatcgtatcacggactgacctataccaaggctttcggcaagggcgcttatatgacaaaggcaaccgcgcaattgatgcgtgacctgggcagtattcaaagtccgcaaaacgctttcttgttgaatctgggcttggagacgttgcatttgcgcatgcctcagcactgtggcaatgcacagaaggtagccgaatatcttgcgcagaacgacaaggtggcatgggtaaactattgcggtctgccgggcaacaaatactacgaactggcgcagaagtatatgccgaatggctcgtgcggtgtgatctctttcggcttgaaaggcggtcgtgagttgtccatcaaatttatggattcgctgaagctggcggccatcgttacccatgtagccgatgcacgcacatgtgtgcttcatcccgccagtcatacgcatcgccagctgacagacgaacaattgatagaagccggtgttcgtccggatctgatccgcttgtcggtgggaatcgaaaatgcagatgatattatcgcggacatcgaacaggcgctgaacgcataa

SEQ ID NO: 3462 - DNA, 684 bp, B.fragilis
aaaggaaatttacgtatgatgttgaacttcgactttgtattaagactgttagtcgccggaatcttaggtgccatcattggcttggacagggaatatcgtgccaaagaagcgggctatcgcacacactttctggtgtcattgggtagtgcactgattatgatcgtttctcaatacggctttcaagaaatcataaaagaaaatagtgttacactcgatccaagccgtgtagcggcacaagtagtcagtgggattggttttatcggtgccggaacgattatctttcaaaaacagatagtcagaggactgactacagcggcagggatttgggcgacagccggaataggcctggcagtaggcgcgggcatgtacgtcataggtattgctgccatggtactgaccctgattggtcttgaagtgctaagttacctgtttaaaagcataggaatgaaaagctcaatgataactttttcgaccgataacaaacaagtactgaaaggagtggctgaccgatttaattccaaagattacctcatagtgtcgtatcagatggatacacagaagcacggaagcatagaaacctatcaagtgacaatgatcatcaaatccaaacggaacaatgacgaaggacatttgctatctttaatacaagaatttcctgaagtgacagtagaacgaattgaataa

SEQ ID NO: 3463 - DNA, 276 bp, B.fragilis
catcaaattcttatgaccatgtccgatttcaaccccagaccgtccgacaaactgacggcaagcgaacgtaaagaactggatacctccgagttcggcataccccaattaagagagttccccatccacgacgccgcccatgtacgcgcggcagaagcctacttcaggtatgcgcccgaagagtataaagcgcagttggcacggaacatcctggccaaagcacatctgttgggagtgaacgtaaaaagccccgccatcctggagtgggcagagaaataa

SEQ ID NO: 3464 - DNA, 1437 bp, B.fragilis
gcacctgcctatccgaatgattcatgttgtagaaatattagcatcacaattatgagtaccaagcatgcaaaagctgccgaaaaattcctggaaaatccggtgatggcagcatggcacaacgagaccctttggatggttcgtgccaagagagacaagatgagcaaggaagtacccgagtgggaagaattgcgtgataaggcatgtgcattgaaactttactccaacagccaccttgaggaactcttgctggagtttgagaagaatgccacagccaatggagccatcgttcactgggcaaaagatgcggaagagtatcgtgccatcgtttatgaaatattgagcagtcacggagtaaagcattttgtgaaaagcaaatcgatgttggcagaagagtgcgaactgaacccgtttctgatagagaaaggaatcgatgtggtggaatccgatctcggtgagcgtatcctgcaattgatgaatctggcaccgagtcatattgtacttccggctatccacatcaagcgtgagcaggtaggagaactttttgagaaagaaatgggaacggagaaagggaattttgatcccacttatctgacccatgccgcccgaaagaacttacgaaatatctttctgaatgcagaagccgctatgacgggagccaactttgctgtggcgtctaccggagatattgtggtttgtaccaatgaaggaaatgccgatatgggtacatcgtgcccgacactgaatattgctgctttcggcatggaaaagattgtgccggacatggaggctctgggagtgtttacccgtctgttggcacgttcggcaacgggacagccgatcactacttatacctctcaataccggaatccccgtgaaggaggtgaatatcatattattattgtagataatggacggagtgccctgctggcccatcccgaccatatcaagactttgaactgtatccgatgtggtgcctgcatgaatacgtgtccggtgtatcgtcggagtggaggatattcttacacttactttattcccggacctatcggtatcaatctgggaatggcacatgatccggaaaagtattacgataatctgtcagcctgttctctctgtatgtcttgttcggatgtttgtccggcaaaggtggacttggccgaacagatttataaatggaggcaggatctggataagattggaaaagctaatacgggtaagaaaataatgtccggtggcatgaaggtgttgatggatcatcctacgcttttcaatgcggcgctttgggctgctccggtagttaaccatttgccacgttttatgaagtataacgatttggatgcgtggggaaaaggacgagaacttcctaaattcgcgggcgaatcgtttaacgagatgtggaagaaaaataaagtgcagggaaaggaggaaaacaaatga

SEQ ID NO: 3465 - DNA, 288 bp, B.fragilis
aaactgttgtatatgagtttctcaggattcgtttttgatatgatcaggcgcaataaggagaacagagacctgcttactctgcgccgggaacggatgaaggaccttcaaggtaaaatgtaccggaaagggacgcttcaaaatccgaatgtaaccctggaagagctggagaagatagaaaaggccacccgtgaaaaggaaaaagcggaaacacaatattatctgcgcgccacgctgatcttcctgaccgtgacagccatactggcactcatactctggtggatattgtag

SEQ ID NO: 3466 - DNA, 453 bp, B.fragilis
gtcatcgttcataaacagctatatactaacactatagcacatccaccttcgttctggcacgaggcttgcaatattattatcgtaagcaagtggcttacagaaaaacaaacttcatttattaacttaaaacttacaattatgaaaaaggtattagtagcagtagcattggttatgggattaggtagctcagtagcattcgcacagaacgcagaaaacgctaacgcagtggtagcaaccgcacaagctccgcaagacgagtatacaaagattgaagtaaaggatctgcccgcagcagtaaccgaagctctcggaaaagcttatcctgaatcaaccatcaaggaagcatcggtaacaactaaagaagaaggtaaattttacaaagtagtcgttactcagaaagacggaacagacgtgactgtggtattgaacgaaaaaggggaagaagtaaaataa

SEQ ID NO: 3467 - DNA, 1632 bp, B.fragilis
aagaagacccaaaacgttatgaaaaagaatttattaattttagtcgcactgctgacatcggcaacgatatcggcacagaacggaggaaccattatgaagaagtatgagaaccaactaccgcaagccggcagaggaaacgtacatgttgcctaccaaggcaaagccatcgaccaaatgatttacgattttatggaagaacagggaataccgggcatgacacttgccatcgtacaggcaccttatattccgcgtgtagcaggctacggagtgacggaccttgaaaaaggaaaccttgccgctgccaagactctttggcccatcggtcccatctcacaaggatatgcagccgtggcagtgatgcagctctacgaaaaaggaaaactagacctgaacgacccgatcggcaagtacctgaaagatatacccgaaaactggaaaccgatcagtatccttcagttgatgcaacacagttcgggcattgcggactatcgtaatgaaaagggattcgatgtatcggccgattatcgcccggaacaactgatcgaaacggtagccgccattccgctcgccttcgaaccggggacagacgtgaaacagagcgccacaaactttctgctactgacttctatcatcgaaaaggccggcaagatgtcgtatcacgactttgtgaaaaagtatcagatcgactacctgggactgaaacagacattcttcggcgaagacctggcgaaagtaaaacaggaggacgtgaccctcaccggcaacgtgcatcagacattcaaaaaagataaagactacatcaatccctcggaaacgactaccggatatgtggaaaaagagggtcgccttgtcgccgcaccggctgtcagcccgacggcactgaaaggattctccgacatctgggcatcagccgagaatgtgagccactgggacatcggactggcgggaagtgcattgatcgaaaagcccgaaaaccgtgacatggtgtacaagccaacccggctggccaacggcaaggtagtacctgccatggcaggatggcagttctataaccacaacggcctgatggacatcaaaggcaacgtatcgggccattcggctttcctgagtcgatttacggacgcctcggagctagtgtgcgttaccctactggccaataaagagggggtagacctgacaaatctgggacgccgtatcgcagccgctttcgacagtgataagatgggtacgggagccaacgacaacctgctctatacttatgaaagccagttcagcgtgcccgaaaccatgacgcgcatcgagcagaccctccacacgatgggcgttcccgtctttgccaagttcgatcacgggaaaaacgccgaagaagtgggattacaactccgccccaaccaggtcatcgttttcggttcaccgaaagttggcacaaaactgatgcaggacaacccgagtatctcgatcgaacttccgctgaagatctccgtttgggaggacaagaacggaagcgtatgggccactttcccacagatgaggacgatggcggccgaatacgggctggaagccgaaccggtaatcggaaagatgcaagaactactggagaaaatcgtaattaaaggggcaagcgtatactaa

SEQ ID NO: 3468 - DNA, 903 bp, B.fragilis
ataagccaccaaactcaatatgatatgaataagaaatcttcacttaacaatttgctctatatacaagagcatcgttcatgcagaaattacctggaaaaggtagaaaacggattcaaatatattgaattctcacatgaagaagttattctggaaaaagaaatttcatggaactatcttttatttgttctcgaaggagaatgtatcatcaattgtaatcagtttagagaacgtttgtttcaggctaactgtatggtgctactccccaaaacggctatggttgaaattaaagtcatagccggtacccggttactctccttatcctttgatgttcccttaaacgtatgtgataagttcatattacaatcgttaacaggactatgcaggaaactggattataatttccagtcactcgctatccgttatccccttcctccttatttggagattgttacgtattgcctgaccaataagatggattgcggacattttcacactttgttgcaacaggaattattttttttactccggggtttttatctgaaagaagaattagccttattgttccacccgatcatctcagcagaattaactttcaaagattttgtcattggcaattattttaaagtaagcaatgtaaatgatctcatctccctctccaatatgtgtaaaagcagcttttactgtaaatttaaagaagtattcggaatgacggccaagcaatggttgctgaaacaacggaacacacatatattaaataaagtgatgacctcagagactacagtcggagagttgatggaggagtttagatttgagtcacaagctcatttcacccactattgcaagcagcattttaattgcacaccacgggagttgattatgaaatatcaggttgtaaatcagtag

SEQ ID NO: 3469 - DNA, 192 bp, B.fragilis
ttgaatggacagacatcaggagaatgtgatattgtaagaaggtggtttacatggcgtgctttcaggagtgagtctcctctttattgccccgatgtgattaaaaacaagcttttgagaggattattgaaaaaatctcccttccccagtcacataattaaaaagaaagatgtaattttgcatgccaaaaaataa

SEQ ID NO: 3470 - DNA, 846 bp, B.fragilis
aatagatttaactgtaaaacaactcaggaccatctaagtattcataatcattacagaatggctaaaaaacatcgtaaagagagccttgatgcccttttcagggaaaaggtattgctggaaatgctgaaaatagcaggagttggtatgtggacatacagtaccgaaacgggaagattacgttacattggattcgccgataccatccatcggcacgacgaattgcagtatgtcgatccagcggattatctgaaattgatgaacggtgaagatctgcagaccgtcactcagtttatggccgacattcatgccgggcgtcctccccaggaaggaatccgttataagattcatggtaacggagaggacttttatcttgaaaatcatgttgtgacctgccaaccgctgggcaatggattctattatctgaaaggatacgtcaagaatataaccgcacaggtgatggaagccaaccgtctgtgtatagagaaggagcgcaccgaacaggcggaccggttgcgctcagccttttttgcccacgtcagcagggagctgcggggacctctcaaccgaatagaagaacttgcgtcgcagatggtacatgccgaaagtgtagaggagcgggaagagtgtttccaccggatacaggagaacaggcggatggcgatgaaaatagcagatgccctgcatgcggtgtcgcaacttccggtcagcacatatgagccttaccactcacccatgcagctttgcctgatataccgtgacttgttgatggagaacggctacagccataatccggaagacggagagcaggaggagaatgcaaacttcctgtcgttactcttttcctga

SEQ ID NO: 3471 - DNA, 1560 bp, B.fragilis
aataaaattaaagcaagaataacaatggaagatataaataaagcttatgccacgttcgccgaacgtgaccgcatcgcttctctgggtggaggcgcagccaagattgatatacagcacgaaagcggaaaaatgaccgcccgcgaacgcatcgacatgttgctggataagggtacatttgtagagctggacaagctgatggtgcaccgttgcaccaactacggcatggaccggaacaagattccgggagacggcgtcgtgtcgggttacggaaagatcgacggacggcaagtatttgtctatgcctatgacttcaccgtttacggcggttcgctatcggcatcgaatgccaagaagatagtcaaggtgcagcaactggctttaaagaacggtgctccgatcattgcactgaacgattcgggcggtgcacgtatccaggagggaatcgaaagcttgtcgggttacgctgacatcttctaccagaatacgatggcaagcggagtgattccccagatctcggccattctgggtccttgtgccggaggagcctgctactctcccgcactgacggatttcatctttatggtgaaagagaaaagccacatgttcgttaccgggccggacgtcgtgaaaacggtgatccacgaagaagtcagcaaagaagagctgggcggcgccatgacacacagcagcaagagcggtgtgacacacttcatggccaacaccgaagaagagctgttgatgtcgatccgcgagctcctctcattcctcccgcaaaacaacatggacgaggcacgcaagcagaattgcaccgacgacgtcaaccgtgaagacgcctcactgaacagcattgtcccttccgaccccaacgtaccgtatgacatgaaggagatcatcgaaagagtagtcgatggaggctatttctttgaggtgatgcagaactttgccaagaacattattatcggttttgcacgcatgggcggacgctcggtaggcatcgtagctaaccaaccggcttatctggccggagtgctcgacatcgacgccagcgataaagcaagccgcttcatccgcttctgcgactgcttcaacattccgctgattacattcgaagacgtaccgggtttcctgccggggtacacccaagagaacaacggcatcatccgccacggagccaaaattgtgtatgcttttgctgaagcaacagtacccaagctgactgtaatcacccggaaggcttacggcggtgcttacatcgtgatgaactccaaacagacgggagcagacgtgaactttgcctatccgagtgcagagatcgctgtaatgggtgccgaaggtgcggtgaacattctgttccgcaaggcggacgcagagacgaaagcccaagagctgaatgcctacaaagagaagtttgccaccccctatcaggctgccgaactgggattcattgacgaaatcatcctgccgaagcagacccgcaaacgcctgatacaggcattggagatgacggagaacaagatgcagaccaatccgcccaagaagcacggaaacatgccactttaa

SEQ ID NO: 3472 - DNA, 1056 bp, B.fragilis
atcaagaataaaaaggaattcaaaatgaaaagaagaataaaatccgcccaaagcattttatgggttctattactcattttgtcagcatcgtgcagtaaagacgaaatacagatcgtagatcaggatacaagttggcaaatggacaataagtatatcgaagaagatatccgtgagcaactcggcatcgatccgttcacagatctggtgtacctgggatattacggcaatccttatacacagttggaggcaatcaacgacctggtaaataccacactggtgggaaagaacgaactttcgttcaaagtaaaagtgacgaagccttacaaagaagatatcaaagtcaatcttatgaaagaagacaaactggtaaccgattttccagagatggcggagggaatacctctttttccgagcgaaaactgcacctttgaaggcggtgtgctgaaagccggcgaactggaaacaacggtgaaactaacgattaaggatgttgagaagttaaacaacctatcgggttatgtgatggccataaagctgacgatggaaggatcgcatgagcatttggccatcgcccgaacccgctcggcatactttgtgaaattaaatctttctatacgcctggacaatatcgattcaagcaataaaaagatcgaaggaaaaggattcaacaaagaaatcagttttaaatcggacatacgcccggataaattaggttcgttaaacgatggcaacttcacagccaacaactggtatacctccaacgcgaacaattatctgacgataattctaccggaaaaacaatcgctcaaagggttcaggctggacaccaacacctctccaagcggctcgtatatgctcaaatcctgtagagtgatggttgaaacaccggatgggaattgggtgaaccatggagtattcgaccgcaagagtatggatggaattgcttatataagctttaaaaaaccggtggaatgtactaaagtgcgtttcgagaatatgatggccttcaatggcagattttccgttgatgtaaatgaagtcacagctttccggtaa

SEQ ID NO: 3473 - DNA, 3285 bp, B.fragilis
aattcgttcaaatctatgaatttttatcgattaaagtctattttttttataatttttagctgttttattctacaaacggctgcctttgctcaaaacaacgtaaaaataacaatcaagaaaaagaatatcacgttgcaggaagcattgcgggaggttgagaaacaatctgattatctgatcgctttcaacgaatccaaacttgagaaaaccaagcgcgttaacctgaatattaatgctgaatctctggataagacactggcttctatcctgtccggaacggggctttcctacaaaatcaaagacaaatatatcatgattattccgcaatcaaaagtggaagtcgaaagcaaaaaactgtcggggatagtgaaagatgacaaaggagatcccttgatcggagtcaacgtctccttcaaaggtagccccacaggaaccgtcaccggtcttgacggacgattttccattctggctgccaaaggaaatatcattgaattctcctacgtaggctataccacccaatatattacagtgggcgatgcttcttcgctaactgtcgtattggaagaagacgccaaggcactggacgaagtagttgttaccgcactgggtatcaaacgtgcggaaaaggcattgagttatagtgttcagcaggtaaaatcggatgctatcaacgatgtgaaagatgccaacttcgtgaacggattgaccggaaaagttgcaggtgtatccatcaaccggagttcctcgggcatcggcggggcgacccgtgttgtcatgcgcggagccaagtctattgtaggaaacaataatgtgctctacgtggtggacggtatgcctatcggcaacccttcaaaaggcgaaatcaacaatgactatagcactccgggaggaggtgaaggtatttccgacttcaacccggaggacatcgaaagtctatcgatactgacaggtccggctgccgcagccctgtatggttcatcggcagccaacggtgttatcctgattaacaccaagaaagggcaggaaggcaaactgaaaatctcgatctccaacaatacggagtttatgaccccgtatgtaatgccggaatttcaaaaccgatacggtaatgcaaaaggatcatacaagagttggggtgagatgctgcaacagccttcaacgttccgcccgaaagacttcttcaagacaggagccaatatcatgaatgccgccaatttttcagtaggaaacaaaaataatcaaacgttcgtatcggtggcaacaacaaactccaccggcatcattcccaacaacgaatactatcgttacaacttcacattacgcaacaccgcgagtatgctgaatgacaaactccatctcgacctgggagccagttatgttctgcagggagaccagaatatgctgtcggcagggcgttactttaatccgctggtacctctgtatctctttccgcggggtgaagatttcgaagcagtcaaggtgtacgagcgctatgacaccaaccgaaaattccccatacaggaatggtcttatggcgatcagggcctgaatctggaaaacccgtactggattgtgaaccgcgaaatgtttgtttccaaaaagaaacgttacatgttttatgccaatgtaaaatacgatattctcagttggctgaacatagcaggacgtatacgtgtggataacaccaacactacttccgagcgcaaattacacgcttcgacaatcaagctgcatgcccaatcggacaaaggagcctacaaccggagcatggaagaatatcagcagacctatgcggatattatgctgaatgtgaacaagaatttcggtaacttcaacctgacggcaaatgccggattcagttatgaagatcacctgaccaccggcatgggcatcggaggaaaactgtttaccgtccccaacctgttctctgcctataacttcgatccggcttccggacccggttcgcaatcgcacacccatacacgtaacaattcggtctttgtaagcaccgagctgggatataaaagcatgctttacctcacacttaccggacgacaggaatgggcttcccagttagtcaactctgaccagcccacctatttctatccttctgtcggagtgtcgggcgtaatctctgagatggtaagtctgcctaaatttatttcattctggaagatgagagcttccttcgccgaagtaggaggaccgatcaactataccggattgactcccggaactgtcaccgatcccatgaaaggcggagtcatcaatccgatatctgtctatcctttcccgaacttcaaagcagaacaaaccaaatcgtatgagttgggaactaacctgagacttttcaacaacaaaatcaatatcgatgccacggtgtacctgacagatacctacaaccagaccttcctttccagcatgtctcctgcttcgggatactcgggcttctatgtacaagcgggtaaagtgcgcaacaaaggtatcgaactgtcattaggctataacgaccggttcggaaaagtgggatatgccaccaatctgacttatacagccaaccgaaataaaatcatgaagatggtgcatgactataagaacccttcggacggttcgctgttcagcatcactgaactgaccctgcaagataagggaggagtttacctgcgggaaaaggacgccatcggagacgtatatgtaaaaggcatccttgccaggggcaaagacggtaaactgatcgaagaagaaggaggatataaagtagaccgctcacaacgcatcaagataggatcggtcaatccggacttctcgatcggctggagacacaatgtcacctggaacaacattactctggacctgctgttcaacggacgtttcggaggtattgtcacctcttccacccaagcattccttgacgactacggtgtatcgaaagacacttataaagcgcgtcagaacggtggtgtatgggtgaacggaacccaatacgacgcggaaaaatattatacgaccatcggcggcgaacaactgatggcatattatgcatacaaagcaaccaatattcgtcttcaagaagccagcctgagctataccctaccgggcaaatggttcgcccatgtgatcaaccggctgacagtttccgccatcgggcgcaatttgtggatgatctataataaagccccattcttgattcaaattacctcttcgacaggtacctataaccggggagatgtctttatgccacccagtttgcgtagtgtgggatttagcgtgaagattgaattataa

SEQ ID NO: 3474 - DNA, 297 bp, B.fragilis
agcacatgtttcgctgttcggtccgcttccgagaaaacggcaatgctcgttatttccatctcccgacaggagcgcatcaccctcacggcaatttcaccgcggttggcgactaagattcttttaatcatattcatttctcaattaaatgcatatacatattcgcgcttttccaccctgcggacatacgtccacccgatgaaaacacagtatttctacgatttggggcttaacaacgatgctttctttcctaacccacgaggagagaatgctcttattcacgaatggcaggtcttctga

SEQ ID NO: 3475 - DNA, 540 bp, B.fragilis
atgattttaaataacgagtctaataagaagaagaaatttgagcagtttttcattatgacttatcccaaagtcaaagcgtttgcatggaaattgttgaagtcagaagaagatgcagaggatatagcccaggatatattcgcaaaactatggactaatcctgagatttgggaaaatcaggaaacttggaacagctacatatatactatggtccgcaaccatatttataactttctaaaacataaatcaatccggcagacctatcaggagcaatgcacaaaagaggagccggctatatccgaaactgacattcacgatcaactttatgccaaggaaagtgaacttctgataaaacttacgattgccaatatgcccgaacagaggaggaaaatcttccgaatgagccggacacaggaaaaaagtaatcaggaaatcgccgacgagctggatatttcgatccgcactgtagagcgccacatctatttggcactaatcgatttaaaaaaagtactcctcaccctattttttttctatctcggttga

SEQ ID NO: 3476 - DNA, 2310 bp, B.fragilis
cctttattaaaacgcataatcatggctaaaataaccaaagaagccgcattgctctatcattcacagggcaaacccggtaaaattgaggtggtacctaccaaaccctacagtacacaaaccgacttatctctcgcttactctcccggcgtggcagaaccatgcctcgaaatagaaaagaacccacaagatgcttataaatatacagccaaaggcaatctggtagctgttatctcaaacggtacagctgttctgggattgggtgatatcggcgctcttagcggcaaaccggtaatggaaggtaaaggtttgcttttcaaaatctatgcaggaatcgatgtattcgatatcgaagtcaatgaaaaagaccccgacaaatttatcgaagccgtcaaagccatcgcccctactttcgggggtatcaacctggaagatatcaaagcacccgaatgttttgaaatagaacgccgcctgaaagaggaactcgacattcccgtaatgcatgacgaccagcacggaacggccatcatctccagtgcgggattggtcaatgccttgcaagtagccggtaaaaagattgaagatgtaaaaatcgtagtaaacggtgcaggtgcttcggccgtatcgtgtacgaagctttatgtatcattgggcgcacgccttgaaaacattgtcatgctcgatagcaaaggtgttatcagcaaggcacgcaccgacctgaacgaacagaagcgttatttcgcaaccgaccgtaccgatattcacacactggccgaagccatcaaagatgccgacgtattcttaggactctccaaaggaaacactttgtcgcaggatatggtgcgcagcatggctccgatgcctatcgtctttgccctggcaaacccgaccccggaaatctcttacgaagacgccatggcagcccgcccggacgtattgatggcaaccggacgttcggattatcccaatcagattaataatgtaatcggtttcccgtatatcttccgcggagctctcgacacgcaagcgaaagcgatcaatgaagagatgaaaattgccgctgtacacgccattgccaatctggccaaacagcccgtacccgatgtagtgaacgaagcctaccatgtgaacaacttcaccttcggtccggaatattttattccgaaaccggtagatccccgcctgatcacggaagtatccatcgccgtggcccgtgccgctatggagagtggtgttgcccgtaagaatatagagaactgggatgattataaaacacatctccgcgaattgatgggacaggaatctcagctgacccgccaactctacgacacggcccgtcgcaatccgcaacgtgtggtatttgccgaaggcggacaccccaacatgttgaaagctgctgtcgaagccaaatcggaaggaatctgccatcctattatattaggtaacgaagagcgcatcgagaaactggccaaagaactcgacctgagcctggacggaatcgaaatcatcaacctccgccacgaccgtgaagcggaacgccgtgagcgctatgcacacatcctctcccagaagcgtgcccgcgaaggtgctacatacgaagaggccaacgacaagatgttcgagcgcaactacttcggtatgatgatggttgaaaccggagacgcagacgctttcatcaccggactgtacaccaaatacagcaataccatcaaagtagcgaaagaagttatcggcatccgtccggaatacaaacatttcggaaccatgcacatcctgaactccaaaaagggaacttacttcctggctgacactttgatcaaccgtcatccggatacttccactttgatagatatagccaaactggccgatcaaactgtcagattcttcaatcatactccggtgatctccatgctgagctattccaacttcggttccgaccaggcaggaagcccgctgaaggtacacgaggcagtggcctatatgcaacaggaatatcccgaactggcaattgacggtgaaatgcaagtgaacttcgccatgaaccgcgagctccgtgactctaagtaccctttcacccgcctcaacggcaaggatgtcaatacattggtattccccaacctgagttctgccaacgcaggatatcagctgctgcaagccatggacccggataccgaattcatcggcccgatccagatgggactgaacaaacctatccactttacggatatagaaagctcagtacgcgacatcgtaaacatcacagccgtggctgtgatcgacgctattgtagaaaagaaaaaagctaataaatga

SEQ ID NO: 3477 - DNA, 954 bp, B.fragilis
ctgatattaaaaacaaaaaaagatcttataagttggtgcttttctatctttttattagttttaaaacttaatcgcatacaaacaatcatgcaaaaattaaaccaacaaccggatatttgtccttatttctctccggaatttaaagtgatacctcagtatattataatgaaagagggagagtgcatggaattgaataatagaactaccagtttttttatttttattctttcaggtgaaattacaattagttttgagcagtacactaatcggtccgtgttggaaaatgaaatgttttttctgcctaaaaacaactgttttaaatggaaagctgttacgcaaacagtgttgattcttacaggatacaacgccaccattttcccatgtacgagtgtcagggcaagaattttatataaaataaaggccggcgtgaagttcgattgccgtggagtagtgatgaaggacgaagtcaaagtagtagtgaatcaaatgaagcattatcttgagtccggaataaactgtcatcatatgtacattttgaaacataaagaactgtatctcatgttcaagcacttctatacgtatgaggagataatacagatattttatcttatattaggcagcaatccgctctttaacgaacgggtgttggataattatttaaaagtgaaaaccgttaaagagttagccggtcttttagggtatggcataaagacgtttgaaaagcttttcagagagaattttgatgaatctccttataaatggatgcagaaacggaaggctttgcagatacaacaaagattgatgaatcccgctatctcattgaagcaaatcatgtatgaatttaaatttgcaacctcttcgcattttaatttttattgtaagcaacatttgggtgccgctccgatgcaaataagaaacagcaataaggatgataatatgagtaccttgccttaa

SEQ ID NO: 3478 - DNA, 2313 bp, B.fragilis
acgagcataaaacggaatgaagtactaacgaaatatacataccatactatgtcacatttacctaccttgattgctgaccttgccttaatactgatgtccgcaagtatcattactcttttatttaaatggctgaagcaacccctggtcctgggatatatcgttgccggattgctggccgggccttatgtccgcatcttcccgactgttggcgatatggagaacatcaatacctgggctgagataggagttgtctttttgctttttgctctcggactcgagtttagctttaaaaaattgatgaatgtcggatcggcagcgtttattacggcaacaaccgaagtgatcagtatgttactgatcggttttatggtggggcatctgttggggtggagtacgatgaattctgtgtttctgggtggaatgttgtccatgtcgtctaccacgattattattaaagcctttgatgatcttggtttgcgcagccaacggtttacaggcattgtgttcggaaccttggtggtcgaagacctgatcgctatcctgatgatggtcatcctttctactatggcggtgagcaaagagtttgtgggtgaggaactcttgatgagtgtcctgaaagttgcctttttcctgattttgtggtttctggtcggtatattcatccttccgttcttcctgaaaaaagcaaagcggttgatgaataatgaaactctgttgattgtctctctcgggctttgcctggcaatggtcgtgctggctacccgtaccggtttttcggctgcgctgggtgctttcattatgggatctattcttgctgagacggttgaggccgaacatatagaacacatcatacagccggtgaaagatcttttcggagctattttctttgtatccgtcggtatgctggtcaatccgtctgtcctgcttcagtatgcctggccggtggttatcattacattggtgactcttgtgggtaaatcgattttctcttcattgggggtcttgctatccggcgaaccactgaaggtttccgtcaagtccgggttcagtctggcccagataggagagtttgcttttattatcgcgggattgggagcctcgctcaaggtgctggacccgtttgttcccccgattatcgttgcggtatccgttatcactacctttaccactccctattttatccggttggcaaatccgttttccgaatggctttataaagtactttcccctcggacccgtgaattcctggaccgttacgcttccggcaagaagaccgtcaatcatgatagtgactggaaacggttactgaaaacgattgtcggaagagtgattatttacagtgtcctccttactgctatttggctgttgtccgttcagaccgtatacccgacgataaacggaatgtttgattccccgggacgatggctgagtgtagtgatgtgcctgctcacccttttgctgatgactcctttcttgtgggctcttgtttcagataagtacaattctccggacgtgtttctgaagttgtggaatgacgacaattacaatcacgggaggctggtagcgttgattctgttccgtgtttcggtggctgtttttttcatagcgggagttgtcatcagttattttagtcttaattacgggataggtattgtcatagctgttgccgtgttgggactgatacttcttctcagggagaacctcacccaatattcgcatttggagaaccacttcctgaccaatctgaacggaagggaggaagcagcccggaatcgctatccgctgaagagccgtttcaacagtgagtttagtgataaagatatcgagttgacctccgtttgggtatctccttattcatcttatatagggaagtcgctggaggaacttcctttcaggcgtgagtttggtgtcaatgtagtggggattgtcaggggagaacggaggatatacattccgcaaagtgacgagtgcatttatccgcaggataagttgatcgtggtcggtacagacggccagttacagaagtttcgttcggaactcgacatccggcaggattttccggacgaaaagaatgtgcgacaagaggtgacgcttcactctttcacggtagatgaagaatctccgctcctgaataaaagtattgcccagtcacggttgggaaaacagtatgacagccttatcgttgccattgagcgggaagacgagttgatttccatgaatcaaagtacggttttccgtttgggagatctggtatggatagtgggtgacagggagaagatcagacaactcttgatgcggaaaaagcatgtgtaa

SEQ ID NO: 3479 - DNA, 366 bp, B.fragilis
tatagaataaatatgaaaactctctttttgcaatatcccgcatgcagcacttgccagaaagctaaaaagtggctgacagaaaacaacattgagtatactaaccgccttattgtggacgataatcccacagtagaagaattgaaagcctggattccactaagcggactacccgttaagaagtttttcaacaccagtggtgtagtatataaagagctgaaactcagcagcaagcttcctacaatgactgaagaagaacagatcgcccttttagctaccaatggcaaattagtgaaacgcccgctggtagtgaccgagcgcttcgtattggtaggatttaaacccgaagaatgggaaaaattaaaataa

SEQ ID NO: 3480 - DNA, 207 bp, B.fragilis
tataagataaaatatctgtattatctcctcatacgtatagaagtgcttgaacatgagatacagttctttatgtttcaaaatgtacatatgatgacagtttattccggactcaagataatgcttcatttgattcactactactttgacttcgtccttcatcactactccacggcaatcgaacttcacgccggcctttattttatataa

SEQ ID NO: 3481 - DNA, 834 bp, B.fragilis
gagcttacaaaagccaccaagcaccccattatgttcgggtggttcaatgcctggcaaccggacggagcgggaaaatatccccgcctgtctcttttgccggacagcatggatgttgtttcgatatggggaaactggcactctctgagcgaagaaaaaatcaaagagttgcggagcgtacaggccaaaggaaccaaagtcattatcggctggattatagaagatataggcgaccagataaaatggggacgcgaccaatggcccgccgatgatactcaagccatcaaagagtatgcgcaagccatcgtagacacaatcaacaaatacggctacgacggattcgattatgactatgagccgtcatacgcatcaccgttcaagccgggcaatcattgcggcaatttgacttcttgctcacgcgattataataaagagaaagaaatcttgtttatgaagaccatgcgcgagctgctgggcccggacaaactgtttcatctgaacggctctatccattggctggacccgcgtgcggcacagtatttcgaccgttttgtcgttcaatcttacaacggatcggcttccagttttgagagatggaccaatgatatccaaaaccggttgaatatcaaacccgaacagctcgtatttacggaaagctttcagaacaagcccggtgcacgaagcagattcccaggtacatacgccggttacgtggcttccaaacaaggcaatgtaggaggaatcggagtctttcatattaatgaagacgcatttgaagacgaagcctatgttaacatcagaaaggccatctctatcatgaatcctcccgtaaaataa

SEQ ID NO: 3482 - DNA, 891 bp, B.fragilis
ttcactaaaaagacctatttttgtaggcaaaataaagaacatgatatggaaaaaagaaacccgcttaccctcacgctcgaccagccgtttgtggcagggaccgatgatttttctcccttttacaaccgtttgcataaactcaattgtgccattatcctttattgccgtgccggccgtggtacaatggccatcgatctgaagaaatacgagataacggtaaatacccaggttgtactccttccgggtgctgttatcagccttgatgagaagagcgatgattttcgggtctcctttttcgcttcacatattgaaatgtttcgtgaggcttgtatccgttttgaaccctccttttttcattttataaaagagaagccctgttatacacttccttccgaatttaccgcccccataaacggtctcctgcatgctacgtctgctatttatgccgataccgatcatcgtttccgcaaccagatagcgcgcaatcacctgcaaagtttcctgcttgatgtatacgacaaagtacaccgccttttcacccataaagagattgagggcggcagtcgtccgaacgaactttttcataagttcgttgctctggtgcacgaatattgctgttcgcaacgggatgtcgttttctatgcaggcaaactctgtatttctactaagtacctgacgagcatctgtcgttcgctgacaggtcattcggccaaaaaagtgattgatgattttacggcacttgaaataaaggtactcctccaatcgaccgatctcagtattcaggagatagcagacaggctgaattttcccgaccagtcgtatctgggtaggtattttaagcgacacgaaggggtttcgccgatggagtacagggcggaattggcaggataa

SEQ ID NO: 3483 - DNA, 585 bp, B.fragilis
aattcaaaaaaagtaatcatgttaaagatattggtgacttatgccgtacaaggcgaatttacagaaatcaagtggcccgacgtggaggtatattatgtgcggaccggtattggaaaagtgaaatcggcttttcatttgtccgaggctatccagcaagtgaagcccgatattgtgatcaatcagggaacagccggaactattaatcatcaggtaggggacgtttttgtctgccgtcattttgtcgatcgggatatgcataagatgaccggattgggaatggaataccgtattgattcgtcggaattgcttgctgccaggggcttttgccaacactggaccgaatcggcaacctgcaataccggtgatagcttcctgaccgagctgacggatattgagggagatgtggttgatatggaggcttatgcgcaggcttttgtatgcagagccaaagaaattccttttatttcggttaagtatgtttcggatgtgattggacagaattctgtgaagcactgggaagaccgtttggaagatgcccgtgcaggcttatctcactttttcaatgttttaaaagaaagtatatga

SEQ ID NO: 3484 - DNA, 1185 bp, B.fragilis
cagagaaaaaagaacccaatgatcattcgtaccatactcgatacagacctttataaattcactacttcgtatgcttatatcaaactattcccgtacgcaataggcactttcagcttcaaagacagggacgggactgaatatagcgacgagtttgtggaaagattgagaacggaaatcaatcagctatcacacgtgacactgaccgaaaaagaactggaatatatgataaagaactgccgcttcctgcccagggtctattgggagtggctctcttctttccgtttccaacccgagaaaatagaaatccgtctggacgaaaatcggcagcttcacatcgaagtgaacgactatctttacaaagcaacgctttatgaagtacctctactcgccatcgtttcggagataaagaaccaatcgtccggcaatgttgccaacctggaagacatcctgtacaaactgtccgaaaagacagaactgtccaataagcatcagctacttttctctgaattcggaacccgaaggcgcttttcgttcgatgtgcagaatcaagtcatcgggcacctgaaacagacagcccattactgtatcggcacttccaattgccatttcgccatgaaatacggcatgaagcccatgggtacgcatccccatgaatggttcatgtttcacggagcgcaattcggctataaacatgccaactatatggcccttgaaaattgggtaaatgtatacgatggcgaccttggcatcgccttgtccgacacttatacatctgccatctttctaagcaatctaagccgcaaacaggctaagttgtttgatggcgtgaggtgtgattccggtgatgaattccggttcatcgatcagctgaccgcacgttataaggagttgggcatcgacccgaccaccaagacaatcgtattcagcaacgcactcgacttcggcaaagcactggatatccagaagtattgccggggaaagatccgttgctctttcggcatcgggacaaacctgaccaacgatacgggattcaagccatcaaacattgtcatgaagctatcgcaatgcaagatgaacatgaaccaggagtggcgcgaatgtgtgaaattatcagacgacatagggaaacatatcggcagcccggaagaggtgcgtgcctgtctatacgacttgcggttggagtaa

SEQ ID NO: 3485 - DNA, 687 bp, B.fragilis
aaacagaaaaagattatggaaggtatcaataccccgttcgttattgacgaacatacagcgattgtaatgacagacccacaaaacgattttctgagtgagaacggtttaggttggggagcttttggagagaatatacagaagaacggtacggtagagaacctccgccgcatctttgaggtagcggcagcgaaaggtatgctggtattcatctctccacattattattacaaacacgatcaccaatggctttttgaggggcctatcgagaaactgatgcatgacacgggtatgtttgagcgccggggacaactgaccggtgagggatttgaaggttcgggtgccgactggctggatctctacaagccttatatcaacgaaggcacgaatatcatcgttacagctccgcacaaactttacggtccggaaaacaatgatctgattctgcaactccgtaagcgcggggtcaataaagtagtggtgtgcggcatgtccggcaatctctgtgcagaatcccatttgcgcgagttgcaggaacggggatttgaggcagcggtggtgtttgatgctacggcttctgccaagcttccggggatggatgccgatacggcagcgtttatcaacttcacgttgttggcggaaaaggtgtatacaacggatgaatttgtaaacgagatgcggcagcgataa

SEQ ID NO: 3486 - DNA, 549 bp, B.fragilis
tttatgagaaagattaacgaaattttttatagtttacagggagaggggtatcatacgggtacccctgctgtttttatacgtttctcgggctgtaatctgaaatgtgacttctgtgatacccgacacgaagagggtgaaatgatgacagacgaagatattgtcaatgaaatcgggaagtatccggctgtcatggtgattcttaccggaggagagccttctttgtggattgacgatgcttttatagaccttttgcaccgtgcaggcaagtatgtatgtatcgaaaccaatggtacgaaacccttgcccgctgctattgattgggtgacctgctctcccaagcagggtgtcaatttagctttaaaccggatggatgaagttaaagttgtttacggaggacaaaatattgacgtttatgaacaacttcccgccgaacattttttccttcagccttgttcttgtaataacaccgcagaaacggtggattgcgtgatgcgacatcctaaatggagacttagcctgcaaacgcacaaactgataaatattctatga

SEQ ID NO: 3487 - DNA, 1101 bp, B.fragilis
aagagactgaaaattatgaagaagaagtttactatatttgtcatgctattggccggtatcatttacactggccatgcacaaggcgtacaatggatttatcaacaaaaacaggagaaaaaaaacatgaagaatctgagtgaaatatattttgcaggcggttgtttctggggaacagaccatttcctgaaacagatcagaggagtaaaatcgactcaggtcggatatgccaacggaaacattgctaatccgacttaccaacaggtgtgtacaggaaaaactaattttgcagaaaccgttaaggtggagtataatccacaagaagttcccctaaaactattgatcgaccttttttttaagacaatagatcctacaagtctgaatcgacaaggcaatgacaaaggttcgcaatatcgcatcggtatttattatactgatgaagttgacttgccgactatccggacagccatcgacgaattggctaaagagtattccaaacctatagtcatagaagtgaaacccttatccaatttctacaaagccgaggaatatcatcaggattatctggataagaatcccggaggatactgccatattaaccctgcactattcgagttggcaaaaaaagcaaatgcacaggctgagcagccccagacaaattacaaaaaaccggatgacgccacacttcgtagtaaattgacgcccgagcaatatgcggtcacacaaaagaacgcaaccgaaccagcttttcataacgaatactgggatgaaaaacgagatggcatctacgtagatatcactaccggtgagcctctttttatatcaacagataagtttgattccggctgtggctggcccagtttcaccaaaccgatagaaaaagaagtgataaaagagaagatggatacatcacacggaatgatacgcacagaagtacggagtaaaacgggagatgcacatttaggacatgtcttcacggatggccctaaagaaaaaggaggattacgttattgcatcaacagtgcatccttacgcttcattccaaaagagaaaatgaaagaagaaggatatggagagtacttgaaacttctgcctcaaaaataa

SEQ ID NO: 3488 - DNA, 747 bp, B.fragilis
tatattatgaaagtaggtttatttatcccctgttatatcaatgccatttatccgcaggtaggggtggcatcatataaattactgaagaacttaggggtggatgttgattatcctcttgaccagacctgttgcggacagcccatggcgaacgccggttttcaagatgaatctttaaaaatggctattcgtttcgatgatttattccggaagtacgattacattgtcggtccctctgccagttgtgtggcttttgtgaaagagaatcatcccggcattctggccaaagaaggccatcagtgccagagcgcaggtaagatatatgacctttgcgctttcattcacgatgtgataaaacctacgaaaattcctgcccgctttccccataaagtcagcatccataacagttgtcacggtgtacgtgaacttttcctgtcagctccgagcgaactgaatataccttattttaataaattgcgtgatttacttcagatggtcgaaggaattgaagtttttgagccctcccatgtggacgaatgttgtggtttcggaggtatgtttgcggtcgaggagcaggctgtttcagtctgtatgggacgcgataagatacggcatcacatggagaccggtgccgaatacatcaccggagcggatagctcctgcctgatgcatatgcagggtatcatcgaacgtgagcacctgcctatccgaatgattcatgttgtagaaatattagcatcacaattatga

SEQ ID NO: 3489 - DNA, 1218 bp, B.fragilis
aatactatgaagtccattttgttatctgttatttcattcttgttagtcatgaatgtctgtggtaagaatgatgtggatatgagaacttatttgaaaaaagttctcggtaatcttggtaagatagaatcagcttcctatcatgagcaatctcagtcctggcaacccggcgataccgttgccattaccaattttcatcgttttattaaagaatacaccaatccttctgattcaaccatcggcgcgagctatgtgtgtcttgacgccaaggatacgacgcgatttgaatttggttatgatggaaacgtgaggatgataagttatcatgagcataaagggattatgatcgatgatttcacgaccagatcccttcctttcaggttggtggctcctccgtttttttgttatacccggaatatcatcggatatgctttgagtacgggagatagcatcaccaccgaatggaaggatttaggagaagcgtattacttcaagttggtgatacatgaagacaggcaggttgaattttttggaaaagcgtactacataccgaagcctccttttgatttgggagacccgacctcgatttacgaattgtggattagcaaagcggacggtctgccttataaaatgcgcagggaaatgtcgcatcagatttctgctactacttgttcggatgtagtcttgaatcaattgtcgatagccggtttaaacttatatgattatgtgccccaagactatgagatccgcaagtatggcgagcaaaaaaaggtcactcagcctgcggcgacagatcttataggacagaaagctcccgactggatgttgaaagatatgtatgagaaaccggtggcgttatccgaatttaaaagtaaagtgctattggtgaacctcaccggtatcggttgtggtgcttgccatgcatccattccttttctgaacggattgaaagggaagttcaatgccggtgaatttgaagtggtttctatagaaacctggggacgtgaaccccattcgctgcgaacttatgcggataagaatcaaataaattatagttttttgtgcggtgatgaaggtattgtcaagtcataccggacttatggcgcggcacctttattctttatattagatcaggatcgggtgatcagaaaggtcatccgggggtatcgaatggggcggaccgatgaagaaatcacagatgccattaaagcactgttatga

SEQ ID NO: 3490 - DNA, 1434 bp, B.fragilis
acaagcatgaaaaagttaatcatatcccttgccgctatcctcgccctaagcagttgcggcatctactccaaatacaaacccgtcacgaagattcccgacggactttacggacacgaaggaacagacacccccgggttgacttccgccgatccggaaatccaacgaagtgatactgccgccaacttcggcaacctcagctggcgggaggttttcaccgacccgtatctgcgcgtactgatcgactctgccctcgtgcgcaacaccgatctgcgcactgcccacttacgggtgaaagaggctgaagctaccttgctttccgcacgcctctcctatctgccggctttttcactttctccgcaaggtacggcaagcagcttcgatggcggaaaagctactcagacctattcactgcccgtcagtgccagttgggagatcgatatctttggccgactgaccaatgccaaacgtcgtgcccaagctgtcgtggcccaaagccgagattatgaacaggcggtgcagacccaactgattgccgccgtggccaacaactattttaccttgttgatgctcgacgcccagatcgaaatctccaccgctacggaagctgcctggaaagagagcgtcgccaccacccgtgccatgaaagcagcgggaatggtgaccgaagctgccttgtcgcaaaccgaagctacctattataatatatgtacaactctgctcgatctgcaagagcagctcaaccaagccgagaacgccctttctttgctgctggcggatgtcccccaccgtatcccccgcggacgtctggccgaccaacagctcccggagaatctatcggtaggcgtacccctgcagatactctccaaccggcccgacgtacgcagtgccgaacagtcgctggcacaggcattctacactaccaatgctgcccgttccgccttttacccctcgatcacactgagtggcagtgcgggatggaccaattcggcaggtgccatgattgtcaaccccggtaagtttcttgccacagcagtagcctctcttacccagcccttgtttaaccgcggagcaaacatcgcccaactccgcatagccaaggcgcagcaggaagaggcacgcctcagctttgagcagaccttactcaatgccggaagtgaagtcaacaatgctctggtacaatatcagacggcacgagacaaatcggcctatttcaaccgtcaggtggcctctctggagaatgctgcacgcagcacgcaactactgatgaagcatggtaacacgacttacctggaagtgctcaccgcacagcagacactgcttaatgcgcaactctcccaagtggccaaccgctttaccgaaatccagggagtcatcaccttgtatcaggcattgggagggggcagggaaactgcctccggagaaagaaattcttaa

SEQ ID NO: 3491 - DNA, 963 bp, B.fragilis
aataaaatgaaagacctactggataaaatattccccacattaagcgatgaactgattattgtcatctcgcttatcatcggactacttgttacggcaagccttattctctttctcgtaaagaagatatttccgaaaacaaatatcagcgaactcgctgcacgcacacgctcatggtggatcatggcgggcatgtttatcggtgccgtatttatcagctataacatctcttatttcttccttgcatttctctcttttatcgccttcagagaactttattcggtactgggattcagagaagcggatcgcggagcattgttctggggcatactagccattcccattcaatattaccttgcctacctggcctggtatggagcctttatcatattcattccggtagtcatgttccttgtattgcctttacgactggttttaaagggagacacgcatggaattaccaagtcgatggccctgttgcaatggattctgatgctttcggtattcggtatcagtcaccttgcttatctcctgtcgcttcccgaactaccgggattcagttcaggaggacgaggtctgctgttgttccttgtattccttaccgaaataaatgatgtcatgcagttcatttggggtaaactcttgggacggcataagatacttccgaaaataagtccgaacaaaacatgggaaggttttctgggtggtgtaatcagtaccactgtgattggttactttctcggtttcctgactcccctctccgctcctaatgtcatcctggtaagtgcccttatcgcaattgccggattctcgggagatgtagtcatctccgcgatcaagagagacaaaggaatcaaagatatgggaaacagtattcccggtcatggaggggtgttcgaccggatcgactctctggcctacactgcccccgtattttttcatttagtttattatattgcttattaa

SEQ ID NO: 3492 - DNA, 1332 bp, B.fragilis
aaactgatgaaaacagacttgatatacggtattgaagaccgtccgccttttaaagatgcattatttgcggcattgcagcatctgcttgctatttttgtagctattattactccgccgttgattatcgccagtgccttgaaactggatgtggagaaaaccggtttcttggtttcgatgtctctctttgcttcgggggtatctacttttatccagtgtcgccgttttggacctataggggcaaagttgctttgtattcagggaacaagtttttcgtttatcggtcctatcattgctacgggacttgtcggtggacttcctcttatttttggtgtctgtatggcggctgctcccattgaaatgatcatcagccgcactttcaaatatatgcgtaatattattactccgttggtttcgggtatcgtggtgttgcttatcgggttaagtttgataaaagtaggtattatctcttgtggaggtggttatactgcgatggataatggtacgtttgcttcttgggagaatctttcgattgcaggtgcggttttgctcagcgtgctgttttttaaccgttgcaagaataagtatttgcgcatgagttccattgtgttgggactctgtttgggatacggccttgcttttgttttgggaaaagtagatatgagtgctttgaatgtagagatgctgatgagtttcaatattccccagccttttaaatacggactcgattttaatgtgtcttcttttattgccatcgggctcgtatatatgattacagctatcgaagcaaccggagacgtaacggccaattcgatgatttctggtttgaagatcgagggtgacgactatctcaaacgagtttcgggaggtgtgatggccgatggttttaactcttttctggcaggtatatttaactctttccctaattctatttttgctcagaacaatggaatcattcaattgacaggagtggccagtcggtatgtgggttactatatagctgcaatgttgattcttttggggctatttccgattgtgggagctgttttctcactgatgccggaccctgtgttaggcggagctactttgttaatgttcggaactgtcgcagcagccggaatccgcattgttgcatcacaaaatatcggacggaaggaaacattggtattggctgtcagtctttcattgggacttggagtagaattgatgcccgatgtgttaagccaggctccggaagctattcgtagtatcttttcgtctggcatcacgaccggtggtttgactgctatcatagcgaatatcgtaattcgggtgaaagaggaaaacgaggaataa

SEQ ID NO: 3493 - DNA, 759 bp, B.fragilis
aatatgaagaattacttatttgaggtttgtaccaactctgtagagagttgcattgctgcacaggaaggtggagcaaaccgtgtggaactttgtgccggtatccccgaaggcggaactactccgtcgtatggcgagatagcaatggcacgtgaggtactgacgaccacccggctgcatgtcatcatacgtccgcgcggcggcgattttctttgttctcctgtcgaggtaaagaccatgctgaaggatatagaaatggctcgtcaacttggagccgacggggtggtgtttggctgcctgactacaaatggcgggatagacgtaccggtgatgaaacaattgatggaggcctcgaaaggcttatctgtcactttccatcgggcatttgatgtctgccgtgatgcgtctgaagctttggaacagataattgatctgggatgcgaccgtatcctgacttcggggcaacaggcaacggcggaacttggaatacctttgttgaaggaactccgtgaaagggcgaacggcagaattactctccttgcaggttgtggggtgaacgaaaagaatatctgccggattgcaaaagagaccggtattcaggaattccatttctcggctcgtgaaagcattaagagcggaatggagtataagaatgaggcggtatccatgggaggaactgtccacatcagtgagtatgagcggaacgtgacgacagtgaaacgcgtgaaagatacgattgagagtattacttcttctctttaa

SEQ ID NO: 3494 - DNA, 876 bp, B.fragilis
acgaggcggaacgcctgtatccgtcatgcaatgacttcaacgagtttttgcagaaaatcaagtgcccggcaagcgggcgggaaatgtgaagagccggcaaacggaacatttaaccggccggatttacgaaccgataacaaaacaataatgaaacaggaaaatgacataccggacaagatcctggaacgtatccggaaactgatacgcctgaaggaatcgaccacctcggaaggcgaggccaaagctgccgccacccatgtgaaccggcttctgaaggaatataacctttccctgcttgacgtgaacgaaaagcggccggagacggtgtttgaaatcagggaatccggagcgatcagttataaggacagcttcggcaactactggaagcgtgacctgctgcgcgtattgtgcgaatacaattactgccggatgctccgttaccggggaaccaccgacatgctgattgtgggtacgcaggagaatattgcagccgtaaccgtgctgtatgattatctacgcaccactttccgccggctggcagataaaaggcacatggaatatgtatcgatcaaacggggatattaccgtaccgagaagtacaggaagaagtatatacgttcgtacctcgaaggcgtgacaccgggactaagagaccagtttgaagcgatgcgaagcacttcggcggaagaagtgcgtgaaaccgctctggtacattgccataacgctcttatcgagagatacctggaaacaatcgggacgtgcagtgccaaagtacagcccagaaagacaaagacggactattcggcttaccactccggaatggatgacggacggagtatcagcctgcaccggcaaataaacggaggaaatgtatga

SEQ ID NO: 3495 - DNA, 603 bp, B.fragilis
agtgcagggaaaggaggaaaacaaatgagtagtaaagaagacatattagcgagtatccgtaaaaatacgaagaaccgctacgaatatcccgattggcagatcaatgcaactgtttatccggacgtggttgccaaattctgtgaaatgagttttgccgtcggtggtgaggctattgtgctcggtgagggagaagatatcaatgctgtcattcgccgtacttaccctgatgccggcagcattgcttccgatttggaggaaatcacgtgtgctacgttcaatcctgatttgttaggtcgtgcgcaggatctgaacggaaccgatatagccgttgtcaaaggtgaaatcggagtagccgagaatgcggctgtctggattcctcagacagtgaaatacaaggcactctattttattgccgagaagctggtgattgttctggacaaaaatcgtattgtgagcaatatgcatcaggcttacgaacggataaaagatgaaaaatataaattcggtacatttatctcgggaccctcaaagactgccgacattgaacaggcattggtgatgggagctcatggagcgagagatgtattggtaatattaaagtaa

SEQ ID NO: 3496 - DNA, 498 bp, B.fragilis
atggctattgaaaatacagagggctatcctcttatttcatggagagaaataataattaaaactaaatatatgaatacccaacgtcaaaccggtacctgccgctctctttcggggcatgcacagcggcatgggcgcgaagtccgtccctcttatgagatcagcacttcgcaattttctgatatgaaagtcaggagactgactcgtaattacggattcggtggatacagcatctaccgttatctggtgagtgaggccctctacaagggggagtatttccttccttggtgtgaggagaccgcgcgtgcggttgcctcttactggaatgcctctttggaagacattacccggatcgtggacggttgcgtacaggtcggcctgttcaatgacgaactgtacaggaagcacagagtattgacttctgccgccatccagcaggactacctcaagttatgcggcatggcctacatccaggaggagttcgctctttcggccagttga

SEQ ID NO: 3497 - DNA, 1518 bp, B.fragilis
aaacaatcagatatgataaacaagaaacatatatctttactcaccttggtgatattcctttcgctgagtcattttgccgtttcggcttcggcgcagccatccgttgtggaggtgccttctgtttcggtgcaaccctctgtcgacagcttgtcccactatctggaacaggcggcacgcagtaatccgcaagtcaatgccgacttcatgctctataaagcctctttggagaagatccctcaggccggtgcttttgccgatcccgaattggaaatcggttttttcgttaaacctatggagacgctgatgggaaagcagatagccgactttacgttgatgcagatgtttccttggttcggcactcgcaaggccgcccgcagtgaagcttctgagatggcacgtatggcttacgaacaatttcgtgatacacgtaataatctctggtatgaggttaaggcccagtggtatcagcttagtagcctcaacgagcaatatcacattacggaagctaatatccgtcttctttatcaactcgagcagttggcactgaaccgcttttccgcttcgtcggcacaggcagctccctcgtcgacttctgtaacgtcagttgcttcgatgccgcctgcactttcttcggggagtggcatgtccggtatgggaggaatgggcagcccggcgcctgcgggtactccaggtgtttctgccggcagctcttccggtagagacatgtccggcatgggaggcggatcaatgggaaacgttgttgttggtggtatgtccgatgttctccgcattcaaatggagcgtgccggattggaggataaccttgccagtttactttctgcccggctgaccgttcaagcccggtttaacgccctgctcaaccgtccgtccgatgcttctgtctgtgtacccgattctctgacacaacgcttctaccggatagacggacagctcctgctcgacagcatcttcacccgtaatcccatgcttgccatgctcgaggcagagggagaagcctatcgtgccaaggcaaagatggaccgtcgcatgagttatcctatgatcggtatcggtctgcaatactctgtggtcaataaagtggccgatccgatgggaatgcccgatatgaacggcaaggacatggtgatgccgatggtcaaggtaagtcttccgctgttccgccggaaatacaatgcccggcagcgggagagccataactaccggatggcaagcgaactgaaacgtgacaatgtacagaaccagttgcaggctgaatacattaacgttcgccagcagctcgacgatgccgcccgtaaggtgtcactttacgaacggcagtatgccctctctctttctacctggcagttgatggtgcgtgaatttaccgccgggcgtcaatcgctgaccgatgtgattcaggtggagcgtcagatgctcgattataaactgaaaaagagtgaggccgtagccgcttataatactacggtggcagccatagaaaagctgatagccgactga

SEQ ID NO: 3498 - DNA, 183 bp, B.fragilis
cgaccgtcagagagacccttcccataccggaaagatcgtgaatggccgccaccttctttactttatttgcaaacatacacttatatcaatcaaaaccaatattcatccaagcaacccgcagtcgcatctcctctgacactgcttcgttactttaatattaccaatacatctctcgctccatga

SEQ ID NO: 3499 - DNA, 237 bp, B.fragilis
agaataacagaatcagaatccgacagtcttcgattcgtctatcggattcacataaaaacaatcagatatgataaacaagaaacatatatctttactcaccttggtgatattcctttcgctgagtcattttgccgtttcggcttcggcgcagccatccgttgtggaggtgccttctgtttcggtgcaaccctctgtcgacagcttgtcccactatctggaacaggcggcacgcagtaa

SEQ ID NO: 3500 - DNA, 387 bp, B.fragilis
aattcgaaagacaccatgaataaaagttttttctatgcgatatgttttgtcgtaatactggtagttgagattattattggtatatatgttcgtgatagctttgtacgtccttatatgggtgacgcactggttgttgtgttgatttattgttttatacggatttttattccgaacggtttgtcacaattacctttgtatgtgcttgcttttgcctgtttcatagagatacttcaatattttcagttggtggatgtgttgggaatatcgaatcgtatactccgtatagcccttggttctactttcgatttgaaagatatggtcagttatgccggcggatatgtatttattctactggcagaatattttttagataagaaaagaaaataa

SEQ ID NO: 3501 - DNA, 243 bp, B.fragilis
aacaatagagaaaggaataaatacatctccatctaccggattcttccactgaattcttccaataaacttatcggattctatattcaaaataagattgcgaatgtaccgttttttacagaagctccgattcaatatccaagggtagccggatgtaattgtgcgatagtgaactgcctttgtgcgtgtccgcacaatagcaaaagagtgttcaggaatatattgtattatataatagccatttag

SEQ ID NO: 3502 - DNA, 1122 bp, B.fragilis
caaatccgggacggttatgatcggacgatcgtcgaatttttacggttaaatttccatccggtagccattcgggagggatacctcctgataaatgactatctttgcggatctttattggacttcatgatggacaaaacgaaaaaagtcagatatgtattctctgttttcatggtgatgctgatggtgggcatagccgaatggacaggcgagaaagagattatctttccggagatggcggcgctcgccgtcggcttgtgggtgatcgataagcgggtttggaaagtcgggcgttggcagctgatcgggctgatgacagcaggggctgttgccggagtttgtatcgtgcgctactccacgctgccgttgctctgcaatttatgtctggcatttgcctttgccgcctgttgcctgctgttcagccgggctactctgattccgctgatttcggcttgtatgctgccggtgctgctgcacactgagacctggatctatccgtcggccgttttcctgctttccgccgtgcttgttgccggacagaggctgatggaaaaaggaggtttgcgccgggagacggattacgtcctgcccgggcgtgagtggaaaaaggagattttccgttgggcggctctgctcttttgggtttcactggtagctgccctttctatctcctgcggatgcagttatttcattattcctccgttgatcgtgacattcacggagattgtcaattcgaaggccggattcagaaaccgccccatgcaggtgtttctgtttttggttaccggagctgccttggggaccgcttttcagattatcgggcatacctttttgcatttgcccgaaacggtggtcgccttgctcatcatctgctgcttgtttgctgtcttcgagtggaccggaaagtactttgctcccgccggagcattggcgttgatccctctgatagtcccgcaagagggtgtgcattggctgcctctgcaagctgctgcgggcgctgccctgttcatcgctatcggtatgcttgtgttccagcaatgctacaagtggagtaaagcccagttgatcttctgctttactcccacattgttgcgcagatatctgaaccgcaggaggaaggagtga

SEQ ID NO: 3503 - DNA, 417 bp, B.fragilis
gagtcgggggaggtaaaggaagtcccccggataactattttcactataaatgactattttccgccgaaaagtttttgtaatatcagagttaatcgtatttttgtgtacaattttggtgtagtgatgacagaagaagaaaagaagctattaagtacctttgaagcaaggctgcggcatttaatctatctgcacgatgaattaaagcgcgaaaatgctgagttaaagcaacttctcgaagaagagaagtccgaactcgaaaaggcgagagctgaatacaaagcgttagaatcaagctacacagacctaaaaacagctacgacaatcagccttaacggcagcgacgtaaaagagacgaagctgcgattgtccaaattagtgcgtgaagtcgataaatgcatcgctttgttgaatgaataa

SEQ ID NO: 3504 - DNA, 1173 bp, B.fragilis
gggatgaaactatcggattacatacggggattccgcaaggggaaagaagcacatcgattggagaaagaagcgatgcgtgatccttttttggccgatgcgttggaagggtatagccgggtggagagtggagccgatgagcaaatagagttgttgcgtcgccgggtgaatatgcgcgtaacgcaaaaacgcaggcataccattgcttggagtgtggctgccagccttctgatcggagtttgtatcggttcttatttcctgcttcaggagaatactttaccggatgaagcacggatagcaatggaagaagtatctcacttggaacctttgtctgtacaaaaggaagaaaagaaagaggatttggtggcgacggtgagaaaagattccgcaactattcagaagggattgataaccgggaatagagagaaaaaagttgttgtatctccccacacagaggtgcctcaggccatgacacaggaatggatcgatgaggcattggaaaccactattgccgaagagcctttggctgctaccacaagttcggctatgaaatctattccagctaatgacagcagccttactgctcaggtagcggttgggggtaaagtacatggcagagtgacagactccagcggttatcctattgtcggtgctaccgttaagctgaaagggactaatcagggaactatctccgacgtaaatggtaattttgtattgaagacaggtggaaatcgggaacttgcagtcgattatattggttatgaatccgttacacttccggctgatacgactaaaagcttattaatagcgatgaacgaagatcaagctacgcttgatgaggtggtagtggtagggtatggttcgcagtcgaaagggagtataacgggagctgtagcgagtctgaaaatgtccggtactccccaacctaccataggtagaaaggcatttcggaagtatctgaaagagagtctggttcatccgtctgataaagactgtgcgcgtgccaagggaaaagttattcttacttttcgggtagataaggaaggacgtccacaagacattactgttaaaaagggactttgtgcttcggctgatgaggaagccattcgcttgatcgaggaaggacctgactggacaatgggtgaggaaccggtagaaatcagtatccgtttttga

SEQ ID NO: 3505 - DNA, 936 bp, B.fragilis
acatttccttgctttgcagcagaaatcaagtttagtatggcaaaacaacaattcaataaactaatctggctggtggatactatcttccggaatgctcctgtgacatttgccgaaatcaatcgtcgttggagagcgggagatgataatcgttctgatatacctttgcggactttccataaccatcgacaggccattgaagaaatgttcgacataaacattgaatgtgataaacggaacaatacctattatatagcagacgccgaaggaatgttgggtgataagttgaagatgtggttactgaatagtttttcgttgaacaatgtattgcaggaaaatgtggatatgaagaaccggattgtatttgaggaagtaccttcgggagtgcaattcatggatcttgttattgatgctatgcgtagcggacgcgtgcttgctatggaatatcaggcgtacaactgggaacactccaaagatgtgttacttgagccttatttcgtgaaattattccgccatcgctggtatttgataggaataaaccgggaatataaagcttttcgttcttattctctcgatcggatcaagagaatcgctctttcggaagagacattcaatttcccacgtaagtttactcctcaggatcatttcagagatagttttggtattattcgtgatgaaaatctgcttcctcagcacactgtcctcaggaccactatttcacaggctccatacctgagaaatcttcctttacattccagtcaaaaggagattgccgttacagagagttatgttgattttgaactttatatttcgcatacttatgattttattcaggagttattatccaaaggagcggcagtggaggtgttgaagccccagtcgctgcgggataagataaaagccgagatacaaaacatgcaaactctttaccgcttatga

SEQ ID NO: 3506 - DNA, 1659 bp, B.fragilis
aatagtaattgtatgaaaaagatatcagatattcttcgtaagaagcaagtactttatcccctgattgcccttgccggctttgtgctgggttggcttttgttcagcccttcatcttctccggagtctgccgggggaacacatgctgaagctcataaccatgatatgcatggaacgtctcatgatctggtgcaggacgaatccggtgtctggacctgctccatgcatccgcagattcgtcaggacaaacccggcaaatgccctatctgcggtatggacctgatccctcttaagaagaacgttatttctggaggtgatgctgtttccgatcccgatgccatccggctctctgatgaggccatggctctcgccgatgttcagactacccgtgtcagtcgcagtaaccccgtgaagcaagtccggctgtacggtaagattattccggacgaacgtagtctgcagtcgcagacagcttatgtcggcggacgtattgaacggcttgacatcgagttcaccggcgagaccgtacgtgccgggcagacacttgctactctttattcgcctgaacttttcaccgcccagcaggaattgctcgaagcggtccgtatgcagcaacccgctcttgtgcaggctgcccgcgagaaactccgcctttggaacttgacggatgcccagatcgacgctatccaatattccggccaggcgtctcctatggtagagattaaatccaacacgaatgggatcgtcattgccaagcgggttaaccggggcgactatgtttcacaggggagcattcttttcgatattgccaacctctcccgtgtgtgggccatgttcgacgcttttgaggtggatttaccttttcttgccaaaggtgaccgggtggagtttactctttctgcctttcccggaaagacgtattccgggcgtatttcattcatcgatcccattcttaatgccactacgcgcacggcccgggtccgcgtggatgtagccaatcccactctggagatgaagcccgaaatgtatgctactgcccaggttgctgcccctctaaaggggtataaagaccggattgttgttccgcaaacggctgtcctctggactggcaagcgtgctgtggtctatgtgcgcctgcccgatacggatactcccaccttccggatgcgtgaagtcacccttggccccgctcttggcggagcctatgtggttctcgacggactttccgatggtgaggagattgtgaccaacggagtcttctccatcgatgccagtgcacaactcgaaggcaaacgctcaatgatgaacgaagatactccgggaactgctcccatgaccggacaccaaggacacagcatgtccggtatgtctggcagtcatgctgtctctcaggaaagtgaacacgtactgtttgccgtccgtggttcttgcgatatgtgcaaggaacgcatcgaaacagccgctaaaggtgtctccggtgtccggtccgctcattgggaccgggagaaacaaatgatccacctgcaactcgacccgtcagaaacatcggccgacgccgttgccaaagccattgccgcagcggggcatgatacggataagtacaaggccgtcaaagcagtttacgatgctctgcccggctgctgcaaatatcgggatgagtaa

SEQ ID NO: 3507 - DNA, 1185 bp, B.fragilis
aacatgaaatgtaacgtatcttacaaatatctgtttattgcgatcggcatactttgcccgctcttttccgcctgtgactatgccgacggagaaggttcaggctcggaaaacgcagtatacatggaaacacccgataataaaggcatcgtcaacttcactttagagcccgatggcggaataacctatctgacaccccggctggccaatatcagccaaaacccggtgactatacaagtgggttatgacaaagaggccttggataaatacaacaaggacaacggggcctcgtatgaaccccttcccccctccgcttttaaactggcagatgcagagggaaacgagctatccgcctccgaaggcatacgagtacccgccggtgacttttcagcaaaaataatggtgaaagtaggacaactgaattccaaggatttccccgccaataagaaatatgcaattcctcttagtatcacgggggcttccaactattcgctgattccctcacaacgcagcgcgatcttgctcctgaatcgttccatcctttcgtcggtagccaaagtcagcggtggagaaggcatccggataaaacctgtcggaatgcacacaaaggccgaatggaccattcaaatgagcgccatctattccagcctgacccgaagcaacctgaccacagcctatctaagcaacggaacaggaggagcattctatacccgcatttcatctactgccggcatacaagtgaaaaacggacgcgacggggacgacacatggactcaaatacccctgcaagcgggtaaatggctgcatatcacctatgtgcacaaggataagaaaacgacagtctatgtcaacggaaaagtccagaaggtatttgagaacagtgccatcacctttggcgagaacagcatgatcgtagtcggaaactccggttaccgtaacgactatctccgcgagatacgtttatgggacaaggcgctgacagagtcggaaatcaacgattacttatacctcccgatggaccctgcaaccccgcatctcatttcgtatctgccactgagcaaagagatggagaccaaagacctgaaagctcccgccggtacggagaatgtaaccacgaaagcccgcattgaatatgtggaaaacgttaaattcccggcagatgaattagtaattgtaaatcaagaataa

SEQ ID NO: 3508 - DNA, 1536 bp, B.fragilis
aaagaaagatgtaattttgcatgccaaaaaataacttatcttatggcagtttacgtagaagaagtttcaagaactttcggtgaatatctacttattcccggtcttaccaccaaacagtgtgtaccctccaatgtctctttgcgcaccccgctggtgaaacatgcggcaggcacacaagcagcaatcgaattgaacatccctttcgtttcggcaatcatgcaatcggtttccggtcccgaactggccatcgagttggcgcgtaacggaggactctcgtttatcttcggttcgcaacccatcgccagtcaggcggaaatggtgcggaaagtgaagaaatttaaagccggttttgtgaccagtgattcgaatctgactccggaacatacgttggaagacgtactccgcctgttgcgccagaccggtcactctactatcggaataacggatgacggttcgccaaacggacatcttctgggattggtaaccagccgtgactatcgtatctccagagacccgctggataaaaagatcaaagacttcatgactccttttgagaagctgattgtgggtgaagtgggattgacactgagcgaggccaaccagattatctgggatcataaactcaatacacttcctattatcgacaaagaaggacgtctggcttactttgttttccgcaaggactacgacagccacaaggagaatccgaacgaggtgtcgagtcccgacaagaaattgttggtaggtgccggtatcaatacccgtgactatcaggagcgtgtccctgccttggtagaagccggagtagatgtgctctgtatcgattcttcggatggttattcggaatggcagtatgagaccctgcaatggatcaagcaacaatatggagataaagtgctggtaggtgccggtaatgtggtagataaagaaggtttcctctatctggcagaggctggtgccgactttgtgaaggtgggtatcggaggtggatctatctgtatcacccgtgagcagaaaggtatcggacgtggacaggcgactgccctgcaagatgtggctcgtgcccgcgacgaatatcaggcacggacgggtatttatgtacctatttgtagtgatggcggattggtgcacgactatcacatggtgcttgcccttgccatgggagccgatttcctgatgatgggtcgttatttcgcacgttttgacgaatcgcctaccaagaagctctgcatcaagaacaactacgtgaaagagtattggggcgaaggttcaaatcgtgcccagaactggcaacgttacgatatgggtggaactgaatcgcttaagtttgaagaaggtgtagacagttacgtgccttatgccggcaagatgaaagacaacctggcggccactctgagtaagatcaaggctacgatgtgcagttgcggtgctgttaccattcccgatttgcaacaaaatgccaagatcacgctggtttcatccacaagtatcgtagagggtggtgcacacgatgtgatcctgaaagaaaaaggataa

SEQ ID NO: 3509 - DNA, 333 bp, B.fragilis
gccgatttgtgttacctttgcgggagaactaaaataaatcgggccatgttcgtattaatattgacttataaagcacctatcgaaaaggtgatcgaattgctggaagcacactgttgctatctggataagtattatgctgccggaatctttcttgcttccgggccgcaggtgccccggacggggggagttattctttgccgtgctcagagccgtgcagaagtagaaaagataatcggtgaggacccttttaatgctgtggcagactatcgggtgatagagtttgaaccgaataagtcggtagaaggattcaaggaacttttaaaaataggttga

SEQ ID NO: 3510 - DNA, 1308 bp, B.fragilis
gataaaagccgagatacaaaacatgcaaactctttaccgcttatgaatgcaaatgttctcgaaaaattgaagatactggcagaatcggccaagtacgatgtttcctgcgcctcaagtggcacggtgcgtgccaacaagcccggtacattaggtaatacggtgggtggatggggtatttgccatagttttgcggaagacggacgttgcatttcgttactgaaagtgatgcttaccaattattgcatatacgattgtgcctattgtattaaccggagaagtaatgacttgcccagggctacgttatctgtgtccgaactggtagacttgacgattgagttttatcgtcgaaattacattgaagggttgtttttgagttccggtgtggtgcgaaatcccgattatacaatggagcgtttggtacgtgtggcgaaagatctgcgtgaagtgcaccgctttaacgggtacattcatttgaaaagtattccgggagccagccgggaattggtgaacgaagccgggcgttatgctgaccggcttagtgtgaacgtggagatccccaaagaagagaacttgaaactgctggctcctgaaaaagatcataaaagtgtatttgcaccgatgctttatattcaacagggcgtactggaaagtagtgaagaacgaaaaaagttccggtatgcgccccgctttgctcctgcgggtcagagtacacagatgattgtcggtgctacggctgaaagtgataaggatattctctttctttcttccgccctttaccagcgtcccacgatgaagcgtgtctattattccggttacgtatcagtaaatacatacgatactcgtttacctgcacttaaacagcctcctttggtacgtgagaatcgtctttatcaggcagattggctgatgcgattctatcagttcaaagtcaatgaaattgtggatgacacctatcctgatcttgatctggaaatagatcccaagttgtcgtgggcgttacgtcatcccgagcagtttcctgttgatatcaacaaggcggattatgaaatgatacttcgtattccgggaattggggtaaagtcggcaaaattaattatagcttcccgtcgttattcgaagttgggatattatcaacttaaaaaaataggtgtggttatgaaaaaagcacaatattttattacttgcagcgaattacccatgcggactgtaaatgaaatgactccacagaccgtacgtagcttgttactgcccaaatctgctaagaaaaagacggatgaaaatcagttatcatttgtttttaacgattga

SEQ ID NO: 3511 - DNA, 249 bp, B.fragilis
ttcccttcacgcgtccaccattttaccgacctccgtccggtactcccaacgtcaccggaatatgtctccccattcagttcccgccgatattccgccaaccgttcagtcacaaaaaataatattaacaggcggttcaaacagatgccttatcagtttgctataaaagaagttgccggcatcacaaaaataaaaacaatcgtttcaatctttcataaaactaaaaagaggtctcttttttttatctattaa

SEQ ID NO: 3512 - DNA, 741 bp, B.fragilis
ttacttttgcgccttaataaaaaaacattcaacatgagaaggactgctattgctcttttttgcctgtttttgttatctgttggcatcggattaagggcacaaaacattcagttgcactatgatttcggacgttctttgtatgataaagatttaaaggaccgtcctgtattaacctctaccgtagagaagtttcatcctgataagtggggtagtacttatttctttgtggacatggactatacttctgacggagtagcggctgcttattgggaaatagcccgtgaattgaaattctggaagaatccgttctcggtacatgtggagtataatggaggtcttgccaaaggtttttcttatcagaacgcttatttggggggagttacctatacttataataatactgctttctcgcgtggcttttcattgtcggccatgtataagtatattcagaaacaccattctcccaataactttcagctgaccggaacctggtatatgaatttcagcaataacttgctcactttttccggctttgctgactggtggcgtgaggagactgcttatgggaagactatttttcttaccgagccccagttttgggtgaatctgaaccgtataaaaggtatcagtgataaatttaagttgagtgtgggctcagaagttgagctgagtaataattttggtggacgcgatggtttttatgtcatccctacactggcactgaaatggacaataaactaa

SEQ ID NO: 3513 - DNA, 2112 bp, B.fragilis
aaacaatcgcgtatgaaacaaaagaaaatgctttcactcacactttcccaaatacggcaactatactgtcaggagttacctgaactcacagcaatggctcaacaaagtcttgacgacaccgactttaaaaaccacctgcaagagttcctcactccttacatatccggagggaacaaagcgggtgagcaaattcgactccttatcagctacgacggaaagacagttcatgagctgtctaacgaacaggatatgcaaatacagaccttatcccttctccgacgcttcttgaccgggaatttggaaaatgctgaaatacctactgacttattcctggacctatactatctctttaaaaggctggaagagccggaatccccactcccctctccacaacgaattaaaaaccgaaccgaacgctgggccaccggactggacgaagatgtgatagagttacgttccgagaatcaggaacggatgctgcatctactgatacaaaaaatagaaaaccggaaatccaaaccatcttcacgttttcactttgaagaaggaatgagttatgaagagaaatatcaacaggtctgtcagtggtggaacgactttcgcttccatctttcaatggccatcaaaactcctaccgagttgaaccgttttctcgggaactccctttccagcgaaacaatgtatttgttgtcacgggcccgcaaaaaaggaatgcctttttttgccactccttactatctttctttactcaataccagtggagaagggtataatgatgaagccatccgcagctacattctttactccccccgtctggtagaaacctatggtaacattcgtgcctgggaacgtgaagacattgtagaagtcggtaaaccgaacgccgccggatggttattgccggatggacataacattcaccgtcgttatccggaagtagctatcttgatccccgatacaatgggacgggcttgtggaggattgtgcgcttcatgtcaacgcatgtacgacttccagagcgaacgattgaatttcgagttcgacgcacttcgtcctaaagaaagctgggacaaaaagctacgcagattaatgtcttattttgaagaagatacccaattacgagatatattgattaccggaggagatgctctgatgagtcagaacaaaaccctgaaaaatattcttgaggctgtttaccgcatggccgcacgtaaaagaaaagcaaatcaggaacgcccggaaggagaaaaatacgcagaattgcaacgtgtccgtctgggatcaagattattagcttacctacctatgcgtattaacgatgaattgatagagatcctaagagaatttaaagaaaaggcttctgtcatcggagtgaaacaatttattattcaaactcacttgcaaagtcctttagaggttactccctacacccgggaagctatccggaaaatcctttctgccggatggctgattacgaatcagctggtatataccgtagctgcatcccgacggggacacaccacaagactgagacaagtactcaattcgctgggagtagtttgttattataccttctccgtcaaaggattcaatgaaaattatgccgtattcactcccaacagccgatcgatgcaggagcaacatgaagaaaaagcatttggcaagttgacgcaggaacaggctgacgaactgtactctcttcttgaaacaggtgaggacatcgctactcgaatacgtcatttcatgaagaaacatcatttacccttcatggcaacagaccgaagtgtacttaatctgcccgctatcggcaagagcatgacattcaacctagtgggaataacagaggaaggcagacgtatccttcgtttcgaccatgacagcacccgccgtcatagctctatcattgacaaactgggaaaaatatatatcgtagaaaataaatcactcgcagcttatctaaggcaattaagcaaaatgggggaagatccggaagattatgccagcatttggagctatacggaaggagaaacagaacctcgcttcaagttgtatgaataccctgaatttgaattccacacaacagaacggatgagcaatctggaagtattataa

SEQ ID NO: 3514 - DNA, 405 bp, B.fragilis
ttttcattcagcgagaaaagttatttttcctatttttgccgaatgaaaactatctgtattatattaggtaccatttcgctggggctcggcattcttggcatttttctgccattattgcccactaccccgtttctgctactcactgccgccctctatttcaagggatctccccggttataccagtggcttctgaatcacaaatactttggtacttatatacgcaactttcgggaaaataaagcgatcccgttacgcgccaaaatcatctcactgctgctcatgtggggcacaatgctttattgcattttcttcctgatcccgttggtctgggtcaagatactcctcttcctgatagccgcaggcgtaacttatcatatactttcttttaaaacattgaaaaagtga

SEQ ID NO: 3515 - DNA, 1215 bp, B.fragilis
aaaaatcacagaatgaaagttaaaaaaatcttattatcaatgtgtgcgatagcggcattggcaagttgttcgcagaatgatgacgtggctgttcctacggacagtgctccgccggctaaagtgaccatccgttttgcaggaagcgaaggcatgacaagagctatcggaagtgaggatgcagtggttaataacctgactgcgtttttctttaacacggcaggtgcacttatcaaggccccgatgcctgtggctgggaacgacttaaagcctgaaataacgcttgccaccactacggatgcctctcaggtggttttggttgccaatgtaccggccggtactgctttcgccggtgtaactagtctttctaagttgaaagaatttgtggtttcttctctgggtacggaggcgagtagcaattttccgatcaaccagacaaaaactaacctgacgatgagcggttggggagctattaatatgaatgctgataataatacaggcactgccaacgtaaaattgcattttatggctgcaaagatcgaaacgctgaaagttactatcggtggcaagaacgtagggcactatgcagacactgaagatggagttacagatgacaaatggtttactatcaaacaggcttacctgatgatggcacagaccaattctgttcttttacccgctaccgaccttggtgcatggacaggtgcattcactcctgcaaccttcgcttatgccggcggtttggcatggggcacgaggccatgggagaatcctcctgtaaaccctgatcctgtcaaggcaaccgattatttgcaaaccactatccctgccggtgctacaagcaatgtcatagataatattcttgtatccgccccttggtatgtgtttgaaaatgcttctccaaatgcaaccggagtagtccttgaagttgtatgtaatgtcagaaaagataataatactctggagaaagaatccagatactttacaatgtattttggagagaagaaaaccggagactcagggaatcagcctattctcaacgcaggacagaggtattctatcaacatagccctgaatggcagtttcgatccgggagacggaaccggtggtggtggtacgacagatccgaccaagcccagtgtagatgccaatgttgaaataaccgtagctcctgccgaatggacagctgttgctgtaatcaataaagaattcaactaa

SEQ ID NO: 3516 - DNA, 2334 bp, B.fragilis
agaaaaaacagtaatagaaccatgatcaagcattacttgaaagtagcattacgcaatttgatgaactttaaagttcatagtcttatttcggctatttgtttagcgataggtatcacctgcttcagtatgatgaattattttattgatgccataacgggtaaagtagaactgtccgataataataaatacagcatccggttgtccggagcatcttcccagacagccgccgatatctatttgtttaaggaggattttgattatctgaaagagttgccgatagcgggcatagatacccttgtggcttcttcctcttatagcaatggaaaagagattacggccatcgacaaaaaacaacgggaactgccgtttttggtgtcgttccaaaatgtatcatccaattatttcacctataattcgctccaattgaagtatggcaatcaagagataacagctcccgacgaggtgatcgtctcccgatcgtttgcccggaaagcatttggagaagaaaatccgataggccaggtcatccgtcaggaaacagaggctgccaacccgtctgatcttatggtgtataaaattgtcaatgttgctttgacagaagaaaaagattttcatgggaaaacgatcgattgttattttcccttgtccgcaaaatcccgtactccgctctgcatcagatcacgtctcaccggacaaaccacgaccgaaagcctgaataaacagttaaaaggcctgacctggaagcatggagaccaggatatctatttatatgcctccctggagtcggaacagaatagcagtgttcaaagaacgataagcattctgctcgcccggtttatagcttcgctgatcttattgtctggtttgatcaattttctgaagttcattatccagatgttctataaccggcaacgagaactggtgcttcgcaaatgtatcggttcggacatcaaaggattgtttgccttgcttttcgccgaaatcttctggatgctatctgttgctttccttctgtccttggccgtgacggaaatcacgctctctctggtatatacgtatatccgtccggaagacatgatctcattctccctggtagacttgtatggttcacagttaggtttgtaccttgctttgttgttgatctgcatgctcgccattctttatcctatctatcggttacgccggttgagtgtcctccattcggtcgtgcagagacagaagcggcacgtgttccgcaatttcatgattgctctacaattggcgatctccatccttttcacaggcggtgtattcggcataacgcttttgttcaatgagatgtttgaaggaatgtaccgtcctttgagcacggaagaagagaaccgggtgatttcaatatcggtcaataccatatgcatgcagaaaaacatggatgccattctttcggatatccagtctttgtccgagataaccgatcggacatccgccttcaataccttcgatgccgatgtttatacttacatgacctatatgaaagacggaaagccgagaggaaatgtgatgatgatccaagcagagcctcattattttgagttcttcaagatcccgttctccggaaaattagtagataaggatgctcaaggctttgtttatataagcgaacagtttaaagaacaattgcaaagggatagtatagcaggtagtgtcacgctggatggcaaagaataccggattgccgggacttaccgtgcactgaacagggaagatactcagagcagttcagtcggttctgtctttctagttaacccgcaagcctacacctattacttcaaaactctccattccgatattactccggtcgccctggaaaagataacggagatctgccggcgttatgtacccgagacattgcctcttaacattcgtaatacgggtgattccaaacagtccgtcatgggaactgtagcactcttgcagacagcatccctgttgttggcgatagtcagtatcctcctgttgatattaagtatttattccggaatctccatggatgtgataaatcggcaaaaagaagtggccatccgaaaaataaacggagccaccccgagagtgattgccctgttattcggcaaaatctatttgattatttatctttctgtcttcgtcattatctatccgctggtacgattggtgttgataagcatcacacaaaaaagcaatctgcaaagcatatatagttggagctggggagtcctgttgttcttcacgatggctcttttgatctttttggttacggcatacaagatttataaagtaatgcacctgaatccggcaagcgtcttgaaaaaggaataa

SEQ ID NO: 3517 - DNA, 951 bp, B.fragilis
cagcctggcagacaggagggaccggatcgtccacattacaataaacgttctcataacacgcaggttgtgcaggagatggcgacagctatatccgcgcaatctgtcacatcaagaaagaaaggggcgatgaaacggactatcctcatcttattgggctggatgctgctctcgcaaggatgcagctatggtgtgggcgacgactgcctcccacctgaagaacctgtacccatacggatggcgattgcagaaggaaagctctccacgcgggcacctgtcacaacgatcgatgcaagcaatctgtcgaatgtcggcatttacgcagtcagcgaagggagcatagccgggcaatatccctggacatccactcctttcgccctgaatctggtaccgagcggcatcagcggcagccagctctctttcaaccccaaactctattatccattgggagggaaacgggtcattttctacagttattatccgcgcacgacagccacaagcggcagcaattacatcacggctccgggcaacggtgtcgctcctgcctatcatttcacgctgacgggagcagaagacatcatgtatgccgcaggcactcccacaggaagtaccagcaccatgcccgtcagcctgacattcaaccatgtgttgacccaactccagctgaacacttccctattgggcgcactgtccagcatcaagctgctgggtgtgtacaataaaggtacgctcgacattggcaacggaaatgtcacctacgacagttccacgacggatatcacattgaccgttccccttctaggttcggttaccaataccgtaatggttcctgccggagtagcaagttataaggtagaagtcgttctgctgctttcgctgttgaaaaggacatatctggtgaaacccacttcgggtaatttccaacctggggtaatttatacgatcagtctctga

SEQ ID NO: 3518 - DNA, 513 bp, B.fragilis
gaatataaaagtatggaaatacatataggaaatcgcgtggccgaaatagaattggtcagcaaggaagacaacaaagtggttctcaccatcgacggaaaaacgttcgaagcggacgttgtcatggcagagaacgggaattgcaacatcctgatggacggacgcagctccaacgcccaactgattcgcaaagagaacggaaagagctacaaagtgaatacacactacagcagcttcaatgtcgagattatagacagccaggcgaaatacctgcgcatgcgcaagaaaggtgaagaggagcagaacgaccgtatcacttcgcccatgccgggcaaggtggtgaaaatccccgtcagtgtgggacaagagatgaaggccggagaaacggtcatcgtcatcgaagccatgaagatgcagagcaactacaaggtgacttcggactgccggattaaagagattttggtgcaggagggcgataacattgccggagagcagacgctgataacgttagaataa

SEQ ID NO: 3519 - DNA, 1350 bp, B.fragilis
aaagaaaaaagaattatgaatgcagctaaggtattagaagatttgaagagaaggttccccaacgaaccggagtatcatcaggcagtagaagaagttctttctaccattgaagaagaatacaacaaacatcctgaattcgacaaggccaatctgattgaacgtctttgcattccagacagagtataccagttccgtgtaacttgggtagacgataaaggcaacgtgcagaccaacatgggttaccgtgttcagcacaacaacgccatcggcccgtacaaaggaggtatccgcttccatgcttctgtaaaccttggtattctgaaattccttgctttcgaacaaacatttaaaaactcgctgaccacattgcctatgggtggcggtaaaggtggatcggacttctctccacgcggaaagtcaaatgccgaagtaatgcgtttcactcaagccttcatgctcgaactgtggcgccacatcggtcctgaaaccgacgtaccggccggtgacatcggtgtaggtggccgcgaagtaggcttcatgttcggtatgtacaagaagttatctcacgaatttaccggaacattcaccggtaagggacgcgaattcggcggttcactgatccgtccggaagctacaggttacggtaacatctacttcctgatggaaatgctgaagaccaaaggaaccgacctgaaaggtaaagtatgcctgatctccggttcgggtaacgtggctcagtacactgccgaaaaagtattggaactcggtggtaaagtagttaccatgtccgactccgatggttacatctacgatccggacggaatcgaccgcgccaaactggattacatcatggagttgaagaacctctatcgtggacgtatccgcgaatatgccgaaacttatggttgtaaatatgttgaaggagcccgcccctggggtgaaaagggtgatatcgcactgccttcagccactcagaacgaacttaacggagacgatgcacgcaagttggttgccaacggggtgatagccgtatcggaaggtgctaacatgccttctacacctgaagccatcaaagtgttccaggatgctaagatcttgtacgctccgggtaaagcagccaatgcaggcggtgtatctgtgtcaggattggaaatgactcaaaactctatcaaactgagctggagttcggaagaggtggacgaaaaactgaagagcatcatgaagaacattcacgaagcttgcgtacagtacggtaccgaaccggacgggtacgtaaactatgtgaagggtgctaacgttgccggattcatgaaagtagccaaagcaatgatggcacaaggaatcgtataa

SEQ ID NO: 3520 - DNA, 885 bp, B.fragilis
aacaacagaagtatgaaaaagttaatgtttgctgtaatagcttgcgcgatgggcctttcgggctgctcttcggaggatgactgtgctaccaatcccgaacctgcgggagatgtgacggaaatcaaattaagtgccggtatccagggagtggcaacccgcagcccggtatcgaccaatgacaatataacggctccgtttgtggcctccgccaccaccggagactatacgacgaatgcatggagttccaccgtgacgtttgtggcatcgcccacaccgacagccgcactctctttcagcccggcacggtattatccggtggataattctcccatctatatcagaggttactacccggcagggacactttccggcaaaacagttacgctggctggcgatgggacagaagacgtgatgcttaccgctcaagcctcagggacgaaagcgactgcaggagcactgtcgtttgtcttcaaccatctgctgacgcaattgcaattcaaacttgtggccggtgcaggatatccggcatcgggtgtcaacgtgaccagtcttgtcatcaagcaacaaaagacacctgccacactggacctgaatacatccagcctgacgtataccaccaaagaccttaccctttcgggtacattccccatcctaacggccggaagtacaatcaacaactatccgatggtgaaaagcggcgaagccctcacggtggcagtcaccacaagtgacggagtgacttatcccgaatctaccatctcggtcactaccgaagtcggaaaatcacatttaatcacccttacctttacgccgaaggaaatcacgtcctctatcagtgtgacagcctggcagacaggagggaccggatcgtccacattacaataa

SEQ ID NO: 3521 - DNA, 2811 bp, B.fragilis
cggcagacgagtatcctgcaaatgttctcgctccacagcccggacgactcgtacgacgaagccttcctggccaattatatcagcatcaacctcaaacctgagattctccgtatctcgggcgtcggagacatgatgattatggaaggagattatagcttgcgtatctggatgaaaccggacgtaatggcacaataccggctgatcccttcggacgtatcgactgtcctggcggaacagaacattgagtcggccaccggatcgttcggtgaaaattccgatgaaacgtatcaatataccatgaaatacaaaggacgccgaatcacaccggaagaattcggtgagatcgtgatccgttccaccgacgacggacaggtgctgaaactaaaagatatcgccacaatcgaactgggacaggaaagttatgcttacagtggtacgacggacgggcacaacggtgtctcgtgtatgctcttccagacagccggctccaatgccacagaggtgaacaaccaaatcaaccgattccttgaagaggcaaggaaagaacttccccaaggagtggaactgacacaactgatgtcgtccaacgacttcctgtatgcctccatccacgaagtggtgaagacactgttggaagccattctgttggttatccttgtcgtgtatgtctttttgcaggatatccgctcaacactgattccactggtggggatcattgtatcacttatcggtacgttcgctttcatggcgatagccggattcagtatcaacctgattacgttgtttgccctggtactggtcatcggtacggtagtggacgatgccattgtggtggtcgaagccgtgcaagcacggtttgacgtgggatacaaatcatcctatatggcaagtgtcgatgccatgaaaggaatcagcaatgccgtcatcacctcctcattggtgttcatggcagtttttatccccgtatcgttcatgtccggcacatcgggtacgttctatactcaattcggactgacaatggccgttgcggtaggtatctcggcagtaaacgccctgacactgagtccggcactttgcgccctgctactgaaaccgtacatcaatgaagacggtacccagaaacagaacttcgccgcccgtttccgtaaagcattcaatgcagctttcgatgttgtggtagaaaaatacaaaggcatcgttctcttcttcatcaagcgccggtggctgacaggatcactcctgatagcttccatcgccttactggtagtactgatgaatacaacaaaaaccagtcttgtacccgatgaagaccagggtgtcgtattcgtcaacgtcagtacggccgcaggcagttcgctacggacgacagacgatgtaatgaaacgtatcgaggaacgcatggaacagattccacaagtgaagcatgtgcaaaaggtggcaggatacggattgctggccggacaaggaagctccttcggtatgctgatcttgaaactgaaaccatgggacgaacgccccggaaaagaagatgatgtgcaggcagtgatcggacaagtgtacggacggacggcagacatcaaggatgccagtgtattcgccatctcaccgggtatgattccgggctacggaatgggtaacgcacttgaacttcacatgcaggataagaccggaggagacgtcaatgaattcttccagaccacacagcagtatctgggagccctcaaccaacgtccggaaatcgccatggcctactctacattcgacgtgcgctatccgcagtggctggtcgaagtcgatccgtcgaaatgcaagcgtgccggtatcacaccggaccaggtattgagtactctttccggatactatggcggacagtatgtgtccaacttcaaccgattctcaaaggtgtacaaggtgatgatccagtccgacccgcagtaccggcttgacgaagcgtcactgaacaatacattcgtacgcatgtctaacggagagatggctcccctcagccaattcctcacactgacccgtacgtatggcgccgaatcactgagccgtttcaatatgtacaactctattgccgtaaatgccatgccggccgatggttacagtacgggtgacgccatccgtgccgttcaggagacagcttccacttccctgcccaaaggttatggatacgattacggaggcatcacccgcgaagagaatcagcaaagcggtacgacggccatcatcttcggcatctgttttctgatgatctacctgatcctgagtgcactctacgaaagcttcctgatcccgttcgccgtcctcctgagcgtaccctgcggcctgatgggttcattcctcttcgcacgcatgttcgggctggagaataacatctacctgcaaaccggactgatcatgctcattggattgcttgccaaaaccgccatcttgctgacggaatatgccgccgaacgccgtaaggcaggcatgggactgattgcttctgcattgagtgccgccaaagcccgcctgcgcccgatattaatgacggcattgaccatgatcttcggtctgctcccgctgatggtagccagcggcgtaggtgcaaacggtaaccgctcgttgggaacaggtgctgtaggtggcatggtcatcggtacactggcactgctgttcatcgtaccgtcgctgttcattgccttccaatggctacaggaacggatacgtcccgtacagatagaaccaagtcatgactggcagattcagacagagcaggaagtgagtgaacacgaaaaagaagaagctaagaatcgccctctaaaataa

SEQ ID NO: 3522 - DNA, 309 bp, B.fragilis
cataaaaaaggatgtatgaacgataaaataaaaataaacctgcaaatagcggattcttattatcctctcaccattaaccgtgatgaggaagagaccgtaagagaagcggcaaagcaggtaaatatcaggctcaatgcgtatcgggagcactacaggaacgtggctccggagaagattatagctatggtggcatatcagttttcactggagaagctacagttgctgcaacgtaatgatacccaaccgtatacggccaagatagaagaacttacggaaatgctggaagagtatttcaggaacgaggaataa

SEQ ID NO: 3523 - DNA, 558 bp, B.fragilis
aaacgaacgggacttatttgtaaccggtatgaaaatattctttcatgccgggatgatattcgtcggataaacactacctttgttggaatacaacgtttccaacctaatatcaatccatataacatgactccagatttcgattacagtgaagtgcctttcggattcaactattgcctcaacaaatcatgtaagcaagcctccacgtgcctgcgctaccggttgtacactcatattccggcagcttgccagaccataagaataatcaaccccgtttacgccgccaccatcgatgacgtgtgccctttcttcatgcccgacaagaaagtgcggtatgccttaggcatcacccacttgctggatcatgtgccttacagtgacgcagtcagcatcaaaagacaaatgctggcacacttcaagcaggccacttattatcgttgccgccgcaaagaacggatgctcgatccttccgaacaggaatatatccgtaaattatttgtcagtaaagggatcaaagaactaccggtatatgatgaatacatagaaaagtacgactggtag

SEQ ID NO: 3524 - DNA, 291 bp, B.fragilis
gggatgaagggtacatactggtatgccgtggactatgccggcacggggcacctttttacctacaagcccgaaagggatgcggggatctggaacggggaggaagccctgcaggtttcccaaggggcactccgggaggtattccccaagatcacctggcaggactcacccgtagtggtaacactggaggtactcccctgtgaggagaccttccgcctgcgcctgtcaaagaactgcggttatatcctgagaaaatatctccgtttcccccggaaagaaaaaacaaatgattga

SEQ ID NO: 3525 - DNA, 429 bp, B.fragilis
tatccacttattaaacgtattactaacaagaatattatgaatttacgaactttcattgaacggcctgtcctatcggctgttatatccataaccattgtcgtggtcgggattatcggattgtttacgctacccgtagaacaatatccggacattgccccgcccaccatcatggtgagcaccagttacttcggtgccagcgcagaaactctgcaaaagagtgttatcgcgccactcgaagaggccatcaacggtgtggaagacatgacctacatgacctccagcgctaccaatgccggaacagtctctatcaccgtctactttaaacaggggactgacccggacatggcggcggtgaatgtacagaaccgagtttccaaagctaccggacagctcccctcggaggtaaaccaagtaggtgtcaccacttga

SEQ ID NO: 3526 - DNA, 1125 bp, B.fragilis
ataggaattatgattgaaaaggttagtaaagtaaagcaggctatattattcgcctgctgtttggccgccaccggatgcaagcaagcaccgcaggcaactgtagaatcgggatacaaagtaataacccttgcgcctaccgaccggacgctatcgagtacgtactcggcaacaatacgcggacgccaagacatcgaaatctatccgcaagtgagcggtacactgacacaggtgtgtgtcagcgaaggagaacgggtaaaacggggacagtcgttgttcatcatcgaccaagtgccttacgaagctgccctgcagacagcattggcaaacgtggaagcagccaaagcctcactggctacagcacaactgacgtatgacagcaaacaggaattatataagcagaatgtggtttcgaccttcgacctgagtacggccaaaaactctcttttggcagcacaagcgcaattggcacagatgaaggctcaggaggtgaacgcccggaacaacttatcgtacacattggtaaaaagtccggcggacggagtggtgggaacactgccctatcgggtaggaacgttggtgagtgccagtctgcctgaaccgctgactaccgtttcggacaactcggacatgtacgtctacttctcgatgacggaaaaccaactcttaggactgatccgacgctacggatcgaaggaagaagcactgaaacaaatgccggaaatcggcctccaactgaatgaccgatcggactatccgcaacaaggacgaatcgagacaatcagcggagtgatagaccggaacaccggaacagtcagcctgcgggcagtatttcccaaccgggaaggattgttgcacagcggcggcgcgggcaatgtgattgtaccgacagaaaaagcgggtgcattggtcattccgcaagctgccacatttgaggtacaggataaagtatttgcatataaggttgtggacggaaaagcgcaatccgctccggtacaagtgacacgtgtgaacggcgggcaggagtacattgtggagagcggtttgcagcccggcgacgtgattgtggcagaaggtgtaggattgcttcgcgaaggaacagagataaaaacaataaatggtgaatga

SEQ ID NO: 3527 - DNA, 186 bp, B.fragilis
ataaggattatgaaagaattagtagaaaagattgctactttggtagctgagttcaacaaagatgcaaatgctcagattgaaaatggtaacaaagctgcaggaactcgtgcccgtaaagcttcattggaaatcgaaaaagcaatgaaagaattccgtaaagtatctttggaagaatcaaagaagtaa

SEQ ID NO: 3528 - DNA, 681 bp, B.fragilis
cgtggagttatggggcgaagaaatagaataatgcataaaatgacagaaatggaaattacatataacatacagacaatttacacataccgcaacgaaaacatgcccgaggacagcacgaaagtgtacaggttctcccggaaagtaagccggcgtatctggaaatatgccttgtcaacccccgacttccgctcttttctggaagccaaaagccgggagtgctccgatacaatctcccgaatgaaccaggagttacagaacgtagtggtcacatttcatatctcctttaatggagatatcccttttgtggggagtgcagtgtgctttttcaagacagtctcaggaggagagctgcgctgcaggtacaaccagtccatcctctttgaggaaacactgcccggcgggaagtatctccgggacagttccatagagggaatgatccaaaaggaaagaccggagaattccgctttcgggctgcttctgtttgcagtttccctcgtttcggttttcgggatattgacggtacccttcgcgtttaacctggcacgcttccctcttgtgccggccggatttacggttatcgcagtcttgatcttactgacggtctgtctgagacatatgaaccgtagacgcatcacgcggagaatggagatacaggataaaagacaggaacccattaaataa

SEQ ID NO: 3529 - DNA, 1236 bp, B.fragilis
ttttgttatattaaattaaaacttatgacatcagtaaaattaaaattgaacaagacccgtgcattgaaagatgggaattatccggtggtattccagctaatccaccaaaagcgcaaaaaaataatttatacgaaataccgtatgaaagaagaggactttataattattgccggaaatgttgtttcgggttgccataccggttgcaaaatcagtcgcgaattgttgaggatctataagcaactgaccgcacgagttcgcagactggaaagccgtggtgaggaatatacaataaatgatatcactactgtcatgttttcaaaagtgaccgggaaattcttattactgccttacattgatacacaaatagaatggaaaaaatcaataatgaaaaacggaaccgccgctgcttatcaaagtacctatgcttcacttgccaaatatatcggtaagaaagaggtgaaaatatcgcaagtgaaccaccgctttgtaacttgctacagagactttttatccaaaaatggggctacggaaaatacgatcggatactatttaaggaacttcagggcattgtataatctcgcggtaaaggacggcttggttcctccatgcgattatccgttcaaggaaatatgtaccaagccctgtaaaacagtaaaacgtgcattagatcgggaacagatggttaaattggcttgtctgtcattgcattccgatgcagagttaaaacgttcattggatctttttctttttggtttctatgcccagggaatggcttttgttgacattgcatatctgaagtggaaaaatataagtggtaatcggattatctatagaagacataaatcaaaacaattgatacaaatagtcattacaccccagatcaaatccattatagacgagcatgggaataatacgaacaatgcagaagagtatgtattctcggttatcaaaaacaatgcaaatgaatatactcagtatcgtacagctttaggacgtaccaacaggcacttaaaaataatctctgcgaaactgaagattgatcctccgttgactacgtacaccgcgcgccatacatgggcaacactggccagagaatacggggccccggtttcggcaatcagtgcgggattagggcataccaaagaagaaatgacacttgtctatcttaaggaattggatttggctcctcttcaccggatcaataagatggtaaataatcttctggagagaaaatga

SEQ ID NO: 3530 - DNA, 198 bp, B.fragilis
aggataaatatggcctggatggtaacccaaaagaatattaagattcatacctgcattgacggtatagattcagttgaagatgtcagagtggtaatctcgcataagaaattgaaagctcttggtgcgaaacgtagagtttataaagacacgagagagagcttttttcttattgaatccgattgtgaaatcatcctctaa

SEQ ID NO: 3531 - DNA, 1182 bp, B.fragilis
agcacaaatatcatgattcaaaactctatctccgacaatcgtatcgtctggctcgacgtcatccgctgtgttgcaatgataatggtcataggcgttcattgtatcgaccctttttacatttcgcccacaatgcgggctattccggaatacacacattgggcagcgatctatggttcactgctccgtccgtcggtacctctgtttgttatgatgacgggactgcttctgctccccgtaaaaaaacaaccactgggtaaattctacaaaaagcgcatttaccgtgttttgttcccttttcttatatggtcggtgttgtatagcatgtttccttgggttacaggcgtactcggactaccgaaagagatcatcggtgacttcttttgctatacacaagggcaggaatcacaaagcctgatagactctcttaaagatgtggcaatgattccattcaacttcagccataaagagaaccacatgtggtatatctatctacttatcggtctgtatctctacatgccattcttctcggcatggatagaaaatgccgaccgaaagaccaaacgagcttttctcctgatatggattatctcactcttcatcccttatttgaaagagtatgttgccaattgtttgttcgaaagaagcggatatgtattcggcacggacacgtggaatgaattcgggctcttctattactttgccggattcaacggctatttattactggggcattatgtcaaaaaaggaaatgactggagccttatgaaaacattcatactctgcatactcatgtttgccgtcggatattatatcacttatacagggttcagcaccacagcgtcaaatcccaatgcgacggaaacagagatggaactcttctttaccttctgcagccccaatgtgctactaatgactttggctaccttcttactattacaaaaggttgtcatcaccaactctactgtcattaaagtattggccaatatgacccagtgtggtttcggcatctatatggtacactattttgtcgtaggtcccttcttccttttaataggaccttcgtcattgcccatccctttgcaggttccactgatggctatctgcatattcctttgcagttgggcatttactgcactaatttataagctgatgccacgaaaagccgtttggtttatgggataa

SEQ ID NO: 3532 - DNA, 1524 bp, B.fragilis
gaaatgaatatgattaaaagaatcttagtcgccaaccgcggtgaaattgccgtgagggtgatgcgctcctgtcgggagatggaaataacgagcattgccgttttctcggaagcggaccgaacagcgaaacatgtgctttacgccgatgaagcttattgcatcggaccggcagcatcgaaagagagttatctgaatatagaaaaaatcattgaagtggcaaagtcatgccacgcagacgccattcacccgggatacgggttcttatcggaaaatgcaacctttgcccgccgttgccgggaagaaggcatcacctttatcggtcctgacccggaaacaatggaagccatgggagataaaatctcggcacgcatcaagatgatcgaagccggggtaccggtagttccgggcactcaagacaacctgaaaagtgttgaggaagccgtagaactctgcaaccaaatcggctatccggtaatgctgaaagcctcgatgggcggtggcggaaaaggaatgcgactgattcatcatgcagacgaagtggccgaagcctatacaacagccaagagcgaatcgctttcctcgttcggagacgacacggtctatctggagaagtttgtggaagaaccccatcacatcgagttccagatactgggcgacaagcatggcaacgtaattcacttgtgcgaacgtgaatgctcggtgcagcgccgcaaccaaaagatcgtagaagagagcccttcagtttttatcacaccggaactgcgccgggacatgggcgaaaaggcagtagccgctgccaaggccgtgaactacatcggcgcgggaaccattgaattcctggtggacaagcaccgcaattattactttctggaaatgaacacccgcctgcaagtggaacatcccatcacagaagaagtagtcggcgtagatctggtaaaagaacaaattaaggtagccgacggacaggtactgcaactgagacaagaggacatccagcaacggggacacgccatcgaatgccgcatctgtgcggaagatacggaaatgaacttcatgcccagcccgggtgtcatcaagcaaatcacagaacccaacggtatcggagtacgcatcgacagctatgtatacgaaggatacgagattccgatttattacgatccgatgatcggcaaactgatcgtgtgggccaccacacgggaatatgccatcgaacggatgcgccgcgtgcttcacgaatataagttgacgggcgtaaagaacaacatcagttacctgcgcgccatcatggatacacccgactttgtggaaggacactatgacacaggcttcatcgccaaaaacggtgaagtgcttcagcaatgcatcacgcgcaccagtgagcgtgcggaaaacattgcgctgattgccgcctacatggactacctgatgaacctggaagaaaacaacagcggactggcagcggataaccgcccgatcagcaagtggaaagaatttggattgcacaaaggggtattaagaatataa

SEQ ID NO: 3533 - DNA, 333 bp, B.fragilis
atccggaatatttcttttaaattaacaggaaacaacactacttggcaaacactttcatacctccggtgttatacatcaacatacaaaaaacaaccgcctatgtcacaagaaatgaaagcattcccaggaatgaaagcttcacagaaactcaacttcaaccattccgaagttattatcaacagcgcaccggaccggaaggttatcttggaatcgactctgttagagcagtcattcgtggaaaaaggatgtggggaaaccactccgcatgcttggaaaacaacatcgaaagagtctctgaaaagacccgtgtttaacgagatatggtacacataa

SEQ ID NO: 3534 - DNA, 1389 bp, B.fragilis
ttaatagatatgaatctaattaacgatatattatggacctacatcctgattgcaatgctgttgggatgcgccatttggttcacgattaaaacccgtttcgtgcaattccgcatgatcggcgaaatgctacgtctgttgaaagactctgccggaaaagaagaacatggagagaaacatatttcttcgttccaggcctttgccatatcactggcaagccgtgtcggtacaggaaatctggctggcgtagctacggcaattgccatcggcggaccgggtgccatattttggatgtggatcattgctctattaggagcatcgagtgcttttgtagaatctaccctcgcacaattatataaggaaaaagggaaggaatcttttatcggaggccctgcctactacatgaagaaagggttaaaaaaaccatggatgggaattctgtttgccatactgattactgtcactttcggatttgccttcaactcagtacaaagcaataccatttgtgcagctgtagaacatgcgtttggcatcagccatgtgcctatgggcatcatcctgaccggactgactctattgattattttcggaggtatccagcgcattgctaaagtaagcagcatcatcgtccctgtcatggcactgggatatgtaggattggcattggtcattgtactcatcaatatcacacatctgccggatgttatcggaaccattgtcagccatgcttttggttggcaacaggctttaggaggaggtgtagcagctgcattgatgcaaggcatcaaacgtgggctgttcagcaatgaagccggtatgggttcggcaccgaacgtagctgcaaccgcattcgtatcacacccggtgaaacaaggactgattcagaccttaggagttttcacagatactcttattatctgttcatgcacagcattcatcattcttttcagtggtgctccgctcgatggttcgaccaacggagtacaactcactcaacatgcgttgaacaacgaaataggaagcataggaggtatatttgtggcagttgcccttttcttttttgcgtttagcagcatcatcggcaattactattatggagaagcaaatatccgatacctcacccacaaacgatggatagtttacctttaccgtttattggtaggagggatggtatgggtgggagccatgtccactctcgattttgtatggggactggcagatatcaccatggggttaatggccatctgcaacctgatagcgatcgcctttctgggaaaatatgctttccgattgctgcaggactatcgtgaacagaaaaagtcaggcatcaaaagcccggtattcaccaaaaacaagatgaaggatattgaaaaagatattgagtgttggtaa

SEQ ID NO: 3535 - DNA, 192 bp, B.fragilis
caaacagatattgcttccatggcaaatcatcatttaaatgaagagaaaccttccactaaagtgtcacaatctttacttctaggcgacaactttttgtcgcccgagagaaaaaagtttttcacctacacgacacaaagtgaaacaatagagaaaggaataaatacatctccatctaccggattcttccactga

SEQ ID NO: 3536 - DNA, 3768 bp, B.fragilis
tctatctgtatgattaataaaataattcgttatttccttgaaaatagggtgataactattcttctgctgacacttgtcgtggtttggggaatttctactgcgccctttaactggcatggggggattgtgccgcgaaacccgattcctgtggatgctatccccgatatcggtgacaaccagcagattgtggctacggaatggatgggacgttcgcctaaggacatccaagatcagattacctatccgctgaccacttcattgttgggtataccgggggtgaagaccatccgcagttcgtctatgttcggtatgtcgtttatctacattatttttgaggatgatattgagttctattggagtcgttcgcgcattttagagaaactcaactcgttgcctccgggcactttgcccgaaaatgtgcagcctacgctggggccggatgctacagcattgggacaaatctattggtatacgctggaagggcgtgatcctaaaaccgggaaacctgccggcggctggaacgctgaggaattgcgtactattcaggacttttatgtcaagtactctttgtctgctgccgaaggtgtgtccgaagtagcttcagcaggaggttttatcaaggagtatcagatcgagttgaatccggatgcgatgtactcgttcaatgtgtcggtgatggatgtgatgaatgctgtgaagaagagtaaccttgatattggtgccgaaacaatggaggtgaataaagtggaatacttgattcgtggtcttgggtatgtgaaaaatgtggcagatatagagaatacggttgttaccgtccgtgaaggggtacctgtacgtatttccgatattgcctttgtgaatatcgggccggggacgagacgtggcggcttggacaaggaaggagtagaggctgtggggggcgtggtgattgcccgttatggctccaatcctctggaagtaattaataatgtgaaagaaaagatacatgagatggatgccggaatgccgcagaaaacattggctgacgggacggtgtcgaaagtgactgtcgtccctttctacgaccggacgggattgataaaggagaccatcggtacattggagacgagcctttcgcacgagatattgatctgtattattgtcatcattgtgttggtacttaacttgcgggcatcggttgtaatagcaagtatgctgcctattgccgtattggctacatttatactgatgcgatataccggtatcgaagcaaatatcgtggcgctgtccggtatcgcgattgccatcggggtgatggtagatgtgggtgtggtatttgtcgagagtattatccggtacatggagatgccggagaataagggtatcacgcggggtaaaccatttgtcggactgatctataaagctgtaagcgaggtgtcgggagctattgctacggcaatgattacgactattgtcagtttcttacccgtatttgccatgcaggcgcaagaggggaaaatgttctctccactggcatatacaaaaacttatgcattggcatcagcttttgtgttgggattaattgtgctgcctacattggcttatatccttttttcggtgcggattgactctaggttgatccggcgcgtaatgaactgtgtgcttatagcatcggctattgttttgttcgccgtatacgatagtgtccctgcattgggactgacggcggttggaatcaataacttgcttgcatatcgttggaagaatcctaagacaggcaattatgttaatatcggtattgccctgacggtagctgttttctatctgtccgaagagtggctgccgatgggaccgcaacggggactgtcggtaaatgtgctgattgtagccggatgcgttgccatcattctggctttactttggatactggtcattttctacgagcgtattttgcgttggtgtctggccaatcgatggaagtttatgatgattcctgcagcaaccgtcgtttgtggtttcctcatcgggcggagtatcggcaaggaatttatgcccagcctgaacgaaggctcttttctattgatgcctaccagtatgcctcatacgggtattgaacagaatctagattatgtggagaaactcgataagcggctggcggccattccagaagtagaaactgccatcggtaagtggggacgtgtaaattccgctctcgatccggcaccggtccagatgtttgagaataccattaattatcgtcccgaatatatcatcggagaagacggaaagcgtgcccgtttccgtgtgaattatgatggtgcattcctgctgaaaggtggaggtacatataatcctgccaatggtttccggcttatccctgccgatagtctggtgcctgattcgcgtggcgactatttccgccagtggcgtccggagattaagaatgcaaatgatatctggcaacagattgtcaatgttacccatttgccgggactgacctctgcaccgaaactgcaacctattgaggcacggctcgtaatgctttcaaccggtatgcgtgcaccgatgggggtgaaggtatacggtcccacactggaggatatagagcagggaggtaaggcgattgagcaggcattaaagtctgtaccgtctgtcattccctcgtctgtgttctacgaccgggcggtaggtgctccgtatctcgaaataaagctgaatcgtgagtcaatggcacgttatggcgtggcggtgggcgatctgcaggaagtgctcagtgctgctgttggtggcatggcgttgacccgtactgtagaggggcgcgagcgcttccccatccggttacgttatgcacgtgagttgcgtgatagtccggaggctctttccatgctacttgtacctactgctaccggaatacaggtacctcttaaagagttggcggacatcgaatattcccgtggtgcacaaatgatccagagtgagaacactttcctggtaggttatgtcatcttcgataaactttcaggccgtgccgaagtggatgtggtgaaggaggcgagtaatctgctcgaggctaaagtaaaaagcggtgaactgcttctccccaaaggtgtttcttataagtttgccggtaattatgaacaacagcaacgtgctacggaccggttgatgattgttgttccgttggctttgctcattgtcctgctggtactctatttccagtttcgtacggtgacggcctcgctgattcatttttcgggtgtattcgtagctttcgctggcggttttattctcttgtggctctatgggcaaccgtggtttatgaatttcagcattgcgggtgaaaacatgcgcgacctcttccagatgcatcccatcaacctgagtgtagcggtctgggtagggttcattgctctcttcggtgtggccacggatgatggagtattgatgggaacgtatattcaccatgtttttctggaacgcgatccccgtacgaaatatgacatccgtgaggcggtagtagaagccgggctgaagcgtgtccgtcctgctgcaatgacaacggcgacaacactcatcgctctgcttcccgtacttacatctaccggaaagggagcggatatcatggtaccgatggctatacccacgtttggaggaatgctgatacaatcaatgaccatgtttgtcgtcccggtattacaatgctggtggcgtgagactgtggagaggagacgtgagaagaaaaacggaagtgaagtttctgagccggttacaggctctcccggtatctga

SEQ ID NO: 3537 - DNA, 882 bp, B.fragilis
tataagtgtatgtttgcaaataaagtaaagaaggtggcggccattcacgatctttccggtatgggaagggtctctctgacggtcgtcattcccattctgtcatcgatggggtttcaggtatgtccgttgcctacggccatcctgtctaaccacacgcagtatcctgattttacttttcttgatctgacggacgagatgcctcgtatcattgctgagtggaaacggttggaagtggagtttgatgctatttataccggttatctgggatcgccccgacagattcagattgtatctgattttattcgtgattttcgcagaaaagatagtctgactgtaatagatcccgttttgggagacaatggtaagctctattccaatttcaatgaatcgatggtggtggaaatgcagcatttagtcacacatgccgatgtgatcacccccaatctgacggaacttttctatctgctcgaccggccgtataaagagagtaataccgatcaggaactaaaagagtatttgcgttgtttgtcggacaaagggccggaagtggtcattatcaccagtgtaccggtgttggacgaaccccacaaaacttctgtttatgcttacaatcggacaggaaaccgttactggaaaatcacatgtccctatttgcccgcccattatccgggtacgggagatacgtttacgagtgtcattaccggagctttattgcagggagacagtcttcccattgctctggaccgtgctacgcagtttattttgcagggcattcgtgctactttcggttacgagtacgacaatcgtgagggtattctgttggagaaggtacttcacaatctcgatatgcccatccagagcagcagctacgagttgatttaa

SEQ ID NO: 3538 - DNA, 1134 bp, B.fragilis
aaggctatctttgcgagcgaaaaagcaaaaattcaccttagaagtcaaacaatagcacagcagcccgagcctgcatcttttatacgtagcgatatgaaaagaaaactctgtcttctcctgttcttctgtcttttattgactgccccggctttgcgggcacagcagaaagccactcccagatccggtgaaggtatctctaccttcctcctgcgccacaaccgcgccccgaagaaatactacaatgatttcatcgaactcaacaaagccaaactagggaagagcagaactcttaaaatgggtgtcacttacctgattccccctgtcaagaaagcgtcggccgccacttccggaaaaacgacggaggcagcagccgaaaagacatccgcacatcacccgcgccgtacggaagtcaacgagccgctcttcgggaagtggctttcaaatgtcaaggtcacttccaatcgccttgccggtacctgcttctatgttgtcagcggacatggcggtcccgatccgggcgccatcggacgcgttggcaaacacgaactccacgaagacgaatatgcctacgacatcgcccttcgccttgcccgcaacctgatgcaagagggtgccgaagtacgtatcatcattcaagatgccaaagacggcatccgtgacgaggcttatctctcgaacagtaaacgtgaaacctgcatgggctctcccatcccgctgaaccaggtacagcgccttcagcagcgttgcgacaaaatcaatgccctttatcgtaaagaccgcaagaagtataaatactgccgcgccatcttcattcatgtggacagtcgtagcaaaggtacccagaccgacgtcttcttttaccactccaaccgcaaagccgagagtaagcgcctcgccaaaaacatgaaggaaaccttcgagtccaaatacggcaagcatcaacctaaccgggggttttcgggcaccgtaagcggacgcaacctctatgttctggcccacaccacgcccgcctctgtttttgtcgagttgggcaacatccagaataccttcgaccagcgtcgcctggtgatcccctccaaccggcaggcactcgccaaatggttaatggaagggtttataaaagactataaataa

SEQ ID NO: 3539 - DNA, 321 bp, B.fragilis
tgcttgatcatggttctattactgttttttctttatgatcgcaagaatcatgccatatcgctaaatggctattatataatacaatatattcctgaacactcttttgctattgtgcggacacgcacaaaggcagttcactatcgcacaattacatccggctacccttggatattgaatcggagcttctgtaaaaaacggtacattcgcaatcttattttgaatatagaatccgataagtttattggaagaattcagtggaagaatccggtagatggagatgtatttattcctttctctattgtttcactttgtgtcgtgtag

SEQ ID NO: 3540 - DNA, 189 bp, B.fragilis
acaagtgtcatttcttctttggtatgccctaatcccgcactgattgccgaaaccggggccccgtattctctggccagtgttgcccatgtatggcgcgcggtgtacgtagtcaacggaggatcaatcttcagtttcgcagagattatttttaagtgcctgttggtacgtcctaaagctgtacgatactga

SEQ ID NO: 3541 - DNA, 1047 bp, B.fragilis
cgtatgaacatcctttttggtttaatccttttggttatctttaccccactaattaacataataattgtcatgaaacatatatctattaactatattctaactactgcacttgctttaggtatcggcatcagcatccctgtccttataggcagcacttgcctcagcgaacaacactctgtacaatccgaagttccttattgcgtcactcctcccactgtccccgaacaagctgtgtttgatggtgacacaatcgacctgcgtcgttatgaccgccgtgaacgtatggaccgcgaactgatgtccttcatttacatgcactccagcaccatgcaaatgattaaacgggccaaccgctacttccctgtcattgaaccattactgaaagccaacggtattccggacgacttcaaatatttgatggtaatagaaagcaatctcaacccgatagcacgttcaccggccggtgccgccggtttatggcaatttatgcctgtcactgcccgtgaattcggtcttgaagtaaatgataacgtagacgaacgctatcatattgagaaagctaccgcagccgcctgccgttatttcaagcaggcttatgccaaatatggcgactggatggctgtatctgcctcttacaatgccggacaaggacgtatttcctctcaactggacaaacaattggcggatcatgccatggacctctggctggcagaagaaacctcacgctacatgttccgcctactggctgtaaaagaggtattcggcaatcctcagcgtttcggttttctgctgaagcgggaacatctctaccctgccattccctacaaagaagtggcggtagatacagaaatcagtgacttgagcaactttgcacagaaacaaggcatcacctatgcacaacttcgcgatgccaacccctggcttcgaggttcatcactaaaaaacaaaaccgggaagaaatacgttttacatatacccacgcaagagggtatgaattatgatcctcgtaaaacagttcctcacgaacataaatgggtgattgactaa

SEQ ID NO: 3542 - DNA, 594 bp, B.fragilis
acaatggacatagaaatagaaaatcatccgttagagccctttctccccgccaatgcccgattgctgatgctgggaagttttccacctcaaaagaaacgatggtcgatggatttttactatccgaacctgaacaatgatatgtggagaatcgtgggattgctgttctttaacaacaaagactacttccttaacgaaacccggaaagctttctgccgcgaacgcattatcagctttctcaacgataaaggaatagctttattcgataccgcttcggccatccgacgcctacaggacaatgcctcagacaagttcctggaagtggtgcagcccactgatataagccgacttctcggacaactcccggaatgcaaagccatcgtcacaacagggcaaaaggcaacagatacactccgggcacaattcgaagtggaagaacccaaggtgggcgatttctctgagttcgtctttgatggacgcccgatgcgcttataccgcatgccttcttcttcacgagcctatccgttggcactcgacaaaaaagcggcagcataccgcaccatgtatcaagatttacaaatgcttaatatagaataa

SEQ ID NO: 3543 - DNA, 642 bp, B.fragilis
cttatgagcatattcgctaacttatttaaaaaacaggccgacgctgacgcaaaagtagtaggcaatgtagaagatttcgtatcactgacacgtgtatattttcaatctgtaatcgcagtaaatttaggtatcacgaatatccgttttctgccggatgtagccaacttcaaacgtttattcaaagtagccacacaaggtggcaaattaggacttgccgagaaatcagcttcccgcaagatgttgatgcaggattacggcatcagtgaatcgttttttaaagagatagacacctctatcaagaaaaactgccgcacacaaaatgatgtacaggcatatcttttcatgtaccagggattctcaagtgacctgatgatgctgatgggtaacctgatgcaatggaagttccgtatgccggcgatattcaaaaaagccttgcgctccatgacagaaaaaactgtgcacgatgtatgtaccaaaacagtatggaaagctgatgacgtacacaaaacggctgccgcagtacgccagtacaaagaacgtctcggattttcggaacaatggatgtcagagtacgtatacaacattgttttactggctaaaaaagagccgaaacataaggacgaagaagcgaaagcaaaatga

SEQ ID NO: 3544 - DNA, 354 bp, B.fragilis
ccattaataatatctacaacaatgtttacagtaatcaaaagaatggagatatcggctgcacataagctgattcttccgtaccggagcaaatgcgccagtcttcatggtcacaactggattatcactgtctactgccgttctgagcggctcaatgcagatggaatggtagtggatttcacccagattaagcaggccgttaaggagaaactggatcacaggaatctgaatgaggtacttccttttaatcccacggcagaaaatattgcccgttgggtatgcaagcaaatacctcaatgttataaggtcgaagtgcaggaatcggaagcaaatacggtgatttatgagaaagattaa

SEQ ID NO: 3545 - DNA, 1656 bp, B.fragilis
attataacctttaaaaaatgcaacactatgaaattaaataaagtaaagaatatgtggagaattctatcggtcatagccctcttgggttcaacactatgcacctcgtgtatatccgaagatatcaaccggaacccgttgctcccgacgaaagaagatgaaaagatggacggagttatttacggagcctacctgcccaatcttgaaaaaagtgtaatccccatcggcaccgcttcagaaagtacagaaccggtaaatcgctatcagatcggagtaaatctggccggtgacgcctgggcgggatacatgtctccccgagacaacaaattcaacggcagcaagaatttcaccaactatttcatgtacgaaaactgggtgaactatgtgtattcttttatggtgacggatgtatattcgccatggatgcagataaaacgcatctcgcaggatgaagggacaagaaatgacgagatttatgccttggcccagatcatcaagatcgcggcactgcaccgcactacggatatgttcggcccgattccctactcacaagtgggcaaaggttcttttaaagtggcatacgactctcaggaaagcgtataccgctcttttctgaaagaactggaagaggctgtccaaaccctggacgattactcgaataagagcaaagaagtattgcctgccttcgacattgtttataacggcgatgtcaataaatggatgcgctttgccaattcgctgatgctccgcctggccatccgtgtccgttttgccgatgcgggactcgccaaagaatatgcggagaaagccgagaagcatcccgcaggcctgatcgacagtaaagaactggcagcccatatgggtaaaggagccggcctgcagatgaagaatccgctgaaagtgatcaacgaagaatacaatgacacccgtatgggggccaccatctattcttacctggcaggatacaatgacgcccgtgctgccatatactttgtcaaaaacaatggtttcaaagccgtacgttgcgggatcgccaagtccggagacgcctataacggattcacacgcccgaacgtgcatgaagacgaccctctctattggatgaaagcatccgaagtatgcttcttgaaagccgaaggggcactggccggattcgatatgggcggcagtgccggcgacttctacaacgcaggcatccgcatgtcgttcagtgagaatggactggacaattcgtcggccgaaacctatctgaaagactccacccgcaaaccggccaactacaccgatacctccaacggcgagttgagcgccaatgctccgagcagcatcaccatccgttgggaaaacggagctacggaagaagaaaagctggaacgtatcatcactcaaaaatatctcgccatcttccccaacggacaagaggcatggaccgagtggagacgtaccggatatccccgccaaatagtcgttgccgaaaataaaacgaactccgcagtattgatcggaaacggatacgacctgggaggcgtaaggagactgccctatccccgcaccgaatatgaacaaaacggcgaaaacctccacaacgccatcagccagtatttgggaggagtagacaatgctgcccccaaagtatggtgggacaaaaaaagcaaatag

SEQ ID NO: 3546 - DNA, 681 bp, B.fragilis
gaggaaaagatggaaaaaagattcatgcaatctgttgccatgcggattatatataaaggtgttttccactggttcctgaaattaatcgtaggggttcagttcaccgattgccagttcctcaaaaaggagaagcagtttatcatccttgccaatcataacagccacttggataccctcagtttgctatcttctttgcccggtaaccttttatggaaagtcaaacctgtagcggcagaagattatttcgggaaaactcgctttcaggcttcgataagtaactttttcatcaatactcttttaatcaggagaaaaggggaaaaagattcggaacatgatccgattcgcaagatgctcgaagccattgatgccggatattcactgattctttttccggaaggaaccagaggaaagtcggaacaaatgggaaaaataaaatccggtatagcccgtatcctgtctctgcgacctgaagtgaaatatattcccgtgttcatgaccggcatgggacgttcactgcctaaaggcaaaatgatactgctaccctacaaagcatccgtctattacggtatacccacattggtaaagagtacagatacacatgaaatattagaccagattacaggtgattttgaagtaatgaaagaaaaatatcaagtcgttatcgacgaagaagaggaatag

SEQ ID NO: 3547 - DNA, 231 bp, B.fragilis
tctttttctgtttttagatgtttatattctttttcaacccgggtgctgccgtatcggcagcctccgtttttttcgactttgcaaaggtcggtattcggtacggtacgggaaatggccattcaaccggataatttggcaattcttcccgattacacaaaaacatctattttcatcccggaaagggaccggtataggaagaaagccggagcaggaacacctatttatatataa

SEQ ID NO: 3548 - DNA, 1599 bp, B.fragilis
gttgctgacttttcaatctcggatgatctggctgccaaagttactttagtacccatcgagggatattacgataagggtaaaagtcgtcagaatcaagctgaggcacaggcggtagtagacgagattgttcgcagactttccgatccggaattgagaaatcagagtataggtgttgtaacttttagttccgtacagcagactttaatagaagacatgttatcggatgttgttttacagaacgcagaattagagaatcttgcattcaatcgtgaagaacctgtttttattaagaatctggaaaatgtgcaaggggatgaacgggacgttattcttttttctgtaggttatggtccggatgtcaacggaagggtgagtctcaatttcggaccgttgaatagggatggtggcgaacgtcgtttgaatgtggcagtgtcacgtgcccgatatgagatgaaagtcttctctacattaagagccgaccagattgatctgaaaaagacatcttctataggagtggcaggtttgaaatatttccttgaatatgcaggtaagggtaccggagttttgaatcattcttatgtagcggtatccgaagaggtcgaaatgggtgagctgattgctgcggcacttcgtgaaaaaggacatcaggtgaaaaccaaaatcggatgttccggattcaaagtagatgtaggtattatcgatcctaatgatacctcccgttatatgctcgggattttgtgtgatggcgagaattatcgggctgcaaaaacagctcgggatagggagattgtgcaagacagtgtactgaaaatgttgggatggaacatttgtaaagtatggactctggattggtgggaagactcacagaaagttattgaccatatagaggcggaattgaaaagagctgagtgcggaaaatcgcaacgatccgttccggtgatttctttggcttcaggatcgggagaagtgcaaaaagagggtttactatgccatgcacaacactgcttagtgaagttgccggagcaagtaattcgggaagaagtgaaaactgcgtcaccggagatttatgaaaaaactcttctaaactctgtaaatgtatctgcttgggaattgatgatgccacgccgggagccccgtatcagaaaacaattgaatgagatcatgcgtacggaggctccgattagccgttcattgttaagcagcaggatctttaatgcttatggcattcttcggaagacagctcgcctgattgaatggatggatggtatactggataaaactccttattacaagcaggaaattgatggattggttttctactggaataccaaggaagaagcagactcgtataccggattccgcatagactccaagcgtgaagccgtagatttacctcctcgtgaggtagccaatgcggctcggaatatactggaacagcaggtcgctttacctttggttgacttaatgcgggtaaccgcccagttgttggggtatgcacgtttcggattgaatgtggagactgccatgcgcaggggagtgcaaatactgttggacggagaagaggtaaagatcgaagggggtaagatacttatgaagtag

SEQ ID NO: 3549 - DNA, 210 bp, B.fragilis
atagacggtgtgttattaaaaagagagaaatcgtttctttctgatcttaaaataggaatatcttcgtctatttgtgttcgggccattaaagtgtctcttttctatgaaaagttagtagatattataatattattattaagtataaaagttgggataccgcttgtcgatttctgttttcattggctatatttgcgtgtatctaaaatataa

SEQ ID NO: 3550 - DNA, 1845 bp, B.fragilis
aataatgaagttatgaaaacaaatcaattcagagcgatggtgttcgcactgctaatggcagttatctctttggctacagtgagtgcacaagctattactgtgtcgggtactgtaacagatgcaaaagatggaactccgcttgtcggctgttcggtacagataaagggtactacgaaaggtacggtgacgaacatgaacggtcaatacacgattcagtctaagaaaggagagacgttgttgtttcagtatatcggctataagcaagagaaaagggtggtaaaatcgtccacactggatgtgaagatgaaagctgacgaacttgtattggaagaatgtgtggttgtaggatacggacacgaactaagggccactaaatcaatgtctactgcttatatggcagtatgtcccgcatcgggaatcatgtataatgctgtaaatgcggaagaatatggcgagattcaggaaaatggtttcaagaatgtgtcggatgctccactttctactttttctattgacgtggatgccgcttcttacagcaatatgcgtcgttttatcaataaaggtaaactgcctccagtcgatgcaatccgtacggaagaattagtgaactacttttcctatgattatccgaaaccgacgggaagtgatcctgtgaagattacgatggaagccggaacctgcccttggaacgcagatcaccgtcttgtccgtatcggactgaaggctaaagaaatcccgacggacaatctgcctgcatccaatcttgtctttctgatcgacgtctctggctctatgtggggagcgaaccgattggatttagtgaaatcctctcttaaactattggtaaacaacttacgtgataaagataaagtagctatcgtgacttatgcaggcaatgccggtgtgaaactggaagcaactccgggaagcgacaaacaaaagatacgtgaagccattgacgagctggaagcaagtggttctaccgcaggaggtgaagggatcatgctggcttataaaatagcccaaaagaactttatatcaggaggcaacaatcgtatcatactctgcaccgatggtgatttcaatgtgggcgtatcatcggacaaggaacttgaaaagctgattgaacaaaagcgtaaaagcggtatattcctcaccgtattgggatacggaatgggcaactacaaagacagcaagatgcagactctcgccgaaaaaggcaacggaaaccatgcctacatcgataacttacaagaagccaaccgggtattggtaaacgaattcggagcaactttacacactgttgccaaagacgtaaagttacaggtagagttcaatccggcacaagtgcaggcctaccgactgataggttacgagagccgtttgcttgcagacgaggattttaataacgatacaaaagatgccggagaaatgggagccggacatacagtgacagctttctatgaagtaattcccacgggagtaaagagtgattttgcaggaaaaatagacgatctcaaatatcagaaaaaacaaaaaccatctacgcctctcaatgaatctgacgagttattaaccattaagctacgttacaaagctccggacagtaacaccagcaagaagatagaattgccgttgattgaccataaaagcaaccgggtctctgccgatttccgctttgcagccgcagtagccatgttcggacaactactgagagactcggaattcaaaggaaacgccacttatgacaaagtgatctctttggcaaaaaccggattagaaaatgatgaaaaaggatacaaaagagaattcatacggcttgcagaaactgccaaaagtctctga

SEQ ID NO: 3551 - DNA, 315 bp, B.fragilis; identical to SEQ ID NO: 2146

SEQ ID NO: 3552 - DNA, 576 bp, B.fragilis
atgttgtttttcaaaagaaacatatcgagactatcggacgaggaattactgatacactatacgaagtctggcgatacggaatatttcggcgaattatataaccgatatataccgttactgtatggactttgcctgaaatacctgcatgatgaagaccgggcacaggaagcagtcatgcaactatttgaagatttactacctaagttgggaaattatgagataaaagtgttcaagccatggctctaccgggtagcgaagaatcattgcctgcaacttttacggaaggaaaataaagaaattccgttagattatacggttaatattatggaatctgacgaatttctgcatctattaagtgaagaggaaagttcggaggaacaactgaaggcattacatcactgtctcgaaaagttgcccgaagaacaacggaccagtattacgcgtttctttctcgaagagatgtcgtatgccgacattgtggaacaaaccggatttactctgaacaatgtgaagagctatatccaaaatggaaaacgaaatttaaagatttgcattaaaaatcagcttaagggatga

SEQ ID NO: 3553 - DNA, 324 bp, B.fragilis
agcgcctcctctcttaatttcttttcaactataaatgcttattttatagcatctgtcagctcagcacccggtttaaatttagcaactttctttgcaggaatctcaattgccttcttggtagaaggattgattcccattcttgctgatctttcagctacagagaatgtaccaaatccaaccaaggaaattttgtcaccagccgacaaagcttttgtaaccgaagaaaagaaagcttcaagcgctttcttagaatccactttgctcaagccggattccgctgccattgcattaataagttcagccttattcataatacgtaaatga

SEQ ID NO: 3554 - DNA, 1734 bp, B.fragilis
tgtccgcttcctttttcttcttttcctttttctttctctacctttgccattgatttatttattaatacacaaactatgaaatcacttcattctcttttattttgcggagtacttcttttgcatgcttcttgttcgggaataaaaacatcagatgagaaatctttaggtgattgtcctttggtagcgacctggaaacaggccggtactgacagtatagtggtattggacgtcgggttgataaaagataccatgcagatacggctcagccagttggtagacgacctggagattatcaagcttgaaacccgggatacggcattagtcaagtccggatatatggcggtctctgaccggtacatgcttttgggaagttatttaatgccttgtaagctatttgataagaatgggactttcctgcgtcaaattggcgggcttgggcaaggtcccggtgagtataccaatatttatgatgctcagatcgatgaagtgaataatcggatttatatgcttccgtggacttcaaatcaactattggtttttgacttggatggaaatatacttcctccgatacctttgccggcccgagttcctaaaggagtgttccgggtagatacgaaaaagaatctattgactatgggcatcttgcctttccaggatttagaaaataaatttgtgctttggcaacaagatctcaaaggaaatgtattgcaatccatcagttcgactccttattatacttatgatgattacagcaatgaagtgagcagtaaccggaatgccggttcttttgacttcttcatctttaattggtctgccgtacaagattccttgtatcactatgatgcgaaagagaatcgtttggttcctgtttttaccgccaatttcgggactcaggatattcccaagcatacgtatacggagtttcccggacattattgggtcaacatcataacagaggttgttaatgggcagggtatgcctccaatgaatgttttgatagataagcatagcctgaaagggacctattgtacattggtgattgatgaacttgggggcattccggtcgagtatccgtacgactgttttcaggacggacgttttctgatgaatctcgatccgggagatttgattgatgaattggaaaaagtccttgctagacccgaacgtttttctaaagaagaatcagatcgacttacaaaattaaagaattcgatttccgttgacgataataactatattctggtcggtaagtttaagtcaaaaggagaaagtctgatactttctgctaatccggttcagaaaataacggagcaggaacaacaaccggcaaaagaggaaccggtaaagactgccgttcagtccgaagtagcatcggaggcggatacagtgtggagtgtatctccatattcagctatacttcctgatgccattgattatttccgtactcataataaatataaagattgggatccgaaaaagggcaagcgcgtccttgtgcgtggcatagcagaaaaagacggaacaattacaggtgtaggcatcagttatggatgggatctcgatcctcagagcggggctatgaagaataagagcgagggaacttgtgggctgaaagagttggatgaagaagccttaaggctgatccggcaggctaaacttttacccggaatgacagataaaaaaataccggtcagaagtaaattcgttattgtagtcgatttccctcctaaatga

SEQ ID NO: 3555 - DNA, 195 bp, B.fragilis
cttcgcccgttacggctcttccccaaagcacgcaaaggaagaattgttcttttgttcatgattcatcagccttgcaagcaaaaagacaggaaaaagaccgatccgctaactcgtctttacaaaaagaatgcccaaccggaggccgaacaggaagaaaaccgggtcattgaagggtcaaagccggggattaagtaa

SEQ ID NO: 3556 - DNA, 486 bp, B.fragilis
ctcgtctttacaaaaagaatgcccaaccggaggccgaacaggaagaaaaccgggtcattgaagggtcaaagccggggattaagtaagaataagtccggattcgatactaaaagcctcttcgttttccgaaaaagaagtaagcatttccttcaaaagacggttacattttctaaaaacgcttacttctttgcactgacatctccatacgttttgaaaactacgtttactgctccggaaaacacgacttattccggctcttcatgctctaaccggttgctctccgaatcacctaccggagtatcaaaaagcctaaaattcccctccctgaagagcaccgggaatatttacttccagatcgctttctttctgacggaaaataaaagccggacaaaacaaaacgataaaccgggaaacgaaatagagacgtttttccggccccgcctgtcccgagagtcgaaaaaaagaaaactgggaggtttcatttga

SEQ ID NO: 3557 - DNA, 1203 bp, B.fragilis
gggattgatacgttgctcatgaacccaaaactttgttgcaaaatgactaaaacgactaatatgaaacagaacaccttttttgttaatgtatggaccttgatgctgattctgggtcttattgcttgtggagagaaaaaaacgcaggtgaaaacagaacttcagagaatagaagcttttgcatttgatgttaatgatgattatttacaaagctatgccggtactttttgctattctacttcagcccggatcgatggtaaagagtgtctgattgtttataatggaaaacttcattccattgacatcctgaatctggctgatcgccggccattaaagcaaatagctctggctaaggatggtccggatcagatacttgctcccaaagggatcggctattataaagattcgtttatcatactgaataccggtggtttgtatcgggttggtcaggatggaaaagtggtgtctaagaaacttctcaatgattttccgcagattaaggaagaagggtatggaatagccgttcccgatcttactgtttactttagcgtgtatagcttcttcggatttgatgctgcgaatggaagagtggctttacccctctacttttatgagaaagatactacgggagaatatccgaagaaagtgctgattgtttcgtgtgacgattggaatatacgggatgaagtggagatacattgtcctgatgtgataaggaaagagggagatatgcaattactgggttgtgtcaacgtgcttccctacggtgactggttgatttataatttccctgcgtcttccaaagtttatgtttacgatctgtctgtaaaaaagagtaaagaatatgattttccttctacctttacagatccttttttccatttaccggatataaatgggtcggagcccggtttcggatgcctcaaaaccggttattatttcccattgtgttacgatgcctatcataatgtgttctggcgtattcaacatgggcctttagatggtcatggagtgggaggaaagcccttttccgtcatgtgtatatcacctgattttttgaatagtgcagagtatgtgattcctgccggtgcatctatctatcccgatttggcttttacagattctttgatcttgttgccgtatacgggaggtgataaaatcggtgaaaacaatatgtgcttttatggactgcaatatagagaatag

SEQ ID NO: 3558 - DNA, 324 bp, B.fragilis
aacgtttatttaataattgataaaaagctaaacatgaagaagattgatttaattagaagtattgctgttaaaagcaatttaaagaaagagcacattgccattgtggtggaaggtgtgatggaggctattgccgaggcgctacatcagggagaatccgtcacattggtaggtttcggaacctttgaagtaaaagagcgcaaagcccgtaaaggttataatctgtctacgggagagataatgactattccgggaaaaaagacggtgagattcaaaccgggtgcaaagatgaatcttgagacgaagcatcaggatacctcccggtga

SEQ ID NO: 3559 - DNA, 1839 bp, B.fragilis
cgtctcctttttttgtatctttgcgcgcagaataataacttggatatgaagatagaagataaacttgtgacgtccgtaatcagcggactcaaagcactttacggacaggatgtacctgccgcgcaggtgcagctgcaaaagacgaaaaaagagtttgaaggacacctcacccttgtggtattccccttcctgaaaatgtcgaagaagggcccggagcaaaccgcacaggaaatcggtgagtatctgaaagccaatgaaccggctgtggcagcttttaatgtgatcaaaggtttcctgaatctgaccgttgcgtcggctacgtggatcgaactgcttaatgaaattcatgccgatgcgcaatatggcattgtatcggcagatgaaaatgccccgctggtgatgattgagtactcttctcccaacaccaataaaccccttcacctgggccacgttcgtaataacctgttgggtaatgcgttggccaatatcgtcatggcgaacggcaataaggtggttaaaaccaatattgtcaacgatcgcggtatccatatctgtaagtcgatgctggcatggcaaaagtatggcaagggtgaaactcccgaatcatcaggcaaaaaaggcgatcatctggtaggtgattattatgtcgctttcgataagcattacaaagctgaagtagcagagctgatggagaaaggcatgtcgaaggaagaggcggaagctgcctccccgttgatgaatgaagcgcgtgagatgttagtgaaatgggaagccggtgatccggaagtgcgtgcgctttggcagatgatgaataactgggtatacgccggttttgatgaaacgtaccgtaagatgggagtcggtttcgataaaatctattatgaatccaatacatacctggaaggtaaagagaaagtgatggaaggccttgagaaaggtttcttcttcaagaaggaagacggttctgtctgggctgacctgacagccgaaggattggatcacaaactgttgcttcgcggcgatggaacttcggtatacatgactcaggacatcggtacggctaagctgcgttttgccgattatcccatcgataaaatgatctacgtggtaggtaacgagcaaaactatcacttccaggtattgtctatcttgctggataaactcggatttgagtggggcaagagcctggtgcatttctcttatggtatggtcgaactgcctgaaggcaagatgaagtcacgtgaaggtacggtggtggatgctgatgacctgatggccgaaatgattgcgacagccaaagaaacctctcaggaattgggcaaactggacggcttgacacaagaagaggcggacgatattgcacgtatcgttggattgggtgcactgaaatactttatcctgaaagtggatgcccgtaaaaatatgactttcaatccgaaagagtctatcgactttaacggtaatacaggaccttttatccagtatacgtatgcacgtatccggtctgtgttgcgcaaagccgccgaagcgggtatcgtgattccggaagtacttccggccaatatcgaactcagcgagaaggaagagggattgattcagatggttgccgattttgctgcggtagtgcgccaggcaggtgaagattatagcccgtcgggtatcgccaactacgtttacgacctggtgaaagagtacaatcagttctatcatgacttcagtatcttgcgtgaagaaaatgaagacgtgaagttattccgtattgctctgtctgccaatattgccaaggttgtccgtttaggtatgggattgctgggcattgaggtgccggatagaatgtaa

SEQ ID NO: 3560 - DNA, 1353 bp, B.fragilis
tggggaccttatgcacaaacaataaatcttaattcaattgtggctatgaaacacatgtccttattgctaatcggcgtatttgtattattggggtgcagttccaataagaagcaagagcctatatccaagtcaggaatacctgtgattaatctttctgaggatgtatcgactgtaccttcacttcttttaagtgaggctgcctcaaaggtcgatatagtaccgttagaagtgacggatgaatctctattgggggaaatctatcatcttcaaataaccgagaacgatatatgggtacaccattataaagataaatgtatttgccgtttttcccgttccgggaaatttctgaataaagttggaaaaataggtcaagggcctggcgaatttattcaattatctgatttttttatagatgagaaacatagagaaatctatattgtatctgcatcaagaggcatttttgtatatgattttgatggtaatttcaagaggcagcctaccagaacaatagtagaaactatgttcggttctatttttaatcaatttatgatatataataatcacttttttattcttcaaaatttacctttataccgagaaatacctaaagattcgttatggtctcttgccttggttgatagttcttacaagaaaaaaaagatatttaaaaaccctgtacatataggtaaagaagatcaaattatagagaatcgtatccagatgaattatatgtttaattattggctggaatcttctactaacatcgatacatataataatcaactaactcttaagtttcctgacactgatacaatttatagctatgacagtattaaagaggaattagtgcctcagtatgccatttgggtagacgaagaaaaaggagattacgaatatacacatttatggtttcgtgacaggaaagctttcgattatttttcgatacactcatactactctactaaagaaaatatttatttggtaggcagtaaaggagaggaggtgtatatatattgttacaataaacaagaaaagaatgtaaggttgcaaaaacaacaaggagagataaccgagcgtgatgtgtcttggtttagtattcctttccgtcgaatggaatgtccgtttgtcctaagcaatgatctatgtggcggtgattttattatagattttcgctcttctggtaaatactgggtagatgtattatatcttggcaatgatggaaatagggttgatttgaatcaaataaaatcatctactgtaatagatgaatccaagaaaaaggagctaattcaggttttggaaagtgcgactgaggatagcaatccggttttgatgattgcaactttaaaataa

SEQ ID NO: 3561 - DNA, 207 bp, B.fragilis
accactgtatataagcacaatagacatgaatcgcacgattttaaccctaaatacccggacagttacaagcttgtaatacaagtcaattttaccattatacctacttttgccctctatatccaccaatataatgccaacggttcttccaaaaaccttcttatggtccactcctataaaagacaatatttagtctataccttcttttga

SEQ ID NO: 3562 - DNA, 1101 bp, B.fragilis
cacatgaagcatataggcagattagccctattcttatgtctggctgtcaacgcattcttcatcggaatgttactgttgacagcttacagcccgtatatcaatcccgaagtgcatccggtgcagtcatgcttgggactgacttttcccatttttctcgtcatcaacttctgctttctgatcttttggctcatcgtgcgttaccgtttcgcactggtccccctactgggtttcctcctttgctatccgcagttgcgcacctatatgcctgtcaacccgggaacggccggacaaccggaaaacagcatcaaactcctttcgtacaacatcatgtcctttgggaacatgaagaaagagaacggacaaaaccccatcctgaattatataaaaaacagcaacgccgacatcgtctgcatgcaggagtatgccggctccgaaaccgccaagatacatctcagcaataaagagatcaggcaggcattaaaggattatccgtatcacaatatcaagcaagtgggaaaaaccggagcaggcagtcaactggcctgttactcgaagtttccgattctatcggcacgcatgctcgactaccggagcaactacaacggcagcatggtttacgagatcaagataggaaaagacaccgtgctgctgataaacaatcaccttgagtcgaataaacttacccgagaagacaaagtggtgtatgaagacatgctgaaagatccgaaggcgggaaaagtgaaaagcggtgtacggcaactcgtcaataaactggcagaagcttcggccatccgctcggcacaggcgcgcaccatcgctcaggaaatagcccattcaccttatccgtcggtcatcgtttgcggcgactttaacgactccccgatttcgtatgcccaccgggtcatctcgcaagatatggacgatgcttttactgaatcgggatgcgggctgggcatctcatacaaccagaataaattctatttccggattgacaatattttggtcagtaaaaacctgaaagcgtccggatgcacggtggacaattccatcaaagactcagaccattatcccatctggtgctatattacgctccccgattaa

SEQ ID NO: 3563 - DNA, 258 bp, B.fragilis
aaaagaactaatagtagattatttttctgttgtagaacagaatttattcgtatttttgcgttcattatgatgcgcgaagaagctaatacgcacattatcacattaattacattaacaaataagaaggatgcctactgtaacaaaaaacctgataattatcaatgttctcctgttcctcgcacaatttgtagcacaaagctatgggatcaacttatccgactatctgggtctgcactttttccttgccgacaattttaa

SEQ ID NO: 3564 - DNA, 1827 bp, B.fragilis
gaacttaataaggggtcagatatgcaggctattatattggcagcaggaatgggcaggcgtctgggagaattgacccggtacgacactaagtgtatgattgaggtgaacggtatccggatcatagatcggttactggcaaacctggcagtcgcaagactatcgaggattgtgcttgtgattggttttcaaggtgacaaactacgggcgtatctgggaaatgaatattgcggaattcctatttattatctggaaaacccttactatgcacataccaataatatttattctctgtttctggcacggcaccacttagcgtctgatgatactttattgttagaatcggatattgtttttgagaagagaatacttgaaagagtgctcgaagaaccgtatccgaatgtagcagtagtagaccgttataagagttggatggacgggactatggtgactgtggatgaaaagcagtttattgtggactttgtatctaaacatactttttcgtacgaaaaaacttctacttattttaagacggtgaatatctatcgttttagtaaggaattttctgtaggtaagtacgtaccttttctggaagcctattgtaaatgttttgataatagtgcatattacgaacaaatactggccgttttgtctttgttggataaagccgggctgaaggctttgccgcttgagggtgaaaagtggtatgagatagatgacatgcaggatttagatattgccgaaacgctatttggtaagaaagaagggcttttgcccggttaccagaaacgttatggagggtattggcgcttccctttcttgcttgattttgcttatctggtgaatccacatttcccgacagaaaggatgctggaagaactgaaggctaatttggataaactgctcaggcaatacccttcggggagttatgtaaacaggcgattggtggcgaagcactggaacattcctgcggaggctgtcgcggtggggaatggcgcggcagagttgataagaaagctgatggagctgcttcccggtagaatgggggtgattcttcctacatttgaagaatatctggtgcgtgatgaccggatagagactttcttgccgttggggccaggttatcgctataccgtaagcgacctgaaaatattttttgaggataagggagtgacttcgttactgttgctgaatccggataacccctccggaaatagtattccttacgaggatttgatttcattagcgggatggactcaggagcgttcgatacggctgattgtggatgagtcttttattgacttctcggagggaggagaggaaacttctctgattggtgacaagatactgaaggagtataatcatctggtggtgataaagagcctgtctaagtcacatggaattcccggattacgattgggaattgctgtttccggtgaccataaattaatggatgaattacagcagaaacttccggtctggaatataaactctttggcggagtactatttacagattctggacaaatacacaatcgactaccgtcaggcatgtgcccgctttagagaggaaagaacgctcttttttgaagaacttcaggaggtaggctatttagcggtatttccttcacaagcaaacttctttttatgtgaagtgacccataagtacagcgcccgagagcttgcggaagttttgctgagagagcatgatattctggtaaaagactgtagcttgaagaggggaatgtatggaaagcagtatattcgtattgctatcaggagtaaagaggaaaaccggtatttggccggaatattaaaatataaattatga

SEQ ID NO: 3565 - DNA, 465 bp, B.fragilis
aaaagcctcctccgcgtaattgcggaggaggctttttattttctgacagaccttcccttcacagagacacgatcgaatgaaaaagaaataaaggggcgtgagtgcaggtgcaatttactcaatcttcctcatggtcatttgaccaaggtgatcacatcgcatacaaaaagtaagtgcattcttgccccgccgggaagaatgcacttgcacacaaacaaaacaaacaataagccgatctgtcacagatgggcattggccttaattagaactttcacaatctcaccgggaggtatcctgatgcttcgtctcaagattcatctttgcacccggtttgaatctcaccgtcttttttcccggaatagtcattatctctcccgtagacagattataacctttacgggctttgcgctcttttacttcaaaggttccgaaacctaccaatgtgacggattctccctgatgtag

SEQ ID NO: 3566 - DNA, 3036 bp, B.fragilis
attaaaagtaaaatgcaaaacaaaggatttgtaaaggtttttgcggtattactcacgctggtatgcgtgttctacctctctttctccttcgtgactcgccattataccaataaggcaaaagagtttgcgaaaggcgacgtgaaggtagagcaggattacctcgactctctctccaacgagaaagtatggttgggtaactatacgctgaaacagtgtcgtgaaatggaaatcagtttaggtctggaccttaagggaggtatgaacgttatcctcgaagtgtctgtacccgatgttatcaaagcattggctgacaacaagcccgacgaagctttcaacaaagcactggccgaagctgccaaacaggcaaccaccagccaggacgacgtgatcacactgtttattaaagagtatcacaaagttgcaccgggtgccaaactctctgaactcttcgcgacacaacagctcaaagacaaagtaaaccagaaatcatcagacgccgaagttgaaaaggtgctgagagaagaagtaaaagctgccgtaacgaactcatacaacgtgcttcgtacacgtatcgaccgctttggtgtggttcagcccaacatccagagcctcgaagacaaaatgggacgtatcatggtggaacttccgggtatcaaagaacccgaacgtgtaagaaagctgcttcagggatcggctaacctcgaattctgggaaacatacaacgccaaggaagtagctccttacttgcaggctgccgactctaaactccgcgcagtcctggcacacgaagctaccgtcaacgatacagttgccgcagtagattcaaccgccttggctgcagcagaagctactcccgataaagcagtcagcgctgccgacagccttgctgccgcactgaaaggcggagaaaagaaacagcaggcttcttctgccgatctggaacaactgaagaaagagcatccgctactggctatcctgagtgtaaatccaaacggaggccctgtggtaggttatgcaaactataaagatacagcgactgtcaattcatacctcgctatgaaagaagtggctgccgagttgccgaaagatcttcgcctgaaatggggtgtttctccgttcgaatacgatccgaaaggacagacttttgaattgtatgccatcaaatcaaccgagcgtaacggtaaagcaccgctcgaaggtgacgttgtaaccgatgctaaagacgactatgaccaatacggcaaaccgtctgtaagcatgtcgatgaactctgacggcgcacgtcgctgggcattgctgaccaagcagaacatcaataagtccatcgccatcgtattggataattatgtatattccgctccgaacgtaagtaacgagattacaggtggtaactcacagatcaccggccactttactccggaacaggcaaaggacttggctaacgtattgaagtccggtaagatgccggctcctgcacacatcgttcaggaagacatcgtcggtccgtcactgggtcaggaatctatcaatgcaggtatcttctcattcgttgtcgctctgatcctgttgatgatctatatgtgctctatgtacggattcatcccgggtatgattgccaacggcgctttggtactgaacttcttcttcacactgggtatcctttcatctttccaggctgcgctgaccatgtcaggtattgccggtatggtgttgtcactcggtatggcggtggatgcgaacgtgttgatctacgaacgtaccaaagaagagcttcgtagcggcaaaggcgtgaagaaagcattggcggacggttactcaaatgccttctctgctatcttcgactccaacttgacttctatcatcaccggtatcatcctgttctatttcggtacaggtccgatccgtggtttcgccacgactctgatcatcggtatcctctgttcattctttacagccgtgttcatgacccgtctggtttacgaacacttcatgagcaaagacaaactgctgaatctgacatttacttcacctatctctaagaagatgctggtaaatacacacttcgactttatgggtggcaacaagaaatggctgactatcacaggcgtgattttgctgatctgtatcggttcgctggtaacccgcggtttgagccagagtatcgacttcaccggtggacgtaacttcaaggttcagttcgaaaatccgatcgaaccggaacaggtacgtgagctgatctctaacaagttcggtgatgccaacgtaagcgttatctctatcggtaccgataagaagactgtacgtatcagtaccaactaccgtattcaggacgaaggtaacaatgtagactctgaaatcgaatcttacctgtacgaagcattgaaaccgatgctgactcagaacatcacactggctacattcatcgaccgcgataaccatacgggcggcagtatcatcagttcacagaaagtaggtccgagtatcgctgacgatatcaagacttcagccatctggtcggttgtattcgctctggttgctatcggtctttatatcctgatccgcttccgtaacatcgcttacagtgcgggttctgtagcagcactgaccagtgatacactgatgatcttaggtgcttattcactgtgctggggctggatgccgttctctctggagatcgaccagactttcatcggcgctatcctgactgctatcggttactcaatcaacgataaggtggtaatcttcgaccgtgtgcgtgaattcttcggcctgtatccgaaacgcaacgtaaaacagttgtttgatgactctctgaacacaactctggcacgtaccatcaacacctctttgagtacattgatcgtgttgctgtgtatcttcatcctgggtggtgactctatccgcagcttcgccttcgcaatgatcctgggtgttgtcatcggtacactgtcatctctgttcgtagcttctccgattgcatatatgatgctgaaaaacaaaaaaggttcggcacctgcaactactacagaagaataa

SEQ ID NO: 3567 - DNA, 249 bp, B.fragilis
atttcccccaatagagattcatccgtcacttctaacggtactatatcgacctttgaggcagcctcacttaaaagaagtgaaggtacagtcgatacatcctcagaaagattaatcacaggtattcctgacttggatataggctcttgcttcttattggaactgcaccccaataatacaaatacgccgattagcaataaggacatgtgtttcatagccacaattgaattaagatttattgtttgtgcataa

SEQ ID NO: 3568 - DNA, 1482 bp, B.fragilis
tttgaaaacaaaatgaaatcatttactttttttagaactgaggaaggaaactattacctatataatagtagaaagtcgtctttgctgaatgtacaccctgtgataaaggtgatagaggcattggacaacaatgatggagaggaaactttgtttgctaaaataatgaatcagaatttagaaataggtgatgatgaaaaacgtttgttattggataaatatctatttttgagggataatggtttctttgaagagattaatgaggaagattttatcgatggaaaaataactccggaaattgtggagaagcaaattgcattcatagataatgttctttttcaagtaacaggtaactgtaacctgcgatgtcaatattgttgctatggagacatgtactcagataaagtggagaaaaaaaatctgagttttgaaacagttgaaactgtattgaattatttaatgtctttgtggacttccaataaaaatctttcttatgaacatccgatcagaataggattttatggtggagagcctttggttaacttttctttgattgaaaaaattgtttctctatgcgaaagcattaccgaaaggacaggtttggtatttatatatagtatgactactaatgccttactgcttgaccggtataaagactttattgttagacacaatttttctttattgatcagtatggatggcaatgaagcacataatgtgttgagaataaagcctgatggggaacaatcctttcaaacggtgtatgaaaatgtgaaaaagttacaacagcaataccctgattactttcagaataaggttgaatttaactcagtcctgaatagccattcttcggtcgatgatatacatgactttatattcaatgaatttggtaaaattcctttaatagagacgatttcacatacagcactaagtgatgaacaaaaatatcaagaaatagctaaagattataaagagtctccagaaatgatgattaaaagaaaggataggtctccagtatataaggaattgggattcttcttttattatcaattagataacgcttataaacattattgtgaggtattgtatgggactatcaagcagaaaaagagaatacctaccggaacctgtttgcctttttttaaaaaaatgtttgtgacagctgataataaattgttaacatgtgagaggatcagtttacatcatgtgttgggcactgtagataatgaagtacatttgaactttggggagattgctagcatatataattcttattatgaaaaaatgagatctcagtgccggggatgctatttaatagagaattgtggtgagtgcttcttacagtttcctttgaaaaatggggtaccggtatgtcacgtaaagatgaatgaaattcaatatcaacattatttgtctgagatatttggagtgcttgagaagaatccaagtttatttgaagaagttaataaaatggtgtttgcatga

SEQ ID NO: 3569 - DNA, 381 bp, B.fragilis
tgtaattcaaatctgttagccatggataaaatagagtttagagaagataagataacgttttcatataagaaatcttatggagaatgtttgtatcaggatttaattgctgtggaatatagcaagccttactgtatattacaaataggaggtaggaacagtattctgtttttaataagcctacgtgtgattctggaaaaattgcctgccgattttctgctgataaatagaggaattatagtaaataaagagcgtattgtagattgtgtacttcaggacggggcatatcatataaagatggataataataaaatttataggattagcactcgtaagctggctacagttaagaaatattttatggtacaaaatgatactatttag

SEQ ID NO: 3570 - DNA, 1005 bp, B.fragilis
aacaaacaaaacgaacagtctatgaagaaagtcattttagcagtcgcctccattgcattgtgggcttcttgtatcgaggatgagaaagattattctcagattatcgaaacacgtgtagcaaattgcgaaacatccaaagatttcagcgtacctgtcaaagaggggtataccacctttgtcacctccggagaagataccctggcaatggctaatgaacctatcaccatccgtatccccaaaaacgccacaatatcgactcgtgccgaaggagacggtatcaacatcagttatacgattctggacgaaggatcggaaacaacttacgcaaaggtgtggcaggccatcatgttcgaagatacgcagaatggtgattacgattacaacgatttgattatccatgtaaagaataccgccagtaatcacgcctaccagcatcccagcgagacttggcaaacgatagagatccagcccatcgcattgggaagcaccaagacgatcaaactagggtgtatcctatccgatggctcaacgcacatgatcagcgatgacgtcagaactgatttattcggcggaagacagggattcatcaatacggtcaatgacaatgacccgatacgttacaaactggcttcaaccaatataaaaaactatgccatgcccaagaaagaaaaaacctcagcagcgtgggtagcctggttcattgaggtagacggaaaacggatgtacgctgccagctcagacatcgattacaaatcctacgatatggtaaataaggaaaatatgccttatggcctggccgtttcgaataataatggcacgttcagctatccacaggaaaagaacagtctttttgagacgtatccgggctttagcgattggatcaacggtaaagtaagctccatcggcagtttccaaaaagaacttgtctacaaatattgctccggcggcattatcggcgaagacggtaaatcacataagatctgggattatctggatttaaactaa

SEQ ID NO: 3571 - DNA, 3012 bp, B.fragilis
attatgaaaaaaaagatatcacgattgatatgtgccgtggcatgttgtgtgcctgtcgccttgcaggcacaaaccagcgagaaaataacgtctcccgtaaatctgtataaagaagggaaagagctgttcctgcaaaagaactatgcagccgcaatgcctcccctgcgcacatttgtccgccagaaagcggacgtgaacctgaaagaagaggctgaatacatgttggtatgttcggcgtatgaattgaaagaccgtaatgccatcgcgcaactacgcaactatctggacacctatccggatactcctcacgcaaaccgtatttatgcactgattgcctctgcttatttttatcagggcaactatgatgaagctctcgccttgttcaactcttcccgccttgatttgctgggcaacgaggaacgggatgacatgacctatcaattggctacctgctacctgaaagtcggcaatgtcaaagaggccgccatctggttcgaaaccctgaaagcaagcagtcccaaatatgcgaatgactgttcttactatatctcatacatacgttatacgcaaaaacggtatgacgaagcactgaaaggctttctccccctgcaggatgacgcaaaatacaaggcattggtgccctattatatcgctgagatttacgccgtcaaaaagaattatgacaaggcacagatcgtagcacaaaattatctgtctgcctatccgcaaaacgaacacgccgcggaaatgtatcggattctgggagatgcctattatcattttggagattatcacaaggcggtcgcctctttccggaattatctggaaaaggaaaatactccacgaagagacgcactttatatgctgggactgtcttactttcagaccggcgtattttccaaagctgccgaaacactcggagaggtcactaccgagagcgatgcactcactcaaaacgcatacctgcacatgggactcgcctatctgcatctggctgaaaaaaacaaagcccgcatggcattcgagcaggctgccgcctcgaacgcaaacctgaaaattaaagaacaggccgcctacaactatgcattgtgcatccacgaaacatcttattcggctttcggcgagtcggtaactgtttttgaaaaattcctcaatgaattcccgaactcagaatatgcggagatggtaagtagctatctggtagaagtgtatatgaacacacggagctatgaggcggccctgaagtcaatcgaccgcatcgcacatcccggtaaacgcattctggaagcaaagcaacgtatcttattccaactgggcacacaagcattcgccaatacacaattcgaacaagccatcggttatttcgaccgctcgctcggactcggacaatacaaccgccagaccaaagccgacgccctctactggagaggcgaagcttattaccgcttgaaccgtatggaggaagctaaacggaacttcaccgattatctgcaattgacccagcagacccataacgagatgtatgccctggcacattataacttaggctatatcgcatttcaccagaaagactatacacaggcacaaaactggttccggaaatatatcagcctggaaaaaggggaaaacaaaacggcactggccgatgcttataaccgcatcggagactgttatctggatgtgcgcaactttgacgaagccaaacattattactcacaggcagaagcgatgaatactccttcgggagactattcattctatcaactcgcacttgtatcgggcctgcaaaaagattattcaggcaaaatcactttgttgaatcgcctggcaggtaaatatcccgcttccccctatgccatcagcgccctgtacgaaaaaggccgttcttatgtattgatggacaacaatcaacaggccatcgcttcgttcaaggaactattggctaaatatcccgaaagtcctgtcagccgcaaagcagcggcagagatcggattgctctattaccaaaacgaggactacgaccaggctattaacgcttacaagcaagtcgtccaaaaatatccgggaagcgacgaagcgcgtctggccatgcgtgacctgaagtcgatctatgtggatatgaaccgtatcgatgaatttgcggcgctggcttcggctatgccgggcaacatccgcttcgatgcgagcgagcaggactcactgacttatatggcagctgagaagatttacatccggggacgagtggagcaggccaaagagagcttcggaaagtacctgcaaactttcccggatggagcattcggactgaacgcacaccattatctctgcctgataggcaaagaacaaaagaactacgacatgattctggaacattcgggcaagttgcttgagtatccggacaatcctttctcggaagaggcattgattatgcgtgcggaagtacaattcaataaagtacagtttgccgatgcactggcaagctacaaaatgctgaaagaaaaagcaactaccgccgaacgcagactgctggccgaaaccggtatgctccgtgcggcttatctgctaaaagacgatacggaaaccattcatgcggcaactgccttattatcggaagccaaactaagcccggaacttaagaacgaagccctgtattaccgtgccaaagcttatctgaatcagaaagcagacaaagccgccatgggcgacttgaaagaactggccaaggatacacgtaacctatacggtgcagaagcaaaattcctggtagcccaggaactgtataactcacagaactatgccgctgccgagaaagagttgctgaacttcatcgatcaaagcacaccgcatgcctactggctggcgcgtggcttcatcctcctgtccgatgtatatgtggctatggataaaaagttggatgcccgccagtatctgctgagcctgcaacaaaactaccatgctgacgatgacattgagagtatgattgaaagcagactgaacaaccttaataagtaa

SEQ ID NO: 3572 - DNA, 2406 bp, B.fragilis
ggtaaagaaaacgtttttttctacttttgcgggcaatttatatgttttaatatcacagatatgcagaaaaaccttgtcattgtcgaatctccagcaaaagcaaaaacgattgaaaagtttcttgggaaagattttaaagtcctctcaagttacggacatattcgcgacctgaagaaaaaagaattttctatcgatatagaaaagaatttcaaacccaaatacgaaatacccgcagagaaacaagagctggttaataaactgaaagaagaagcaagcaaagcagaaaccgtatggctcgcatccgatgaggaccgggagggagaagccatttcatggcacctttacgaagtcctgaaattaaaacctgaaaatacgaaacgtatcgtttttcacgaaatcaccaaaacagctatactgaaggctatcgaacagccacgcgacattgacatcaacctggtgaatgctcagcaggcacgccgtatcttagaccgtatcgtgggtttcgaactttcacctgttttgtggaaaaaggtaaaacctgcactttctgccggtcgggtacaatcggttgccgtacgtctgatcgtagaacgcgaacgtgagatacaggctttcaagagcgaagcttcttatcgtgtcacagctgttttcctcgtaccggatgctgacggcaagctggtagagatgaaagcagaactggcacgccgcctgaagacaaagaaggaagcccaaaaattccttgaatcatgcaaggcagccacattctctatcgaagatatcgtaacccgcccggtaaagaaaagcccggcagccccatttaccacctcaaccctacaacaggaagctgcccgcaaactcggcttcactgtagcgcaaaccatgatggttgcacagaagctttacgaatcgggattaatcacctatatgcgtaccgactcggtaaatctgtctgaatacgccacagagggaagcaaagttgccatcgcacagatgatgggcgaccaatatgtgcatccacgccatttcgctacgaagaccaaaggagctcaggaagcgcacgaagctatccgcccgacttacatggaaaaccagaccatcgaaggatcggctcaggaaagaaaactatacgacctggtttggaaacgtaccatagcctcacaaatggcagacgccgaactggaaaagacaacggcaaccatcggtatcagcaacggtaacgataaatttaccgctaccggagaggtgatcaagttcgatggttttctgcgtgtatacaaagaatcgtatgatgacgacaatgaacaagaagacgaaagccacctgctgccacccctgaagaaaggacaaatgctggaacatcagggaatcgtagctaccgaacgtttcacacaacgtccgtcacgctataccgaagccagcctggtgcgcaagctggaggaactgggaatcggacgtccgtcaacctacgcaccgaccatctctaccatccagcaacgcgaatatgtggagaagggggataaaccgggagaagagcgctcgttcgatatactgaccttaaaagataatcagattacggatatcaaacatacggaaattgtcggagcagagaaatcaaaactattgccaacggacatcggcactgtagtcaatgacttcctgaccgaatacttccccaatatcctggattataactttacggcaaacgttgaaaaacaattcgacgagatagctgaaggcgataagaaatggacaagcatcatgaaggatttctataaggacttccatccttcagtagaaacgacactggctaccaaaaccgaacacaaagtaggtgaacggattctgggagaggaacctaaaaccggaaagcccgtatcggtgaagatcggacgtttcggcccggtagtacagatcggtacggccgatgacacagacaagccacgctttgcacagatgaagaaaggacagtctatggagaccatcactctggaagaggcactggacttattcaaactgccgcgcaaagtcggagaatttgaagataaaaccgtaacaatcggtaccggacgcttcggaccttatgtatatcataattctaaatatgtgtctttgcccaaaacttatgacccgctggaggtcacactggacgaagctatcgagctaatcctggctaaacgtgaagcggaagcgaaaaagcacatcaagaagtttgatgaagatgcagaaatggaaatcctcaacggcagatacggaccatacatcgcttacaaaggaaataactacaaaatacccaaagacgtggtaccggtcgatctgaattaccagacctgcctggaaatcataaaactgcaaagcgaaaaagcagaaaacgctccgaaacgcggacgctacgctaagaaaaaatag

SEQ ID NO: 3573 - DNA, 1710 bp, B.fragilis
cagagtatgaaatataataattatatccttttaggaattgcttttactgcactgcccgtttcgatacaggctcagacgcagcccaaagatacgactgtaaaccgcaccgtaatagtggagcagcaatataatccggacataatggatgctgccaaggtaaatgtcctccccaaagttgaagagccctccgtaagcaaaaaggaggtggagtacgctacattcacaactcccgccacttcgattccggcagggactataggcgcttacaccggcaaagagatacaaccgggattcatcccgggttatgttcgcctgggatatggcaactacggtaacctggacgttttagccaattatctgttccgtctctcggacagggacaaactgaacgtgaacttcaaaatggacggaatggacggtacgctggatatgcccttcggtgatacccgaaaatggaacgctttctattaccgtacacgggccaatgtagactatgtacaccagtttgcaaaactggatttgaacgtagccggtaatttcggcctgagcaatttcaattatgaaccttacggattcaaaaagcagaaattcacctccggtgacgtacacttcggagtaaaatcaacagacgaaaccctgcccttgcaataccgggcggaaaccaatctgatgctatacggacggcagcaatgccaactcttcggaggggtaaacgaaacaatggtacgtactctggcaaccgtaagcggttcagtcagtgacgagcagacagtagctatcggatttgccatgaacaacctgatctacgggaacgaactgaaagaaaataaagaccggataaaggatattttcaaaaatcgtacaacacttgatctgaatccttactacgaattgaataatgacagttggagagtacatgtaggcgccaacgtagacctctctttcggaaacgggaaagctgtccgcgtgtctccggacgtgaaagctcaatatgtattctcggacagttacgtactatatgccaaagcaacaggaggcagacaattaaatgacttccgccggctggaaacttataatccgtacctcgatccgggacaggaggtaaaagacacttatgaacaactgaatgccggactgggattcaaagccagtccgacacccggactttggttcgacatcttcggcggataccaaaatctgaaagatgatttataccaatcggcagacgcctgggagggtggagacggagcaaactacattggtttgggacagacccatacagataacttttacgcaggtatcaaagccagctatgagtacaaagacttatttgctatttcagcaggcggaacttattatcattggaatgcggacgctcaaacaaccggttcaaaatcctccgattataatgaagcgttactgatgaaaccggagtttgacctcggaattcacacggaaattcatccgatagccgcgctttggctaaacgcaggctaccaatatacccgcagggccgaacgttataccggactttacgcgaaaagtattcctgccgtcagcaacctaagcttgggagccacctacagaatctttaaaggaatttcggcatatgtaaaggctgacaatctgctgaataagaaatatcagtactacttatactatccggttgaaggaatcaattttgtggggggactgagcttccggttttaa

SEQ ID NO: 3574 - DNA, 1311 bp, B.fragilis
attgtgatgaagtctatattattattactaataattacgctattgggatgcagttccaatatgaagcaagagcctatatccaagtcaggaatacctgtcattaatctttctgaggatgtatcgactgtaccttcacttttgctgagtgaatctgctgaaaaactagaaattgttcctttggaaatgacagatcaatctatgttaggtgaaataagacgaatacaagtgacagaacatgatatatggattcatgattttaataaattttatatttatcgtttttcccgaacggggaaatttttgaatagaattggcagtatagggcaagctccaggagaatatgtcaatttttcaacctttctcgttgatgaatataaaaaggaggtctatattatttctaataacaatggtattttggtatataatttcaagggagagtttaaaaagaaaatagttgatcagcagacaatcaataatctattctcatctgtatatagtcaatatatcttatataatggaaatttctttgctgctcagaatatagctttatataaattaatagataaagattcattgtggtcttttgcttttttggacacggcttttcaagaaaaaaaattatttaagaatccagcacatatgggtagagaagagcaaattatagctaactgtgtcgataaaggtagaatgattaatctttggatggaatatcaaaccagtatagacacttacaataatcaactgacccttaaatatccagatactgatacaatttattgctatgacgatgcgacgaatgacctcttgtctcaatatgtaatttgtacaagagaagagaaaggagactatgaggttactcacttatggtttaaagatagaaaggctttcgattatttttcgatcaagtcctactatccgactaaagctttcatttatttggtgggtagtaaaggcgaggaggtatatacctattgctataataaaaaagatggaagtgttagactgcagaagcgacaaagtgcaataaccgagcgtgatgtcccttggtttagctttcctttgcgccaaatgaaacgtgattttgtgttagataatgatttaggtggaggtgattttactgttgacagccgttcttccggtaaatactgggtagatatattagaacccggcggtgatgagaactggattgatatcgaccaaataaaatcatctaccgtaatagatgagtccaagaaaaaggagctaatccgagttttggaaagtgcgactgaggatagcaatccgattttgatgattgcaactttaaaatag

SEQ ID NO: 3575 - DNA, 1311 bp, B.fragilis
attgtgatgaagtctatattattattactaataattacgctattggggtgcagttccaataagaagcaagagcctatatccaggtcaggagtacctgtgattaatctttctgaggatgtatcgactgtaccttcacttcttttgagtgaggcggcggagaaattggaaattgttcctttggaaatgacagatgaatctgtattgagtgatattacggaaatgcaagtaactgatcataatatatggatagatcatggacgcgaattctacatttatcgtttttcccgtacgggaaaatttctgaatagaatagggagtataggccaagggccgggagaatatgtcaattatttaacttttcttgtcgatgaagataaaaaagaagtatatattttttccactaataacggtgttttagtatatgattttgaaggtgggtttaaaaagcaaatttcagatttccaaactatggttggaatgttttcgtctatatataagcaatatatcttaaatgaccataaattttttgctatccagaattttggtttatatagatctgtggataaagattcattgtggtcttttgtttctttggacgataactttcagaaaaagagactatttaaaaatccggttcatgtgggtaaagaagagcagattatagctaaccgtgccaatatggatcggatggttaattattggatggagtatctaaccagtgtagatatttacaatggtcaattgacccttaaatatccggatactgatactatttattgttatgatgatgcgacaaaccaacttttgcctcaatatgcaatctttacagatgaagaaaaaggggattatgaagctactcatttatggtttaaagacagaaaggctttcgattatttttccattttttcttattatccgactaaagatttcatttatttggtaggtagtaaaggcgaggaggtatatacctattgctataataaaaaagatggaagtgttagattgcagaaacgacaaagcacaataaccgagcgtgatgtgccctggttcagctttcctttgcgccaaatgaaacgtgattttgtgttagataatgatttaggtggaggtgattttactgttgacagccgttcttccggtaaatactggatagatatattagaacctggcggtgatgaaaactggattgatatagaccaaataaaatcatctactgtaatagatgaatccaagaaaaaggagctaatccgagttttggaaagtacgactgaggatagcaatccgattttgatgattgcaactttaaaataa

SEQ ID NO: 3576 - DNA, 1236 bp, B.fragilis
aatggtgtttgcatgaaaaagtattggtttattgtagaaacatatgtttttctttggaaaaaagaagatcatatattggtttataattctatcagtgggaaaggatatatttataaatgttccccggatttattatcttttatggatcaattgatgttacctgagaatttgtattgctcacaagtggatgaagaactgttgagaagaaagtctattggcgaatttgtgatttcaatgcaatctaacttctgcggtagtttgtttgatgttgatgaatttcctcagaagccaattgtggctgttcctgatgtgaatattggtgaggatatagaaggtgtggataattctgtttttggaggaaatgttctacgtaatttaactgatgtgttcatttgcttaacaggaaaatgtaataaaaactgtccagattgtaatttgatttataaacaaatgtgttggtgtcataagagtaatgagagtttggcatttgaaaaattagaagctattttgaaaaaactagagtatttaaatgtatttgaacttcattttacaggtggtaatatgtttttgtatccttattggagggaattactcataaaacttaatgaaatatcctataaaaagagtttttatgttcattactcacagcttagaggctatgatgaagatattgatcatattttgaatttggaaaattccgttattagaatacttgttgatttcgcagattttgatgttgagaacttgcttctgatttctaaaagtggaggaccgtttgaatatttgtttaaaataacttcttggaatgaatataatgaggcttgtgatataattgaaagattatgcttaaatgcaaagatcattcctttctataatgtaggtaattattctttttttgaagacaatgtctttctgaatatgcaagatatattgtctactaagtggactaaaaatgagatatttgcaaatcaaaaacttaatacaaatgattttggcaaaattaggatactagagaatggatttgtgtatgcaaatttaaactttgcccctataggtaaatggcatgatgattatagggaaatcgtttataatgaattaaaaagaggaacgtcttggcgtagaacccgtgattcattgcctgtttgtaaagaatgtttgtgtaaatatctttgtccttcaccctctaactatgaattagcaattggaaagtctaatttgtgccatgttaaatcataa

SEQ ID NO: 3577 - DNA, 381 bp, B.fragilis
tcagttacttgcatttccgtaatatcactcaatacagattcatctgtcatttccaaaggaacaatttccaatttctccgccgcctcactcaaaagaagtgaaggtacagtcgatacatcctcagaaagattaatcacaggtactcctgacctggatataggctcttgcttcttattggaactgcaccccaatagcgtaattattagtaataataatatagacttcatcacaatttatttattagaaacaacatatttttccatcataggaacctactctattattttaaagttgcaatcatcaaaaccggattgctatcctcagtcgcactttccaaaacctgaattagctcctttttcttggattcatctattacagtag

SEQ ID NO: 3578 - DNA, 1200 bp, B.fragilis
aatgaattctgtatgaaagttttgtatgtaatttttatatgtgttttgtattcatgtatgcaaaatgttgagccggataataagataaatgtgggtgcagcaatgaatgctttaggaaagataacggcacagacaatatcttctaatgtgagatatgtagcattggaaacaaatgatagtagccttgtgggagaaatgccggatatgcgggtgttagagcatgccatacttgtatcttccgtaaatcaatgcctgaaactttttgatcgatctaccggtaaatttattcgggatataggtcatgtcggaacagacccgcagggatatgctaaagatgcttggggaaaagtgaactattgggttgattatgaccaaaacataatatatgttttaggttggggtaatgatttaatattgtatgatttagctggtaattataaagatagaatttgtatagatgataatgtacgctataatttgcagcaaagctatctatatgttacttatggtaaactatggggacataataaacttgatatttccaagtcacccttgttttgtatagacgaaaactctaatcacattacagatatagtaggtttaccggtagatttacttcctatggatgatttgcaatctgtatcggaacttttaggggattatgtatcttatggcggtgatttgacaatggcttcatttgccaatggtggaaagttttacacagccattaatagtccttccttatggcggtttgagaatgatattagattaaaacaaacattcaacgatacgatctatacgctgtcggatagtaaaattaaaccttatttaattttcgagctaggggattgggcttggcaatatcaagatcggttggaagaaggtggatgtgaaaagaaaatcatgattgattatgctttggaaaatgagagatgtatttattttcattttcatacagggttctatactaaaaataggcaggctttttgtggactatattataaagctgatcatagagttgtgttgatgtgcggagatagactgttggatacagttaatagacaatctctcagagttaggggagtaagttctgatggctgttttatagctctgctgcaacctgatgagttgtgtgatgaagtgaaaaagaaaacgggtagtaaagaagaagacaatcctatagtggtaatattggagtaa

SEQ ID NO: 3579 - DNA, 1287 bp, B.fragilis
aaaatattatgtatttttacttctaatttaatgatggacaaagctatgcgaataatattgatactgggtgctatgatattgggcttcacggcttgtagtaacaaaaaaacagtgaatcctaatcctgttgttcgggataatattattcatttgtcaactgcgataaagaatgttcgagaggaaatgatgctttcggagttggtggatagtgtcagatatattcctttggaaacgaatccgaattgtatgttacgtaattatcagcgtttgaccttttctccccaatacatattttacttaaactattgttttgattggaatgggcagttcttgttccgtattgggagccagggtcaaggggcttgtgaagatatctatgcgcatgtggccgaaatagtatatttgaataatcatttctatgggaatgcctctaaaataatagaatatgatgaccgggggaagtgtacggggaaagagctaagctggtttacccagaaaacaatggacactgcaccggttggacatttggtcaatcaggtctgctttgctccggcaggagaaaacctgatgttttataattctccggatacggtttatttcataaatacggattacgaatttgtagccaaacgcagtatgatgccgtggaacaggaaagggatcgctccgtccatggggagtgtgaagtatacgagctactataaagatacgaccttattttatattttttatacggatacagtttttactgttacccccacttccctggtacctcgctgggtggtggagttggatgaagaattacggtttcctacccagtatctatatgaagatggattattttctgatgcttttaaatgttgggaatcgggcaacttggaaaatgcaaaaatgattaaaatgctggatcacaaatatatagtatccggtgtttttgaaacagagcattttgtttttttatctgtctatgaatatatggcatactgggagctgcgtaaactgcctaagcctcctctattaacagccatttacaataaacgtacgggtgagacatttgcggtgaaacagattatagatgatctgggtggtatgaagaccttctttccttcttggggggcgtataatgaaaagcttttagctaccatctggccttataagttgaaagaatttatagaagaggaacagtcggccggacggactgtggctccacaaatactgaacctgatgaaacgtgtgcgagaagatgataacccgatattgataatagctaatttgaaaacaaaatga

SEQ ID NO: 3580 - DNA, 1686 bp, B.fragilis
gatacaatgtgtttgaataaaaatattaaatcctttcttgggatacttatgtgtgggatattggcttttctgccggtatcctgttcagatgattctccggtaacaggttcacccttgcttccggaggctcctgaaggtaaagtgaacgtatttctttctcttcataaagggagtgattatgaatctcctgccacacgttcggggacagcggccgatgaaactattatgggacctccctgggtgttggtttttttggggaatgataaagatgcgactttcttggaagccgtacaagccgatatgacctcggtcggagagctttatgcacaattaagtgcctgcaattcttcagtggttttgctgttgatttcaaatgccgatgaattgatacaggcgaagttaggaagtcttacgactacgacaactttatccgatgcagttaccaatcttcttctgtatggcgatccgtcggattctcctgtggggggtaactctgcattagcaattccgcaagcgacagttccttttacagggaagaagatcccgatgtcggcctattgtccattgccacagattatcacaggtactactgtaggaactgtcggtacccctcttcgcctaaaacggatcgtatctaaattatacgtagatgcttccggtgcacatgcttccgatggttttattttgacaggagtatctgttattaacgtaccggtacaaggagcacttgcttttgaatatggaaatgcgaatgaaactttacctattacggctcaatttaccgattatggtcataaatcgggtagtgcttcccggttggacaatccgattatagcctcttcaacaggatttgccgggcatataaccgcaggtatgggaagtgaagactatcctgtttatgtatatgaaacggcaggtggcccggctgaccgttcggatgttattcttgccggtaagtttgataacggaccggttcgttattatcgcgcgagtctgaaaaacagtaaaggagaaaagctggcatttaaaagaaactatctttatacgctaaatctggtacgtgtggaaggaggaggctattctacgatggatgaggcgattgctgctccttcgggtagtagcggaattctttgcaatgttacggtggtagacgattcgcatgaaataacaggtaatggtgtttattatttggggctgacgaattcttcttatgtgctttatacggatgaagaacagaaggatgttacggtatgtgtgatagggaccaatgcgtacagccgtccgggaagtacggttactccgggagtggtaagcatgtcgtccgggatagccggtgtgactcttaaaactacttcgatctccgcagactcgactgccattaagttggattttgccaagggagcgcagggagaaacgacccttgatgttcaggttggaggattgcgtagggaaataaagctgaaagctgccggtatgggtgtttccggcaattatgcttcaggttctcaaggactcttgttgggagatttcaaccagatccgtattcttgaaagtacgtctaagtctggactggcaatatctcccgcatctccggaccgggatagcgaggtcatctcttccgttacttctccttctgtccctgtttacttctttgtcgaggaggctgcgggccccacaaagtgctaa

SEQ ID NO: 3581 - DNA, 687 bp, B.fragilis
caaataagaaggatgcctactgtaacaaaaaacctgataattatcaatgttctcctgttcctcgcacaatttgtagcacaaagctatgggatcaacttatccgactatctgggtctgcactttttccttgccgacaattttaatccggcacagctattcacttacatgtttatgcacgggggattcacccacatcttctttaatatgtttgcggtatggatgttcggacggattctcgaacaagtatggggcccgaaacgttttttattttattatatcctctgcggcgtgggcgcaggcttacttcaggaaggagtacaatacatacaatacgtgaccgaactgtcgcaatataccagtgtaaacatcggtacgggtatcatccctatgagtgaatacctgaacatgatgactacagtgggagcttcgggagccgtgtacgccatcttgctggctttcggaatgctgttccccaaccagcagttgttcatcttcccgctgcctttccctatcaaggcaaaattcttcgttatcggatatgccctgatagaactgtatgcaggttttgccaataatccgggcgacaacgtggcgcacttcgcgcatctcggaggaatgatattcggattcatcctgatcatgtactggagaaaaaagaacagaaacaatgggacatattataactga

SEQ ID NO: 3582 - DNA, 930 bp, B.fragilis
tcatgtactggagaaaaaagaacagaaacaatgggacatattataactgacctgaaagaagcgtttcgtagagggaacgtctatattcaactgatattcatcaacgttggagtatttgtcattacaacgctgatcggtatcttactgcagttgttcaaccggagtgccgccggtatcttcgagctgctggctttgccggcttcttttacccgatttgcatggcagccatggtctatcttcacctacatgttcatgcatgcgggatttctgcacatcctgttcaacatgctatggctctattggttcggggcactgtttctgtatttcttctcgggcaagcacctgagaggcctttatatagtaggaggaatctgcggcggactgctttatatgatttcttataatgttttcccgtatttccgtcccatgaccgcctactccaccatggtaggcgcatcggcttcggtgctggctatcgtcgtggcaacagcctaccgggagccgaactatcccgtacgccttctcttcttcggcaatgtacggttgaaatatctggccctgatcgtggtgctgaccgatctgctgttcatcacatcgagcaatgcgggcggacacatcgcccacctgggcggagcactggcaggactctggtttgcagcaagcctgaacaaagggaaagacatcacttcatgggtcaacaaggcgctcgatgccatcgccgccctgttcagcgccaaaacctggaagcggaaacccaagatgaaggtgcattacggaaacaatacccgtcagaacgattacgattacaacgcccgcaagaaggcacaatcggacgagatagaccggattctcgacaagctgaagaagtcgggatacgagagtctgacaacagaagaaaaaaagagcttgttcgacgcaagcaaaagatag

SEQ ID NO: 3583 - DNA, 234 bp, B.fragilis
gccgacatcgggatcttcttccctgtaaaaggaactgtcgcttgcggaattgctaatgcagagttaccccccacaggagaatccgacggatcgccatacagaagaagattggtaactgcatcggataaagttgtcgtagtcgtaagacttcctaacttcgcctgtatcaattcatcggcatttgaaatcaacagcaaaaccactgaagaattgcaggcacttaattgtgcataa

SEQ ID NO: 3584 - DNA, 1470 bp, B.fragilis
aaagacagaggatgggggccggggaataagaagtggcggatgcctactttagatgaactgaagcttttgggcgatgggattcgggaaactatttcttctactccgaattggaactctatttctatcagttcggatgatggtagttttgttattagcaatggaattcgtacgaataaccgctattatcttcctgctaatagatatggggatagcggggagtattggtctgcttctgccgcgattagtggttcagcccgaggactttgctttagatattcaagtacttccataaaagattggaccactgcgttggtgtctggagccattcgttgcgttgttgattctgagaataattattcaaaagtttatcgtgttgtttattcgaataccgatcctctgaatcaagaaaataatttgtatagcgttccgccaccggcattgttgaacgaaggagaaacgataacattgccagcgctgtctacaaaattcaatgattacgaagtacgtgaagggagtaaagtggtaacaaagtattttcattccggatggcttgtaaatggacggcattttgattttggtgattcatatgtggtcggtgctgatgggataggaaacactgaagtggagattaggcctgaatggactaaactttgtaaaatagagtatgttgctactcctccatatcccggagctattttttattggcgttttcccagcactactatcttcgtaaagataggagagaaacattccttattttatgttgaatcagcagtaaactcttcgcctgtcaagatgtgtaccggactgctggttaatggtattcgttatagctttggagatgaaatagttgctagcactgatgtcaagatagaaccttattgggcaaatacaccggagaccccgtttgcatcaactaatttggaactttctaatccgggttctactgatgcaacctttatttttgcacctactggcagtaagggtagtaagtgctcccatcaggttgctaattctaactttcccataaatggtgtaactattccgtcactactgccgactgattatgataacgctaggaggttgatacatagtgtagaggggctaaaacgaggagttggtgatgtatgtcgtttagtaggtatccctctaaatgaaataaatgcgaaattggctgccggagagttgccggacaacaaaacatggcgattacctgccgtgtacgaaatggctgctctacttcatccatatcaagatagttcggaaggaaggttttatcctatcttaaatacttattttccgtatcatacagtatatataggaatcccaggtattgcggcttcttatataaccgctggtagtagaaataataaccgtgtggttactgtaacgatttcgcaaggagacggcggtattactggtggcatgttcagtgctacttctgattatgctcgttgcatccgccaatag

SEQ ID NO: 3585 - DNA, 570 bp, B.fragilis
aactgcttctttttcgttatttttgcctgcacaaaaacaaatagaatgatggaacatccacttaatcaatttaaatactgtccgaaatgcggttctgccgcttttgagattcacaacgagaagtctaaacaatgtaccgattgcgggttcgtttattatttcaacccgtcatcggctacagtggcactgatcttaaacgaaaaagacgagttactggtatgccgccgtgccaaagagccggcgaaagggacgctggaccttccgggtggcttcatcgacatgaacgaaacgggtgaagaaggagtaagccgggaagtagaagaggagaccggactaaaagtgaaaaaggcaacctacctgttttcccttccgaacatttatatctattccgggtttcctgtacatacgctcgacatgtttttcctttgccaagtggaagatacaagtcactttgaagcaatggatgatgtggcggactcgtttttcgtcccattgtgccaaattaatcccgaagagttcgggttgggctctatcaaaaaagggttaaaaagattcctgaaagagaggtaa

SEQ ID NO: 3586 - DNA, 621 bp, B.fragilis
  unsure (596),(597),(598),(601),(602),(603),(604),(612),(613): Identity of nucleotide sequences at the above locations are unknown.
attatgaatatagatataaaggaggcacatcggaggatgctttatttattgcagtctttcgatactgtctgcaagaagcacgatattgattattggctcgattatggtacactgctgggagctatccggcatcaggggtttattccttgggatacagatacggatgtggggatgttaaggagtgattatgcactctttttggagaaaggtgtgtcggaattgcctcaggatattttctttcagactccggaaacagaaccggccatggctccatggagctggttggttgaggcgcggttgagagatcggcacagccggtatgttccggataaaaagactccggccgagccgatgcagtttggtggattacagttggatcttttcatttatgattgggatggtaagtatgagaatgctttgtcgaacagttttgagcggaatttgagtgagagccgtattcatttgcggctggatgaggtggaatatctggatactgcacgatttgaaggagtggagtttccggttccgtcaggatacgatgcttatctgacccgttggtcttcaccacggggctggcgagaagcgcgtcgaggccnnnggnnnntctatggnncctccccg

SEQ ID NO: 3587 - DNA, 234 bp, B.fragilis
tttaccgtcttcgccgataatgccgccggagcaatatttgtagacaagttctttttggaaactgccgatggagcttactttaccgttgatccaatcgctaaagcccggatacgtctcaaaaagactgttcttttcctgtggatagctgaacgtgccattattattcgaaacggccaggccataaggcatattttccttatttaccatatcgtaggatttgtaatcgatgtctga

SEQ ID NO: 3588 - DNA, 300 bp, B.fragilis
catatattaattaatcatttacgtattatgaataaggctgaacttattaatgcaatggcagcggaatccggcttgagcaaagtggattctaagaaagcgcttgaagctttcttttcttcggttacaaaagctttgtcggctggtgacaaaatttccttggttggatttggtacattctctgtagctgaaagatcagcaagaatgggaatcaatccttctaccaagaaggcaattgagattcctgcaaagaaagttgctaaatttaaaccgggtgctgagctgacagatgctataaaataa

SEQ ID NO: 3589 - DNA, 1281 bp, B.fragilis
atgaagcagatctttttatttttattcattttcctgcttacctcctgtatttcaggaggtgccaagcaagatcaaattaaggttatagatcgtaccattcgcattggcgatgcaatggagcatcctgttccaatgaaactttcagcttttgttgatagtattacttatattcctttggagacaacaaaaagttatgtaaaagataaaatgcttatttcttatgtggagccatattgggtcgtttatccgggaagcttatttgataaagaaggacgatttgtaacaaatattggtgcattagggcaagggcgtggtgaggaaaccaatggttggggatatagtgttttttatgatcttcagagaaatgttttctatacattgggggataaaattatagagtttgatagtaatagaaaatttactggaaaagaagttagaatatcttatcgtgaaagaaatgcgatgcaggtagctggtggattgaaaaatgtggttgctttgctaaaagctgatacaaaatatttattggtaaattatccggattccattttttggatggactctgatttagaagttacacataatacccggattattccagatagcttattccttgatcctccgggagacgcgaatggaatgtcatatacattctcacgttataaagatacgactatcttttataattgttttacggatgccatttatgcagtgactgatacggggcttcaaaaacggtgggacttggacttgaaagggctaaaaccggacaatcgttgttttttaaatgagcttaatcgattgtacttgcaagaaatggttaaaatagttcgttcttcaagtgggaatgagaatgtagtaaagtcgaaagctgaaaatagtgaattagctcaattgattgatgataagaaatgggtcaatcatgcttacgaaagtgaacgttatgtactgatgtcctgggttaacttgaaggctttttccggatggagaggtctgaaagaagaatcgcatttagctttctatgacaaacgatcaggaaagacaatagctgtggcaggagatggtttaatagatgatattgatggtggaatgatgttttatccatcacttggagtttgtgacggtgcgatggtgtactctgtctggccgtttgaattgaaagaatatattcaagagaagaaagccaaaggagaagccgtgagtgatcgtcttattgcacttgctgattcactggatgatgagcaaaatccgattcttgtaattgctcatttaaagaaatag

SEQ ID NO: 3590 - DNA, 303 bp, B.fragilis
tttcattttgtcaaatttacaatttgtccggtaagctctgtctgtaaccggataaattcggatgaagattcatgcagcgcaaaaaatgcgctgcatttggcttctgtgtttgtctatattgtagctgttttgctgattggcggatgtttggatatgatattccttgatccgtctgtctacttgtctcctgtgcttgctgtttgctttctttcttctatcggtgctttttctttttcagtatgcaaccagcctctttcttccccaattgggtcactgatttatcctccgtttttagtaagttaa

SEQ ID NO: 3591 - DNA, 324 bp, B.fragilis
ttgatttctgtcgcatacaaggctgcaaatatagtttttttttcacattcagaagtaattaggaggcaaatatttgaatgtgaaggggatttttgggacgcttcgacagatattggcggaagtatcgtttgtctttttggcaatatgtcaaatgaaacctcccagttttctttttttcgactctcgggacaggcggggccggaaaaacgtctctatttcgtttcccggtttatcgttttgttttgtccggcttttattttccgtcagaaagaaagcgatctggaagtaaatattcccggtgctcttcagggaggggaattttag

SEQ ID NO: 3592 - DNA, 210 bp, B.fragilis
tcccgaagagttcgggttgggctctatcaaaaaagggttaaaaagattcctgaaagagaggtaaaatacataaaaacaagtacttttgtcaaaactctgaattatgaaaaaaaagatatcacgattgatatgtgccgtggcatgttgtgtgcctgtcgccttgcaggcacaaaccagcgagaaaataacgtctcccgtaaatctgtataa

SEQ ID NO: 3593 - DNA, 3069 bp, B.fragilis
aagctgccggtatgggtgtttccggcaattatgcttcaggttctcaaggactcttgttgggagatttcaaccagatccgtattcttgaaagtacgtctaagtctggactggcaatatctcccgcatctccggaccgggatagcgaggtcatctcttccgttacttctccttctgtccctgtttacttctttgtcgaggaggctgcgggccccacaaagtgctaaattgtcgggccttgcgggagaatccgtcgttgttatagagaatcgggtgtataacgatctccctgccgcatctaatatttattgggacgcggcacaaggcagattgacgttcgatgatgttccgtcgtatgttcctgctgcccgaaaccaaaaacagggagtgtattttctgtatggttccttaattgcactgcaaggaggaagcagcgcaactgatgtgtgtcagctcgatgcagcagaagtgaatcctgtatggaaaaccaatcagtctccgaacattcctaagtttaatcccgcctctttagctcccggagcagatctggagaatgtattgacacatattcataatccgggtaatcgtattggtgatatctgccgttatcttacgcagcgcggatgggctcctccgggaaagaaatggaagatgcctgtgaaagaacgtttggaagctgtcttgaacagtatatatagaactgaaggatcttggttaccgatagggggacttgcgacagacggtactggtgaagttgttcacgggagattgataaaggatcgattttactttccggcatcgggttcacgcaaagaagatggaacctttatcgagcaaccgggtgtctccggacactactggagttcttctgtcatttccggcagtatcggatggcaacctgcttcgctgtggtttcagggaggggatgctgcaatacaagcaactgctttggacgtggctcttccggttcgttgtgtcgtagataatacgtctaccgattggccggaattagctactgtcacttattatgcttatccgccgggaggagcaacattaacctcggaactgccggccaatcattttgtggagcaacgcaaaccttttgcgctgccctctacccctttgactctcagtgatccgtctgtggctcataccggctggggcaataatcttggattgggagaaaatactactataaacactagtgttggcagtttttatgcgacttttagccaaggtgcttctctagagtatgactctaatcttcctgcaggtacggctttagtgtccggaacggttccgggagtctatgttgctgccggaggtacaagtatcaaactttcgacgaaccagttggtatgtagtaatccaggttatgtgcataccggatggagcatcgatggagtttatcatggattgggtgcaaactatgtgatgcatgcatccggttccaggaaggcttttgccgtatggtcacgtgactgctgggttgagtatctggcaaaggcgcctgcgggtgcccctgccggtgttactgtcaccggtactttgccgtctcctgtgaaagtagcccagaattcatcggttactttagcaacggaagcccaaggtttacaggtttgcagtgatccgaggtggaaacacactgcatggacggcaggcgcttttggcggaaatacgatcgtgacaaatgcccttaaaatatatcccgaatggacgcggtattatcaagtaacttactcaccgcagccaccgtccggaacagtacccggctatccgcgttctgaaattgtggcgccgggaagtagcgtgatgttgccggttcaactgcataccagtgatcctttgcaggtacatcaggcgtggctggtaggtggacaagagaaggcaccgggaacatcggtcattgtcaatggggatatgaccataactgctaagtggctgctttatgaagtaagctatctggcaaatgctccggtagggaccacttcggtaactcctttacccgctttacagaagatagctccgggcaagatggtgactttatccgctacccgtttggtatgcagtgatccggcgtggatacataccggctggagcgtcggaggtgtgcattacattttgggggccaatatacccgttctaagtaacatgcaggtatctgccgaatggacaaaaagatttaagatcaagtatcatctgaacttgccttcaggaaccggtcatgctggtgatatgctacctgaggatgaatatgtgatgcctggacagaacgtgactctggcagttcccaggctcaaatgcagcaatgaggatttcttctttaccggttggatgattaatgggcagttctatggtttaggttcaagttacacaccgctacccggtcaggatacagatgtctatgcagtatggaaatatgctcaagctatggaattcaatgtaaccgtatctaattcaggtcgtggaaccgataatgccacattggtatttacggacagtaaagaagagaccggagcgttctttcaaagtcgcggagtcgttgcatggagcaatacgggaagtcccgttacctggtttgatccggtaagcaccgggcgtacatggtcttccaattggatggctttcgcgtcggaagagttgcatacttatgctaacctcagaaatggcggcggggacccgtgccgcttgattgggtattcacagaagtatgtaagtacgcagatctccaaaggggaactacctgataatagaacgtggagactgcctaaaggacgggagtatatgcagtatggatttacaccggaaaatacagttggcagttgggctaatggctggacctttaacaatggtaaatttcttccggcttcaggaatgcgtagtgttgctgacggtcaactccgtgaatcaggcgtcggatattattggttgagtgatcactttgcgattatcgatcattttggtaagcagtatatgggtagaggaagtaaagtttcatcggacaaggtgatagaagaaggtgttgtatatcattctgcagccggcttccagattcgatgtgtgagacagtaa

SEQ ID NO: 3594 - DNA, 702 bp, B.fragilis
aagagattatcggaaaataataatttatctttgccaatattaaatatgaagattaactatacatatatgatgcgatactccgttattattcccgtttacaaccgtcccgacgaagtggacgaactattgcaaagcctgacagcccaacacttcaaggatttcgaagtcgtggttgtagaagacggatcatctgtcccttgcgaaaagatagtgaaccaataccagggaaagttggatatacattactacaacaaaccgaactccggtcccggacaaacccgtaattacggtgccgaacgtagcaacggcgaatatctcatcatactggattcggactgtatcttgcccgaaggatatctcgatgcagtagagaaagaactgcagaccgccccggccgatgcctttggagggccggaccgggcacatagttctttcaccgatatacaaaaagccattaattactccatgacttctttcttcaccacgggaggcatccgcggaggcaaaaagaaaatggataaattctatccgagaagtttcaacatgggtgtcccgccgggaggtttatcaggcattaggacgtttctccaatatgcgtttcggcgaacacatcgatttcagtatccgcatatccaagggaggataccaatgccgtctctttcccgatgcctgggtgtaccacaaacgacgtacggattttaa

SEQ ID NO: 3595 - DNA, 765 bp, B.fragilis
cccgtgctatctttgggtaatgccgaaatggaacgtttgcggatgactaccaaaacaggacaggcagaatggcgcgcgttggacgagaaccagaaaatgcgggagttacctctggcaatagaactccaggactttacgattgatgaataccccccgaagttgatgctgataaataatgaaacaggtgaggccttaccgtcaaagaaaccggaaaacctgttgattgaagataattttcataccggacgattgcttgattgggaaattggtatcgagaagaaaatacctctggctgccagtgtagcgactcaggatacgttgaattttgtagaatttcattcaatgggggctacttatgctgtttatctgaaagctgtgaataataagacaggacagcagcgtgaaggatgggtgagttgcgggagttttatgtttccttataaagctatccggcttgacgatcagaccagtctggtgatgccggaacgtgaaccccgtcgttttgcatccgaagtcaaggtttatacggaatcgggatgccgtgattcggctacgattgaggtgaataagccttttgagttggaagggtggaaaatatatcaattgagttatgacgagtcgaaagggcgttggagtgatatcagcgtattcgaactggttcgtgatccatggttgccggtcgtttataccggtatctggatgatgatagcgggagctgtctgcctgtttgccttgtcacagaaaagaaaggaggacaacacatga

SEQ ID NO: 3596 - DNA, 285 bp, B.fragilis
aaaagcgtatcaaaaccctctcttttggttttccaccttgcgcctgataccgtaatcaaattggaaccggttctaaaacaaaaagaagcaaaggaatcctccttcacttcttcttattcgtttgcaatggctaatacttatgccttcactccgttgtattcgtcagaaacagtcagtttcttacgacctttagcgcgacgtgcagccaatactctacggccgttagctgtagccattctctcacggaaaccgtgtttgttttttctctttctgttagagggttga

SEQ ID NO: 3597 - DNA, 1884 bp, B.fragilis
caaataaaatcatcatctatgaatagaagactttctatattcgtaatcattttgtttttcctgttacctgttgccgcacgggcacaggtaacaggttctttccgcttcgcacagttgacagacatacatctcaatcccaacaatccgaagccgacagaagacttgaaacgttccgtcgaacaaattaacgccacaccgggagtagactttgtattagtcaccggagaccttaccgaagagggtgatcgcacgaccatgttagttgtaaaatctatcctggaccgactgaaagtgaaatattacgttataccgggcaaccacgaaacaaagtggagtgattcaggttgcactgctttcagcgaaatattcgggggagaacgctttaaattcgaacacaaaggattcttgtttttagggtttaattcaggaccactgatgcgtatggcctacgggcatgtagtaccgcaagacatcacatggatgaaacaagaaatggataaagttggaaaagataagcctgtaatcctggtcacccattatcctatgcaggatggggatgtggacaattggtatgatgttaccgatgccgtacgtccatacaatatccgcacttttatcggaggacactatcatcgtaatcgcttcctctcatacgacggtataccaggtattcttacccgctcaaacctacgtgacaaaaacggttcaagcggctatagcatttttgatatcactccggactctatcattacttacgagcaacgcatagatgaaccaatgaaacgctggactgccctatcactcaccaaatcttattataaccgtaccggaaaggcagtgaaatatcccagtttttcggtgaataaagagtatccacaagtaaaaataggctggcaggtgcagaccggtgtcggcatctattgttcacctgccctctggaaaggcagagtttatgtaggtgatgacttgggtttcctaacttgctacaccctgaaggaaggacgtaaattatggagtttccaatcagggaaacgcattgtgggcacacctgccgcaaccgacgggattgtggtttttggctccgctgaccacaacatctacggattggatgctgtaaccggtaaagaacgctggagggttacggttgcccaaccggtattgggagcggtaactattgaaaaaggtatcgcttacataggtggcagtgattccacttttcgcgccattcgtatcaaaaatggtaaagtagtatggacttataccggtatcaaaggttacatcgaaacaaaacctctggtagaaggtgacaaggtcatattcggtgcatgggacaatactctctatgctctcaataaatccaacggcaaggaactctggaagtggaccggcggactgacccgtatgcacttctcccctgctgccgtatggcctgtagcagcacatggaaaagtattcatcaccgacccacaacgtgccatgaccgctatcagcttaaaaacaggaaaaacagtttggcgtaccttccagtcaatggttcgagaaacaatcggtctatccgcaaacaaaaatcagatttatagcaaaacgatgaatgacagtgtcgtatgctattccaccatcagcgacactccgaaagagatctgggcatctaatgtaggctttggctacgaacatgctccatccatgcagatggaaaaagacggtatagtattcagtagtaccaaagaaggacttatctttgcattggatgcaagtaccggacaagtattgtggaaacataagatcggcaattcactgattaacaccgtactccccatcagccgccatcaagtactgtttacagccaccagtggtgaaacaggcttacttgagtggaaagaataa

SEQ ID NO: 3598 - DNA, 924 bp, B.fragilis
aaaaactttccgatcaaaacaaatcaaattacaaaaaatattatatatttgtatccaaatcaaaaaggctgcgaaatgaaacttattgcggaaagtggttctacaagaacggaatgggcattggttgaagacaatcatctcgtacaacgtgtgtttaccgaagggctaaaccctttcttccagactagaagagaaattagcagaagcgtcaggttgggactaccggaatcattcttcaaaaaaaaactggatcaagtatattactatggtgccggatgcagttcatatgaaaagaaaaatatcttaggtgcctctttagtggcacaattcaaaactcccattcaggttgaaagcgatttgctggcagcagctcgtggtttatttaaatgtgaagccggaattgcctgtatcttgggtaccggatcaaattcctgtttttacgatggtaaaattatagtcaaaaatgtgaaagctgccggatatattttaggagatgaaggcagtggagccgttcttggaaaactttttttagctgaccttcttaaaggactagctcccaaagaattggcaaatgaatttcatgagaagtttcgtatctcggtcaatgatgtcatggaatctgtatataatcttcctttccctaatcgttttttaggaaccattgcgtatttcttaggagattatatggataatgaatatgtatataacctattaactaacaatctccgtagtttctttaaccgcaacgtatgccaatacgattatataaactatcccatccgctttgtaggctcactagcttatgcgtatccagatattttacaagaagtagcacaggaattcggagtagagatagatgttatagaagagacacctatgaatggtttaatcgagtttcactccatgaacatcgaagagtcctaa

SEQ ID NO: 3599 - DNA, 777 bp, B.fragilis
tactttagtcccgtgttttttgaatttggcataaaagattttattgatatcctgttagtggctttcctgctttattacacttataagctgatgaaagcctccggatctattaatgtgttcaccggtatcctggtgtttatccttatttggctggttgtatcgcaggtgctcgagatgaagctcctgggctccattttcgacaaattggtgagcgtgggagtcttggcgctgattgttctgtttcaggatgaaatcaggcgctttttgctgaccctgggttcgcaccagcacgccagtgccttggtacgtttccttaccggcaacaaaaaagaaaaacttcagcatgatgatatcatgccgattgtgatggcttgcatcagtatgggaaagcagaaagtaggagccttgatcgttatggagcgtaatgtaccgcttgacgatgtcattcgtaccggtgaaattatcgatgccaatattaaccagcggctgattgagaacattttctttaaaaacagccctttgcatgatggcgcaatggtaatcagtaaaaaacgtattaaagcggccggatgtattcttccggtatcccacaacctggacatacccaaagaattgggacttcgccaccgggcggcaatgggtatatcgcaggtttcggacgctttggccattattgtttccgaagaaaccggagccatctctgtggcatggcgcggtcagttctatttgcggcagagtgccgaagaactggaaagcctgctgacaaaggaaagctaa

SEQ ID NO: 3600 - DNA, 474 bp, B.fragilis
tccatttcgtttactttttctttatttttttgtagttccccactgttaaataagaatcttcgtgccttattagttgctaccctaactctatttttcataactttgcaacgttttcaaaaatcaataggtaatagtatgatacgtcagtgtgccattttatttggctgtttggctttgggtgaattgattgtttatctcacggggattaagctcccgtccagcatcatcgggatgttgctgctcaccctctttttgaaattaggttggatcaaattgcattgggtgcagggaatgtccgactttctagttgctaatcttggttttttctttattcctccgggagtagccctgatgttatatttcgacatcattgcggcacagttctggccgattgtgatagctactctagtcagtacccttcttgtgcttgtcatcaccggatgggtccatcaattaacacgtaaactcaaatga

SEQ ID NO: 3601 - DNA, 1902 bp, B.fragilis
cccacaataccattgagcatggaaaacaaaatcaacttttctcctccctcaacaagagaggggaaaggtgtgaggtttttactcactaccttttcaatattgctttgtagcctgcaagctgtggcacaatctctgccacgtgtagctcccgaacaagtgggcatggactctcatcgcctgttacatgccgatgaagctattcaccgggcaatcgatcacaaagaaataccgggagccgtactcgctgtcatccgtcatggcaaaatggcttatctcaaggcttatggcaacaaacgaatctatcccaatgtagagccgatggaaataaacactgttttcgacatggcttcctgcagtaaatctatgtcaacagctgtttcggttatgattctggttgaacgaggacaacttcgtttgctcgatcgtgtcagcttttacctccccgacttccaggaatggcggggagaaaacggggagaagaaggatattcgtatcatagaccttatgacacatacttcaggtctccctccttatgcaccggtatccgaactgcaggaaaaatatggttctcccaaccccaaaggactgatagagtatatttccacttgcaaacgtgaatttaaacctcagacgaaatttcagtatagttgccttaattacatcactttgcaacatatcatcgaaaccattaccgggcaaagcttgcgagactttgcaaaagaaaatatcttcgatatactgggaatgcaatacacggattatctgcctaccatacaacagcaggacggaaagtggatcaatacggtggcctgtccctggatggaccggattgcacctaccgaaaaacaaaaagacggaagcgtactctgcgggcaagtacacgatccattggcacgtatcctgaacggagggatctccggcaatgcaggtatcttctctaatgcaaatgacattggcatcctcgcagccgctcttctcaacggaggcgaatacaatggtcaccgcatcctcagcccgctgggagtaaaaaccatgtgtacagttccccgtgagctaaccgcatttggccgtactccggggtgggatattttctctccctatgcctcaaacaagggtgatcttttcagtccgaatacctttggccatacaggatatacaggaacttccatcatcatcgatccggacaacgacacggccgtcattctgctggtcaacgctgttcatccggaagaccggcatagcatagtccgtctccgttcgttggtagccaatgcagtagccgcctctatctgtcctcccgcacaagtatatacagatcattattacaaacgcttcctgcaatttgaaacagaaacacccatcagccccaaagatattgtgatggtgggcaacagtctcacggaaaatggtgggaattggagcaagcgcctaaataaaaaaaacataagaaatcgggggatcatcggtgacgaagcattgggaatctgtcaacgtctttttcagatcttaccggggactcctcaaaaacttttcctaatggccggaatcaacgatgtgtcacacgacctgagcaccgatagtgtagtcactttgataaccaaagtcattgagaaaatccaaaccgaatcaccacgcaccaaactctacatacagagtcttctgcctatcaacgaatcgttcggacgatataaaacgatgatcgggaaaactgacctgatacccgaaattaaccgcaaacttgaagcacttgccaaagaaaagaaaataccttttatccacctctttccattatttacggagaaaaacagcaacgtgatgcgaaaagaactgactacggacggattacacctgacagaagaggggtatagaatctggagtaaagcactgaaacggtatctgtag

SEQ ID NO: 3602 - DNA, 330 bp, B.fragilis
ctttgtcaaccacatgcgttgtctggccaatgtcaccaccatcggagaccaaaaccggagaggttcgggtatgccttttactttcgaactgcccaacggatggagcgtccctttttttcccggccccattttgatgcggagatgaatacaatgagtttggcctttgaaccggacttcaaggcaattttcttcccgaagattgattttgagggaaagattcccctgtttaaaagggcccggaaacccctaaaggataaaattttttctcccaaagttcccaaatcccaggataaattttttttttcccatgtgggtgttttaaccccgttc

SEQ ID NO: 3603 - DNA, 249 bp, B.fragilis
tttcaacagtttgtgggtctctttctcgaggaagaagtattgttgcaccggcattttcgagcattggaacaagaaatggaagtacataactctgagtataaaggtcctctacagtctgaaagattcgtgcacgttgccattcccagcgagccaatttggattcgtaataaaagccgtgactttgccatagagcaatgtgacggttttgcaatccgtttgtgggggtataaggaacagataatcgggtaa

SEQ ID NO: 3604 - DNA, 414 bp, B.fragilis
ccattaattactaattatatgtcgaaaatgaattcaatgcttatgggaatatgttttcttttgtcttctctcttttcttgccagcagtcgaaaggcgatttcaagacagtgccggtgaaggagtttgcttctctgattgaagatgcaagtgtgcaacggctggatgtccgtaccatggctgaatattcggaaggccacattccggggacgatcaatatcaatgtgctcgatgattcgtttgcggatatagcagactccacacttcaaaaagataaaccggtggctttatattgccgcagtggcaagcgaagcaagaaggcggctgccattctcagtgagaaaggatataaagtgtacgaattggataaaggattcaatgcctggcaggaagcaggcgagaaagtggagaaataa

SEQ ID NO: 3605 - DNA, 924 bp, B.fragilis
actggggctactgaaataaaaatgtggaaagacttcttttacttcacacgtgcagaacggcaaggtatcctgatacttgccgttttgtgtattctcgtatttgtggccggatggttgatccctgtcaaagagaacacggcaaaaaacaatacggaaaagtttaaaaaggaatatgccggttttatgtcctccatccgcgaaaaagaacaaaagatatattcacacaataaccgctttcagcccccacgaacagtccgtctgactacatttgaccctaatatcaccgactctgtcggattccttgatttgggactgccggcatggatggcaaagaacatcctaaagtatcgaaataaaggtggaaaattccgtcgggcggaagacttccgaaaagtatacggattaacgcaggaacaatacgaaatgctcctaccttatattcatatagctacgctcgcaaagcccaaagatacacttcgcctctatacccgaaagatagaagaagacacactgaaattttttaaatatgcagccggaacagtagtcgaactgaacagtgcagacacaacggaactgaagaagatccccggtataggtagtggaattgcccggatgataacaggatatcgcaaccgtttaggaggattttatgatatagcacaattgaaggagatacatctcgatgtagaaaagctccgcccctggtttaacgtggcaaccggcaatacccgacggctgaatatcaaccgaaccggtatcgaaaggctcaaagctcatccttacatcaacttctaccaagccaaaataatcgtagaatacagaaaaaagaaaggaatattaaaaagtctgaagcaactttctctctacgaagagtttacgcctcaagatctggagcgaatcagccactacatctgttttgagtaa

SEQ ID NO: 3606 - DNA, 1176 bp, B.fragilis
ataaaaaacacaatgaatcaaacagtcaacaaacgcctactcgctcttgatgtattgcgaggcattactatcgcaggtatgattatggtcaacaaccccggcagctggagttatgtatatgctccccttgggcatgcggcatggatcggcttaaccccgaccgatctggtatttcctttctttatgtttatcatgggtatctctacctacatctcattaagaaagtataactttgagttcagccactcggccgctttgaaaatccttaaaagaaccatcgtaatctttgccattggtttgggaatcgcatggttctccatgttttgccgtacctggaattcactctccggtgaagatatttcattcttctcccgtctgtatgagtcggtctggactttcggccacatccgcattctgggtgtcatgcagcgattggcgctttgctacggtgcaacagccatcatcgctttaattatgaagcacaaatatatcccctatctgattgccatcctgttgatcggctatttcatcatcctgatcaacggaaacggattcgaatacaacagcagtaacatcctatcaatagtagaccgtaccgtattgggtgaagcacatatgtacaaggataatggcattgatccggaaggtctgttaagtaccatcccttctatcgcacacgtactgataggtttctgtgtgggtaaactcctgatggaagtaaaagatatccatgaaaagatagagcgtctgttcctcattggcactattctcactttcgccggattcctgcttagctacggttgtcccatcagcaagaagatatggtcacctactttcgctatcgtcacctgtgggttggcatccagtttcctggcattacttgtatggatcatcgatgtgagaggctatacacgctggagccgtttcttcgaatcattcggtgtcaaccccttatttatttatgtgatgggagccgttctctccattctcctgggcagcatactgataccttatgacggaggtagcatcagcctacacggattcgtgtacaacgcaattcttcaacccgtgcttggagactatcccggttctctggcattcgcaatcttgttcgtagggttgaactggtgtatcggatatattctgtataagaaaaaaatatatataaaaatatga

SEQ ID NO: 3607 - DNA, 714 bp, B.fragilis
cgaatattaaccactaaaaacagaattgatatgaaaaagagtttgttaatcagtgttttcgcaacactcgcaatgatgatttctttaaatgcacttgcacaagaaaaagcgacaggtaaggcttataaagctattcagaaagatgaaaaagtaatcaacaaagatttgcagaaaaaagccattaaagaagcacgcaaacaagcgaaggaactgacgaaagaaggattcaagactccggtaggaaagttaccgttggacaaacaactggagaattcatgggaaaaacagatggaaattgatatgaatggcaatccatactggtatattgccacatcaagagtgattggtggaaatcagtcggctgcagctatgcaggctaccaacacggccaagattgatatcgccggacaggttcagacaaaggttacacagttgatcgaatcgaaagtagccaatgacgatatggggcaggaggaagctgccagtctgtcgagcgcagtagctgccggtaagagtattatcagtggaacgctgggacgtactattcctttggttgaagtatatagaacgttgcctaacaaaaatgtagaggtaatggtaaccatcggttatagcctggaagctgcaaacaaagtagctgtcaaagcacttagcgaagaattggctaaaaaatcaccggaattggctaaggaactggataaactcgctcagtaa

SEQ ID NO: 3608 - DNA, 1200 bp, B.fragilis
ttacctgtaactcgttgctcgtcacttgtagtttataaaagaataaaagctatgaatacaacagagtttgatgaaatccgtccttacaacgacgaagaactctccggggttttcgaagaactgattgccgatccggcttttcagaaggtggttgccggggtgataccggatgtaccctttgagatgctggcacaaaagatgcgtgcctgtagaacgaaactggaatttcagaaaaccttttgctacggtttgctatggaaacttgcaggcgactgtacggatggtatttcattggatcatacggctattccggacaagagcaaagcatacacctacatctcgaatcaccgtgacatcattcttgattccggtttcttatctgtattgttagtcgaccaggggatggatacggtggagattgccattggcgataatctgctgatttatccgtggatcaagaagtttgtccgggtcaataaatcatttatcgtgcagcgtgcactgaccatgaggcaaatgcttgagtcgtctgcccgcatgtcccgttatatgcactatgcaatcggagaaaagaatcagtccatttggattgcacaacgtgaaggacgtgccaaagactctaacgaccgtactcaggacagtgtactcaagatgctggcaatggggggcgaaggggatgtggtcagccgtctgatggagatgaatattgctcctctcgctatttcctacgaatatgatccctgcgattacctgaaagcacaggagttccagctgaagcgtgatatagagggctataagaaaacgatggcagatgacctgaaaaatatgcagaccggtttgtttggctataaaggccgggtgcatttccagacgggagcttgcctcaatgacctgctttcgacagtagatcgctctttaccgaaaccggagttgtttgcacgtatctctacgtggatcgatcagcgcattcatagcaattaccgtctttatccgggcaattatgtagctcacgatctgttgactggtaagaatgattttgaatcccactatacgttggccgagaaggaacgtttcgaggcttatgtggaaaagcagcttgaaaagatagagattcccaacaaagatatttctttcttgcgtgaaaagctgttgttgatgtatgccaatccgttgaccaactatttggccgctcgtcaatga

SEQ ID NO: 3609 - DNA, 888 bp, B.fragilis
tccatggttgccggtcgtttataccggtatctggatgatgatagcgggagctgtctgcctgtttgccttgtcacagaaaagaaaggaggacaacacatgagttgggatcaatttgtgatttttgccattgtagcacttttatgctggggaatcggtgcggttgccgcctggagaggaaagcggcaatggatggtctatacggctacattagcgggattggctgtcttttttgccttcattctcgggatgtggatctctctggaacggcctccgatgcgtacgatgggtgaaacccgtttgtggtactctttctttttacctttggcaggtatcataacgtatagccgctggcgatataaatggattttgagtttcagttttattctttcgctggtgttcgtctgtatcaatctgtttaagcctgagatacacaataaaactttaatgcctgctctgcagagtccttggtttgcaccgcatgttattgtttatatgtttgcttacgctatgttgggagcggcggctgtcatggctgtttatctgctttggatcaaaaagaaaactccggaagaacgtgagatggaactgtgtgacaatctggtcaatgtgggactggcatttatgacgctgggaatgttgtttggtgcattgtgggcaaaagaagcttgggggcattattggagttgggatcccaaagaaacgtgggcggctgctacgtggctcggttacctttgctatatacattttcggatgaaccggaggcaaaaagtgcgtacggcgcttgtcggacttctcatttgcttcgtattactgcagatgtgctggtatggcattaattatctgccatcggcacaggggaccagcgtacatacgtataatctgaattga

SEQ ID NO: 3610 - DNA, 216 bp, B.fragilis
aatccgtctgcagcaatatcatgtgtagccgagctgaatgccactagccaaaaaatggcaagggtcgtttggaagaagtttgacataggtatggtgaaagcgattcctgccagtccggcacctactaatagctgcatgctgactatccaccaacgtttggtttttaataagtcgacaaatggactccagaaaggtttgataacccatggtaaatag

SEQ ID NO: 3611 - DNA, 792 bp, B.fragilis
gacaattatttttgttttggaatagaaatccgtatctttgcgccgttattttctcagtttcctatgcaaaaagtatttctattcctcctattgtttctgctcccactggcagaagtacccaaccatgcaccggccagtgagcctgtttctgtagcctctactccggagacagacgaaatagaccaactgttcgatgatatgcagctggacgggattgtcagctatacagctttccgacaggcagtgaccggctatcggaaaatcgagcagaaaagcaagtccatcatgaccctgatcgatttttcaaaaccatctaccgagaagcgcctttacgtgcttgatatgaaaaacaaaaagttgctatatacttccgtcgtatcacacggcaaaaatagcggaggaaactatgcaacctcattctccaataaaaacggttcgtacaaaagttcgcttggcttttacctgaccgaaaacacttatcagggacgcaacggttactccctggtgctgaacgggctggaaaaaggaattaacgaccaagccaaacaacgcgccatcgtgatgcatggtgccgcatatgccaatcccaacatcaccgcttctgccggacgcttgggacgaagcctcggatgccccgccttgccgcaagcactcgccaaaccgattatcgacacaatcaaaaaaggtagtgtgctctttatctacgccaacaacaaggactatctggccaacagcaccttcctgtctccacggcaaacggagtatctttcatgggcgcagcctgccaattga

SEQ ID NO: 3612 - DNA, 930 bp, B.fragilis
cagaaaagcgccatgaagaatccgatcatttatagaatactgcaacagggtttctgcctgattttctgcctggggcttctctcttcctgcattcgggaagaggagtttgtcaataatccacagggaaatttcgagcagttgtggaaaatcatcgacgagcaatactgttttctcgactataaacagatagactgggacgagattcacacccggtatcaaaagcttatcaccccgaatatgggcagcgaaggactatttgaagtattgagcgaaatgctctacgaactacaggacggacatgtcaatctggcctcggctcacaacgtgtcttattacgacgcctggtatcaggactatccccgcaacttccgtgcagacctgctggaagattcctatctgggacgcgccagtacggattatcgcacggcagcaggccttaaatacaagatactgaaagataatatcggctacatacggtacgaaagtttcgccgacccggtcggtaacggtaatctggacgaagtgctctcctatctgtcggtatgtaacggactgattatcgacgtgcgcgacaatggcggcggaaatgcaaccaactccgcccgtatcgcttcccgtttcaccaatgaaaagatattgacgggatacatctcccataagacaggaaccggacacaacgacttctccaagccttatgccatctatctggagcctgccaacggagtacgctggcaaaagaaggtagtagtgttaaccaatcgccgctctttcagtgcgaccaatgactttgtcaaccacatgcgttgtctggccaatgtcaccaccatcggagaccaaaaccggagaggttcgggtatgccttttactttcgaactgcccaacggatggagcgtccctttttttcccggccccattttgatgcggagatga

SEQ ID NO: 3613 - DNA, 240 bp, B.fragilis
tatcaattggctttgttgattcttttaagagataaattgtttattattaacaaaggtttagaaactctttggagttctactatggcaaagatatattttattttaatatcaagaacaaatattttatataatttagatttatatttgtatattcacattatgacgcttctctgttttataaaaatgatctgtgaatacatttataagcgatggttcttaaggtttagaaacattttttag

SEQ ID NO: 3614 - DNA, 1113 bp, B.fragilis
tgtgctctttatctacgccaacaacaaggactatctggccaacagcaccttcctgtctccacggcaaacggagtatctttcatgggcgcagcctgccaattgaaaattttatcatacctttgcggaaaaggcatattcattctaacaaagacaattatgaagaaatttacttgcgtacaagacatcggcgacctgaaatcagcccttgccgaatcattcgagatcaagaaagaccggttcaaatatgtagaactgggacgtaataaaactctattgatgatcttctttaactccagcctccgcacccgtctcagcacccagaaagctgctctcaacctgggtatgaacgtaattgtactggacatcaatcaaggggcctggaaactggaaaccgaacgcggcgtcatcatggacggtgacaaaccggaacatctgctggaagccatcccggtgatgggatgttattgtgacatcatcggtgtacgttcgtttgcccgcttcgaaaaccgtgagtatgactataatgaagtgatcatcaatcagttcatacaacattccggacgcccggtgttctctatggaagcagctacccgtcatccgttgcagagctttgccgacctgatcaccatcgaagaatacaaaaagacagcccgccctaaagtagtaatgacctgggctccccatccgcggccattgccacaggcagtgcccaactcgtttgccgaatggatgaatgccacagactatgagtttgtcatcacccaccccgaaggttacgaactcgatccgaagtttgtaggaaacgcacgggtagaatatgatcagatgaaagctttcgaaggagccgactttatatatgccaagaactgggcagcttatacaggcgacaactacggacagattctgagtacagaccgtaattggaccgtaggcgaccgtcagatggccgtcaccaataatgcctacttcatgcactgcctccctgtaagacggaatatgattgtgacggatgatgttatcgagagtccgcaatccattgtcatcccggaagccgcaaaccgtgaaatctcggcgacagtggtactgaaaagactgctggaaaatctaccataa

SEQ ID NO: 3615 - DNA, 627 bp, B.fragilis
gcgggaaattattggagtgcttattatcgatatttttttcatttctttttatttattactatgaagggttataatatttttttctttataccgttgttgtttttattgctttctttgcacgcttgtacaagtaaatcaaagaaagatatggaatatgtaaaaggctggcacggcaaaaaaataagtttaccttcggaaagtgattttttgttatttgggagagactcagtggtctatgactatagctcttttccatataagattgttcttgtaattggaaaagaacaatgtataagttgtaagtttgatgtggctaaatggcaagaattgattcaacaagtagattctatcacatcttttaaagttggttttgtttttgtgttagagcctatttatcagcatgatgtctacgtgatgttgagatctcatcaatttatgactccagtatttattgatactaataacacatttagaggtatgaataaaatatcagataatgattctcatgtttggttgttggattctaacaataggattatttatattggagatccaactgttaatcaaaagataaataaagaatatatggagttagtgagaactaactacttgtttaacgataaataa

SEQ ID NO: 3616 - DNA, 420 bp, B.fragilis
gtattggactatctttgcagaaacataaatttatttatcatgaaaaagttaacctgtctaattaccctattcttattcattagtgttggctatataaatgcagaaacaatggcctcaagaaagaaaattaaaatgaaagtagaaactcagcaccatcaacgttctctgcccccaccttgtcccgcagaagcttttatctgcggaaatacggttgatcttattttcagagaaacaaataaaactgcagttgtcacaattatgaatttagatacgggagaagccattcattacaatgtttcaacaaacgattgtagtatctctatcgatttaggcaacaatcaaagtgaatcaaactataatattgaattaatactggatggcaaagcatataccggagaatttacaacaaatgaaatctga

SEQ ID NO: 3617 - DNA, 894 bp, B.fragilis
atctttttatatatgaaaaccatatctaaattatttttgctattgtcaataattctactttcatcatgtgatgaaacagaattggatcaaacggtgactaatcaagtaaatccgcaaaaagaagaagattccagaattgtattcaatagtgcaaaagagttttataacacccttgatacactatcttacatgacttatgaagaacaaacagaatggattcgtgcctcgggtattaaatatccgctatataaagaccttgaattttgcgaagatgaaatcatgacagaaatgcctagagcatttcaagcactattcaaccataaaatggaaatgcaaataaatgataccgtaattgcatttgaaaaaggaaatatgtacgtaaaatcaattaaggagaaaattctacccgttcctgttctatatgggcaagtaggagttaaccaagaggaatcagaagtaacaacaagaactgtatatgaaacaaaatatggaaagattggaacatcatatcaatatgaattcaagattccagaaggtaaatccaaatacaaatatgtacatgaacttaaatccgttattattaaagagaacctcccaccatataaatcatggagtaatttatttttagttttaaaattagaatggaaaggtaaaaagaaatggaaagttgcagaaaaagaagaaagaaatatctcaatagatttaaatgtgtgtaaacgcaatttagcaaaagtaaagtataaccaagaaatccggatagatgttcaaaatatggattctaaatcacactctataaatatagaaggttatatcatccatgaagtagttggaataccaagtaccaaaatgtttaatggatggagttatccattagtggagtggcaaccccgataa

SEQ ID NO: 3618 - DNA, 768 bp, B.fragilis
atatcaatccacgcattttatttactaagtggtaagattggtacgggagaaaatgctatctttgctcaaaagacaagcatcgtggtaaaagtagagtttacagacgaatatcaaaagattttgtggcagatatctttgtttaaggatatggataacagtttgcaacgtcggctgccacaagagctggaactttcggtgtacgaggttgccagaaaagagatcgtattgaagcaggatacctattgcaatcatttatatgtgctactgaaaggggaactggaggttaatattgtcgatgtggcgggaaacctggtgaaagtagaagatattcgtgctccccgtgcttttgccactcctcatttgtttggtgataagaatcttttacctgctacgtttactgccagtgaagattctgtattgttgatggctacccgtacttccgtttttaaattgattagttctgtacccgatttgttgcatcgcttcttgtgtgtgacgggtaattgcaacaaatgtacggttacccgtctgcgtatcctgtcttataagatgctgcgcagccgtttggtctattattttatggagcataagatttctccggatacagccttgctggagcacaatcaggttcaattggcagaatatctgggagtgacgcgtccggcactctcgaaggagataaataagatgatgaaagaggggctgatttcgatcaataagaaagtagtgacgttggaagatatggcggcactcaaagaatatatctga

SEQ ID NO: 3619 - DNA, 1371 bp, B.fragilis
gatagatcccaactatggcaagaaagcagagggtattccccaaaaaacaaaataaacccatttctatttaccggatatttaaaacatactgagaatatgacatatagaagaagtatattaaagttattactcacttttttcgtctttatgacctccactctcctctcacgaggagctgaaccgggagcaagacctccgagaatccgtataaaaaccggaattgaggtcctgaaagagcaaaacttcaaatgccttgaaggaaagcgcgtaggattaattaccaatccgaccggcgttgacaatcatttaatatccaccattgacattctgcacgaagcacccaatgtcaacttggtagccctttatggccccgaacatggtgtacggggtgatgtacacgccggtgataaagtagataacgccaacgattccagtaccggattgcctgtttattcactttacggcaagacacgcaagccgactcccgaaatgctaaaagacatcgatgtgctggtatacgacatacaagatatcggttgccgttcattcacctatatcagtacgatgggagtagcgatggaagctgccgccgaaaataacaaagaatttatcgttctcgatcgtcccaatcccataggcggattaaaaattgaaggaaatgtggtagaagatggatatatatcttttgtcagccaatttaaaattccgtacctttacgggcttacttgtggcgagttggctctgatgctcaatggcgaacagatgttgagtaaaccatgcaacttgcacgttgtgaaaatgaaaggctggaagcgcaagatggactacgttcagacagggctgcaatggattccttcgtctccccatatcccgcatccgcattccgctttcttttatccggtatccgggctactcggtgaactaggttatatgtcaattggtgtaggatacaccattccgttccagatgtttgctgccccttgggtggaagcagagaaactggcagataacctcaatcgcctgcacctgccgggagtaatattccggccgatgcatctcaagcctttctactcagtaggtaaaggagagcatctgcaaggagtacaagtgcatattgtagattttaacaaagcctcactaagcgagatacagttttacgtgatgcaggaagtaaccgccctctatccggatcgtgccgtattcgaccatgccgataaagagcgcttccatatgttcgatctcgtcagtggctctaaagagatacgcgagcgcttcagtcaacgcaaccgttgggaagatgtccgcgattactggtacaaagatgtcgacgactttcgacggctatcgcaaaagtactatttatataaataa

SEQ ID NO: 3620 - DNA, 1332 bp, B.fragilis
ttttgcacccacaacagagaaaaaccgattattatgaaactttctgctctctaccagatattcctggattgtgccgtagtgaccaccgacagccgcaactgccctgcaggttcactgtttattgccctgaaaggcgaatcattcaatggaaacgcttttgcagctcaagcattaaaagacggctgtgcatacgccatcgtagatgaagccgaatatgctccggaaaacaacagacatatcattctggtggacaattgcctgcaaacccttcagcaactggctaattatcaccgccgccaactgggtacaaaagtgatcggcattaccggaaccaacgggaaaacaaccactaaagagctgatttctgctgtcttgtcgaaatctcacaatgtactctacacagaaggaaacctaaacaaccacattggagtgcccatgactctgcttcgcctaaaagcagaacatgaactggcagtgatcgaaatgggagctaatcatcccggagagataaaatttctggtacacattgccgagccggattatggaattatcaccaatgtgggaaaagcgcatctggaaggattcggttccttcgaaggagtgatccgcaccaaaggagaattatatgactatctccgtgaaaaggaagattctaccgtctttatacaccatgataatgcttatctgatggacatcgctcatggcctgaatctgattccctacggaagtgaagacgcactttatgtaaacggacatgtgaccgggaattccccttatctgactttcgaatggaaagcaggcaaagatggtgacttgcacaaagtgcaaactcaacttatcggcgaatataacttcccaaatgcgttggccgccgttactatcggtcggttctttggagtggaagccggaaaaatagatgaagcactagccggatatactccccgcaacaaccgttcacaactaaaaaaaaccgcggataatacactaattatagacgcctacaatgccaatccgaccagcatgatggcagctctgcagaacttccgtaatatgactgtgaaaaagaaaatgctgatattaggcgatatgcgtgaattgggggcggaaagtgcagctgaacaccgcaaaatcgtggacttcctgcaagaatgttcttttgagaaagtcctgctggttggagaacaatttacagcaactcatcctccttatcacacctatgccaatgcacaggaagtgataaaggaactgcaaacggaaaagcctaaagactacaccatcctgatcaaaggatcgaatggtatcaaactgagcacggttgttgaatttttataa

SEQ ID NO: 3621 - DNA, 864 bp, B.fragilis
ctttttaaccatatccccattatgaaacaatcccttccataccaacctggtcctatcggtgtattcgactccggatacggtgggctgaccatcctgagcaaaatcagggaagcgctgccggaatacgattacatctatctgggcgacaatgcacggactccttatgggacccgttcctttgaaatcgtatacgaattcaccttacaggctgtcaacaaattgtttgagatgggctgtcatctggtgatacttgcttgcaacacagcctcagccaaggcactgagaaccatacaaatgaacgaccttccgaatatagatccggaccggagggtgctgggagtcattcgcccaactgcagagtgtatcggcagtatgacccaaacgcgccatgtaggaatattggctacagccggtaccatcaaatcagaatcatatccgcttgaagtgcataagttgtttgaggatatcaaagtaagcggagaagcttgtcccatgtgggttccactggttgaaaacaatgaagccaacggcgaaggagccgacttctttattcgtaaatacatcgacaacctacttgccaaagaccggcagatagacacccttgttctgggatgtacccattacccgatactattgcccaagatacaaaaattcattccccaaggagtgaaagtggtggcacagggagaatatgtggctaccagtctgaaagattaccttcaccgtcatcccgaaatggacatgaagtgcactcgggaaggtaaatgccgcttttacaccacagaggccgaagacaaatttattgaatcagcctccatgttcctcaacgagaacattacagtgcaacgaataactttagaataa

SEQ ID NO: 3622 - DNA, 1380 bp, B.fragilis
catatactttttatgacaaaaaaagaaagaggaaactttggtagtaaactgggtgtgatattagcttctgcagggtcagccgtcggactgggcaatatatggagattcccttatgaaacaggaaatcatggaggagctgcttttattcttatttatctgggatgcatcctcctactcggactaccgattatgatagctgaatttttaatcggacggcactcacaggctaatactgcccgtgcttaccagatactggctcccggcactcaatggcgttgggtaggacgaatgggagttttggcaggattccttattcttggctattactctgtagtggccggatggacattagaatatatattcgaagctgtcagcaacagttttgcaggtaaaactccggcggagttcatctcttctttccaaagtttctccagcaatccctggcgtccggccctatggctcacgttattcttactcgctacccatttcatcatcgtgaaaggggtggagaagggaatcgaaaaatcatctaaaattatgatgccgaccctcttcatcattatcttaatactggtgggatgctctgtcactttgccgggagcgggcaaaggcatagagtttctgctaaaaccagatttcagtaaagtagatggcaatgtatttctgggagctatggggcaagcgttcttctcactcagccttggaatgggatgcctgtgtacctatgcctcctatttcagcaaaaacaccaacctcacccgaacggctttcagcgtaggaatcatcgacacatttgtcgctgtactagccggttttatcatctttcctgcagcgttttcggtaggaattcaaccggacgccggacccagtttaatttttataacccttcctaacgtgttccaacaggctttcagcggaataccgatactggcatatattttttcagtgatgttctacgtattgctggcgctggcagctctgacttctaccatctcattgcacgaagtggttacggcctacctgcacgaagagttcaactttacaaggggaaaagctgcccggttagtgacgacaggttgtattctgttagggatactctgttcactctctctgggagttaccaaggagttcaccatcttcggactgggtatgttcgacttgttcgacttcgtaactgccaaactgatgttgccattgggcggattactcatttccatttttaccggatggtatctggataagaaactcgtttggtcggaaatcacgaataacggtaccctgaaagttcctacctataaactgattatctttattctgaaatacgtagccccgattgccatttcagtgatcttcattaatgaactggggctactgaaataa

SEQ ID NO: 3623 - DNA, 3366 bp, B.fragilis
aaaacaaaacaattaaatcatctatcttttatgaatgaagatcgcaagaaacgaggattagcgaacagcaacctccttatagccatggctattactgccttaattataggtagcagcaatgcaatggctaatcaaactgcttccggcagtagttacaaggtgactgaacaaatgcaaatacaaaccgtgacgggtgtagtagtagatgcaaacggcgaaccgattattggtgccagtgtcgtagagaaagggacaaccaatgggattgtaaccgacatggatggcaaattttcactaaatgtaaaagtaggtaccactctgcaaatcacatttgtaggataccaaccgcaagatgtgaaagcaactaaaagcatgaaagttgtcctgaaagaggacaacgaattactagatgaagtggtagtggtaggttatggaacccagaaaaaggcaaaccttaccggagcagtatccactgtagatgtcagcaagactttggaagcccgtccacaatccgatgtgtccaaagctctgcaaggtgtagtaccgggattgaccatcactaataccagtggaaaactaaacagcaaaccaaccatgactatccgtggtaccggaacactgagtaacagtgcaaccagtaacccgcttattgttgtagatggtgtgccaatggacgatatctcatatttaaatacacaggatatcgataatatatctgttttgaaagatgcagcctccacttctatctatggtacaagagcagcatttggtgttatattagtaacaacaaaatctgcaaagaaaacagataaagtcacaatcaattataccaataatttctcctgggatacaccaaccatactcccgaactatccggatgtagctacacaggccagagctttgcgtgcggccaacactcgtgccaatctcgagaatgaattgttcggtatgtacatggatgacaatttcatagcaaaagctgaagcttggaaacaaagacacggaggtaaaaaagccggatatcgcgaaatgattccgggtgatgattttgatttgggagaagatggcagcgcactatattatgcagattgggatgtggtcggaattatgtttcgagactggaaacccgcacaaagtcacaatatatcaatacagggaaccagtggaaaaacatcctattttttgtccgttggctataatcacgaggaaggagtgatgacattcaacccggataagttgaataaatacaacgctaatatgaatgtcacttccgacataacaaattggttacaaatcggtggccgcttcagttatagtgacaaggcatacaccacccctaatacccgccgtaatacttatacgtatatgtggcgctggggaagtttcttcggtccttatggtacttatcagggaatcgatatgaaaaatgatatcgcataccttaaacaagcaggagatgacaagactaatgactcttatactcgtataggtgccttcttaaaagcaactattatcaaagggttaaccctgaatgccgattatacatttaatatcaacaataaaacgaccaaatcagtaggattacccgtaatatgttggaactcttggggaggtaaactaaatactcctactaccgcagcaggagctaatggagatacatgggtatatcagaattcagtccgcgacaattcttacgcattaaatgtattcgctaattacgaactaacagttgcaaaagatcatcatttcaactttatgatcggtgccaatgctgaagaaggtgaatatcagaatcattggtcacaacgtaaagggctattggatgataaactacctgaattcaacctggcaacaggagatcaaactgtaggtggaacgcataacgaatggggtactgccggatggttcggacgcatcaactatgattataacggtatctggttgttagaattgaacggacgatacgacggttcatccaaattcccatcaagtgatcgctgggcattcttcccttccggctctgtaggctatcgtatcagtgaggaaaaattcttcgaacccatcaaaaaaatagtcagcaacaccaaaatacgtgcctcatatggtgaaatcggtaaccaggcagtaggtagcaacatgtacatttcaactgtctccaaacgaacagacggcaatacacactggttgaacggcagtaacaaagtggtagcttacgatcttccttctttggtctctccgaccttaaaatgggaacgtattcaaacactggatatcggtggtgattttggtttcttcaataacgaattgaacatatcttttgactggtaccaacgcacaaccaaagatatgttagcaccgggtcagacgatgccggacgtgctaggtgcaggtgcaccgaaaatcaatgcaggtaccttacgcacacgtggttgggaattaagtattgattggcgtcatcatttcaatgaaataaacgtatatgccaatgccagtataggtgatttcaagactgtcatcaccaaatgggataacgacagccaactcttgaatgaaaactatagcggtaaagtatatggagatatatggggatttgagaccgatcgatattttacaaaagacgattttaacgctgacggttcttataaagaagggattgcttctcagaaaaaattagaacaagacggatttgtttacggtccgggggatattaaatttaaagatctgaataacgacaaagaaattaatggaggtgaaggtacggtaaaagatcacggagacttaaaggtgattggtaataccactccccgttaccagtacggctttcgtctgggtggcgaatggaaaggaatagatattgatatgttctttcaaggtgtaggcaaatgtgatgcatggacacaatcagctttcgtaatgccaatgatgcgtggtgccgatgcgatttatgcaaatcaagctaattattggacagatgaaaatccggaccctaatgctgatttcccacgcatgtggccgggtaatgcaggaaaaggtacagtcagcgtacttgatttaggtaatcataacttctatccgcaaagtaaatacctggtaaacatggcctatctacgtttcaaaaatttgactataggatataccttaccaaaagattggacacgtaaagtttacatggataaagtacgcgtttatttcagtgctaataatatttgcgaacttataaataagagtaatgctcctgtagacccggaagtaaatacttctgaagctatagccaatggtggaagcagtgattacggcaatggaacttggggacgagtagacccgatgtatcgtaccgtatcgttcggtttacaagttactttctaa

SEQ ID NO: 3624 - DNA, 528 bp, B.fragilis
  unsure (388),(394),(426),(439): Identity of nucleotide sequences at the above locations are unknown.
actatgtggcagaaaccttggggatataaagaggggttcgctatctgtggcgggctctttcttacaggcactttcctacaaataacgataggaaaatgtgagctttccattctttcataccctatgaatgtgtgcgtgggagtattgtatcttgttatcttgttactgatctacgccttttcgcaaaagagttatttcatccggtggatgggaagctgccaggctgccgtttcatctatggtatcagtcgcgatgctgactgtagtgatggggctgattcgccaagtgaagtccgatgtacctctgttaggtgctgagagctggctggggttttcgcagatgttgtcggcatgttcgtttgtgctgttgttcctttggatgatcactntgttgngactgaccacaattcggaggatacaccatttncgcttgtgtgatnttccttttgtattgaatcacttggggactgttccttgcactgacccgtgctatctttgggtaatgccgaaatggaacgtttgcggatga

SEQ ID NO: 3625 - DNA, 2682 bp, B.fragilis
tttgttgttaaaaccagagggaaatttgattttatgagcgaagagaacaacgagattacggaaggacattctgactataagccggcggactcacataacgaaagcattaaacatcaacttacaggaatgtaccagaattggtttctggactatgcttcatacgttatcctcgagcgagccgtgccccacatcaatgacggactgaaaccggtgcaacgccgcatcctgcactccatgaaacgcatggacgacgggcggtacaataaggtggccaacatcgtaggacataccatgcagtttcaccctcatggcgatgcatccatcggtgacgcattggtacagctggggcagaaagacctgttggttgactgccagggaaactggggtaatatccttaccggtgacggtgctgctgctcctcgttatattgaagcacgcttgtcgaagtttgcactcgatgtagtattcaaccccaaaaccaccgaatggaagttgtcgtacgacggacgcaacaaggagcctattaccttaccggtaaagttcccgcttttgctggcgcaaggtgtagagggtatcgccgtaggactttcatccaagatactgccacacaacttcaacgaactgtgcgacgcatccatcagctatctgcgtaacgaggaattcaaactatatcccgacttccagaccggaggttctattgacgtatcgaaatacaacgacggcgaacgcggtggagcagtcaagatacggtctaagatcaataaagtagacaacaagacgctggctatcaccgaaatcccttatggcagaaccacgacttcggtcatcgactccatcctgaaagctgtcgataaaggaaagataaaaatacgcaaggtagacgacaatacggcggccaacgtcgagattctggtccacctggcaccgggcacctcgtccgataagacaatcgatgctctttatgcatttacggactgcgaggtgagcatctcgcccaactgctgcgtcattgacgaccagaaaccgcacttcctcaccatcagccatgtgttgagaaaatcggccgacaatacattgtccctgctccgccaggaactggaaatcaagaaagacgaactacaggaaaacctgcatttcgcctcacttgaaaagatattcatcgaagaacgcatttataaagataaagagttcgaacaatccaaagacatggatgccgcctgtgaacatatcgaccgacggttgactcctttctattcacaattcatacgcgaagtgacaaaggacgatatcctccgcctgatggagatcaagatggggcgtatcctgaagttcaactccgacaaagctgaagaggcgattgcccgcatgaacgaagatattgccgagatcaacaaccacttggccaatatcgtggaatataccatccaatggtaccggatgctgaaagagaaatatggcaaaaacttccctcgtcgcacagagttacgcaacttcgacaccatcgaagccgccaaggtagtggaagccaacgaaaagctctatatcaaccgtgaagaaggtttcatcggaacgtccttaaagaaggacgaattcgtggcatgctgttcggatatcgacgatgtgattatattctatcgcgacggacgttacatggtgactccggtagccgacaagaagtttgtgggcaaaaacgtgatttacgtcaatgtctttaagaagaatgacaaacgtaccatctacaacgtagcctaccgtgacggcgcagagggaacacattatatcaaacggtttgcagtcacttccatcgtacgtgatcgtgaatacgacgtgactcaaggcaagcccgattcacgcatttcctacttcagcgccaaccccaatggggaagcggaaattatcaaagtcaccttgaaaccgaatccgcgtgtacgacgcatcatcttcgaacgtgactttagtgaagtgaccattcgcagccggcaaagccagggcgtcatcctgacacgcctgccggtacacaaaattgttttgaaacaacggggtggttccacactgggcggacgtaaagtatggtttgaccgtgacgtgctccgcctcaactacgacggacgaggcgaatatctgggtgaattccagagcgacgacaacattctggttgtactgaataccggagaattttatacttcgaacttcgacctgagcaatcactacgaagacaatgtaagcatcgtcgagaagttcgatcccaataagatatggacagttgccctttacgatgccgaccagcagaattatccgtacctgaaacgtttctgctttgaagctactacacgcaaacagaattacctgggcgagaacaaacacaatcgcttgatcctgatgacagacgagtattatccaagattggaaatcatcttcggaggccatgacagtttccgtgaccctgttgtcgtcgacgccgaagagttcattgccgtcaaaggttttaaagcgaaagggaaacgcctcacgacttatacggtagaaaccatcaatgaactggagccaacccgcttccccgatccgccacaaaacaacgaagaagatgacaccggggaagagccggaaaatctggacccggacagtgataaaacagaaaacgacatactcgacgaaatgaccggacagatgaaactgttttag

SEQ ID NO: 3626 - DNA, 336 bp, B.fragilis
cccttcggtaaacacacgttgtacgagatgattgtcttcaaccaatgcccattccgttcttgtagaaccactttccgcaataagtttcatttcgcagcctttttgatttggatacaaatatataatattttttgtaatttgatttgttttgatcggaaagttttttcatatcaaataaatgcattcggaaatgtagttccctctttgaatgcttgtgcggaacaatcttttgtttttatccttgtgtcggacctgatcaaatcattcttatttaatagattgtatgaagtttataaaaagaaaatctcagccggattgactacctggctgagatga

SEQ ID NO: 3627 - DNA, 2520 bp, B.fragilis
ggaagacccaaaaaatatgaaatagccgacatcaaagtcgaaggtgtcaagaactacgaagattatgttcttatcggactgtccggactctctgtaggacaaaccattactgtaccgggagatgaaatcacaggtgcaatcaaacgctactggcgtcatggtctgttctctaatgtatcgattaccgctgaaaaaatagaaggtaataaaatatggttaaagatcactttggcccaacgcccacgtatttccgatatacgctatcacggtgtgaaaaagtcggaacgtgaagacctgcaaaccaaactgggcatgataaagggtagtcagatcactccgaacctggtagaccgtgcgaaagttttaagtaaacgctatttcgacgataagggatttaagaatgctgaaatcactatcacccaaagagatgatcctgccaatgaaaatcaggtattagtcgatatcgacatcgataagaaagaaaaggtaaaagtacatgccatcacttttgccggcaaccacgccatcaagacatctaagctgaaacgcgtgatgaagaagacaaacgaaaaaggaaaactgctgaacttattccgcaccaagaagtttgtcaacgagaaatatgaagaggacaaacagttgattattgataagtataacgaattgggttaccgcgatgcacgcattgtgaaagacagtgtatccaaatttgacgataagaccgtagacgtattcatcgaactggaagaaggcgataaatattacctccgcaacgttacatgggtaggtaatacgctttacccttcagagcaattgaactacatgctccgcatgaagaaaggggatgtatataaccagaaattgttaaatgaacgcttgtcgaccgacgaagatgctatcggtaacctctattataataatggttatctcttctatacactggatccggtggaagtaaacatagataatgactccattgacttggaaatgagaatttttgaaggccggcaagccagtatcaacaagatcaagatcaatggtaacgaccgtttgtacgaaaacgttgtccgccgtgaactccgtacccgtccgggtgagttgttcagccgcgaggacctgatgcgttctatgcgtgaaatccagcaaatgggacacttcgacccggaaaacatcaagccggatatccagccggaccctgtaaacggaacggtagatatcgcttacgatcttgtatcgaaagcaaatgaccaggtagagttctctgccggttggggacaaacaggtgttatcggtaagttaagtctgaagtttacgaacttctctttggcgaacctgttgcatccgggagaaaattatcgcggtatcctgcctcaaggcgacggacagacactgaccatcagtggacaaaccaatgcacaatactatcaacagtatagcatttcgttctttgatccctggttcggaggtaaacgcccgaattcattctctctgtcggcattcttctccgtacagaccgatatcagtagccgttactacaattcaagctactataacaactactacaacagttattacagcggcttgggtggctacggtatgtacaattatggtaactataacaattacgagaactattatgacccggataagtcaatcaaaatgtggggtctgtcagcaggatggggtaaacgtctgaactggccggatgactacttccagctttcagccgaactctcttaccagagatatatcttgaaagactggcaatacttcccggtgaccaacggtaaatgtaatgacctgagtatcggcttgacattggcccgcgcctcttacgataacccgatctatccccgtagtgggtctgacttctcgctgtccgtacagttcacaccaccttactcattgttcgatggagtagactacagcaagtacaacgagtacaaccagaacgatatgaacaagatgcataaatgggtagaataccacaagtggaaattcaaagcaaaaacatacatcccattgctgaacccgactgtagtgaaaaagactccggtattaatgacacgtgttgaattcggtatattgggtcactacaacaaatataagaaatcaccgttcggtacattcgatgtcggtggtgacggtatgaccggatattcaagctatgcaaccgagagtgtcgccctccgtggttatgaaaacagttctttaactccgtaccgcggacaagaaggttatgcttatacccgtatcggatttgaattaagatatccgctaatgctggaaacaagtaccaatatttatgcgttaacattcctggaagccggtaatgcttggcacgatgtgaaaaacttcaatccgttcgacctgaaacgttcggcaggtgtgggtgtccgcatcttccttccgatgattggtatgatgggtatcgattgggcatacggtttcgacaaagtacttggcgacaagagcgcaggtggaagcagattccatttcgtattgggccaggaattctaa

SEQ ID NO: 3628 - DNA, 894 bp, B.fragilis
cacaagcccaagataaaactgcgtatgaaagtaaaaacaagcatactgctattgctgatgatagcaaccgctctcccctctttcggggggaacggaaatggcaacggcacagactcacttcaggctacccgctatgtgacacgcgccaccatgtacggtgtgggatacaccaatgtattcgacacctacctttctccgcaggaatacaagggaatcgagttccgcatcagccgtgagaccatgcgtatgacaactctgggtgacggcaatgtctcggttcagaacttttttcaggcaaacctggcatacactcacaaccgggtagataacaacaacacctttgccggactggtgaactggaactacggattgcattatcagttccgcattacagacaactttaagttgcttgccggaggaatgggagacttcaacggcggttttgtctacaacttacgtaatacgaacaatccggcctcggcacgcgcctacatcaacctcgacgcttcgggaatggccatctggcataccaagataaaaaattatccgctggctttgcgctatcaggtcaatctgccggtaataggggtcatgttctccccccattacgggcagtcctattatgagatattcacactcggacatgccagcggagtggtccgcttcacctccctgcacaatcagcccgcattgcggcagatgctatcggtcgacttcccgatcagatataccaaaatgcgcctcagctatttgtgcgatcttcagcaatccaaactgaacggaattaagacacacacgtattcgcaagtattcatggtgggatttgtacacgacctgttccgcatccgcaacaagaacggcactcccctgccaccggctgtcagagcctattaa

SEQ ID NO: 3629 - DNA, 2109 bp, B.fragilis
ttggacgccaagataaagaaaaataaatgtcctaatgctatcagcacactaaaaataaagttatctttgcagctatcaagactactcaaaaatatgtcctccaaaccgtaccgtcacttcatagcactcctgctggttttgttttgttcgcgattcgaagcccaagccgaagacctgttcgctaaaacggacagtactcttcaacaatacttgatcagatgtaaggcacaaatcaaagatccggactttctgcaaacaaatgatactcttacgcgcatggctcaagaaaaaaatgacaaacggatgcaggtgattgccgtggccctgaaactggattattactactatcaaaacaatccggacagtatccttgtcatggtagaccgcgtgaagaaaatcagccgaaggaataatgaactgaaatatttctactttgcatggggaagccgattgattatctattatatcaaacaacaccaaaccaacactgccatttacgaagcccggaaaatgcttcagtcagcggaggctgataatttcattcccggaatcgtacaatgttaccgtacattggggacggtctacatgactcaatcgaatcctaaactggcttatgaaaacttccggaaacaaatagccttgattgaagaaaatgaaatagaagatatcaatctgcccactcaatatgcttcactcgcccaatgcgctcttgaaatgcaccgccccgacgaagcgctgaaagcactggaaaaaggatcgaaatgtaccaggagttcatatcagatattcactgtacagaaagcctatattctatattatctggaaacaaaagaatacgaaaaagcccggaaaacacttgtggagttggagcaattgttcgaaaaagataaatcactcacactctataaaagcggattattctatatacagatagaatactaccggaacaccggacagtaccggaaagcacttgacgtgatagaagagatcaagaatgattcatcgagcattaacaaatacctggactatacactcacccagaaacaaggcgacatctattgggaaatgaaccagaaggcccgggctgcccaatattatcgggattatatcctggcaacagactccatccgaagccaggaaatacaaaactcaaccaacgagttctataccattatggaagtagaacagctacacaaagaaaaaaatgaactactgctgcacatgcaggaagaaaaattgcagaaaatcaatatcgcacttgtctcgctggtcattattctggtggcaggaacgatgttacttttccacatctcaaagttgaataaaaaactgaagagatcggaagccaaagtgatacagcagaacaaagaattggtagaaaacggagaagaattacgcaaagccaaagaacaggcggaaaacgcaagccggatgaaaacaacttttatccagagtatgtcacacgaaattcgcactcctcttaattcaatcgtcggattctctcaggtactgagcaactatttcaaagaagaagataatgatgaaatcagagagttcgcctcgatcatcgaaatcagcagcagcaatttactgcggctgatcaatgacgtactcgacatctcttacctagaccagtcggaaatattgccctacgataagcccgaagacatcaacaattgttgcctgctcagcatcgaacgaacccggaacagtataaagaaagaggtatcactccgtttcgaaccgtcatgcggaccacttatgatattgaccaacccggaaagggtagcgcagatactgacccacttgctacacaacgcaattaaattcactgacaaggggaatatcacgctggcttacaccatctcgcccacagaaaaacagattgtatataccgttaccgatacagggaaaggtatcccagtggagcaacaagagtatgtattcgaacgttttgccaagctgaacgatttttcgcaaggaacagggttagggcttcccatctgtcggattattgccgaaaagctaggaggtagcctcatcatagataagacttataccaagggatgccgcttcatacttacattgccgctgataaaagcagactga

SEQ ID NO: 3630 - DNA, 270 bp, B.fragilis
gtaatcaacaaattacgtatcactacaggaggcattgacggaacttatgccgatgtacgcaccatcttacgagaagcactgataggacgtgccacacaaatagccctgattcataatcacccatcgggccatgcgaagcccagccaagaggacaaacgcctgacgggcgccatacaaaaagcgtcgcaaacgatgaacatcaccttggtggatcatgtcattgtctgcgacggttgcttttatagttttgctgacgaagggcttatctga

SEQ ID NO: 3631 - DNA, 426 bp, B.fragilis
atcatgaacaaacagaaactaaacatcaagcagtggtccaaagccgatcggccacgcgaaaaaatgatggcaaaaggttccgaagcattgagcgacgctgaactattgggcatcctgataggttcgggcaatacggaagagagtgccgttgaactgatgagaagaatacttgccacttgcgacaacaacctgaatgaactggggaaatgggaagtacggaacttttcttcattcaaaggcatgggaccggccaaaagcctcaccatcatggccgctctggaactaggcaagcggcgtaaactgcaggaaagcaaagaacgggaacagatcagatgttcagaggacatctacaagctgttccatccactgatgtgtgatctgccgcaagaagagttctggattctgcttctgaaccaagcatgttaa

SEQ ID NO: 3632 - DNA, 555 bp, B.fragilis
cgaatgaacaaaaaaatctatttattgccgttgctgttactggctcttatctttgtttcctgtgaggagacgaaagaagctacgaagtttgataactggcgggcacgtaacgaaggatatatcgattctttgaagacggtatttgatgaaaaaaccgatccggaactgaaagcttttgagccggagataaatccgaagttacggatttattataaaaagaagatctcgaatgatacaggtgctattcccctttatacagattccgtgaatgtgttttatcgtggaagttttatttttggcgaaacatttgaccagaactttacgggagctgatccggggccttttgattcacctactaaatttgttatccaaacatttattacggttggtggtgtctccggttgggctgagatattgcaacgtatgcgtgtcggagaaagatggcttgtttatattccgtgggagttggcttacggagcaagtggaactgacgatattccaggctattcaacgctgatctttgatatgcaattggaagaaatattggatgaataa

SEQ ID NO: 3633 - DNA, 861 bp, B.fragilis
ataaagaacaaaaacatgaatagtaatatagaaaaatcagataaaccctccttcatcaaaatctctgagcagccctcactttacgacgatcttgaaaagaagtcgatccgcgaaatactggaagacatcaataaggaagaccagaaagtagctattgccgtacagaaagcaattcctcaaatagagaaactagtcacacaaatagttccccgaatgaaacaggggggacgcattttctatatgggagccggcaccagcggacgcctcggagtactcgacgcttcagaaatcccacctaccttcggtatgccccccacattaattattggcctgatagcaggcggtgatactgctttacgcaatccggtagaaaacgccgaagataatacgatccggggctgggaagaactgacagaacataacatcaatgacaaagatacggttatcggtattgcagcctcaggcaccaccccttacgtaatcggagctatgcatgcagcccgcgagcatggtatcctgaccggctgcatcaccagtaacccgaactctccaatggcagcagaggccgatatccccatcgaaatgatcgtgggtcccgaatatgtaacgggtagttcacgtatgaaatcgggaacgggacaaaagatgatcctgaatatgatcacaacctcggtaatgattcaattaggacgcgtgaaaggtaacaaaatggtcaacatgcaactcagcaaccggaagctcgtagaccgtggtactcgtatgattattgaagaactcggacttgaatataataaagcaaaagccttgttgctgatgcacggttccgtgaaaaaagcaatagatgcttataaagccggataa

SEQ ID NO: 3634 - DNA, 798 bp, B.fragilis
atgaacgtaaacaggctattaggaattttagctatacttttactgactgccgccagcgctctttatgcacagaaacccgtgaaggtgaaaggcgtacaggggcgttggcaagttagcgatgacatcacattgaagcaggcggaagagagggctttcatggaagcgaagaaagctgctctgcagaaagcgggtgtgatggaaaatgtgtggtcggtatttggccagatcacccaggaagacggccaggagcttcatgaagcttattcgcaaatgaatgtgctggctatcgggggaatggtgaatgttactaataaaaaagttgaagaggtttgggacacggatacccgtagcctgtataaggtagtgaccattgacgccgaggttcggaaagaggacaagtcggatagttcgtatgcccttgaggtgaaaggagtggaaacactctatcgtgaaggggatgtgtttcactgtaagctgactatacatggtacggattcatacttgaagtttttctggttcgacagtaatgggggggctctgctttatcctaacagttatgaaccgaatacattgttgaaagccggtaaagaatatgcgattccttttagtaatgctgtcgactatcgtatggagaagcagcatggtaaggaaagcgagaagataaatatgatgatggtggctaccaaggaagatatcccatttaccaaagaagtcacttatcagaatgtattggagtgggtgtactctatcccggcggttcagcgttgtgctttttatgatatggtattgataaaataa

SEQ ID NO: 3635 - DNA, 231 bp, B.fragilis
agtatgaaaaacgcaaaaattactattggacttatcgggctattgctaataggtcttgtttctgtgagaaaagaaggaaaggtacaagaagccggtttgctattgcaaaatgtggaggctttggctacaggagagtcgttccccgatggagatatagcctgtatcggtgacggatctgtggactgtccgttcacatatctgaaagttgaagtagtataccgtgaagaataa

SEQ ID NO: 3636 - DNA, 1215 bp, B.fragilis
ttaaatcgaaaatcagatatgaaagttttagtattgaactgtggtagttcatctatcaaatacaagctgttcgatatggacagcaaagaagtgattgcccagggtggtatcgaaaagatcggtttgaaagattcattcctgaaattgactttgccgaatggtgaaaagaaaattttggagaaggatatccccgaacataccgtaggtgtggaattcatcttgaatacactggtaagtcccgaatatggtgctatccaatcactcgaagaaatcaatgccgtaggtcatcgtatggtgcacggaggtgaacgcttcagtaaatcagtactgctgactaaggaagtgcttgaggcttttgctgcctgcaatgatctggcacctctccacaatcctgctaacctgaaaggagttgacgccattacagctattctgccgaatgttccgcaaatcggtgtattcgatactgcattccaccagactatgccggagcatgcatatctgtatgctattccttacgaattgtacaagaagtatggtgtgcgccgttatggtttccacggaacttctcaccgttatgtttctcagcgcgtatgcgaatacctgggaattaaaccggaaggtttgaaactgattacttgccatatcggtaatggtggttcgattgctgctatcaaagatggtaagtgtatcgatacttctatgggactgacaccgttggaaggattgatgatgggtactcgttccggtgatatcgatgccggagctgttacattcatcatggataaagagggcctgactactacgggtatctctaacctgctgaataagaaaagtggtgtagccggtatgatgaacggctcaagtgatatgcgtgacttggaagctgccgttgccaaaggtgatccgcaggctatcctgactgaacagatgtacttctatcgcattaagaaatatattggtgcgtatgccgctgctttgggtggggtcgatgttattctgttcacaggtggtgttggtgaaaatcaggcgacttgccgtgccggtgtttgtgaaggactggaattcctgggtgtgaaactcgatccggaaaagaacaaggttcgcggtgaagaggctattatctcaactgatgattcaagagtgaaggtagtagtgatcccgactgatgaagaattgctgattgcttctgatacaatggctatcttggataaataa

SEQ ID NO: 3637 - DNA, 1473 bp, B.fragilis
gcatatatgaaatcaacaatcaattgcttcatcccttacgcgggagcagtacaagcagaaagaacagttcaaggattacaagcaacaggtttggtgaaaaaaatctaccttcttgtcacctcacccagcttcgatccactaccaggatgcgaactactttatgtagacaagcttaccaacagcgcctccatgtacgccattgctacctattcggatgcaagctacacattactttataccaaatatacatcacttgaactgggactatttgcccttgaacggatgattcacattgccgaagattcggctgccggcatggtatacgccgaccattatcaagtgacagaaggtaaacagagtaatgccccggtcatcgattaccagttcggaagtctccgtgacgatttcaacttcggttctgtcctccttttcaaagcctcagccttgaaagaagccgccaaacgaatgaaatccgactatgactttgccggattctacgatctgcgccttaaactttcacagaaatatccattagtacatatcaatgaatacctttattcggaagtagaaaacgacacccgaaaaagtggtgaaaaaatattcgactatgtagatcctaaaaatcgtgaccgacagattgagatggaagaggcatgtaccgaacatctgcaagagataggcggttatctgaagcctgaattccagaaaatagaattcaacaccggcaacttcccatacgaagcttctgtgattattccggtacgcaaccgtattcgtaccatacgcgatgccatccgttctgtactcagccagaaagcagatttcaaattcaacctgatcattatcgacaatcactctaccgacggtaccaccgaagccattgatgaatttaaagacgatgaacgcctgatccacttgattcccgaacgtaatgatttgggtataggcggttgctggaatctgggagttcaccatcctctttgcggtaaatttgctgtccaacttgacagtgacgacgtatatgcccacgacggtactttgcaggtcatggtcaatgcattttacgaacaaaactgtgctatggtagtaggcacctatatgatgacaaattttgatatgaacatgatcgctccgggcattattgatcacaaagaatggacaccagaaaacgggcgtaacaatgcactacgcatcaacgggttaggtgctcctcgtgcattctacacaccaatactccgtgaattgaaggtacccaataccagctatggcgaagattacgcattaggactgaatttctcacgccagtatcagatcggacgcgtatacgaagtcgtttatctatgccgccgttgggatgataactcggatgcctctctcgacatcgtaaagatgaatgctcacaacctttacaaggaccgcatacgcacttgggaattacaggcacgaattgcattaaataagaaacaaagatga

SEQ ID NO: 3638 - DNA, 702 bp, B.fragilis
actcaaatgaattatttagaaaatgaattcttcctgctggcaatcactttcgggatttacttctttgccaagcttttacaaaaaaagacaggaatactcctactcaatcccatcttgttgactattgcagtcatcatcattttccttaaactgacaaatatctccttcgaaacttacaatcatggcggacacttgattgaattctggctaaagcccgcagtcgtagctcttggagttcctctatacctgcaactcgaaacgattaagaagcagctgcttcctatcattctgtcccaattggccggctgcatcgtaggcgttatttcagtcgtactgatagctaagcttatgggagcctcacaggaagtcatcctgtcacttgctcccaaatcagtcaccactccgattgcaatggaggtaaccaagacattgggtggaatcccgtctctgacagcagcagtagttgtttgtgtgggtttactgggtgcagtattaggtttcaaaacgatgaagatcatgcatgtaggcagccctatcgcgcaaggactttcgatgggtacggccgctcatgccgtcggcacctcaacagccatggatatcagcagtaaatacggtgcctatgcaagcctcggtttaaccctcaacggtatttttactgcattgttgaccccaactattctgcgattattaggaattctctaa

SEQ ID NO: 3639 - DNA, 1026 bp, B.fragilis
aaacaaaagaaaaagatgaaagtagctattgttggcgtaagcggagccgtaggacaagagtttctacgcgtgctcgatgagagaaatttcccgttggacgagttagttttgttcggttctaaacgtagtgccggaactaaatatactttccgcggtaaacagatcgaggtcaaacttctgcaacacaacgatgactttaaaggggtggacattgctttcacttcggccggtgcaggcacgtctaaagagtttgagaagactattacccagtatggtgcggtaatgatcgataactccagcgctttccgtatggatgccgatgtacccttggtagtgcccgaagtaaatgcagctgatgctaaagatcgtccacgtggtgtgattgccaacccgaattgcacaaccattcagatggttgtcgcactgaaagccatcgaagagctttctcatataaaaactgtgcatgtatctacttaccaggcagcgagcggtgccggtgcagcagctatggacgaactctacgaacagtatcgtcaggttttagccaatgaacctgtcactgttgaaaagtttgcgtatcagctggccttcaacctgattcctcaaattgatgtattcacagaaaacggatatacgaaagaggaaatgaaaatgtataacgaaacacgcaaaatcatgcactctgacgtgaaagtaagtgctacttgtgtacgtgttccggcacttcgtgctcactctgaaagtatttgggtggaaacagaacgtcctatttcgatagaagaagctcgtgaagcttttgccaaaggtgaaggattggtattgcaagacaatcctgccgagaaagaatatccgatgcccttgttcctggcaggcaaagatcccgtttatgtaggtcgtatccgtaaagacctgaccaatgactgtggattaaccttctggattgtaggtgatcaaatcaaaaaaggagccgcactgaatgctgtccagattgccgaatatctgattaaagaaggaaatatcggataa

SEQ ID NO: 3640 - DNA, 1413 bp, B.fragilis
agtatgcctgagaccggcagccttccgcatattgatagaacgcataaaacaacaattatgaaagaacccaaagtacaggtcggcattttattcgaacctcaaatcaaattcatactgctgaccccctatcatatcaacggggaagaggtcagcggcaaacaggttgtgacctatgataacggacacatcctctggcaagggcattcatatgacgaactgctgtttgagcccctacacgaaaaaagcgatgcttttgaactgcaggatgtcaccatcggtatcaattttcattgggaacgaaaggaaaaccagcgttttatcggagcactgaaaattattgtagaaaataaaaagttaacgggaatcaacgtaattcatgtggaagattacctgaccagtgtgatctcttctgaaatgagtgcaacggcaagtctggaattactgaaagcacatgctgtgatttcaagaagctggttattagcggggctttccctaccctattccaaagatagagaaaaaagtaataccactcccgagaaagtgccctactctacatcttcttttccaccccttgcacaagaggccgaaaataaaattctaatccgctggtatgaacgtgacgcacatactcacttcgatgtctgtgccgacgatcattgccaacgttaccaaggtattacccgtgcctcaaccgacatggtgaggcaagccatctctgccacccgaggagaggtacttatgtcggaaggaactatttgtgatgcgcgcttctccaaatgttgcggtggtgcttttgaagagtttcagtattgttgggaaaatatcagacatccatacctatccaaacaaagagatagcaaaaaagcaaccgatctacccgatctgtgtaaagaagccgaagccgagcgatggatacgtacttctcccgaagccttctgtaatacaaaagacaagaaagtactgtcacaggtactgaataactatgatcaggaaactaccgacttttatcgttggaaagtagaatatgaacaggaagaactgtccaaactgattctgaaacgttcaggaattgactacggacaaattctcgacttggtaccagtggaacggggaacttccggacgacttgtcagactcaaaataataggtactaaacggaccatgatcattggcaaagaactggaaatacgtcgtaccctctccccatcacacctctatagttctgctttcatcattgataaagtaaacgtcacaaacggaataccggatcgctttatccttaccggggccggatggggacacggagtaggactctgtcagataggagcagccgtcatgggcgagcaaggttatacatacgacaccatcttgctgcattattacatcggggcaacgatagataaactttattaa

SEQ ID NO: 3641 - DNA, 729 bp, B.fragilis
atggttaaagaagaattaatggagaactggcaacagagaacggaactccttttaggagcggagaagatggaacgcttgcggaaatcgcatgtgttggttgtcggattaggaggagtaggtgcttatgcagccgaaatgatttgtcgtgcaggcgtagggcgaatgacaatagtagatgctgatattgtacagcccactaatattaaccgccagttgccggctactcatgccactttgggtatggaaaaagcgaaggtgttggaagcacgtttcagagatattaatccggaaatagagttgactgtattgcctgtttatctgaaagacgataacatacccgaactgctggatgctgcacgttatgattttatagtcgatgccattgacaccataagtccaaagtgctatctgatttatcatgctcttcagcgacgcattaaaataatatcgagtatgggtgcaggagcaaagagtgatattacacaagtgcgttttgccgacctttgggatacttatcattgtggtcttagcaaggccgtccggaagcgtttgcaaaaaatgggggtaaagcgtaagcttcccgtggtgttcagtacggaacaggcggatccgaaagcagtattgctgactgatgatgagaggaacaagaaatccacttgcggaactgtgagctatatgccggcggtgtttggttgttatttggcagagtacgttatcaaaagattgtaa

SEQ ID NO: 3642 - DNA, 186 bp, B.fragilis
cggcgcaaagatacggatttctattccaaaacaaaaataattgtctcatttacaggagcccagtcgaaaataaacttggaatgtgatgttgcattccgtacacacatgtgcgagcggggcgtggtgcccagagacgggctgtactctataagtgctttacggggctcgtttaccgggactccgtga

SEQ ID NO: 3643 - DNA, 1488 bp, B.fragilis
caaattatggaaaagaaactgaaatcatggcagggatggctgttgttctgcggagcgatggcagtcgtttttgtactcgggcttgtagtctcttcactgatggagcgcagggcggaaacggtaagtgttttcaataacaaacgggtggagattaccggaatagaagcccggaacgaagtgtttggagaaaattatccccggcagtacgagacgtggaaagaaacggcaaaaaccgatttcaaaagcgagtttaatggcaatgaagcggtagatgtgcttgaacagcgccctgagatggtggtgctatgggccggatatgcattttcaaaggattactcgactccacgggggcacatgcatgccattgaggacattactcattcactccgtaccggtgcgccgatggatgataaaagtggtccgcagccttctacctgctggacttgtaagagtccggatgtgcctcgcatgatggagacgattggagtggactcgttttataacaacaagtggggagctttcggcagtgagattgtcaatccgataggttgtgcagactgtcatgaaccgacaaatatgaaattgcatatcagccgtccggctttacgggaggcttttgcccgccagggaaaagatatagacaaagcgactccacaggagatgcgttcgctggtatgtgcgcaatgtcatgtagagtactattttaagggggatggtaaatatctgactttcccttgggataagggattctcggtagaagatatggaagcctactatgatgaggccgacttcgctgattatacacatgcgttgagcaaagcccgtatactgaaagcgcagcatccggattatgaaatttctcagatggggattcatgcccaacgcggagtatcgtgtgccgattgtcatatgccctacaaaagtgagggaggcatgaagttcagcgatcaccacattcaaagtccgttggctatgatcgaccggacttgccaggtgtgtcatagggagagtgaagagactttaagaaataatgtatatgatcgccagcgtaaagcgaacgaaattcgtggccgtttggagcatgaattggctaaggcacatattgaggctaaatttgcatgggacaagggtgcgacagatgcccaaatggcagaggcgttaaagttgattcgccaggctcagtggagatgggatttcggagtagcttcgcatggaggcgcgttccatgctccgcaagagatacaacgtattctggggcatgggcttgacaaggctttgcaggcccggttggctatttcgaaagtactggctcagcacggctacacggctgacgttccgatgcctgatatttcgacaaaggaaaaagcacaggaatacatcggtctggatatggagaaggagcgtaaggcgaaagacaaattcctgaaaacaatagtacctgagtggttggagaaagcgagggccaacggtcgtctggctaaactgtag

SEQ ID NO: 3644 - DNA, 972 bp, B.fragilis
attagtatggacaaaaaaatatctatttcccaaataaaagaggttgtgcagcaggcctacgaacaggtaaaaggtaatacaggcggtaagaatgccgattatattccttatctggccaatatagacaaaaacctttttggtatcagtgtctgcctgctgaacggtcagaccattaccgtgggtgactttgattatcgtttcggtattgaatccgtatctaaagtgcatacagccattctgattctccgccaatacggggcacagaaagtgcttgagatgatcggtgcggatgctaccggacttccttttaactctatcattgccatcttgttggagaatgaccatccgtctactccgttggtaaatgccggagccatctcggcttgttccatggtgactccgattggtaattcagataagaaatgggacgctatcgtacagaacattaccgatctttgcggttctgctccacagttgatcgaagaactctataagtcggagacagctaccaatttcaataaccgttctattgcctggttactgaagaactataatcgtatctatgacgatcccaatatgtcactggacctttatactcgccagtgctctttgggggtaactgcacagatgttgtcggtggctgccggtacggttgccaatggcggtgtgaatcctgtgactaaaaagcaggtgttcgatgccgaactgactcctaaaatcacatctatgattgctaccgtaggcttctacgaacattcgggcgactggatgtatacttcaggtattcctgccaagaccggtgtaggtggtggtgtgatgggagtattgccgggtgtattcggtgtatctgcctttgctcctcctttggatggctcgggcaactcggtgaaagcacagttggccattaagtacatcatgaacaaattgggattgaatgtattcaatggtgcgagagtgaccatcgtcgattag

SEQ ID NO: 3645 - DNA, 867 bp, B.fragilis
cagaaaatggattcaacgattttcaaaagtctgaatgtgaacggtcgcttacttgatctttccattccgcaggttatgggtatactcaatgttacacccgattctttttatgcaggtagccgaagccggacagaagccgatattgctgcacgtgcccgtcagatacttgatgaaggggcctctatgattgatataggagcttattcgtcacgttcgaatgccgaacacatctcgcccgaagaagaaatgcggcgtttgcgtaccggtctggaaatattgaaccggaatcatccgggtgctatcatttcagttgacacattccgtgccggagtggctgaggaatgtgtgaaggagtacggagtggctattatcaatgacatttcggccggtgagatggacgaacagatgtttccgacggtggctcgcctgaatgtaccttacattatgatgcacatgcaaggtactcctcaaaacatgcaaaaggagccccattatgaaaatttgctgaaagaggttttcatttattttgcccggaaagtacaacaattgcgtgacttgggagtgaaagacattattctcgatcccggtttcggcttcggcaaaacgttggagcataactacgaactgatggcgcatctggaagagttcggcattttcgaacttcccttgttggtgggagtttcccgcaagtcgatgatttatcgtttgtttggaaccacaccgcaggaagcactcaacgggacaacagtactcgatacggtagctttgatgaaaggtgccgatattctccgtgtgcatgatgtgcgtgaagctgtcgagtcggttcggctgatagagaaattaaaaagtgtatcggcttgttcctga

SEQ ID NO: 3646 - DNA, 213 bp, B.fragilis
gttaaaacttgttctttggatgtgaataacaagttctttaaatgcaaaagacttgttatttgcgcacaagaacctgacaacctgcaaaagacgttaacaatgttaattgaagaaaggtgtaagaatgaagataccgattcagacagcgtaaattcacttccggaacttgagctatcttattcagccggtatctgttttttcttattaaagtag

SEQ ID NO: 3647 - DNA, 2139 bp, B.fragilis
tatatgcattggtttgacctcagtttacaactcccgataacagaccccacgtgggtgtttttcttggttttgatcattattctttttgcaccgatgatattaggacgtctgcatatacctcatattatcggcatgattttggccggagtggttatcggtgaatatggctttaatgttctcgagcgggacagtagtttcgaattgttcggaaaagtaggactctattatatcatgtttctggccgggctggaaatggatatggaggattttaagaagaaccggacaaaaggattggtcttcggatggtttacatttatcattccgatggcattgggggtatggagtagtatggaattgctgggatatggatttactacagcggtattactcgccagtatgtatgcttcccatacactgattgcctatcccattatcagccgttatggattgtccagactcaggagtgtaaatataaccatcggcggtacggcggtaacggttacgttggctttgattattcttgccgtcattggtggtatgtacaaaggaactgtcgacggtatgttttgggttctgttagtggtgaaagttgcatttttgagttttctgatcgttttcttcttcccgcgtatcggtcgatggtttttccgtaagtacgatgatagcgtaatgcaatttgtctttgtactcgcgatggtctttttaggtagtggtttgatggagtttgtcggtatggagggtattttgggagcttttcttgccggacttgtcttgaatcgcttgattccgcatgtttctcctttgatgaatcggttggagtttgtcggaaatgccttatttattccatatttcctgattggtgtggggatgataatcgatgtccgtaccctgtttaccggtggtgaagctctaaaggttgccgtagtgatgaccgtattcgctactctaagtaaatggttggcagcttggatcacacagaagatttatcatatgcagcccaatgaacgaagcatgatgttcggtttgagcaatgcgcaggctgctgctacgctggcagcagtattgatagggcatgaaatcattatggaaaatggagagcggttgctgaatgacgatgtgctcaatggcacggtagtcatgattctctttacgtgcgtcatcagttcgcttgtaaccgaacgttcggcaaggcgttttgctctgcacgaagagatgcagtttgaagataataaagagaagacagaacaggagcagattctgattccggtagcaaatccggataccattgaagatctgattaatcttgccttggtcatcagagatactaaacagaaaaaagaattgatcgcactcaatgtaatcaatgataataacaattcggaaaataaggagttacagggtaagcggaatctggaaaaggcggcaatgattgctgcttctgccgatgtttcggtcaatatggtgagtcgttatgatcttaatattgcttcgggcattattcataccattaaggagtatgatgctacagatgtagtgatcggtttgcaccgtaaggcaaatattgtcgattcattttttggtaatctggccgaaagcttgctgaaaggtacccatcgtgaagtgatcatcgccaaattcttaatgcccgtcaatacacttcggcgcattattattgctgtgccgccaaaggctgaatatgaaaccggattttccaaatgggtagagcacttctgccgcatgggaagtcttttaggatgtcgggtacatttctttgccaacgagcaaaccctgatgcgactgcagcagttggtaaagaaaaagcatggtagtacgcccactgaattttccaggttggacgagtgggatgatctgcttctactgaccggacaggtaaattttgaccatctgttggtggttattagtgcacggcgcggatctatctcatacgacccttcattcgaacgtctacccaatcagctcggaaaatatttctcaaacaacagtctgattatattgtatcccgatcagtttggtgaaccacaggaaattgtttcattctctgatccgcgtggctacaacgagtctcaacattacgataaggtaggtaaatggttctataaatggttaaagaagaattaa

SEQ ID NO: 3648 - DNA, 2910 bp, B.fragilis
ataaaaaactgggctgagtgccgaacaaacagagaaacaatgaaaatggaaagaaactacagtgcgttcttgcaagatatcggacgatttatcccgcgagacagattatttactgacgaactccatcgtttggcgtgggggacagatgccggtttctatcgactgattcctcaaatcgtaattcattcaatcaatgatgacgaagtaatagaaatcatctatctagccgaccggtacaatataccggttactttccgtgcagcaggaaccagcctttcgggccaagccattagtgactctgttctgattatagccggaaaaggttgggaaaactacgagctttcacccgaccacgaaaaaatctatctggagcccggcattgtcggacagcgagtaaacgagattttagcaccttacggacgtaaatttgccccggacccggcttctataaaaagtgccatggtaggtggaatcgtgatgaacaatgcttcgggtatgaactgtggaacacatgccaacagtgataaaatgttgctatctgtacatatcatatttcctgacggatattatctcaatacagatagtcaggagtcacgtgagaattttaaagaagattatcccgaattcctccagcgcatctgcgaactccgcgaccagatacgcagtaacgagaagcttagcgcacgcatccgccacaaatattcaatcaagaacgtaacaggcctgaatattctcccgttcctcgtatacgacgatcctttcgacattatcgctcacctgatggtaggttcagaaggtacactggctttccttgccggtgtaaccatgaaaacagagtatgactatccgtataaagccagtgccatgctctacttcagcgatatcaaagaggcatgccgtgcagtggtagctatgaaaagactcgtcaacgcaaatggagaatggattgtaaaaggtgcggaattactcgactggaaatccttggcttcagtcaatgatccgacaggagaagggttgaccgctgtcctgaccgagaccaaagcatgtacacaggaagaactcaatcagaatatcgccatcatcgaggaggcattaaaagcattcgatacatatattccggtccattttacggatcaacccgaagaatattcaaaatactgggcaattcgggcaggtattttcccatctgtaggtggaacacgcccttcgggaacgacttgcctgatcgaggacgttgcttttcatatcgaggatcttcctgaagcaaccgccgaactgcaacagctcatcgcccgccacggatacgatgatgcctgcatttacggtcatgccctggaaggcaattaccattttatcatcaatcagtcattcagcaatgaggctgaggtaaaacggtacgaagccctgatgaatgatgtaatagatttggtagtaggcaaatatgatggttcactaaaagccgaacacggcacaggaagaaatatggctccatttgtagaatacgaatggggagaagaggcctacgcaataatgaaagaagtaaaacaactcttcgaccccaaaggattatttaatccgggagttatctttaatgatgatcctcaatgccatatcaagcacttcaaacccctctctccattgacaataggacaagatacccaagtaacccgacagatagaccggtgcatcgaatgtgggttctgtgaagtaaactgcctgtcatgcggatttacactctcctcacgacagcgtatcgttattcaaagagagatctcacgcttgaagaaaagcggtgagaatccccaattactggaaacgttatctgagctataccggtattctggtaactggacttgtgccggcgacggtttatgtgctatgtcttgtccgatgggtatcaataccggtgacctgacccacatcctgcgtcaggctgagtttcctcccggaagtaccggttacagagccggtaagtttgctgccaatcattttgcaggaatcaaaagtactttgcgcccagtattatcacttgccaatgcggcacatagtttactgggtacatcaacaatgacctccattacccggaaaatgcacagtgcgtggggactcccacaatggacaccggccatgcccaaaagctataaaatacggaaaagcgatcagactccggcaatgaataacaaggtagtctactttcccagttgcatcaatcaaacgatggggctggcaaaagattctcctgtagatcaacctttggtaaaacaaatgctctccctgcttcaaaaagccggatacgaggtcatcttccctcctaaaatggaaaaactctgttgcggaaccatttgggaaagcaaaggtatgctggatatcgccgacagtaaatcgaccgaactggaagccgctttatgggaagccagcgaacagggacgttatccggtgctttgtgaccaaagtccttgcttacaccgcatgcgtgctactatccaaaagataaagttatatgaaccggcagaattcatttatactttcttgcgggacaaactggaatttaccccaaccgaccgaccgattgccatacacatcacatgttccatgcgcaaaatgggattggcgaatatactaatctcactcgcaaagctttgctcaacccaagtattcattccggaagaggtcggttgttgtggttttgccggagacaaaggattcacgcagccggaactcaacacttatgctttacgcaagctgcgtccgcaattgacgaaagccggtatcggtatcggttactcaaatagtcgtacctgtgaaatcggtctcgccaccaataccggtatcccctatgtatcgattgcatatctggtcgatcagtgtacccggcctataaaacaaaaaaataacttaacacttaaataa

SEQ ID NO: 3649 - DNA, 1158 bp, B.fragilis
agtaagatatggtttccttttcaacttttgatcagcttctttaaaacgatatttatgaagaaactaaatcaacttttgttggggctgttacttgttggaagtgcgatagcctgtcatcgagaaacatctttagaagagcgagatatagtaattgatctgtctgtctctaatccatatctgccgatgtctgtattggtggacaccattgagtctgtcaggctgcagttaccttctccttatttttggggtatggtcgataatgtaatttcaaaagattcttgttattacatttcggatagaaagcaagaaatggcattccgatttagcaagaatggtacttttttgaatgcgattggccagcggggtgagggaccgggagagtatagagagatggattcttttttcgtgggaaaggattgtgtttatgtctgtgatatgggtaaacgaacgatttattcttacagttttgatggaaaatttcttcattcgttgagcttcccttattctcttgttttcaatgatgttgttgagttgccggatggccgttttctctgccatcgtccttctcagtctgaaaactgtaaagggctttggattctggatcagaaagggagaagagtgaagaacttattagaatatgaaaaagggactccttgcaagaactcctattggaatacgctgtgtgctcaagaggatggaactataaaaatctataatccggtagatggaagctattatcaatatgatgctgtgaatgatacggtggtaagaaccatgaggcagaagtccaatttgcctatgttggcggattttcactgctcggaccgggaattgtacgaaacgaaagaggagtgcacatacagccttttcacagtggatggaaagaatcttgttttctctctttggtcttttaattcagcaaataagggaatgtggtctgtctattttaagaaggatgggcggatagagcaaggaaatttgaccaagatggatattcctggatattcggaaatgggacgtccggtttcatctaatatccctaatacatttgtgacagtttatacagatgaattcccggatgatgcatttccgtccgcttatcagcaacaggagataaatgagcaaactgcgatacttagccttttgaggttaaaatga

SEQ ID NO: 3650 - DNA, 1803 bp, B.fragilis
ttacggcaatggaacttggggacgagtagacccgatgtatcgtaccgtatcgttcggtttacaagttactttctaatataccataaacaattaatagcgaattatatgaaaaaaattaaatatatagcatgtctgctgtcattggctgtagtatccggttgtgacagtatcttagacaaaggtcctctggactcttttaccaatgataacttttggaccggtgaaggaaatatatccggatatgcaaatgcattctacgaacaattcttaggatatggtaacggcaatggttacggtgatttctatttcaagacattatctgacgatcaagccggaatgagctttgccaaatggacttatccggacaatgcaccctcaacaagtgctacctggaaaaatggctggattgaggttcgccgcgctaacatcatgctcgagaatgtaccgacagttgcttcattggacgaagcaaccaaaaatcattggctcggagtagctcgcttaatgagagcttggcaatactatcacttagtacgtatgtatggtaatctaccttggatagacaaagcacttaacatcaatgatgaaggagaaatatatggcaaccgcgaggatcgggatatggtgatggacaaagtgctggaagatctggactttgcggtaaccaatatcaaagatatttccagtaaaacgacttggagccgttcattagccaacgcaatgaaagctgaggtatgcctctacgaaggcacttttcgtaaatatcgcaaaaatgaagatggacagcaagcccccgatgcaacaggtgctgccaggtacctcacagcctgcaaagaagcatgtctggccgttatgagcaaaggttataaattaaacacctcttatcaggggaattataactcgacagatttaagcagtaatccggaaatgattttatacaaagcatacaaagaaggattactcatgcactccactatcgactacacatgctcatccactcaaatcagcggtatgagtaaaaatgcgttcgaatcctacctgtttaaagatggtaagcccatggcattgacttctttgaataaaagtgacgaagcacctttccaatacggacatttatctttaaaagccattctcgctgtccgggataaacgactggcccaaacaattgatacagtactcctgtataatggcagaggatttacacgatttaacaccggcatggaatcaacttcttcgacaggttatggagtggctaaatacgataatgaagctatcccggaaggttttagaagtcaatcaggaaagaattatactcatgctcctttattttggttgtcagtaatttatttaaattatgcggaagcctgcgctgaattaggtaatatcactcaagatgacttggataaatctatcaacttactaaaagaccgtgctggattaccacatctaaaccctatcgtcggtttcagtgatcctgcaaataaccatggggttagcgatttaatctgggagattcgtcgtgaacgccgttgtgaactgatgttcgataatgataaccgatattgggatttaatacgttggcatcaactcgataaattggatacaaccaaataccccgatatcatcttaggtgctaacgtagccaatgacatggatggttgtgaagccaataaagttggtaaatatattgacggaagtaaagatggtagtcgtatatacgataaaaaacattatttatatccgattccaaccggacaaatagctttaaatccacaattagcccccaataatccgggttggtaa

SEQ ID NO: 3651 - DNA, 1026 bp, B.fragilis
atatctatgcttaatttaattaactctatcgttgcgcgtgcgcaagcaaatcgtcagcgcattgtccttcccgaaggtacggaagaacgtactttaaaagctgctaaccagattttgacagatgaagttgcagatttgattcttttgggtaacccggaagaaattaatgcagctgctgtcaaatggggactcggaaatattaatagggctactattatagatcctgagaaccatccgaagaaagaagaatatgcgcagttattgtgcgagcttcgtaagaaaaaaggtatgactatcgaagaagcccgtaagttggtgctcgatccgttgtacttgggttgtctgatcattaaaagtggcgatgctgacggtcagttggcaggtgcccgcaacactacgggtgatgtacttcgtccggcacttcagattattaagacttctccgggaattacatgcgtttcgggtgctatgttgttgttgacacatgctccggaatgtggtcagaatggtttgctggtgatgggtgacgtagccgtaactccggttccggatgcttcgcagttggcacagatcgctgtttgtactgcacgtacggcacaggctgtagcaggaattgctgaaccgaaagtggcaatgcttagtttctctactaaaggttcggcaaaacatgagaacgtggataaggtggtagaggcattgaaattagctaaagaaatggcaccggatttgaatatcgacggtgaaatgcaggcagacgctgcattagtgccttcggtaggtgcaagcaaagctccggggtctccggttgccggcgaggctaatgtactgattgttcctagtttggaagttggtaacatttcttataaactggttcagcgcttggggcatgccgacgcggtaggaccgattcttcaaggtattgcacgtccggtgaacgacctttcacgcggatgctctattgaagacgtatacagaatgattgcaatcacagctaatcaggcgattgctgcaaagaatggtaaataa

SEQ ID NO: 3652 - DNA, 714 bp, B.fragilis
gctatatgccggcggtgtttggttgttatttggcagagtacgttatcaaaagattgtaagattatgattcatctagaaggtataaccaagagtttcggctctttacaagtattgaaagggatagatttggagataacccaaggagaagtggtaagcatcgtgggacccagtggagcggggaagactactttgcttcagataatgggtactttggacagtcccgatgcggggatgataaacattgacggtaccaatgtaagccggatgaaggagaaagagctttccgctttccgtaacaaacacattggatttgtctttcagttccatcagttgttaccggagttcacggcacttgaaaatgtaatgattcctgcatttatagccggagtgccgactaaggaagcttcgatgcgtgctatggagattcttgattttatgggattgaaggaacgggcatctcataaaccgaatgaactctccggcggagagaaacagcgggtagctgtagcccgtgcattgatcaaccaaccggcagttatcttggccgatgaaccttccggaagcttggattcccataataaggaagaattgcatcaactcttttttgacttgagaaatcgtttcggacagacttttgtgatcgtgacccatgatgaagcattagcaaaaatcaccgaccgtacgatccatatggtagatggaaatatcatttga

SEQ ID NO: 3653 - DNA, 987 bp, B.fragilis
cagagatttagaatgaaacgcaacattgccattgtggcaggaggcgatacctccgaaatcgtagtttccctgcgtagtgcacagggcatttactcctttatcgacaaggagaagtataatttgtacatcgtagaaatggaaggtcggcgttgggaagtgcaattgccggacggaagtaaaacacctgtggacagaaacgactttagttttatgaatggggcggagaaggtcgtgttcgactttgcttatatcaccattcacggaacaccgggagaggatggacgtttgcagggctatttcgacatgatgcgtattccgtattcatgttgtggcgtactggccgctgccatcacttacgataaatttgtctgcaaccagtatctcaaagcatttggtgtgcgtatctccgaatcgttgttgctacgtcagggacaggctgtctccgatgaagatgtggtggaaaaaattggcctgccttgctttatcaaacccaatctgggaggatccagctttggtgtgactaaggtgaagacgcgcgaacagattcaacctgccattgccaaggctttcagtgaagctgaggaagtgatgatagaagcctttatggacggaacagaattgacttgcggttgttataagacgaaagaaaaatcggtagtttttccgttaactgaggtcgtgacacataatgaattcttcgattacgatgcaaagtacaacggacaggtggacgagatcactccggcacgtatatcggaagaactgacccggcgtgtccagactttaacctcggctatttacgatatattgggatgttccggcattattcgagtggactatatcattacggaaggtgagaagatcaatcttctggaggtgaataccacaccgggtatgaccgctaccagttttattccccagcaggtgcgtgccgccggactggatataaaagacgtgatgactgatattatagaaaataaattttag

SEQ ID NO: 3654 - DNA, 516 bp, B.fragilis
aattttgatagaatggaatatatcaacgatttaatccgacggaaagaccgccttttatcggaagacgaagcaatgagtttacttgaaaatggagaatacggagtgttatctatttcttcaactgaagaaggtgtttatggcattcccattaattatgtatgggataaacaacagtctatctattttcattgtgctcccgaagggcataagctttgtatacttcaaaactgtaatcaggcatcgttttgtgtggtaggacgcacgcgcgttgtttccaatcaatttagtaccgagtatgaaagtattgtgattaacgggactatgatttgtcagttagaagaaactgagaagcgaaaggcattggaacttctgcttgataaatattctccagaagataaaaaggtggggttgaagtatatagaaaagtcttttcatcgtacccacgtcttgaaacttgttattaaagtaatatccggtaagtgtaagaaaataaatcagccctgtcaggattattaa

SEQ ID NO: 3655 - DNA, 1353 bp, B.fragilis
gttatctccagccctaataggaagatatcccaacacactttctgctgcttgtgtgccgaacattctaacggatcgtttgttcttcacacacctaaactttataatacctatataactatgcgtattcaaactggccatgggactattccccttattaccctcatcggcatctggtctatctcggccctgaatgccctaccggggctggcggtttctcctattctggggaagctctccgccatctttccacactccaccgaactggacatacagatgctttcgtctctgccttcactattgattatcccatttatccttttggcaggtaaactgacggaacgggtcaatttcatccgtctgctccaagccggacttgccatctttgctctaagcggagtgctctacctactgtcgggacagatgtggcaactgattgccgtgagtgccttactgggagtaggctccggactgatcgtcccgctatccaccggattaatctccaaatacttcgtaggttcataccgtgtgaaacagttcggattaagttcggccatcaccaacataacactggtagtagctacggcagtaaccggataccttgctgaagtcaactggcatctcccattcgtcgtctatctgcttccaatcatttcactcgtactctcggtatatctgcaacgcagcatggcaagcgaaggcagtacctcgcttaccaacgacaaagccccggcagacaaagaagaagatgtagataccggtaacagcaaatacggcattcacgttcgccatcttgccggcattatgggtgtttacggactggctacctttctggtactggtagtcagtttcaacctgccattcctgatggaagaatatcatttcaccagtggtaactccggtattatgatttctctcttctttctggctatcatgactcccggcttttttctgaaccggatcgtaggcactctgaaagagaaaacaaagttttacagttttttgagtatcggcatcggactggcactgatctggatctcacccaaagaatgggtgatagctccgggatgtatcctggtcgggctggggtacggagttatccaacctgttgtctacaaccagacaacccatacggctatttcacgcaaagtgacactggcactggcattcgtaatggcgatgaactatcttgccatcctgctatgtcccttcattatcgacttcttccagtcgactgtattccacatcaaatctcagcagtttgcttttgtattcaatctatgcatcagcatcgtaatgcttgtcatttcctataccaaacgaaattctttcttgtttaatgataatctgaaatag

SEQ ID NO: 3656 - DNA, 1461 bp, B.fragilis
ttaaaaataagagtaattatggaagatttaaatttcagaaaaggtgatgctaaaacagaagcatttggttcaaacagaatgttacaaccctctccggtagagaaaatacctgatggtcctactactccggaaatcgcctatcagatggtgaaggacgaaacttttgctcaaactcagccccgtctgaatcttgctacattcgtgactacttatatggatgattatgcaacgaagctgatgaacgaagctatcaatatcaactacattgatgagacagaatatcctcgcattgctgtgatgaacggtaaatgtatcaatatcgttgctaatttgtggaactctccggaaaaagatacctggaaaaccggtgcattggctatcggttcttcagaagcttgtatgttgggtggtgtagctgcctggttgcgttggcgcaaaaaacgtcaggcccagggtaaaccatttgataaacctaactttgtcatttcaaccggtttccaggttgtttgggaaaaatttgctcagttgtggcagattgagatgcgtcaggtgcctttgacgctggacaagaccacacttgacccggaagaagccctgaagatgtgtgatgaaaatacaatctgtgtagttccaatccaaggggttacatggaccggtctgaacgatgatgttgaagcccttgacaaagccctcgatgcgtataacgctaaaaccggttatgatattcctattcacgtagacgctgccagcggtggtttcatcctgccgttcctgtatcctgataccaaatgggacttccgtctgaaatgggttctttccatcagtgtatccggccataagttcggtctcgtatatccgggtttgggttgggttgtctggaaaggcaaagaatatctgcccgaagaaatggctttcagcgtaaactacttaggagctaacattactcaggtaggtttgaacttctctcgtcctgcagctcagattttgggacaatattatcaatttattcgtttaggattccagggatacaaggaagtacaatacaactctttgcagattgccaaatacatccacagccagattgctaagatgactccgttcgtcaactactcggaagatgtagtaaacccgttgttcatttggtacatgaagccggaatatgcaaagaacgccaaatggactctttacgatttgcaggataagctggctcagcatggctggatggttccggcatatacattgcctgccaagctgcaagattatgtggttatgcgtgtcgttgtccgtcagggattcagtcgtgatatggccgacatgttgctgggcgacattaagaatgctattgccgaactggaaaaactggaatacccgacatccactcgtattgcccaggagaagaatctgccggtagaagccaaagtatttaaccataccggtaaaccacaagctgccaagaaataa

SEQ ID NO: 3657 - DNA, 579 bp, B.fragilis
agaatatcaagtatgattaatgctcaagacatcaagaacggaacttgtatccgcatggatggcaaactgtatttctgtatcgaattggtccacgttaaaccgggtaaaggtaacaccttcatgcgtacaaaactgaaagatgtagtaagcggctacgttctcgaacgtcgcttcaatatcggtgagaagctggaagacgtacgcgttgaacgtcgtccctatcagtacctgtacaaagaaggtgaagattatatcttcatgaatcaggaaacattcgatcaacacccgatcgctcacgacctgatcaacggtgtagatttcttgctggaaggtgcagtagtagaagttgtatcggatgcatctaccgaaaccgtgctttatgctgatatgcctatcaaagttcagatgaaagttacttatacagaaccgggcttgaaaggcgacactgctaccaacaccttgaaaccggctactgtagaatcaggtgcaaccgttcgtgtcccgctgtttatcagtgaaggcgaaacaatcgagatcgatactcgtgacggttcttacgtaggtcgtgtgaaagcataa

SEQ ID NO: 3658 - DNA, 1413 bp, B.fragilis
aatagtacaagaatgaaacgacttttttatttctttctttttgtctgtgtggcagttatagccaatgctcaggcaaaatatgttttctatttcattggtgatggaatgggtgtcaatcaagtgaatggtacggaaatgtatcgtgccgaaatccagaagggccgcattggtgtagagcctttgctttttacacagttcccggtggggacaatggctactactttctctgccactaattccgtgactgattcttcggctgcgggaactgctctttccaccggcgaaaagacttataatggttccattgggatggatgatcagaagaatcctttgcagacagttgctgagaaagcaaagaaagccggtaaaagggtgggagttactaccagtgtcagtgtcgatcatgctactcctgctgctttctacgcacatcagccggatcggaatatgtattatgaaatagctaccgatcttcctaaagcaggttttgatttttatgccggtgccggtttcctgaaaccaaccactacttatgataagaaagaagctccgagcattttcccgatgtttgaagaagccggttacaccattgctcgtgggtataacgattataaagccaaagctgctgcggcaggtaagatgatattgattcaagaagaaggtgccgatacgggctctttgccttatgctatcgatagtaaagaaggagacctgactctggcacagattacagaaagcgctattgactttttgactaaaggcaaaaacaaaggtttctttctgatggtagaagggggtaagatagactgggcttgtcacgggaatgatgccgctacggtgttccacgaagtggcggatatggataatgccatcaaagttgcttatgagttttacaagaaacacccgaaagaaactttgattgtggtaactgccgaccatgaaacaggaggtatcgcattgggaactggaaagtatgccttgaatctcaaagcacttgagaaccagaaagcatctgccgaagtactctctaaaaagatcagtgatttgcgcaaagctaagaacaatcatgtagcttgggaagacattaagaatctgctgtccgaagagatgggcttctggtctgtacttcctatcacctgggagcaagagaagaaactgcgtgacgaatatgaaaagtcatttgtaagaaataaagtggaatttgccgaaagtatgtatgccaagactgagccgatggctgctaaagccaaagaagtgatggatcaaatcgctatggtaggctggacaagcggcggacattctgcaggatatgtgccggtatttgctatcggtgccggttccgatctgttcatcggtaaaatggataatacggagataccgaaacgcatcgcaaaagccggtgggtataaataa

SEQ ID NO: 3659 - DNA, 1131 bp, B.fragilis
caaaaacggaggcaattatgcaaattattagtaatacgagaacaaaacgccttgctattccttataaaaaacattatatttgtaaatgaactccaaacctatcccattatgaagcaaacagcctatatatacctgctcaccctttcttgccttctctgcgcatgcaatagagaaaacagaacaaatttgccacagccccaagtcaccggtgtagcagattcactggaaacggtgcctccggaagagaagcccaaagccatctccgcagaacagatagagatcaaaaaagatttgctctatgataaatatactcttgaagatacgtatccgtacaaagatacgacccgcagttttcaatgggataagatcaaagaacgcctggcactgctcgaaaacattcagcagacaccctcgcaatggggcatcttgcagaactataagaaccggaacggcgaggctccattggtacgccattacaaacggaatgcctataaacgcattgccgacacgctgggcatagagcgctaccagtccgtcccgctctatttgctcaccgatacgcttgtgcccgaacgttatggagaagacggttcgctggtccgcttcctggccgacggagagaatttcgtcaaggtatcccctatctatattggcgaagagtggtatgtacccaagaggtacgtcaaagtgctcccggatacgacacacttcatcaaaacaatcatgatagaccgaagagaccagaacataatgactttggaacaaaccggtgaagcccaatggaccgtacggagtatgaaccccgccactaccggaaggcatcgcccttcgtatgcacaagagacaccattaggaatattcgtcctacaggaaaaaaagacacgcatgatattcctcaaagacggttccaccgccaccgggaggtttgcgccttatgccaaccgattctcagacggaggatacattcacggagtcccggtaaacgagccccgtaaagcacttatagagtacagcccgtctctgggcaccacgccccgctcgcacatgtgtgtacggaatgcaacatcacattccaagtttattttcgactgggctcctgtaaatgagacaattatttttgttttggaatag

SEQ ID NO: 3660 - DNA, 1242 bp, B.fragilis
aaatgcaatggaaatagtgagaaaccgcgaaaaggcaaacgaataaattctccccgatctcctctctgccatacagacattctctttcaagatatccgtatgggagaggtaacatatcgacaaaaatccatatatttgtgctttcaaatcgtcagcataatgaaaaaggagtttacacgaatagccataaaagtgggaagtaacgtactgacccgacaggacggaacactggatgtcacccggatgtctgcgctaaccgatcagatagccgccttgcataaagccggagtagaggtgattcttatctcttcgggagctgttgcctcgggacgaagcgaaatacgtaccctcaggaaactcgacagcgtagatcagcgccaattgttctcggcagtgggtcaagccaaactcattaaccgatattacgagctgttccgcgatcatggcattgctgtaggacaggtactcaccaccaaagagaattttggtacacgccgtcattacctcaaccagaaaaactgcatgacggtgatgcttgagaacggcgtcattcctatcgtcaacgagaacgacaccatctccgtcaccgaactgatgttcacagacaatgacgaactgtcgggcctcatcgcctcaatgatgaatgcacaggcccttatcatcctgagtaacatcgacggcatttataacggttccccttccgatccggactcattagtgatccgggagattggacagggaaaagacctgagtaactacattcagaccagcaaatcgagtttcgggagaggaggcatgctgaccaaaaccaacattgcccgcaaagtggcagatgaaggtattacagtaattattgccaatggcaaacgcgacaacatccttatcaacctcatagagcatcccgaagagacagtttgcactcgttttatccccgcatcccaacccgtatcgagtatcaagaaatggatagctcacagcgaaggtttcgctaagggagagatacatatcaacgaacaggctaccgaagtgttgaactccgacaaggcagtcagcattcttcccgtcggaatcacccgcattgaaggagaatttgagaaagacgacatcgtgcgcatcattgattaccggggtactccggtaggtgtaggcaaagtcaactgtgactccatgcaggcacgggactccatcggaaaacatggaaaaaaagcagtagtccattatgactacctttacattgaataa

SEQ ID NO: 3661 - DNA, 528 bp, B.fragilis
accaatctgggcgtccaattctttaataaaactactaaacgcagataccgcgcactggtatggggcattgtcgatcaggatgaacgtaccatcgtaggcagtatcgcccgcaatccgaaagaccggatgcaaatggctgttatggccgatcctacccaagggaaacatgccgtcacccactaccgggtgcttgaacgtgtgggatatgtcactttggtggaatgtattcttgaaaccgggcgtacgcatcagatacgtgtgcacatgaagcatatcggtcatgtactcttcaatgacgagcggtatggcggtcacgaaatcctgaaagggactcactttagtaaatacaaacaatttgtaaacaattgcttcgacacttgtccgcggcaggctttgcacgccatgacgctggggtttgtgcatcccgtcactggcgaagagatgcattttacttcggagttgccggacgacatgacccggttgatagagaagtggagaggttatattagtaacagagatttagaatga

SEQ ID NO: 3662 - DNA, 894 bp, B.fragilis
agaataatgggccgtcccattaaaattatcggctatttatgctttctgatggcactttgctcatgtaaagagaccaaagagcagcaaatatcccgtttgattcacaaatgggagggtagaacgattgtctatcccgctgatatgacattcagtgttttgggaaaggacagtgccggttattcgtttccccaaaatgaatataccataatgacttacgtggattcggtgggctgcaccagttgcaaattgcaacttcctacatggaaatatttcatttctatggtcgacacaatggccaatggaaaggtatcttttctctttgctttccatccgaaaaacaaaaaagaaatctcttttctattgaagagagatcgattcctttatccggtttttatcgatgaaaagggaggttttgatgctttgaatcatttcccttcggatgtgaactttcaaactttccttttggacagtcagaacaaggtgattgcgattggtaatcctgtccataataaaaaggtgcgtgacctttatttgcaaattattaccggacggcaaaccggagtcgctacctcttcccaaacaaaagtggttttggataaaaaactcgatgaaatgggcgattttgattggaaaattccccagaccgctacttttagtttgcggaatcttggcgatcatcttctgattatcgaggacataaatgcttcgtgtggctgtacatccgtcacttacagtaaggagcctgtaccttcagggaagtctgccgatattcaggtaacttaccgtgcagaacatcccgaacattttgagaagaccattactgtatattgtaatactcccacctctccaatacgtttgaagattcggggtaatgcgattgatgaagaatactaa

SEQ ID NO: 3663 - DNA, 345 bp, B.fragilis
ctttgtcttatgaattttcaaagaaatacagatatgactaagtttgaaatagaagaaaagatagtagatatgctcaaaaccgtattcgatcccgaaattccggtaaacgtatacgatctgggactgatttacaaaatagatgtttccgaggatggagaagtatctattgatatgaccttgactgctcctaactgtcctgcggcagatttcattatggaagatgtacgtcagaaagtagagtcgattgacggggtaaactctgccacaatcaatctggtttttgagccggagtgggataaagatatgatgagcgaagaggctaagttggaattgggctttttgtaa

SEQ ID NO: 3664 - DNA, 1566 bp, B.fragilis
tcacttattatgatgaaaacgaaacattacttttctttcgtttttgcttcactttttctgataccgtccgttatcacagcacaggacgtgaactatcagaaggagtttgatacttttcaagagaaacagcaaaaagaatataaagaatttaagaataaagcagacgaagagtttgccactttcctgaaagaagcgtggcaaaagtataatgcctctatgggggattcgatgcccactcggccggaaccggtgaaaccgacactttttgataaaaaaaagccggttcctgctccggtagagattaagccggcggtgcctaagatacccatagccgataaaccgggtgtaggaggcaaagtgaatgtggaagtcaagaagccggagctgccggcagtggctgataaaccggctccgggtgtttatgttccgggcaaaccttatacccctgtaaaggtagatatcccagctccgttgcccggaagttcagcgcatcgcaatgcgattgagttttatggaacacggtttgaagtggctacagacgtgattgacggttttgaattgggcggaacaagcgaaagtaaagtggcaggtgcctggagtcgtttgtgtaaagccgatcatgaacagttgattaacgattgtattcgtttaaagaaggagcatcagatgaacgactgggcatttttaatgttcatcaagcagttgggagtgcagatgtgtggtgttgccaaaaaagacgatgtagcttttctgcagatgttcatcctcaataaatgtggatataaggtgcgtttgtccaagataaacgataaattaaaattgttggtggctccggcaggaactattttcggcataccttatattaccttcaaaggtgtgaagtactatgtctttgaggcggataaaggtgggtcaatggctgtttatacatatagtcaggattttgccaatgcgaagaatctggtatgtatggatctgagcgccgtgcctcaattcggcatgcaggagtttagcaagacagtgtctccatccgaaaaatctctccttaaagtcaatacggcagtcaataagaacctgatggatttctataaggactatccgcaatgtgaagttgctgtttactacaaaacccctatgagcaaggagttgaagagtgctctttacccgcctttgcaggcggcaataaaggggaaatcggagaaagatgctgcgaatatcctgattgattttgtgcagaattcattccaatatcagacggatggtgaacaatttgggtatgaaaagcctttcttcatggacgaaaatttttattatccggcttgtgattgtgaggatcgagccattctgttttctaacttggtgaaagatttgttgggactggatgctgtgttgctcgactatccgaatcatatcgcttcggctgtacggttcaacgaagatatttcgggtgattacattctgttggatggtaaaaaatatcttatttgtgatccgacttatatcggtgctccgataggaatgtgtatggatcgtttcaagagtgtacccccggaaataatccgctag

SEQ ID NO: 3665 - DNA, 312 bp, B.fragilis
aagtgtattatgaaagtaaagttattgtttgtgatatgtttaagcgttttttcgctgtgtggtatttatcatgttcaagcgaacaaagaggataaaaacgtatcaactttagtattacaaaatattgagtcattggctcagaatgaaggaaatagtgatcatggaaatattgatacgactctggaaccttattattatcaaagttctagagattattggttaccggggatgaatggtacaactgaaattccctgttgtgaaaaatgtgagagtaaatacagtggatgtgctaaaggattagctcgttgttaa

SEQ ID NO: 3666 - DNA, 1275 bp, B.fragilis
aaccgagttatgagaatcacaaatctattttggacagttgtgcttttagccccactgtctgtctttgcacagcaacagaaagagaatctgtttacaattgatgcacagatacgtacccgtggtgaataccgcaatggagtattgaatcctcgtccggaaggagaagaacccactttctttgttaacgagcgtgcccggctttctttggggtatcagcgtgacaggttacagatgagactttctgcacagcacgtaggagtgtgggggcaggatcctcagattgataagaatggaaggtttattttgcatgaagcgtgggctcgccttgacttctcaaaaggattatttgcgcagttgggaaggcaaccgttgtcgtatgatgatgagcgtctgcttggcggactggactggaatgtggccgggcgatttcacgatgcattaaaattgggatatgaaagtaaactgcataagttgcatttgatattggctttcaatcagaatgatgaaaaccgttcatacggaggcacttattatgctcccggagcgcaaccttataaaacgatgcaaacggtttggtataacggtcattgggctaaagatttcactgtttcgctgctttttatgaataccggatttgaaacgggtacggagggaaatggtaaaacagccaatatgcagacaatgggcacttatttggtatacacgcccggagcgtggctgttcaatggcagcgcttattatcagtttggaaagaataaggctgacaagaaagtatctgcttatatgtttagcctgaaagccggttataaaattgatccgaagtggagcgtaagcctaggtacggactatcttagcggcgatcccgatagtaaaaaagtgagtacttttgacccgttatatggaacgcatcataaattttacggaggtatggactatttctatgcatcggcttacaataaggggttgtgggataagattttgagcgtagactttaaaccgactaagaaattgagtttctcgttgaattatcatcacttctctactacatatgacgttatggccacagatggtaaggaaggacgctgcctggggtcggaattggatatgcaggtagattatattttgatgaaagacgtaaaactgactgccggttattctactatgcttggaactaagtatatggatatagtaaagggaggcaaccataaaagttggcaagactggggctggttgacactgaatatcaatccacgcattttatttactaagtggtaa

SEQ ID NO: 3667 - DNA, 258 bp, B.fragilis
acacattatatccctaccattatgaaagaagataaagacacccgcgtagtagaagtcttcaccggttcgccttgggaagcagagttcatcaaaggattgctcgaaagcaatggaatagaatctatcctgaaagacggaggtgggctcgcagctttggcaccttactacatcggacaggaaatagctgtcctcgtcaatgaagacgattatgaaaatgcaatggaaatagtgagaaaccgcgaaaaggcaaacgaataa

SEQ ID NO: 3668 - DNA, 1131 bp, B.fragilis
attaaaaatatgcatatcattaaagtgatatttagtcttgcactaatattgaatatttgcgttagttgtcatgaaaatgatgacaccgcatacttcaatggtaaaattcaaacgattgaagatagtatcaaagacacgaagaaagctacattgaaaatacttccattggatggagcgaattttggatggttatccacatacgactcactgatgttttttatgaatcctaaattaccggatcgcttttataatatatttaatatagacaccggaaaagaaataggcactttttgttatagaggaagtggtcctggggaagttgccgctttgggtccgatttttcatttctttaaagaaaaaggggatctgaaaactctactgttcgctcctaatgaagagaagctatttatctggaatataactcagtcgatcaagcgggacaccactgttatggataagcaaatctcctatccctggagagaggagaatggaggtgctccatactatttgatgtttctgaaggatgaaaatacattaattacagagttacagtcgttcccgcttaatgataaagaagctactttgcccgcttatcaaaaacggacacttgacacgaataagttgctgaagagcttttcaagctataagaagtcgataaggaatgatgaagcttccattctgccggagtcttttttctactcgaatgatgccattaaaccggatggaactaaagtggtgcaagctatggttcatcttgcgcaattgaatattctggatcttgaaacaggtcatgtgagcggctatcgtttggaaggtgaaccggacttttctgtttttaaaagtgatgaaaaaataaagtcgtattttacaagggttcaggcagatgacaattacatatatgcagtatattggggaaaagagcgttgggaacgttttgagactccacacatgaatatcattcatgtatatgattgggatgggaatctggtacaaaaaatagagacggattatagcattgggcagatgtggatagatcctatccgaaatagattatatgtgacaaatccccaaatagatgacgtgctttatttagacctggatgatttcttggttcctaacacaggcttatga

SEQ ID NO: 3669 - DNA, 858 bp, B.fragilis
gaaaaaaatatatataaaaatatgatattaatagcagacagtggttctaccaagaccgattggtgtgtggtagaacatggacagttgatccaacagatttttacgaaaggtaccaatcctttctttcagtctgaagaagaaatcagtaatgaaatagcaactgcactgattcctcagttaaagacaaacaagttcgaggctgttcatttttacggagccggttgtgctttccccgacaaaatagagacaatgcgcaaagccatagcctcgcatctgcaagtcagtggagaaatcgaggttagtacggatatgctcgctgctgccagaagtttgtgcggtcatcaaccgggtattgcctgtatcatgggtacaggatcgaattcatgttattacgatggtaaaaacattgtcaccaatgtatctcctctaggatttatactgggcgatgaaggcagtggtgcggtattgggcaaactgctggtaggcgacatccttaaaaaccagatgactccgggacttaaagaaaaatttctggaacagttcaatctgacccccgccgaaatcatcgaccgggtgtatcggaaaccattccctaaccgtttccttgcaagtttctccccatttttggttcaacaccttgacgaaccggtcatacgtgaattggtccttaacagcttcaagaaattcctgaagcgcaacgtgatgcagtacgattaccagcacgccccggttcatttcatcggttctgtagcattctattacagagagttactttccgaagcatgtaaaataatgggagtacacttaggaaccattatccaaagtccgatggaaggattgattaagtttcacgagtaa

SEQ ID NO: 3670 - DNA, 1800 bp, B.fragilis
atcgttgatatattccattctatcaaaattttaaaagtaatatcaattattatttttacaaaatttgttacctttaccttccgaataagcaaaaatataaagatgagacaatatttactaaatataatactgttatttttaggattcactatcatttattcttgttcacggcatcagcaaataaacagaaccatctttctagcagattccattatggaatatcaacccgatagtgcgtttaaattattaaaaacaataaatcaaacagatttatctgtttcagaaaacgcaaaatacgcattattattagcacaagcacaggataaagccggccatcaattaatcaacgattcattaattttgattgctataaatcattatgatcacttatcaaaagataacaataaagcaaaagcatacttttatttaggacgattttatcaaaacaataatgattatgcaaaagccattaactcttatctcattgcagaaaaagcaacatcagatcatgacacattattaactttgatatacgataatttgggtacatgctataaaaaccaagatttttatgacaaagccttagaagtatataaagacgcatactacatttataaacaatacaatagcaagaatatcctatacccacttcgaggaatggcaagcatatatgctattcaagaacagtttgagaaagctcttaaatattaccaaacagctctcaccattgcatcaagtaccaatgactctacatggcagtctatcttattttgtgatatttcccggatttatgacaataaaaacctctatgaagcggcatatagttatatagtacgctctattcaatatgctccacgcagtagcgatctatctgctatgtatttttggaaaggagaaatattacacaatctgaatcaattggattctgctttttattatatcaatttagctaaaaaaagttcagacttaaatacacaggcatcggcataccaagctctatatgaaataaaaaaagaacaaggagaattaaatgatgcaattctatacaatgacacgtctctcattctatatgattctatacaagatttaaaccatagtgcggaaatcagtcacatactaaagcaacatgcgacagagacattacaacaggccgaagttataaaacggcaaaagcatacagcttttcttattgtaactacattattactcattgcgtgtatcacatttatctttctttataaagataataaaagaaaaaaagtatacattaaaatacaatgtgaattaagaaataaccaaatagaaaaagatgaattaaaagagaaaatcaaaacgctaattgatagtaatacatatattgcggaaaggaataaagaattaaaaaaagaagaactaaagcagcaacaaattgaattatggaaaagaacacttcaaatatgtacacgactatttcatacttccacatcatataaaaaattacatgcaatagaaacagccaaatttaaaaaagaaagagaagaaaaacagaaagaaattaattccatacagaaagagataaacgaagttttcatcgaagcaattcaggagttacgagaacaatatccaaaactaacacaagaagacctcttctattgcattctacaatatttgcgtctatctacctctacaatcaaattttgtatgagagttgaaagtaaccaagcactcacccaaagaaagtatcgcataaaaaaacaaatcagtccccaaaccttttctataatctttaatgaaagctctccttcagaaggagttttatga

SEQ ID NO: 3671 - DNA, 1314 bp, B.fragilis
acacacaccattatcatgaaaaacaaaaatatatcaccgtgggcatggattccgactctttactttgcacaaggattaccttatgtagccgtaatgactatctcggtaattatgtacaaaaatctgggtatctccaacacagatatcgctctttatacctcttggctctatttaccatgggttatcaaacctttctggagtccatttgtcgacttattaaaaaccaaacgttggtggatagtcagcatgcagctattagtaggtgccggactggcaggaatcgctttcaccatacctatgtcaaacttcttccaaacgacccttgccattttttggctagtggcattcagctcggctacacatgatattgctgcagacggattctacatgttggcactcaacgtacaggaccaggcactttatgtaggtatccgcagcactttctaccgcattgccacaattgccggccaaggcttgctggtgatgctcgcaggtggacttgaaatatggacaggcagcattaaatatggatggagtatcacgttctttattctggcaggactcttcctcgccttctgtctctatcataaatgtatattgccaaagcccaacagcgataaagcagtagtaggtgaaaatagtgccagtgctattttcagtggattcatagaaaccttcgcttccttcttccgcaaaaaacaagcaggagttgctatccttttcatgctattctaccgttttccggaagcacaattagtgaaacttatcaacccattcctacttgatcccattgacaaaggcggactggggttgacaacagctgaagtcggattggtttacggtactatcggtatcatcgggctgaccttgggaggcattatcggaggtatctgtgcagcaaaaggaggacttcaaaagtggctttggccaatggcatggagcctttcattgacttgtctcacctttgtatatctaggctacttccaaccacaaaattttgtgataatcaacctatgtgtatttatcgagcagttcggttatggcttcgggttcacagcctacatgctttacctcatttactactccgatggtgaacataagacagcacactacgcgatctgcaccgcttttatggcattgggtatgatgctgccgggtatggctgccggttggttgcaggaactgatcggatacgaaaacttctttatctgggtaatggtttgttgtaccgcgacaatagccgtatgcgcctttattaagatagatcccaactatggcaagaaagcagagggtattccccaaaaaacaaaataa

SEQ ID NO: 3672 - DNA, 1260 bp, B.fragilis
acgaactgcattatgaatctgaatgatacttttgctgccgtacaggcagccggccgccatctggcactattacccgacgatcggatcaaccaaatactgaatgccgtggcagaagctgctttggaacagacttcctacatcctctctgagaaccggaaagatctggaacggatgtcacccgacaatccgaaatacgaccgactgaggttgaccgaagaacgacttcggggaatcgcttccgatatacgcaacgtggccactctcccctctcctctgggcaggatattgaaagagagcattcgtcccaatggcatgagactcactaagataagtgttcctttcggggtcatcggcatcatttacgaagctcgtcccaatgtcagcttcgacgttttttcgctttgcctgaaaagcggtaacgcctgtatcctgaaagggggaagcgatgctgactattcgaatcgtgccatcgtagaagtgatacaccaagtactccgacagtttaacatagacactcacatggtcgagttgctaccggccgaccgtgaagcaacccgggaactgctgcacgctgccggatacgtagatctgatcattcctcgcggcagtagcgccctgattaactttgtacggcaaaatgctactataccggtaatagaaaccggtgcaggcatctgccatacctactttgacgaatacggagatacggccaagggagctgccatcatccataatgccaagacacgccgcgtgagtgtttgcaatgcactcgattgcgtgattgttcacgaaagcagattgtccgatctgcctctcctttgtgaaaagctcaaagccgacaaggtgattatctatgcagatccgtcagcctatcaggcactcgagggacactatcctgccgggttgctgaaacctgccacccccgagagcttcggaactgaatttctggactacaaaatggcaatcaaaactgtgaatagttttgagaacgcactcggacatatccaggaatacagctcacgacatagcgaaagtatcgtcaccgaaaacccgaaacgcgccgcgcttttcacccgcatggtagatgcagcctgtgtatataccaatgtatctaccgctttcaccgacggagcacaattcgggctgggagcagaaatcggcatcagcacacaaaagttgcatgcccgcggaccgatgggattggaagagatcacttcctacaaatggatcatagagggtgacggacagacacgtcagtga

SEQ ID NO: 3673 - DNA, 555 bp, B.fragilis
aaaaaacgcatgatagaagaattgcctgacgatattgaacaggacgaattggatgatatagaacccgtaggtgacgaaaaccagctctatgaacatttccgcgtggtagtggataaagggcaggcaatggtcagggtcgataaatatttgtttgaacgcatcgtcaatgcttcgcgcaatcgcatacagaaagcggctgaagacggttttgtcatggccaatggcaaaccggtgaagagcagctataaagtgaaacctctggatgtgattacggtgatgatggatcgtccccgttatgacaatgagattattccggaggatattccacttcatattgtctatgaagataaatacctgatggtggtgaataagccggccggactggtggtgcatacgggacacggaaactatcatggtacgttggtcaatgccatcgcttggcatctcaaggataaccccgattacgatgccaacgacccacatgtggggttggtgcaccgcatcgataaagatacttccggattactggttatcgctaagacaccggatgcctaa

SEQ ID NO: 3674 - DNA, 609 bp, B.fragilis
atacatagcataatacatactatgaaggtaaaagaatatatccaatggttactcccttcgcgtaagtggagagtacttgcgatcattataacaggtgtgattgtaggtggaggagctctttttctttatatgctccgggcacatacttatctggctgatgatccttcggcctgtgtcaactgtcacatcatgggaccttattatgcaacctggttccatagttcgcatagcaggaatgctacgtgcaatgactgtcatgttccccacgaaaatcctgtgaagaaatgggtgttcaagggaatggatggcatgcgtcacgttgctgtatttctgacacggggcgagaaggatgtgcttcgggccaataaagagagtgcggaggtgattatgaacaattgcattcgttgccatacacaactgaatacggaatttgtaaatacgggacgaattgattatatgatgtctcaggtaggtgaagggaaagcttgttgggactgtcatcgggacgtaccgcatggcggaagcaacagtgctgcctccactcctgacgcattagtaccttatccggattctcccacaccggagtggttgagaaagatgatagaataa

SEQ ID NO: 3675 - DNA, 1929 bp, B.fragilis
gcatttgttttaactatgaaatatgtattgtttatcctgttagttttaactttggcagcttgtcaatcggagaaagataggcggttggaatatgctttggaatttgccggcgataatcgcgtggagcttgaaaaggtattagaacattatagaactgatccggaaaaattggaggcagctcgttttttaattcgtaatatgccgggatggtattcttatgaaggaaatgaacttgattctattcaccatttattagttggggtttgtgaagggcgttctatatctaaaagggagaagaataaatggaacagaatttcttttaactctctctccaagatatatgacgcccaagtgataactgcggaatatttgatagataatatagacctggcttttgaagtttggaggaaatatccttggaatagaaatttgccgttcgatgatttttgcgaactgatattaccttacagaatagccgatgaacctttatcggattggcgtaaattgtattatgaagattatggaactctactcgattctctttataaggggagtgatgttattgaagcttctaagatcattgacgggaaactgagaaagctgtattacatctacaatactgattttcgggtacctcacttgaatgctgtttttctttatcataaccggattggttattgtcgtgaagcatgcgacctgacaatatatgctatgcgtgcttgtggaattcctgttgcgaccgactattttgtttattcacccgattatcaacattatcattgttggacgatgttgcgtgacacaacgggaacttttcttcaattcggatttaatgagtttgaagcgtcacgtgataccttacggcatgacggaaggaaaaaggggaaggtgtatcgctattgtttcggtatgcaggcggataaaaactccggaacttcgggaaacaggcaattatctcctgtgcttaagaatcgatttgtgaaagatgtgacatctgaatattttggaagtaatgatacgacaataccgatacaaatgtctggagagcaatatatctacttagggatatttagtcccggcggatggattcctatagatatggcacttggtaatgctggtaaggttactttccgggatatagaacccgatgtgatttatcagactctttatcagggagatggaggaaaactgtatccggcaggatatccgtttatatctaaaacggggggtgggtttgttttgttgaaacccaatatcgatttgatggaggaagctatattaaagcggaaaatgcctcagcaaaagacgattgcggaatgggcttatcgagctatcataggggcaaaagttgaagcagctgatgatttgtcatttatgcaggcggatctgttatggcaatttgaggatacgcttaccactaattattgtgtgttgactccgcttctaagaaagaagtatagatatgttcgttatgttgctccgatagggaaaagaatggagttggcggaactggcactgtttaaggattcattatgtaaggagaaggttcggttggggaggataaacagtatagaaccgattgcaaaattagagtatgttacagatggtaatatactgacttattttcaggcacgtgatacatcttgttatctggcctatgatttgggggaaagtacgctgatcgaaagaattgttttttctccgcgtaacgatgataattacatttggcctggggataattatgagttattctatcaggacggaataaatggatggaagtcgttaggcagcaaggtggctacagaaagggaaattgattttctggtgccacaaaatgctctgctatggttgaggaatcgcacaaagggacgcgaagagcaggtctttatttataaaaatggaagacaatattttgcatttgatttataa

SEQ ID NO: 3676 - DNA, 654 bp, B.fragilis
cagcttataattatgacgataaaagaatttttttctttcaaggccaatagattcttctggataaacatcatagccatggttgtagtggctgtgctcatagtggttggcacacttaaaggactggatatatacacacgccatggcgaagctgtaatagtgcccgacgtaaaaggaatgtctgtaagcgaagcggaaaagatgttccggaatcatggactgacttgtgtggtgtccgactccagttacgtaaaaaataaaccttccggcattatcctggatcttaacccgtcggtcgggcagaaagtgaaagaaggacgaacaatctatctgacaataaataccctcagtactcctttgagtgtggtgcctgatgtggccgataacagttccgtgcgtcaggcgcaggcaaagttgatcgccgcaggctttaaacttaccgaaaaccggatggtgagcggagagaaggactgggtatatggcgtgatctatcagggacgccaattgcagattggagataaagctcccatcggcgctacgctgactctgatggtaggtgacggagtgcagtctaccgcaaccgattctgtcgatatggtggaaaatgctgctatgtctgttgaggattccggaacagatgatgattcctggttttaa

SEQ ID NO: 3677 - DNA, 3084 bp, B.fragilis
cttaacataataatgaaaccaatccttacctccctgattctgctgcttacagccggcttattcccacaagccgcagcaacccaagagctatctaaggaacttcgttcgcagataggagactttctgaatggaactgcccggaaagaaatctctgtaggcaaaatccatatcgattctgttaatacagaaggaaatgacttgatacttttcgctaacataaactgttcgtatattcccttccgtacagacaatgttagcaaaatttatcaaggcatcaaagcattactccctccagagctagcaaaacgcaagttacagatccggacagaccaccatgccatcgaagagctaattcctctggcacttcgtaatacaagagggagaaaaattccgacatttagttacaaagcagatacacctctgattacccgattatctgttccttatacccccacaaacggattgcaaaaccgtcacattgctctatggcaaagtcacggcttttattacgaatccaaattggctcgctgggaatggcaacgtgcacgaatctttcagactgtagaggacctttatactcagagttatgtacttccatttcttgttccaatgctcgaaaatgccggtgcaacaatacttcttcctcgagaaagagacccacaaactgttgaaatcattgtcgacaacgatagatgcagagacggacattcggtttattcagaattaaacggaagtaaaatgtggaaaaacggggaagaagcaggattcgcccacttaaagagaacgtataaagacttcgaaaatccttttcgtgaaggtacctaccgtcaagtagaaaccaccaaaaaaggaactgtaagcgttgccgaatggatacctgaaattcctcgggcaggacggtatgccgtatatatttcttataaaacagtaaataacagcacggaagatgccctttatactgtctatcaccaaggcggtaaatcacaattcaaggtaaatcaacagatgggtggagggacttggatttacttgggaacctttagcttcggtatcggtaaaacagattgtaaaatcgtccttagtaaccaatcggccaaagaaggacgcttggtaacagctgatgctgtaaagataggcggcggttacggcaatattgcccgaagtatctccgaagaaggagttacggtaaatacaaaaagttcggacacaatgataaccgatacctatcatccgaaagctcaggtgaactatccatacgagattagtggctatcctcgtttctgtgaagcagcccgatactggatgcaatgggcaggcataccagacagtgtttattcagacagtcacggtaagaacgactatacagacgattacaagtcacgtggaatttgggtgaattacctcgcaggaggttctgctgccaacccaacagaaaaaggactaaacatcccggtggacatggctttcgctttccattcggatgccggtaccacttatggtgacacaattatcggcacactcggtatctttcatacttcggcttataatggtgcatatgcaaacggtgcctcacgatatgcctcacgtgatttatgcgatctggtacaatcaaatatcgtgaaagatgtccgtaccttgtatgaacccgaatggacacgccggggaatgtggaatcaatcttattacgaagcgcgtgtaccgcgagtaccaacgatgttattagaattattgtcacaccaaaactttgccgacatgcgttacggacttgatcctcgtttccgcttcactgtcagtcgtgccatttacaaaggaattctacaattcatctgctcccaatataaaatggagtacgtagtacaacctttacccgtcgatcacatgagtctccgctttgaagaaggcaaccgaatcaaactttcctggcaaccggtagacgatccgctggaaaccaccgcaaaagccgaccagtatattgtgtatacgcgtatcggggacagcgacttcgataatggtgtgattgtaaattctccaacctatcaaacggttatcccttcaggggtggtttgcagtttcaaagtgaccgccttaaacaaaggaggggaaagctttccatcagaaatcctttctatcggaaaaacttttaacgacaaaggaactgtattgatcataaacggatttgaccgggtctgtgctcccgcagattttacggcagacgcagatactttagccggattcttagacgagctagaccacggagtaccctacaaaaccgacataagttacatcggtccgatgaaagagtttcgccgacagataccatggatggatgacgacgcctccggatttggtgatagttacggtacacacgaaacaatggtaattgccggtaatacatttgactaccctgctatacacggagaagcgattttgaaagcaggctactcgtttacatcttgcagtgacgaaagtatcgtccatccagactcttctcctaaagagagagaaacacaaatctgtatgaatgactataaatacgtagatcttatattagggaaacaatgccagacaaaaatgggacgtggtggaatccgcccattggaatttaaaacatttagtaaagagatgcagaatgccatcacaaactactgccaggcaggaggtaatttcttcgtatcaggcgcctatgtggcatcggacttatgggataatcgtctggtgaaagccaatgaagaagacaaaaagtttgctatggaggtattgaaatacaaatggcgtgtaggacaggctgcccgcaacggaaaagtgaaaagtgtagcctctccattcccggaaatcacaggaagctacacttattatcaagatctaaacccggaatcatatgtcgtagagtcgccagatgctcttgaaccggctgcacaaggtgcattcactatactgcgatattcggaaaacaatctgagtgccggcatagcttataaagggaattataaaacctgcgtactgggattcccattcgaagcgatacgtacagtcacagaaagagaactattgatgaaagccatattgactttcttcgaacactaa

SEQ ID NO: 3678 - DNA, 264 bp, B.fragilis
aaaatggtaattatcttgttcataaaggtttatgatatgggggaaatcaagttaatctcttccttatttgtgcaggggaaaaggtctttgggaaattgtgtgaagagtaatgaatcaatagtgtatttgcatgtggctcagttggataatgtcagactgttattgataaaatttatagatgaaactggaggtagaaaaattatattttatttgcaatcaactctttttttgattttctttgcaaaagaaaatgatgaacaatga

SEQ ID NO: 3679 - DNA, 1029 bp, B.fragilis
cataatccaatgataaaggagcaggtaaaatcattatggaaactttgtttcgatgatagcgaggcattcatcgaactttacttccggcttcgttacaataacgaagtcaatttagccattcaaagtggcgaagaagtgattgctgcgctccaaatgctcccttatccaatgacattctgcaataaaatagtacctacttcgtatatctccggtgcgtgtacgcatcccgattaccgtgcgaaaggagtgatgcgggagttattatcacagagttttgcccgcatgctccgtaacggtgttctgtttagtacattgattcctgccgaaccctggctattcggttattacgccaaaacaggctatactcccgctttccgtatctcccacaaagtcttctcactttcagagttgaccattggtccggaaccggataccatgattgaagaaacgacggaatatcaagaagattattatcaatacctgaccggcaagctatccgaacgtgcctgttgtttacaacatacgcctacagattttaaagtagtccttgccgatcttgccttgacacaaaataccgttctcattgcccggaaggataatcgagtaacgggtatagctgttgcctataaacacgatgatagctcgtatatcaacgagttgtttgctgacaatgaggctgtccgggcacaattactctaccgggccggactaagaaacggcactgaacggattattcttcaacttccccctgtagaatccctgccaagtgtcccattaggaatggcacgtatcattgatgcccgggcagttcttcaactctatgcagcaggttgtcccgaagtggaaatgaatatcgaactgactgacgaacagctttcggtcaataacggttattactatctctgcaaaggaaaatgtatgaccagtgaagtccgcttgcccggagtacatacccgaatgaccattgccgaattatcggaaaagatactggatgaaatgcagccgtatatgagcttgatgatgaattag

SEQ ID NO: 3680 - DNA, 318 bp, B.fragilis
gaaaataaaatgaaaacaagaatgaaaattacgattgcgttcgtcgcagtgatggttctgtcgtttactggttataatgtgtataaaacacaaaaagcaatccagttgtcagatgtagctatggcaaatgtagaagcattggctgatggcgaaggaactaatgccggctattgttatttggaagatacttggagtacaaaaagaggttataaatatttttgcgatagtaaaactgataaaaatacaatctatccatgtccatcttcaatggagtctgggtggtatgatgataataagcaggatcggtgtactaaataa

SEQ ID NO: 3681 - DNA, 942 bp, B.fragilis
gaaacaaagatgaacaaagaaatagaaactctactgagcgaacagctctcctcttgggagacggcacaaaacaattacgctgtcctgaaacgggtacgaataaaagatgtgaaagtgaacggttgcctgtacagaatacagttcaacccggcacgtattgtttcttctgctgccaaagtagatgataaatcgattcaagagcgtaaatgcttcttgtgtccggccaatcttccaccgatgcaaaaaggcattcctttcggagaacactaccagatattggtcaacccatttcctatctttcccaagcacttgacagttcccgagctacaacatgttgaacagcgtatcttacatcgctttagtgatatgctcgacctggctacttatgccgaagattatataatcttctacaatggtccccaatgtggtgcatcggctcccgaccatctgcattttcaagcaggtaataaaggttttctacctatcgaacaagagtggaaagagaaaagaggagagaaagtaatcacctgtaaagatgctactctttgggcactaaacgattacccccgtgcaactctggtaattgaggcgggaagtaaagaaacagctatcatgttgttcaataccgtataccaggccatgccctcaacatcgggtgaagatgagcctatgatgaatgtattggtatggaaagaacagaaaaattggattgtctgcatctttccccgcaacaaacaccgtccctcctgctacacagccgaaggggataccaatatcctgatcagccctgcatcagtagacatggggggagtgttcatcactcctcaagaaaaggattttgaaaaaattacagcaaatgatattgccgacattctcggtgaagtatgcctgagaccggcagccttccgcatattgatagaacgcataaaacaacaattatga

SEQ ID NO: 3682 - DNA, 750 bp, B.fragilis
aaagctgttgttgatgtatgccaatccgttgaccaactatttggccgctcgtcaatgagaatatggacgttacatatcgtcctgtctgtattgttttccgtcttcctgttttcctgtaacgaagatgatggtgctccttacccttccgtgaggttggagtttctgactgcagagtcgggagcagacggtcggttgcaaacgttggttacggataagggagaacgtctggtcgtggcggaggaccgcactgaatcggagctgttacccaattcctctagccgtgtggtgagcaattacgaagtgctttcgtcggtaggagggcggaaagagatacgcatttatgcattagctaatacggtttctccggttccgctgcctgccggagagttccggaatggcttgaaattcgatccggttgatatgctcagtatctggatggggcgtgattatctgaatatgactctctctatccgggcacagaatgcgcggcatacgtttcatttcattcacgagtctgtggagcgggatgctgtaaccggaaagctgaaagtccatttaatgctctatcatgacgatgggggagatgtggaggcttatgccaagcgggcttatgtctcggtaccgctgaggcagtacacgtccgatatcggggaatcagcgatcatttattttaattttcatacgtatgacggggaggtgcagacctatcagtttgaatacgtacccagtcacttaaccattaattactaa

SEQ ID NO: 3683 - DNA, 495 bp, B.fragilis
aaagtatatgttatcttacaattcgatagattttctcgctttaaacgtgcaaatatagaaaatgttccttatatttgcgattcatctgtaatttatttaggtatgctatcgtatattaagaaatatcccgtatcgctctttatcattcttgcggtcatctatctgtcgttcttcaaacctccttcaacggagattagtaaaattcctaatatcgataaggtcgttcatatttgtatgtactttggcatgtccggtatgctatggctggagtttttacgggcacaccgtagagaccacactccggtgtggcatgcttgggtaggagcattcatttgtccggtgttgttcagcggatgtgtagaattgttgcaggaatattgtacgacctatcgtgggggagactggatggactttgcagccaataccacaggtgcggtattggccagtctgataggatattttattatccgtccacgtatattaagtaaaaagtag

SEQ ID NO: 3684 - DNA, 192 bp, B.fragilis
atacttcgtgtgggtgtacatcttgcttatagcaaggagcctgtgtcttcggggaaatctgccgatattcaggttacttaccgtgcagagcatcccgaacattttgagaagaccattactgtatattgtaatacttccacctctccaatacgtttgaagattcggggtaatgcagttgataaagaaaactaa

SEQ ID NO: 3685 - DNA, 972 bp, B.fragilis
caaaatagctttatctttgttatatataaacagttaaaaggaaataacaactttatgatcgcattcagagatataacgatccaagacaaggataccatcacagcctacacgatgaatagttgccgtcgcaactgcgacctctctttttccaacttatgcagttggcggttcttgtatcacaccaagtttgccattatcaataactttctggttttcaaattctgggccggcgatgaattggcctatatgatgccggttggtgaaggcaatcttgaagaagtactgaacgaactgattgaagatgcccgacaggagggtgaacctttctgcatgttgggagtctgctcatgtatgcgcgaagatctcgaggccattatgcccggtcagtttggctttacggttgaccgtgattatgccgattatatttatttacgtagtgatctcgcaacactgaaaggaaaaaaattccagtccaaacggaatcacattaacaaattccgcaatacatatcctgactatgagtattctccgatcaccaaagaccgaatacaggaatgcctggagttagaagccaaatggtgcaaagccaatgactgcgaccaacaggaagggaccggaaacgagcgacgtgccctgatctacgccctcaatcatttcgaagagttaggactgacgggaggtatcctgcacgtcaatggacagattgtagccttcactttcggcatgccgatcaataaagaaactttcggtgtacatgtagaaaaagcagataccagcatcgatggcgcttatgccatgatcaattacgaatttgccaatcacatccccgaacaatatatttacatcaacagagaagaagatttaggaatagaagggttacgcaaagccaagctttcgtaccacccggaaactattttggagaaatatatggcttgcctgaaagagcagcctgtagaaatgataaaatggtag

SEQ ID NO: 3686 - DNA, 1368 bp, B.fragilis
tgtcacacagttgtcttccaatgtctgatggtcaacagtcacacagtacggagtaccgatggcgtcctgacgacggtaacgtttaccgatactgtctttttcatcatactggcaatggaagtggaacttaagattgtcaatgatctcacgagccttttcaggcagtccgtctttctttaccaacggcattacagccagtttcaccggtgccaatgcagcaggcaatttcaatacaacgcggctttcaccattttccagttgctcttcgcaataagcagccgacataatactgaggaacatacgatcaacaccgatcgacgtttcgattacgtacggagtatacgattcgttcagttccggatcgaaatacttaatgctctttcccgaaaatttttcgtgctgagaaaggtcgaaattcgtacgggagtgaataccttctacttctttgaaaccaaatggcatcaagaactcaatgtcagtagcggcgtttgcatagtgagccaatttatcgtgatcgtggaaacgataatgatcgtcaccaaagcccagtgccttgtgccacttcaaacgaatttctttccatttcttgaaatattccaattcgctgcccggacgaacaaagaactgcatctccatctgttcgaactcacgcatacggaagatgaactgacgggctacaatctcgttacggaaagctttaccgatctgagcgataccgaaaggaactttcatgcggccggtcgtctgtacgttcagataattgacaaagataccctgtgccgtctccggacgaagatagattttcatcgaaccatcggcagtagaacccatatcggtagagaacatcagattgaactgacgaacttctgtccaattcttagtaccggaaatcgggcaagctatttcttcgtcaacaatgatctgacggagctcttccagattgttatcgttcagcgcttttgcgaaacgttcgtgcaatgcatcacgctttgcctgatgctcaagaacacgcccattggtgctgcggaactgagcttcgtcgaaagcttcaccaaatcttttggcagctttggccacctctttattaatcttatcatcgtacttagccaattgatcttcaatcagcacatcggcacggtagcgttttttagagtctttattatcaatcaacggatcgttaaatgcatccacatgtccggaagccttccagatggtagggtgcataaagattgcagagtcaataccgacaatgttttcgtgcagcaacaccatgctgtcccaccagtattttttaatattgtttttcagttcaacacccatctgtccgtagtcatacaccgcgcccagtccgtcgtagatatcgcttga

SEQ ID NO: 3687 - DNA, 339 bp, B.fragilis
gagcgcggcttctccactttcgatgttttcaggcttctttccggaagtttggtaaagatttctgtagaatggttgaatttgtcttatcgtaggggacagggaggtcatagagtttttctctcttttagatatgcatatatcatagttccaatctctgtagtctttgtgctttggggagggatgaaaggtggcaataaaatagaactccctgcattccaaccggatattccggcagaatgcagggaggctgtgttaatgagtctgtgtatacttatgctttcacacgacctacgtaagaaccgtcacgagtatcgatctcgattgtttcgccttcactga

SEQ ID NO: 3688 - DNA, 195 bp, B.fragilis
ggtaggggcttcttaataatcctgacagggctgatttattttcttacacttaccggatattactttaataacaagtttcaagacgtgggtacgatgaaaagacttttctatatacttcaaccccacctttttatcttctggagaatatttatcaagcagaagttccaatgcctttcgcttctcagtttcttctaa

SEQ ID NO: 3689 - DNA, 189 bp, B.fragilis
gcaaagagagtactacataataagacgactatgagtaggatctttttcataaaaatagtattaggaggaagtttttgttgtagcaaagatactttttattttaatatcaaaaacaattatttagaaatattttatattataattgataatttacagattggttgttacagagtaaaactttttagctaa

SEQ ID NO: 3690 - DNA, 507 bp, B.fragilis
tctgttctattaatcatcgtgctgtatgccgtaggtatgacagcccaagcacaaaagtttgccctgatcgatatggagtatatcgtgaagaacattccggcttacgaacgtgccaacgaacaattgagccaggcaaccaaacagtggcagggtgaagtcgaagtattagccaaagaggcacgaacgatgtttaaggactatctagctgcatatgctaaactgacggcggcacaaaagacccagatagaagatgccgtcgtagaaaaagaaagagttgcttcacagcttgaacgcgaatgctttggtcatgaaggtgaactttttaagaaaagagaagagttgatgaagcctattctagatgaaatatacaatgcggtaaaagctgtagcagaggaaaacggttatgcagtagtggtagacagagcatctgcttcaagcattatttttgccactccccgcattgatgtaagcaatgaagtgctggcgaaattaggatattcaaattaa

SEQ ID NO: 3691 - DNA, 1344 bp, B.fragilis
cttttcatattcgtcacgcagtttcttctcttgctcccaggtgataggaagtacagaccagaagcccatctcttcggacagcagattcttaatgtcttcccaagctacatgattgttcttagctttgcgcaaatcactgatctttttagagagtacttcggcagatgctttctggttctcaagtgctttgagattcaaggcatactttccagttcccaatgcgatacctcctgtttcatggtcggcagttaccacaatcaaagtttctttcgggtgtttcttgtaaaactcataagcaactttgatggcattatccatatccgccacttcgtggaacaccgtagcggcatcattcccgtgacaagcccagtctatcttacccccttctaccatcagaaagaaacctttgtttttgcctttagtcaaaaagtcaatagcgctttctgtaatctgtgccagagtcaggtctccttctttactatcgatagcataaggcaaagagcccgtatcggcaccttcttcttgaatcaatatcatcttacctgccgcagcagctttggctttataatcgttatacccacgagcaatggtgtaaccggcttcttcaaacatcgggaaaatgctcggagcttctttcttatcataagtagtggttggtttcaggaaaccggcaccggcataaaaatcaaaacctgctttaggaagatcggtagctatttcataatacatattccgatccggctgatgtgcgtagaaagcagcaggagtagcatgatcgacactgacactggtagtaactcccacccttttaccggctttctttgctttctcagcaactgtctgcaaaggattcttctgatcatccatcccaatggaaccattataagtcttttcgccggtggaaagagcagttcccgcagccgaagaatcagtcacggaattagtggcagagaaagtagtagccattgtccccaccgggaactgtgtaaaaagcaaaggctctacaccaatgcggcccttctggatttcggcacgatacatttccgtaccattcacttgattgacacccattccatcaccaatgaaatagaaaacatattttgcctgagcattggctataactgccacacagacaaaaagaaagaaataaaaaagtcgtttcattcttgtactattttaagtttattcgagttagtgatagcaaagataaaaattttaaaaagaagaaaaggagaaagagatatgaatattctgttaaatagatcaccgagcatcaattacccttcaacccaaactgccatctctaacctgcctcatataaaaaagccggaaaacagagagtag

SEQ ID NO: 3692 - DNA, 1215 bp, B.fragilis
aaagtatctttgctacaacaaaaacttcctcctaatactatttttatgaaaaagatcctactcatagtcgtcttattatgtagtactctctttgctcaagcacaaaagagcgatgtaattataggtgctgagcagactaaagcatattttccaattctaaaaaataaacgaattgctatattttccaatcacaccggaatggtgggaaataagcacttgttggatatattattggaaaacaactttaatgtagttgcaattttttcaccagaacatggtttccgtggaaatgctgatgccggcgaacatgtatccagtacaatcgattcaaaaacaggagtacccattctttctctttacaacggaaagtcgaagaaaccgagtgaagcctccatgaaaaagttcgatatattgattgtagacatacaagatgtggggttacgcttctacacttattatatatctatggtgcgtttgatggatgcctgcgcagaatatgaccgcaaaatactgattctggaccgaccaaatccaaatggccattatgttgacggaccaatattggatatgaaatataaatcgggagtaggcggattacctatccccattgtacacggaatgacactaggcgaacttgccttgatggtcaatggcgaacgatggctaccctcttcacgaatttgcgacgtgaccgtcattccttgtaagaactatacacaccagacaatgtatcgcctgcccattcctccttcgcctaacttaccgaacatgaaagcgatttatctatacccttccatctgtcttttcgaagggactccagtaagcttgggacgtggcaccactctaccttttcaagtatacggccatcctaatatgactggatacaattacaatttcactccccgtagtattccaggagcaaaaaatccgccgcaacttaacaaattatgccacggagtaaacttgagtaatcttagtgacgaagaaatttggaaaaaagggataaacttagactacttaattgacgcctatcataatctgaatatgggagatcgttttttcagacctttttttgaattactggtcggtaccgactatgtacgtaaaatgatagaaggaggtaaaagtgctgatgaaataaaagcaagatggaaaagagatgtcgaaaggttcaagatacaacgaaagccttatctactctatcaagacaactga

SEQ ID NO: 3693 - DNA, 1485 bp, B.fragilis
aatatttcattcattaatctgaaaagcatgacacctgtagcggtattaatcactattgcctcctacttcctgatcctgtttaccatttcgtacattgcaggaagaaaggctgataacgaaggcttctttgtgggtaaccgcaaatcagcttggtatgtagtggctttcgccatgatcggctccagcatatcaggagttacttttgtatcagttccgggtatggtaggcatcagtaatttttcatatctacagatggtattgggatttgtaaccggacaaattattatcgcctttgttctgatacccttattctaccggatgaaccttgtatctatttatgaatacttagaaaaccgtttcggtacctcttcctataaaacaggcgcatggttcttcttcatttccaaaatattgggagcagccgtacgtttatacctcgtatgtctcacattgcaacttctggtttttgaacctttccacatgcctttcatcatgaatgtaattctcactgtggcattggtttggctctacacattccgcggaggagttaaatcgttgatctggaccgattcactgaaaacattctgtctgatagtatctgttgtattatgcatttactacatttccactgatcttaagctcagtttcacagaaatgttttccactgtttcagatagtgctttgtcacacatgttctttttcgataacgtgaatgacaaacgttacttcttcaagcagtttttggccggtgtgtttacaatgatagctatgacaggactcgaccaagacatgatgcagcgtaatctgagttgcaaaaactttaaagactcacaaaagaatatgattaccagtggcatttcccaattttttatcattcttttatttctaatgctgggggtactgctctatacattcacatcacaccaaggtatcacaaatccggcaaagagcgacgaacttttccctatgatcgctacaggagggtattttcctatcatcgtaggcatcttgttcattattggactgatttcatccgcttattctgcggccggatcggccttaacagcactgacaacctcgttcactgtagatatcttgggaatcaaaggaaagacggaagacactgtacgaaaaacacgtaagaaggtacatgtcggcatggccatagtcatgggaattgtcattttcatattcaacttactgaataacaccagtgtcatcgatgctgtttatatccttgccagttatacctatggccccatcctgggattgtttgcttttggcattctcacaaaaagacaagtacgcgatcgatacatcccattagtatctatcctttcacccatcctctgcttcattttacaaaaaaattcggagacttggtttcacggctatcaattcagttatgagctattgatattcaatgccttgtttacttttataggtctgtgctttttgattaaaaaaacaattaacttaacataa

SEQ ID NO: 3694 - DNA, 567 bp, B.fragilis
tttcatacatttgcacccgataacttaaaagtaatcattcaaataaataataaaactatgcttaaaaaaattgcacttttaatgatgttaatactcccgatgggcgtatttgcacaaaatcttaaattcggtcacatcaatgcgatggaaattgtttcggccatgccggaatataccaaagcacaatctgagttacaagcattgaacaaacaactcggacaagacttacagagatctcaggaagaattcagcaagaaataccaggaattcatgcagcaaaaagactctcttcctgctgtcattgcagaaagaagacaaaaagagttggaagacatgatgcagagacaagaacaattccaggctaaggctcagcaggatatggaaaaagccaacaatgacctgatggctccggtatataagaagctggatgacgctatcaaagcagtaggtgcagcagaaggtgttatctacattttcgatatggcacgtactccgataccttacgtaaacgaagctcaaagcattaacctgactccgaaagtaaaaacccaattgggcatcaaataa

SEQ ID NO: 3695 - DNA, 1566 bp, B.fragilis
atgattaaatttgtaaataagacgatggcaccagaagatgtttttaaaaaagtagtatcacattgcaaagaatacggttttgtgttcccctcaagcgatatctacgacggactgggcgcggtgtatgactacggacagatgggtgttgaactgaaaaacaatattaaaaaatactggtgggacagcatggtgttgctgcacgaaaacattgtcggtattgactctgcaatctttatgcaccctaccatctggaaggcttccggacatgtggatgcatttaacgatccgttgattgataataaagactctaaaaaacgctaccgtgccgatgtgctgattgaagatcaattggctaagtacgatgataagattaataaagaggtggccaaagctgccaaaagatttggtgaagctttcgacgaagctcagttccgcagcaccaatgggcgtgttcttgagcatcaggcaaagcgtgatgcattgcacgaacgtttcgcaaaagcgctgaacgataacaatctggaagagctccgtcagatcattgttgacgaagaaatagcttgcccgatttccggtactaagaattggacagaagttcgtcagttcaatctgatgttctctaccgatatgggttctactgccgatggttcgatgaaaatctatcttcgtccggagacggcacagggtatctttgtcaattatctgaacgtacagacgaccggccgcatgaaagttcctttcggtatcgctcagatcggtaaagctttccgtaacgagattgtagcccgtcagttcatcttccgtatgcgtgagttcgaacagatggagatgcagttctttgttcgtccgggcagcgaattggaatatttcaagaaatggaaagaaattcgtttgaagtggcacaaggcactgggctttggtgacgatcattatcgtttccacgatcacgataaattggctcactatgcaaacgccgctactgacattgagttcttgatgccatttggtttcaaagaagtagaaggtattcactcccgtacgaatttcgacctttctcagcacgaaaaattttcgggaaagagcattaagtatttcgatccggaactgaacgaatcgtatactccgtacgtaatcgaaacgtcgatcggtgttgatcgtatgttcctcagtattatgtcggctgcttattgcgaagagcaactggaaaatggtgaaagccgcgttgtattgaaattgcctgctgcattggcaccggtgaaactggctgtaatgccgttggtaaagaaagacggactgcctgaaaaggctcgtgagatcattgacaatcttaagttccacttccattgccagtatgatgaaaaagacagtatcggtaaacgttaccgtcgtcaggacgccatcggtactccgtactgtgtgactgttgaccatcagacattggaagacaactgtgtgacattacgtaaccgcgacactatggagcaggaacgtgtggcaatctctgaattgaataatatcattgccgaccgggtaagtattacctcgttgttgaaaacaatccaataa

SEQ ID NO: 3696 - DNA, 1074 bp, B.fragilis
acaatgaaatttatctatagtatcttatttgctttactttggataggggttacaattacttttggatcctatctttatcgtatgggtctgcctattgtaaatgcaagtgcacaaaaactcttgttgcgtacaattgatgaagacttggaatgtagattccgaaaattgaaacccaatcaggcgtacgttaccggaaagaaacatacaaagaataagaaagtaacccttacagataagagcgggactcacaatgtacgtcaatttgccattgatactgtttatacggatacatcttttgtgcatagagttaaacaatcttaccttatagagcgaaactctattaatgtggattctctgaatcagaaatggcagttgaaacttcgtatggatggaatctgtgctaataccggaataaaactaacaaattctctaaagaacggagagcggatatcggcatcgagtgggctaaatgaacccgattgttttttattagcctatagtacaggggtcggttatggtataaaaatggatgcttttataagacctttttgggcgaccgttgttttaaaagcgcattggaataatatctggacttggaactatgttcttttttcactgatcttttgtttgttttatgttccgggtgttcgtctttttcttgttcaagttttatctaagttcagaatagtagataatcatgttaaatcgtcgcaaccgcttgttcaacaaaaaagtgaatttgtttgggaggtcaatggacttacatttgattatctgcagaggagtatcacttatcataatcagacttgtatactccgaaaacaagttgttgaggtattgctggcatttcttaaagtacccggccatttgctgttgaatgaagatttgaaaaaactattctggaaagaattagaggatgtagattcttgtatggaacgcaggaaccgactgattactgatttacgtactgatttaaggaaaataggggctaatcttggtgttactttggtaaatggaggctatcaactccactttcgttcagaaaatagtaagaaatcagtgaaaaatcagtga

SEQ ID NO: 3697 - DNA, 591 bp, B.fragilis
cttctttcttcaccacgggaggcatccgcggaggcaaaaagaaaatggataaattctatccgagaagtttcaacatgggtgtcccgccgggaggtttatcaggcattaggacgtttctccaatatgcgtttcggcgaacacatcgatttcagtatccgcatatccaagggaggataccaatgccgtctctttcccgatgcctgggtgtaccacaaacgacgtacggattttaagaaattcttcaagcaagtgcacaactccggtattgcacgtatcaatctctacaaaaaatatcccgaatcgttgaaagtcgtccatttgctgccggttgtattcacgtcaggagttgcacttctactattatgcactcccttttgcttgttcaacctcgtcccgattctgctttatgccttactggtctgcctggattctgcgctgcaaaacaaaagcttacgcatcggcatctattccatcgctgcttctttcatccaacttatcggatacggcacaggattctggcgtgcctggtgggaacgctgtatactgggaaggaacgaatttgaggctttccgcaagaacttctataaataa

SEQ ID NO: 3698 - DNA, 783 bp, B.fragilis
acgatccattcttacagtatgaaaaacgtatatttcctttctgatgcccacttggggtcacgtgccatagagcatggacgtacgcaggagcggcgcctggtcaattttctcgacagcattaagcacaaagctgccgcagtatatctgctgggcgatatgttcgacttttggtatgagttccgtttggttgttcccaaaggttatacccgttttttagggaaactctccgaactgactgatatgggagtagaggtgcatttctttacgggaaatcatgatatctggtgcggcgactatctgactaaggagtgtggggtgacgattcatcgtgaaccggttaccactgagatttatggaaaagagttctacctggcacatggtgacgggctgggagatccggataaaaagttcaagttgctacgtactatgttccatagtcgtacgttacagactttgttctctgcgattcatccccgatggagcattgacttgggattgaattgggccaaacacagccggctgaagcgtgagggtggaaaagaaccggattatatgggagaaaataaagagtttctggtgctttataccaaggaatacttgaaaagtcatcctaatattaacttctttatttacggtcatcgccatatcgaacttgacctgatgttgagtgctacggcgcgaatacttatcttgggggactggatcaacttcttctcttatgctgtgttcgatggtgagaacctgtttcttgagaactatattgaaggagaaacccaactttaa

SEQ ID NO: 3699 - DNA, 372 bp, B.fragilis
gcgatgcactcctgtctgatttgtataggaagcaattataaccggaaggagaatctccttctggctcgcaggagactgacggctctgttcccctctatccgttttacgggtgagcaggagacaaggccgttattctttcgtaacccggcactattctctaaccaaatggcccgtttctataccgatgcagatgctgaacgggtagtgaaggagttgaaaacaatcgaaagagaggccggcagggagcaggaagataaaaagaaagaaaaggtatgcctggatattgatctgcttgtttttgatgaccggatcttgaggccggaagatctgcaaagagaatatgttcgcaaaggacttgaagaattgaagtag

SEQ ID NO: 3700 - DNA, 1011 bp, B.fragilis
ggcttttcatccggacttgttgcccgattatacgcctgtctattacgaacgactcaattaatctgtccgatgaaacgaccgacaatacctcttatgctgcttatagccgcatctatttttgtcttttttctgctgaatctgttgttgggctcggtttccattcccatcggttcggtatggaacatactttggggcggaacggatgaatccgttatctggcaaaatatcatctggaagtcacgggtaccgcaggctttgaccgctttggtggcaggtgccggactttctatcagtggcttgcagatgcagaccatatttcgtaatccgctggcaggaccttctgtacttggtatcagttccggtgccagcctgggagtggctttcgtggtattgttgtccggagcatttggaggcgtggcacttagcaaattgggatatatgggcgaggtggctctttcgttggcggccgttatcggtgccctgtcggtgatggcacttattgtgtatgtatcccaaaaagtgaaaggaaatgtaactttgttgattatcggtgtgatgattggctatgtggcgagtgccgttatcggtgtactcaaatattttagtgtggaagaagacatccgcgcctacgtcatttgggggttgggtagctttgcccgcgtctccggtgatcagatgaccttgttcgtctgtatcatggttgtgctgattccgctctctttcctgttgattaaaaccatgaatctgatgctgcttggcgatgggtatgcacgtaacttgggattgaacatcaggcgtgcccgcctggttggtcatttcatgttcgggagtgcttgtagccatcgtgaccgcttattgcggaccgattatgttcattggtttggcggttcctcatctttgccgtgccatctttcatacctcggatcaccgcatcctgatgccggccactttgctggcaggtgcttcgttggctttggtatgcaatctggttgcccgcatgccgggctttga

SEQ ID NO: 3701 - DNA, 213 bp, B.fragilis
ttggcaacaccatcggcagtccgcacgacaaagaatgttttatccgccggtttcggattgacgatgatttcaaaatcagccgcaactgtagggggattttttttggcagatatgatgttagtgggtgtaaataccccgctgacactgataaaagttgctgcatccacattggatgtacccgaaatatactggaatgcattttccgtagcataa

SEQ ID NO: 3702 - DNA, 1053 bp, B.fragilis
tgcaacgcaccgtcatcaaagggattgttcgtttcgataggcgcaacaaaagttacagattacttgtttacagataaaaatataaaaacaatgattatgcgtaatataaatacagatttaatagatgcaatgaaaatatacttacccaaggggaataatcttgcaaatgcgctgatggatattctttaccttggcaaagaagctacttacaggcggttgcggggtgaagtaccgttcacttttgccgaagttgccaccatatctcaacacatgggcatctctcttgataaaatagtaggggccgatttgaatgacaacgctattgttaatctgaatatgttgcaatgccaacgccctgcggagacctattattctattatcgattcgtatataaagttgttcggtcaattgattgaacgggaaagttcggaaagaagcacctcttcaaataccgttccacaaaccctgtatttaaagtatgaagccttatccaaattccaacttttcaaatggatttaccagcatgaaagtacatatgcaggcagacattatgaagatttggagattccagaaaaattgattgacaagcaaaaagaatttgtaaatctgtctcagctattccagtcaaccaattatatatgggataaagagatatttatcagattggtcaatgaggtcaagtttttcttaaatatcaatctgatatcagaagacagtgtaaaaagaataaaaaaggaattattgatattgctgaatgaattggaaaaaatttcagctcagggaaaatattcatccggaaaagatgtgaaaatatatatatccgatatcaattttgagtctacatatagttatgtagaaacagatatttaccatcaatgcctgataggggtcttttccattaattccataacttcgaaagatgattttctatttcagcacttgaagctatggatacagtcattaaagaagtattcaactttgatttcgcagagtggtgaggttcagcgaatccatttctttaaccggcaacaagaactggtgaaaagtttatga

SEQ ID NO: 3703 - DNA, 210 bp, B.fragilis
gctacggaaccatccttcattgcgagtgcaaaggtagtgctttttctgaaatctccaaaaaaatctgtgtctttttttacttacattttcacgtatatattctataatcctaaaggtaagctagttaagtaccaaataaaaagtaacattgtccagcctatcagtatatataccgaatatcgccaagtgtattttaagagtgaaccataa

SEQ ID NO: 3704 - DNA, 598 bp, B.fragilis
  unsure (22),(31): Identity of nucleotide sequences at the above locations are unknown.
tagagagcccgtagtattccanttgcaaggncaagacaaacttctccggcaagcagcattcgacctgttgatcctggatattatcatgcctaagatgatcggtctggagctatgccggctttatcggcatcaatacggttatctcaccccggttataatgttgactgcattgggcaccacggaggatatcgtgaaagggctcgattcgggggcggatgactatttggtgaaaccattcagctttcaggaactggaggcgcgcatcaaggccatcctgcgcagagggcgggaagactctgtccagcagctggtatgtgatgatctggtgcttaactgcaacacccgccgtgccagacgcaaggaggtggagatagaactcactgttaaggagtaccgcttgctggagtatttcatgacccatcaaggcatggtgctttcgcgcctgacattattgaaagatgtatgggataagaatttcgatacgaataccaatgtggtagatgtttatgtgaactatcttcgtggtaaaatagataaggagcatgacaagaaattgattcatacggtggtaggttcgggatatatcatgtatgcttaa

SEQ ID NO: 3705 - DNA, 273 bp, B.fragilis
agaaataagttcttatctgaagtcatagagattctgccgggtctgttcaaaatcattttgccggaatcggtgccacaaggcctgtctctatttctaaaagaatccacaattcagcctatcgatccccatgccggaaatttggcttccaaccaacagatgtgtttaaatataggacgaaaagaatgtttttgctcacgttctttgtcatctgaaagattttccataacttgcaacttttatcggttaagcttgtacgatgtcccattatgttaa

SEQ ID NO: 3706 - DNA, 183 bp, B.fragilis
acaacaaccacccggtttgagataggcaactatttgttcgactctcttgcacaaacactgacacatgccggattgaaacatgagctatctcatcgggagtcggagatcctgagagcgactttgcgaaaatcagaatcaagtggtcaacacacagaatgtattactcgacctatggggagatga

SEQ ID NO: 3707 - DNA, 711 bp, B.fragilis
caaatgataactacacatcccatacgtttcgtatctttaggccccggcgaaccggatctgattacgttgaaaggactcaaagcactgcaaggagccgactgcatcttctgtccggccaccatgactcaagacggcaagtcctcttcacgggcactctccatcctgaacactctcggattctcggacaccgtacagtgtttccggcttcctatggacaaggacaggacactggcattaagatcttatgaagctgtatatgaaagcagcaaaatactccgtgcagagggacaaaacgtcgtaattgtggccgaaggagatgcgggtctttactcttccatccactacatctacgacaagctgcaacaagacgacatccctgttgaacagattgccggtattcccgcttttattgcttccggagcgatggcgggcctgcacatcgtcagtcaggaagagcggctgatcgtgataccgggtcacgtcaccgccaaagaactggacgactacctgaaacatcagacggtagtggtcataatgaagctatcgcaatgtatagacgaggtacaccaatgtataattaaccatccggaataccaataccactactttgaaaatgtagggaccgagaaggaatactactcttgctccaccgaagaacttcgggaaaaaagatatccttatttctcggtaatgattatcagattcggataa

SEQ ID NO: 3708 - DNA, 183 bp, B.fragilis
cgaggtgtaaccttatccgaatctgataatcattaccgagaaataaggatatcttttttcccgaagttcttcggtggagcaagagtagtattccttctcggtccctacattttcaaagtagtggtattggtattccggatggttaattatacattggtgtacctcgtctatacattgcgatag

SEQ ID NO: 3709 - DNA, 1479 bp, B.fragilis
ttgatttggacaatctggaagcagatgaagagtaaatggcgtatgccacatccggcaacgatgttcttcctgtttacgctggcagtcatctttctatcctggatattcgatatttatggattaagggtgcaactaccacagacaggagcagagattcgtgtacaaagtctgctgagtccggagggtattcgctggatgttgcgaaatgcaattactaatttcacaggatttgcaccattgggaatggtgctgatagcaatgtttggtatcggggtagctcaacattccggctttattgatgcttgtgtccggcaaggggtgaagaatcgaaaaaataccaggaggatcatcctgtgggtgattattcttggattgctatcgaatatagtaggagatgcaggttatataatattgcttccgatagcagccactttgttttattcggtaggattaaatccggtagcgggaattattaccgcatatgtttcggtttcctgtggctacagtgccaatgtagtgctgagcaccatggacccattaattgcccgtacgacacaggaagcagccattgattccggagtatatcagggaaatacgggaccattgtgcaattattattttatgtctgtctctacattcgttatcggagccataatttacaggataacctgcaaacgactgattccttctctgggacaatatgaggggaaacagatatttgaaggctataaacaattgtcacgcaaagaacgccgggccatgacaatggcaatcgttgtgggaatgctttatgctgcaatcattttatgggccactttttcttcctggggtatcttgcgtggagtaaatggagggctgatacgttcaccattcattatggggattttgttcttattgtcgctgggagctgctattatgggaatggtctatgggtttagttccggacgctaccgttcggataacgatgtgatagaaggattggcacaacccatgaaattattaggtggctatctcgttattgccttttttgcagcccagatgtttgcttgcctggaatattcacatttagataaatgtgtggctatcataggtgccaatttactgtcttctgtgcaggcaggtcctttatggactttgattttatttatattgttcaccgcaaccattaatctgattatggtttctgctactgctaagtgggcatttatggcatttatcttcgtaccggtatttgcacgaatggggattgaaccggatatgacacaatgtgctttccggataggtgacagcgcaactaatgctatcactccattcatgttctatatgcctttagtgttgacctacatgcaacagtatgataagcaagccacttatggttcactcttaaaatacacttggcgatattcggtatatatactgataggctggacaatgttactttttatttggtacttaactagcttacctttaggattatag

SEQ ID NO: 3710 - DNA, 723 bp, B.fragilis
attcggatggcaagccattgtgttggctacttcaagtatcttgggcagcatgttggcttcttttctcgtattacgcctgtttttcaagaaaggaggaaagtcatgaaaagcagtctaattgttgttgcatttttctgtataggttgtctggtcggaatcttcaatgatttccagtttgacatgcacaatctttctatgtacatactttatgcgttgatgttgcaggttggcatcagtatcggaagcaataagaatctgaaatttctgatcaaaagcctacgtcccaatatgcttttagtgccgatagctaccattgtcggaactcttcttttttcagcttttgccagtttattgctgagtcagtggagtgtattcgattgtatggcagtgggaagcggatttgcatattattccctttcatctattttgattactcaattcaaggaggcttctgtaggattacagttggcaacggaacttggtacgattgctttgctggccaatatttttcgcgaaatgatggcattgctgggcacaccactgattaggaaatattttgggaaactggcccctatttctgccgccggtgtaaattcaatggatgtattgttgccgtccattactcactattcggggaaggacatgatacctgttgccatctttcacggaatcctcattgatatgagtgtacctttctttgtttcattgttctgcagtttatag

SEQ ID NO: 3711 - DNA, 222 bp, B.fragilis
gtcatggtggccggacagaagatgcagtcggctccttgcagtgctttgagtcctttcaacgtaatcagatccggttcgccggggcctaaagatacgaaacgtatgggatgtgtagttatcatttgttatcggtttatcatcttaatgttctgcaaaagtgaggaaaatatctctatgaaacaagaattattaagtatctttgaccgctgtaatttgaattaa

SEQ ID NO: 3712 - DNA, 492 bp, B.fragilis
gaatcactttacaagatattttataaaatcatgagcgagaataaacaagcattacaggtggccgcactgaaaaatggcactgttatcgatcatataccttcagagaaactttttacggtagtttcattgctcggattggaacacatgacgactaatattactatcggattcaatttggacagtaaaaaactaggtaagaaaggaatcatcaagattgccgataaatttttctgtgacgaagaaatcaatcgaatttccgtagtagcccctcatgtgaaactgaacatcatccgtgattacgaagtagtagaaaaaaaagaagtgcgaatgcctgacgagttaaaagctatcgtaaaatgtgctaatcccaaatgtatcacgaataatgaaccgatggctactttatttcatgtgatcgacaaagacaattgtgttataaaatgtcattactgcgagaaagaacaaaaaagagaagatattacaatcatttag

SEQ ID NO: 3713 - DNA, 597 bp, B.fragilis
ctcgtaacatataaagtgaataaaaagatgaagcaagactggaagcccggaactctgatttatccgttgcctgccgtattggtaagttgcggaagcgatgaaagcgaatacaatatacttacggtggcatggaccggaaccatttgtaccaatccgccgatgtgttacatttctgttcgtcccgaacgtcattcttatcctattataaaaaagaatatggaatttgtgatcaatttaacaacccgggatatggcattcgcaacagattggtgtggagtacgttcagggaaggattatcataagtttgaagaaatgaaactaaccccgggcaaatgttctgtagtggatgcacctctcattgaagaatctcccctttgtattgaatgccgtgtgaaagaaatcgtatctctgggatcacatgacatgtttatttctgacgtagtaaacatccgtgcagatgatcgtcatctaaaccgggaaaccggaaagttggaactggcagaagcaaatccgcttgtatatgtacacggaggatattataatttaggagaaaagataggaaaattcggttggtcagtagaaaagaaaacaaagtga

SEQ ID NO: 3714 - DNA, 2049 bp, B.fragilis
aaaaaggcgtatatttgttacctacaaacaacaaacaatatgatgcgatatataatcctcttagtcttgtgcgcctggaccggaatagcattggccatagattaccatgcaaaagacagtcttttattacaattaaaacaaacgacaatagctgcagaacgaatcaatatttaccgaaacctggcggacatttgttttgaaacccctgatgaaaagacatatttgctcaacatgtatagagaagcccaaaaggctggcgatacatcgggtatgctcaatgccttaaatgatcttgtatgcggagagacaaaagaatatcgtatggattcagcatatcattatatggaactgataaaagcaatccgggagccccaagaaacagcccctgtattggcttaccttcaaatgcgatttttcgatacactatgcagccacaatgaaacagaagaagctatcacaaaagaattgcaatttatagaagaaaagaaatctgatgaagcatcactttacagtaaaatcgcccaagcttacatcaccggtggtagccttcattacaatgacatgataaaggaggcactcccctatctggaaacagcaatgaacttatctaagcaattgcctccggaaaagcaaatcttatttgtatcgatcattgtttggaaattatccaatacatacagtatgctgaataaatgtgattcagccatccggattttagatgagaatctgcaaacacaacaacaatattacaaagatcactatcaaacacaacgtcctttttataatatggcgatacacgaattacgcttttatacatctctattgactaatgccatttcggaggctcccgaaaaaatggattattactggcaacaaatagttaaattgaacaaaaagctaaccaatccgtacgatcgatataactattttctatcgatggataactattatctgaatcaaaagccccaaccccattatgaaaaagcattggtggctaatgatagtctgatacaaattgcacaagaaataatcccaaacaatctaccgggattatacgacattcaatcacaaacctacgaagccatgggtaacttcaaagaggcattggcatacctcagaatagcgactcaatataaagattcgctgactactgaaaatatgcaaaagcaattgggtgaactccagataaaatatgaagtgaataagttgaacaatgaaaagtcacaacttgaaattaaaaacaaacgtattctggtgatatgcctgtctatcattctgataattgtaatctttgtctgtctgtatttatatcacgacctgaaaaaagagaaaaagatgaagtttcatctccggaacctcaagcaaaaagccgaagaaagtgaaaagatgaagacagctttcataaactctatttgccacgagatacgtacgccactcaattcgattgtaggtttctccgacttgatattcaatgatgagatagataaagaaacccgtgaaggtttttcacaagagatccagaaaagtacaattctacttacttcattaatcgataatatgcttgaaatatccagtctggatgtatcacaagagaagttaccttgcaaagaagcgaatcttaattctatctgtatacaagagatgacattattaaatcggtctcataaacccgatatagactatcggaccgacttgccggaacaccccatcatactgaccacacacgagaaatatttatcattagtcatagagcatctattgaacaatgcaaataagttcactgaaaaaggcattatcacccttcattgtcacatcgacgaagcacgccaacaagttcatataagcgtaacagataccggatgtggtataccggcagacaaacataaggaggttttcgaacgattctccaagctcaatgcattcactccgggtaacggattgggactttatttgtgccaactgatcatccgcagattgtccggaaagataagcattgacccaacatatacaggaggtaccagaataacagtgattttacctgttcaatga

SEQ ID NO: 3715 - DNA, 933 bp, B.fragilis
ttaatgccccacagaatgtttacctgcaagatagaagccggattcagagtattcatattcattatattgcatttcgtactcacgaattgtatccgggaagatatgtccggatgtccccgggatgatggagggctggctctcaaattcagctatgatacaaatgcagactcaagactgagcactgcgcaaggtgttgatcgattggctgttttcatattcgatgaaaaaggactttttatctctcaggtaaacgattctatgacttcaatcaacgacgattatgtcatggagctgccttacaaacagggcagttaccaatttgtagcatggggtggctatgataaaagtacttatcagacttctgaatgtgtgccgaggaaaacttatatcgatgatttctttctatctgtaaaacgtcaggaggacaaccgggtaaccaatcaacccaaactgctctatcacggtatgcacgatatagtggagcttaacagtaaagaaaaaacaatcgtattgataaacttgaaacaaatgacgaatcatatccgggtcattgctcataatttgaatcaagatagaagtgacaacatttatatagaggataataacggtaagtatggatatgattcacaattctccgatgatgaccggataacctatattcccatttatgaagcatcatcggaacaatcaaatccgttgattgccgacttcaatgtaatgaggctagaaaaggatagagaaccccggctgcgaattgccgacaaaactggtacaatccgctatgatgagaatcttattggtaaacttataggcggaaatcccaatattgattttgagcataaccatgatttcaccattgaaatatccttcgataactacatcccggtcattatcaagattaatggctgggagatagttaatgaagaaatatga

SEQ ID NO: 3716 - DNA, 954 bp, B.fragilis
caactattacacacaatgagcgaaaaagcaccctttatggtattctcgggaactaattcgagatacctggcagaaaaaatctgcgcaagcctcaattgtcctctaggaaacatgaacatcacccactttgctgatggtgagtttgccgtttcttacgaagagtcaattcgtggcgcacatgtattcctggttcagtccactttccctaattccgacaatctgatggaactccttctgatgattgatgcagctaagagagcttctgcaaagagcgttgttgcagttatcccttacttcggatgggcacgtcaggacagaaaagataaaccacgtgtttctatcggcgccaagctggtagcagacctgctttcagtagcaggcattgaccgtctgatcacaatggatttgcacgcagaccagattcagggcttcttcaatattccggtggatcacttatatgcttcggctgtgttcctcccctatattcagtcattgaagctggatgaactcgtgattgcaactcctgacgttggtggttcaaagagagcaagtacattctccaaatatctgggtgtacctctggtactttgtaacaaatcacgtgaaaaagcaaatgaagtcgcttctatgcagatcattggtgatgtaaaaggcaagaatgtagtattgatagacgacattgtcgatacagccggaaccattaccaaagctgccaacatcatgcttgaagccggcgccaactctgtacgtgccattgccagtcactgtgtaatgtccgatccggcttcattccgtgttcaggaatcaggactgaccgagatggtatttaccgacagtattccttactctaagaaatgtgccaaagtaaaacagttgagcattgccgatatgtttgccgaaacaatcaaacgtgtgatgaacaatgaatccatcagctcacaatacattatctaa

SEQ ID NO: 3717 - DNA, 285 bp, B.fragilis
aaagttacacaatgcactccctggcaacttttatgtataagctgccggacagttcctctctttcaccttatattaataagtgaacgaaaagagataaatcaaactacaaaacagggagtaattcagataaatccgctaaaccaatgtacatgcacaatgcagtgtccgtacagaatcttattttcttgcacggcattatgtatgctatatgtagtaaacaatcggttcatattattcattaattacagtgcaaaggtaatacttttgcgcatattttccaaataa

SEQ ID NO: 3718 - DNA, 1167 bp, B.fragilis
attaaaagacaaataccgatgaaacaattcctgatcggatgcgcactgctggcctgtatctctttagccggttgccgtccgaagaacaaccagaatgcaacgatagtaaccggtgaggtgtccgatacatcttctgtccgtatcacaccagtttatgccaaaggttttaaagtgacttatactcctacatgccgcttggtcgatatcagcgatccgcagaaagaaggaggtgaatcttttcattacgctcttgtgcccggagggacgaaacctgaaaatattcctgccggctatacagtgatagagactcccgtgaagagtgttatctgtatgacttccttgcagttatccaactttattaaactggatgctttaagtcatgtagtgggtatcacgagcacccgtcatctcttcaacaaagaaatgaacgaacgcttgaagcagggtaaaacggctaagataggtatcgaggggaactttgataatgaagtgatcatgagtgtgaatcccgatgtcatcttcatttctcctttcaagcgcggcggatacgatgccatgcgtgaagtgggcattccgctggtgccgcatttgggatacaaagagatgactccgttgggacaggccgaatggattaagtttatcggacttttcatcggagaggaagagactgccaaccggaaatttgcagccatagaaaagcattataatgaattgaaagaaagggttgcccatgtaaagaagcgtccggtggtgttcagtggagagatccgcgggggcaactggtatgccgtgggcggtaaaagttttctggcacagctcttccgtgatgcaggtgccgattattttctgaaagacgatccccggtcgggaggtgtcacactcgacttcgaaacagtgtacagccaggcggaaagtgccgactattggcgtattgtcaatagtttcgacgggactttctcttatgatgtattgaagagtgaagatccgagatatgccgattttcgtgctttccgtgagaaaggggtgatatattgcaacatgcgtgaaaagccgttttatgaaagtatgcctacccaaccggaagtgctactggaagatttgattaaggcttttcatccggacttgttgcccgattatacgcctgtctattacgaacgactcaattaa

SEQ ID NO: 3719 - DNA, 2370 bp, B.fragilis
ttatctttgcaacttcgaataaaactacggaataaaatgattaaaaagatagtaaaaggcctttgggttttctttgcactgatggtgctggcaggaattgcagtgtttgcctctatcgcttacggatggattggatatatgcctcctgtagaagaactggaaaacccgaattacaaatttgccaccgaaattctttcggaggatggcaaggttttgggtacgtggtcgcttagtaaggaaaatcgtgtatacacctcttataatgaactttcacccaacattgtcaatgcattgatcgccacggaggacgttcgctttaccgaacattcgggtatcgatgccaaagcgctgatacgtgctgtggtaaagcgtggattgctgatgcagaaaaatgcaggtggaggcagtacactttcacaacagctcgccaagcaattgtttacggacgaagttgccagaaatacgctgcagcgcctgtttcagaagccgatagagtgggtgattgccgtaaaactggaacgttattatacaaaggaagaaattttgagtatgtatctcaataaatttgacttcctgaataatgcagtaggaattaaaacggcttcatatacctatttcggatgcgaacccaaagatctgaaaatagaacaggctgctacgctgatcggtatgtgtaaaaatccttcgctttacaatccggtgcgcttcaacgagcgttcgcgcggacgacggaatacagtgctagatcaaatgagaaaggccggatatatcacagcggaagagtgtgattcgttgcagaatctgccgttggaattggtatatcaccgggtggatcacaaagaaggattggcaacttatttccgcgaatatctacgtggtgtgatgactgcttctaaaccggtccgcagcaattatcgtggctggcaaatgcagaagttttatgaagattcgatcgactgggaaatgaatccattgtatggttggtgtgagaagaataagaaaaaggacggttcaaactataacatttatacggatggactgaaaatttatacaactatcaactcacacatgcagcgctatgccgaggaagcagtggaagaacatgttggggagtacttgcaacctttgtttttcaaagagaagaaaggacgcaaaaaggcaccatacagtaatcagctgactcaagaggaaattgaccgcatcctggacagggctgtgaaacagacttcccgttatcaaacgatgaaggaagccggaatttcggaagcggaaatcaaaaaagcattcaataagccggaatctatgtcggtgttcacttggcatggtgtaaaagacactataatgtccccaatggactctatccgatattataagcacttcctgcgtgcaggatttatgtcgatggaccccataaacgggcaagtaaaggcatatgtaggtggtccgaactacacttactttcaatatgacatggcaatggtgggacgtcgtcaagtgggatctaccattaaaccgtatctgtatgcattggctatggaaaacggattctcgccttgtgacgaaacacgtaatgtagaaatcactctaattgatgaaaatggaaaaccttggtcacccaaaaacacttcaaaaggacattatggtgaaatggtgactttgaaatggggacttgcaaactcaaataactggatttcggcatacttgatgagtaaactgaatccgtatgctttggcacgtttgattcactctttcggcgtacgcaataaagaaattcaacctacagtctctctctgcctcggtccgtgtgagatttcggtgggagagatggtaagtgcatatacggcatttgccaataagggaatccgggtggctccattgtttgtgactaaaatagaggatagcgaaggcaatgtattggctaccttctcgccacagatggaagaggtgatcagtgcatcgagtgcttataagatgttggtaatgttgcgtgccgtaatcaatgaaggtacaggagcacgtgtccgcaggtatggaataactgccgatatgggtggtaagaccggaacgactaaccgcaactcggacggatggttcatgggattcaccccttcactggtatccggatgctgggtaggcggtgaagaacgtgatatccatttcgatacaatgacttatggtcagggggcttctctggcattgcctatctggacaaaatatatgcataaggtgtatgccgaccagacattgggatatgatccgaaagagacttttaatttgcctgacggatttgacccgtgcaaagacttcagtatttcaggagatagcattatagatgaaccggaatcagggttggacgatttgtttaattaa

SEQ ID NO: 3720 - DNA, 183 bp, B.fragilis
cctatccttaaggtttacaagagtatgggaaaaacactgcctgaaaacagcagccgcaactttattactgtgctgcgcgctgcccgtacaagcaaaagccgatacttacaaaacacaagagactgcaagtatacaacagcaaacagtgaagaccaccggtgttatcatcgacaacaccggtga

SEQ ID NO: 3721 - DNA, 627 bp, B.fragilis
aataacattaaaacaaaatcaatggaaaatcaagaaacaaaaacagaaaagaaaatcgtgaaagtgaaacttagtgatgcaattaaaaaggcatctatcctgaaagccgttcttcttgcttataaagataaggaactgtcggcagagctcaaatctaaagtgatgatgacccgtatttattacggcaaatttcgcaagcagtttgaagaggatgtaaaggaagcccgtgaggggctgaagccggagggttatgatacacagcttcaggaaatagacgaactggaaaataaggcccgtggagataaggacattcgtaaccttactcctgaaatgctaaaatctgccctcactgaagaggaatacgacaagcatgaaactttcatgccaattttcaataagtatatggaagaggtcactaacttcaaatctgagaagttggatgaagaagtggagatggaagaaaagaaattcactcagaaagagttcgatgaaatcttgaatgtcaataccgctgagagctataatcttgatttgtgtatgccctataacggtaagaatatgatctttcccggcacaatgaaaagtgccgattttatggaggtactgtacgaagagtttattgactaa

SEQ ID NO: 3722 - DNA, 597 bp, B.fragilis
tttggggataagcatgtggaatttgccacatgtttgtggaataattccacaaacaaaatactcctcttattgttacttatcaaacttgaaattaaaaagaacctcattatgaaaaagcttaaatttaatttgttgacaggattgctgttgctgatttccgtctctgtttttgcagccggctttccacctcccgataaagtacaggaaacttttcagaaaatgtatcccaaagttactacagttgattggcaacgaaagggagactatcacattgccgatatcagggtggacggacgggaattaaacgtctggtttagtgataagggcaaatggttgatgacggaggtagatgtcgaaactctggaggctgttcctgccgctgtggcaaaggcctttatgcaaagtacgatggcatctatgcagctggaagatgtaagaatcatcactttccctaagcagccggcggtaattgtgatagaagtggaagagtataatacagactctgagtttcagttgttttatgctccggacggcaaactgttgcagacccttaacgtgagcgataccggaggagagatttacccgggattgttttag

SEQ ID NO: 3723 - DNA, 414 bp, B.fragilis
aaaaacaaaaaaatgagtagaggattacgaaacaacaatcccggtaatattagacatgaccgggataaatggcaaggtgagattgtacccagccaagacagaaagtttaagcaatttatttcgatggcatacggctatcgtgctctgatcaagttactgcaaaactaccggaaactacataaccgacaaactattgctgagtttataaacagatatgcaccaccttgtgaaaacaatacatcaggatacattacccgtgtatgcagtgaaatgcaggtaccgtctacttatattccagacatcgacgacaaagccacaatgtgtgcctttgccgcggccatcggccaagtagaaaacggagttcccgcagtcatggcagatattgaagccggatgggatttgttaatgaagtaa

SEQ ID NO: 3724 - DNA, 780 bp, B.fragilis
tttaggagaaaagataggaaaattcggttggtcagtagaaaagaaaacaaagtgaaacgaatagttctcctttttatatcgatatggattgcttttgccgcttatggagaagacaatcataaaaaggaaagacacccggatgaccgcaaaataaatgtaggaatcaggggtggattcaactcttctatgtttctggtttctgatctgaaaattaaagatgtaaccattgacgaaattcagaacaactacaaaataggatatttcggtgctctctttatgcgcttgaacatgaaaaggcattttatacaaccggaaatctcgtacaatatcagcaggtgcgagatttctttcgataaactcggctcacagcatcccgacattgaacctgactatgcatcggtcagttccactatccacagcattgattttccattactatatggttatcatgtagtaaaacaaggtccttacacaatgtctctctttgcaggaccgaaactaagatacttgtggaataagaagaataaaatcacttttgagaactttgatcaacagggtatccacgaaaagctgtatcccttcaatgtcagtgcagtaattggcgttagtgtcaacatctcccgcatttttttcgattttcgatacgagcaagggcttcacaatttatcaaaatcagtaacatacgataatatagatatggaaggtagaccggaagtaagcaatatcacctttcgacgtcgtgacaatgtgcttagtttttcactcggagttatattttaa

SEQ ID NO: 3725 - DNA, 4491 bp, B.fragilis
ttgtatctgaaagaaatgaatccgcgtttgcttataccactcttctgtatgttgttgttgacgacatttttctcttgtgtcgatacagctccgactaaggaggtacagcacattgattcgctaaattcacgggcttatatgtaccggtatagagatctggattcttcctgcaaggctgcatcgcaagcgtacaaagaagttagcatgtacagtcaggggaaagcggaagcatccaataatcttgctttttgcgcttttatgcggatggattttgatacagctgaacgcctgcataaaggggtatatgacctgacgaaaaatgaattggaacttttgattgccgacatcggattgatgaaaatttatcagcggacggccatgaacaaggagttttatgactaccggaacagtgcaatcaggaggatgaagcggattgatgaagaaaataatctgtttgtcgaccgtcacgagagtgcccgattggattatgcctttacagagttttttatcgtttcggcagtttattactattatctgcaacaacgtaccgaggctatggcttcgctgaatgaaatacaattaaatgaagacttggcgactgatacaaatcaaattctttatttccattatataaaaggttcggccggactgtgtgagggtaaaacaccggatgaacgaaaacttgaagaattcgatgagttatatacaacctggaaaatggcgtcggagcaaggatatttgtattttgaaggaaatggtttgcaaggactcaccaatttaatggcatctcaggagagttatgaactatttctgaacaggcgttcacacgctctgacaaggttcggcataccagtggattcattgttaccgttgcgtttggggcagatggcactggaacgttttcgcaaatataacgatctttatcagatagcgggtgcgtatgtgtcgatcggtaaatatttgaatgcccacggacgatatacagaagcattggatacattggcaaaagctttggactgtgtgaaccaacatcatatgtcatactatcattctgtggcggatacgctcgacaagttacaggtgtttgttcctaataaagatgtggcatatacagaagtaacctggcttggaaaagaaaaggtgaaaaccgtgccggaatggatttccagaatacgagaacagttgagtgtatcgtatgcttgcctgggaatgaaaccggcgtcggattataacagaaatgtttatttggatattttgcggtatacccgtcaggataaagaattggaaagccgctatctttcattagaacaagagtccagacaattgaacgtggtattgtttttcgtgattataggacttatactggtgactgccatgttttggctattcaataagagatcaaaagtacggaaccggatacatattgcacgtctacggcaaactttggatgtttgccagaaaatcacagcttccataccagtggatgtaacagatgaaagtgaaatcgtatacgctatctcggaatctattcaaccggatatggagcaattattcggtgctacagaaatccgtatcgggataagaaatgaagaaacgggagacatcgaatttaatgaagaatgtgagagcgaacagactgatgaacccaagtcgatcggagaggttggtatcgggtcagtatttaatctgtatgtacctgataaaacggaaccgatcgggattctgaaactatttacccgtcatcgcctgaataaggatgagcaggcattggtgaaagttatcactccctatattgcctgggcattggacaatggaatgacatttatttcattgggggatgaacggaataagttggaaaaacaaaggtacgtctacgaacagcatattgccgggaacaaacggcagaacctgataaaaaaatcatgtctggccattgtggatggaatcaatccgtatatagaccgaattatcaatgaagttcataaattgacggaaaagggctttataaacaacgatcggataaagaaagaaaagtatcaatacatcgacgagttggtaactacaatcaatgaatataatgatatattggctttgtggattaagatgaaacaaggttcgcttagtctgaatatagagaattttgaattgaacgaactctttgaattgataagtaaaggacgtaaagcctttgaaatgaagaaacaaaggcttgaaatagaacctacaaaggcattggtgaaggctgataaagcgttgactttgtttatgattaatacattagccgagaatgcccgaaaatatactccggaagggggtatagtgaagatatatgctaagcggactgatgaatatgttgagatttccgtagaggataacggacgcggactttcgactgaagatataacgaagattatcggtgagaaggtttatgattcccaatcgatagggatgaaagacaatccggataaagaagaattgaagcggagtaagggcagtggcttcggattgatgaactgcaagggaatcattgaaaaatataaaaagaccaatgatctgttccgaatatgtacatttaacatagaaagtacaccgggcaaaggcagccgtttttacttccgactacctcccggagtccgtaaaataatcgggatttgtttatgtctggtcggattgttcggcttcttctcctgtcaaggcgaaccgatgcctgaaaaactgaaagatattccggtagattccgtaaccttagcagctgaagctgaatatgaacgtctgttggacgaagcatccagatttgctgatacagtttattattgcaatgttatagaaaactttgaacttgcgttgcagtatgccgattcagcattaaaccggctcaatgcacattataaaaaatatgcccgtcatccccaacgatttatgaaattggtgggaagtgggattccggccgaactggaatggtgggtagaaccttataatacggattttcatgtgatacttgatgtacgtaatgaagcatctgtcgcttttttgggacttaaaaagttggatgcttatacttataataatgttgcctatacggcattgtataaattgacaggggaagatcagtcattagaaggctattgccggcaattggaacgctcaacaaccaataaaacggtaggaattatcttatgtatcctcttattggtggcatctctctgtggctactatcttttgtatgttcgtaaaaggctcttgaaccgattaaatctggaacaggtcttggaaatcaataaaaaggtattcgcttcttcattagtgcgcacacaggagtcggcggaagctttacaacgcgaagaagatacattgaaagagataccacaacgaatcgtaaacgaatcattcgactcgatgaatgagctgttgactatagaatgtttggggattgctgtttataatgaaatgggacatcggcttgaatttgcttccactccccgtatggatacacctccggaaatcatacagcagtgttttgataatcagacttatctttcggacggagatatgcaagcattacctttgctggttgatgcaggagggaaacatcagtgtgtcggtgtattatatctggaaagacaggaggacagtatgcaagaagcggatcgtttgttgtttcagttaatctccagatatgtaggcattgtggtgttcaatgcggttgtcagacttgccacaaaataccgtgacatcgaagcggcacacgaggagaccaggagagcttcgtgggaagacagtatgttgcatgtacagaatatggtgttggacaactgtctctcgaccatcaagcatgaaacaatctattatccaaacaaaatcaaacagatcatcggcaggctgaatacccactccctatcaggagaagaggaaaaggagtgtgtggagactatcagtgaattgatagaatattataaaggaatcttcaggatattgagttcttgtgcttcccgacaactggaagaagtaacgttccgaagggctacaataccggttacggatataatggcatatgccggcaaatacttcaaaagaataagtagaggggttaactataagataacattgactatagagccccttgaagccaaagtcattggagatatcaatcagttgcgttttcttatagagaacctcattgatgaagccctttctttccatcaggatggagaattggttttaaaagccattatggatggagaatatgttcgttttttgttcacagacagaagacgtgagaagcaagtagaggaactgaatcaattattttatccgaatctggcacgtatgacttcaggagagaaaggtgaactacgaggaactgaatatctgatctgcaaacaaattattcgtgaccatgatgaatttgccggaaggcgtggttgtcgcattaatgcagagccggcacagggaggaggattcacggtctattttacagtacccaaaagataa

SEQ ID NO: 3726 - DNA, 990 bp, B.fragilis
tttattatgaaccggacactacaacccgaaatccaggaactagttcaatttaatattcttcctccggtgcgtactgttatgccgaatggagtgccgttgacaattatcaacgcaggtgaacaggatgtggtacgtgtcgatattttgtttggaggcggacgatggcaacaatcacaaaaactgcaggcattatttgccaatcgcatgttacgtgaaggatcccgaaaatatacagcggcggagatagccgaaaagttggattattatggagcatggcttgaattgtccagttcggcggaatatgcatatatcacactgtattcgttaaataagtattttgccgaaacgctcgatgtactcgaatcgatcataaaagaacctctctttccggaaaaagaactgggtacggtaatagatgccaatattcagcaatatcaggtaaatgcatcaaaagtagattttctggcacatagaagtttattgagagcactttacggagaggagcatccgtgtggacgctatgtggaagaaacggactatcatcatatcactccggctttattacgcgagttttatgatacatattatcattcgggaaattgctatgtttacctttccggtaaagtgacggacgagattacccaccgtatagaagccgctttcggtacgacacattttggaaatcatcagcaagtggcggtcaagaaagattttacatttgttagcatacccgagaaacgccttttcatagagagagaagatgcgatgcagagtgcagtaaagctgggtacaactactattatgaggacacatccggactatctgaaactccgggtactgatcactctgttcggaggatattttggaagcagactgatgtctaatatccgggaagagaaagggtacacgtatgggatttcggccggaatcatgtttatccgggcaacggtttgctgggtatcagtacagaaacaactaatgaatatgtag

SEQ ID NO: 3727 - DNA, 957 bp, B.fragilis
gaaattatgaattcacatcaagaattattcggtggaaatattccacaagatgtaactggaaaacaaggcgaaaacgctatcttcattgtctacgggctgaaacaatcggataacactataaaacaagtaaaagatctatgtgctaacttttccgcactgatacgcagtatgcgtaaccgatttcccgaaatgcaattcagttgtacgatcggattcggagctgatgcctggaaacaactttttccggagcagggcaatcctaaggaattaaagacttttgaaacaattaaaggagctaaatatactgcagtttcaacccccggtgatattcttctacacatccgggcaaaacagatgggactctgctttgagtttgcctccattatcgacgaaaagctgaaaggggttgtagattcaatcgatgaaactcatggattcaggtatatggatggaaaagcaatcatcggttttgtggacggtaccgaaaatccggcagtagatgagaatccctatcattttgcggtgataggtgacgaggacccggactttatcggtggcagttacgtcttcgtacaaaaatacattcacgacatgactgcatggaattcacttccggtcgaagcccaggaaaaggtaatcggccgtcataaatacaatgatgtggaattgtcggacgaggaaaagccgcaaaatgcacacaacgctgtcactaatattggagacgacttgaaaatagtacgtgccaatatgccgtttgccaatacttcgaaaggagaatacggaacatattttatcggctatgcaagtaccttcagtaccacccacaaaatgttggagaatatgtttattggtgatcctgtgggaaacaccgaccgtttactggacttcagcactccgataacaggaaccctgtttttcgcaccttcatacgatctgcttgctaaactcggagagtaa

SEQ ID NO: 3728 - DNA, 717 bp, B.fragilis
actgatatgaaaataagaaatctaatggtcgcagcaaccttattggttactgccggagctatggctcaaaatcaagattgtgccttcttttttcccaaccaagaaggtgaacaaatcacccgtaattgctacactgctgatggtaaacttactaatatcctagtctacagagtagatcaggcatatgaatatccgtcaggtatggaggtagtagcaaactatacatttactgatgccacaggcaaaacactcaattccggacaaatggtagctcgttgtagcgatggaaatttttctatgagtatgggagatgtggcaacattccccacagcactcaacatgatgaacgctgatgtatatatgatgggagatttaatgaattatccggatgccttttctaatccgatgaatccgggagacgatgacgaatttgatgacggaactctgcgtctttaccaaaaaggaaataaaaacaaccgggctgaaatctccgtattcgacagagaatttgttactacagaaactgtaaatactcctgctggagcattttattgtacgaaagtaaagtatgaaatgaatatctggacaccgaaagaaacaattaagggttacggatatgaatggtatgcacccaatattggtattgtccgttccgaacaatataataataaaaaggagctacaatcgtacagtgtgttagaaagaattaaaaaatag

SEQ ID NO: 3729 - DNA, 1035 bp, B.fragilis
agaatcatgaagcaaaaaaccattcatatagagaatctttcgataggctacctgggtaagaccgatgttaaagttgtggccgatcgtatcaatgccggcattaactgtggcgaacttacttgcctgttgggagctaatggagtggggaagtccaccctgttgcgtacactttcggcatttcaacctaaattggggggtaagatagagattgtgggcaaggagatcgatgcatataccgacaaggaactgtcaaccgtcattagcgtagtgctcactgagaaatgtgatattcgcaatatgacggtgcacgagcttgtaggcttgggacgcagtccgtataccggtttttggggaacacttcgcggagaagataaggaggtggtcgaacgttccattgctttggtgaagattcagaacctggcacaccgcatggtgcataccctgagtgatggtgaacgacagaaagtgatgattgccaaagcgctggcacaagagactccggtgatctttctggacgaaccgacggcatttctcgatttccccagtaaagtggagatgatgcagttgcttcaccggttgagccgccagaccaataaaacgattttcctttccacacatgatctggagctggctttacagattgccgataaaatctggttgatggacaagatgaacggggtgactatcggtactccggaagatctgtcactgagtggcaaactgagtagtttctttgcccgtaaaggcattgtgttcgatttggagacgggcttgttccgggtagacaacgaatatacatcgcagatacgcctggtggggcatggacagaaatatgccatggtgcgtaaagccctgcaacgtaatgggattttggctaatcgtactgtcgagtcggatacctacatcgaaaccggtgatctgaaagacggtaacggattcatcctacatccgcaggaaggggaagccgtaacgctgaacagcattgaagaactgttggagagattgcaggccggaagtgccgaaagagccgtttaa

SEQ ID NO: 3730 - DNA, 2178 bp, B.fragilis
accctaatgaaaaaattaatggtaattctgataaccggccttttatatatgtcgtgtaccgacagtatggaggtgtccggagatgcagatagaaataatacagaggatgtatcggtaaggttagtgataaccataccggcctccactacatatgcccggacgcgaggaacatttgcgacgaccgatcatgagtctaaaatcagtgagattcaagtgttagtatttgaagaaggtaaatataagtaccgtgtacccggcatatccatcaacaacacttcatccgctgcttcttttaaagctttattaaaatcaagcagttcgcctttaaaattactcatactggccaatgctaccgatgcggtaatagccaatgagccttcggtggatgatagcgaagatttggtgaaaaagaacatcaatctccggttcaacaatatcacttccgattttccaatgtatggggagtatgaattgcccggaggattagaagcaacggttataaataatattaccggaataaagatgttacgttccattgcccgggtagacgtgaaagctacggaagtggcaaactttaagctgtcaggggtgaaagcatatcgtgccaatgaccacttacagataatacccgatgaaaccggagtcgtcagggttacgcttccgagcgtacctgccggaagttccggaaatgtaaacagtatcctgtatcctgtacctgctgagaacctgaatgaattttcagcccaactttacttgcctgaagccgattcaccaactccggacaaccgggtaagtcaggcaacctgtattgttgtagagggttattatgaagggagtgatcaaccgggttactaccgtatggattttgatcccgataatgttgaaaatgctttcgggcaagtacttcgtaatcataagtatattttcaatataaagaaggtctcaggtccggggtggggtagcccggacgaagcggcgaataatcgttccgcccatatcgtagccgaagtacaggcttgggatgattacaccattgatatgaattttgatggagaacatcattttggagtgtcgacccgggaaattgttctcaagaacaaagcaggttccgcaggcattatcaacgtaagtaccgatcttccggactataccttacaatgggccgatgcggcaggaactcccacaggaaccggaagtcagtcattggcaaatgaatactttactgtaacaaaagctcaaaatggaagtcagttagtgattacggctctgcagagtaattcgacgaatgatactagccgaattcaaaattttgtcatcacagcccaccgttggcgtattctggtgaatattcagcaaaaatatgatgtggccgcttatcagacaattcatcttctaacgttcaatgccgggttgggatatctgggaacgaacattattggttccggcagtgccgaagcgcgtgcaaccggtcttcgaggtatattgaataatcaaaataatttcggtccgaccggaactgttgaatgtggaggttataatctgataggtgtaaatgccaactataataacttaaccgatgctctttttgcctcttttgatgttgtctatgtccattatatgggcaatctgttgttcggtacctcggatgcacaaaaagctcataactgggtgaaatcgaaaaagaatcgtgtattgattgtttcttatgatgctctggatgtcagccagaatttattaaaagagatattgggcgggaataacggcatttcttttttaacgagtaataccggtccctatcctttggcaactccagagaatggtaacagctactttagcactaccggtccttttaccagtgccccatatactcctatcaataccgacttctctttacgcaattatgatgcttatcatggcgaaatacagctcaacacggaagcatccaaaggcattactcctatattgatgggacctgcgggaggtattgttttaggcattgattattcaaggagaatcgtttattggggtgatacggatataggtagttcggcgtccagttcgacgtcaactaccgataaccgtataaacaataattccgggaccattaataataatgcgtccaaactcatagctaatgtttttgcctggatagcagaaactgtactatatggagagtaa

SEQ ID NO: 3731 - DNA, 1287 bp, B.fragilis
caaataatgaaaagagacgatttaattttcgatattatcgaaaaagaacatcaacgtcagttgaaaggcattgagctgatcgcatcagaaaatttcgtaagtgatcaggtgatggaggcaatgggatcttgtcttaccaataaatatgcggaaggatatccgggtaaacgctactatggtggctgtgaagtggtagaccaaagcgaacaaattgccattgaccgcctgaaagagatttttggtgcagaatgggccaatgtgcaaccccactcaggagcacaggctaatgcagccgtatttctggctgtactgaatccgggagataaattcatggggctgaatctggcacatggaggacacctttcacatggttcattagtaaacacttcgggaatcatttatactccctgcgaatataatctgaaacaggaaactgggcgcgtagattacgatcaaatggaggaagtagcattgcgtgaaaagcccaaaatgatcattggaggcggttcggcctactctcgtgaatgggattataaacgtatgcgcgaaattgccgacaaggtaggagcaattcttatgatcgacatggcacatcctgctgggttaattgcagccggtctattggataatcctgtgaaatatgcacatattgtgacttcaaccactcataagaccctccgaggacctcgtggtggcgtaatcatgatgggaaaagactttcctaatccttggggaaagaaaactccgaaaggagaaattaagatgatgtctcaactacttgactcagctgtattcccaggaatacaaggagggccgttggaacatgtgattgcagccaaagctgtagctttcggtgaatgtttgcaacccgaatataaagaatatcaaaaacaggtacaaaagaatgccgctgtattagcacaagccttgattgaccgtggtttcactattgtttcaggtggcactgataatcattccatgctggttgacttgcgtagtaaataccctactctaacaggtaaggttgcagaaaaagcactcgtatctgctgatataacagttaataaaaatatggttccgtttgatagtcgttccgcattccagacttcaggtatccgtttgggtactcctgccatcacaacacgtggtgcaaaagaagatctgatgttggaaatcgcggaaatgatcgaaaccgtattatctaacgtagaaaatgaagaagtgatagcacaagtacgtgcacgtgtcaacaagacaatggaaaaatatccgatcttcgcatattaa

SEQ ID NO: 3732 - DNA, 1404 bp, B.fragilis
tatatccacctaaataaaaagataatgaaaacaagtaaaatctttatgactacactggttgcattgactatggctgcatgcagcaatgacaatgattgggttgaccagtccagcaatccggacgtaattgccccggatgcatatgcctctttttccatcaacattccccacgcatcgaagacacgtgcagtatctacagatccgggaattgcagcggaaaacactgtgaaatccttacatgtgtttatttatgacgcagaatctcccaatacacctactgtagctgaatttacggtcgcaggaggtacactcacacagaaaccagccgggagttctacctggatgaccagccaaccgatcagcactaaaaagacggataaatatatttttgcgggagtaaaccttaatacagaaatagtgaactatattacttctaacggattgggtgcattcagctataaagatttcacacaagaaataacaaaattggcggatcaaacaaatggatttgtcatgttcaatagtgcttatccgacccttacgcccgctgctgatttatatgagaagaaaagtgaagccgaaaacaatcacataaccatttctgtgaatcgcatcactgcaaaagcggcggtgttccaatcacagagctttgtggtgaacggaggcggaacgatgacagatctgaagttcggctggagaaacctgaataaaaaattctactttattcaggataacagagacactctcatcaaagactataattgggctaattataccgcagaagattttacgaggggaacagatgccatcaacgtttatgcttcggctgatgtgcccacctctttttcttatgctacggaaaatgcattccagtatatttcgggtacatccaatgtggatgcagcaacttttatcagtgtcagcggggtatttacacccactaacatcatatctgccaaaaaaaatccccctacagttgcggctgattttgaaatcatcgtcaatccgaaaccggcggataaaacattctttgtcgtgcggactgccgatggtgttgccaattactttatagatggacccacggcagaaaagtttgcggagctatgtgccgcgaatactccgcaaatgccatctatcaatgggatctacctattatcggagaatacgtatagcaacggattgtgttactatcatatttttgttaacggtgacgcagtcacaccgcaggctccttataatatctacagaaaccaatatttcaagatcaacatcaattctatacaagcaccgggaaatccttcggacaattttgacagaggagaaccaatcaagcctaattcatggattggggtcgacatccagattatcccttgggaggtgattgaagaagatcacgatttataa

SEQ ID NO: 3733 - DNA, 1407 bp, B.fragilis
caagaaattgattcatacggtggtaggttcgggatatatcatgtatgcttaactttaacaagccaggctatgaaaataggacgtaaaatcgcactcttttatacgttggtaacggtactgaccaccatggcggttatcggagtgttctacctgttcagttcaaggtatatcgatgggttgtacaggtcataccttcgggaaaaagcttttctgaccgctcagaaacactgggagcgagatgaagtggatgagcaaagctatcagaccattcaacggaagtatgatgagctgctgccggaggccaaagagattttgttggatatggatagtgatgccgtggtgcgtgatacgctgaataaatatctttccgccagccagcagaagcagcttctcgagtcaaaagagatgtcatcggtctctttcgtatatcaggatatgctgggagccgcactatactatcccgataatgaaggcaattttatcgtaattatcatgtcgcataacagttatggggtcaagatacaagaacacttgctgctcttatccgcctttctggtattatgcagctcggtattgatctttttcatcggacaactctattctacgagaatattgattcccttgcagcacgtcctgttacagttgaaacagatccgcggcaacagtctgaaccgcagattgaagaccaccggcaataaagatgaactggaccatctgatagaaaccttaaacagtatgctcgaccgtatcgatacggcatttagagcagaaaaatcatttgtcagccatgcttctcacgaactgaataatcctattaccgccattcagggtgaatgtgaaataagtctcctgaaagaacggagtaccgatgagtacatcgaagcactccggcggatagccggggaaagtaaacgcctgtccaatctgatcaggcatctgctgtttctgtcgagacaggaagaggacatccggaagaataacgtagaagagattcgtctggcagacctgttggaagaggctggagctgctaacccgcgcatccggctgcaatatccggaagatgccgcaaggtacgctgtggtcagtgccagcccttacttgtttaaaatagccttgcaaaacgtgatagacaatgcctgcaagtattcgcaaggcgaggtgcttatccggctttacaaggaagatgagcgatgggggatagctgtcaaagattccggaatcggcatcccggcggatgaaatggaacttatcttccagtcattctaccggggaagtaatacgagagaatacgccggtcaagggatcgggttaagtctttccatgaaaatcttttctgtctacagggggaaggtcagcattcgttccgaagaagggaaggggacggaagtgagagttgtcttcgcataa

SEQ ID NO: 3734 - DNA, 939 bp, B.fragilis
acatataacgatatggaaaacagaagtttagtaaccatagcggagcattcgagggagaaaattctctatatgctcgaaatggcgaaacaatttgaaaagaatcccaaccgccggttattggaaggcaaagtagtcgctaccctgttctttgaaccttctacgcgtacccgactaagtttcgaaactgctgccaatcgactaggcgcacgggtaatcggattttcggatcccaaagccaccagttcatccaagggggagactctgaaagataccattatgatggtgagtaattacgctgatgtgattgttatgagacattatctggaaggagcagcacgctatgcaagtgaagtggctccggtacctatcgtaaatgccggagacggagccaaccagcatccttcgcaaacgatgctcgatctctattctatatataaaacacaaggtacactggagaatctgaatatctatttggtaggtgatttgaaatacggacgtaccgtacactctttactgatggctatgcgccactttaacccgactttccactttatcgcccccgaggaactgaaaatgccggaagaatataaaatatattgcaaagagcacaatataaaatatgtagagcatacggactttaacgaagaggtaattaaggatgctgatatcctttacatgacccgcgtacaacgtgaacgtttcactgatctaatggaatatgaacgggtaaaaaacgtatatatccttaaagcgaaaatgcttgaaaatactcgttctaaccttcgtattcttcatccgttaccacgtgtcaatgaaatagcttatgatgtggatgacagtccgaaagcttattattttcaacaagcacaaaatggactctatgcccgtcaagctatactttgcgatgtattaggaatcactttacaagatattttataa

SEQ ID NO: 3735 - DNA, 903 bp, B.fragilis
aaaaagaaagaaatgaaaaacatattgattatcggtgccaatggatttacggggcgccggatactgaatgacttatcggttaaccctatataccacgtcacaggatgctcgctgagagatgacatttgccccggcaaagattatcgcttcgtacgtaccgatatccgggacgaaaatgaagtacggaaattatttaaagaatgccggccggacatcgtaatcaacacctctgccctttcggtaccggactattgcgaaacccatcatgcagaagctgaagctacaaatgttacagcagtcgaaacgatagcacatgtttgcgaacagtatggcagtcgtttcatccatctttccacggactttgtatttgacggtaaaagcatccggctctacaaggaagaagatgaagcgattccggtgaattattacggtgttacgaaactgaaagccgaaaagattatagccagcatttgtagtaattatgccatagtacgtgtagtcgtcgtttatggaaaagcccttccgggacagcatggcaacatccttcagctagtagccaaccggttgagaaacggagaaacgatccgtgtcgtatccgatcaatggcgtacaccgacctttgttggagatatttcagtaggagtagaaaagctgatgtttcatacagccaacggcatctatcatatttgcggcagcgaatgcctcacaattgccgaaatcgcctaccgggtggctgattttctgaaactggatcgttcattgatcgaacccgtcactaccgaggaaatgaaagaggctactccccgcccgcgtttcagcggattaagtatcgaaaaggctaaagccgaaatcgggtacaccccgcgcacattggaagaaggtatggaggcttctttgttctaa

SEQ ID NO: 3736 - DNA, 735 bp, B.fragilis
aatagtatggaagataagaaatttaaagtaattattgtagaagatgtaaaactggaactgaaaggaacagaagaaatatttcgccatgaaatacccaatgctgaggtaataggtacggcaatgactgaaaatgaattctggcctttgatggaaacacaattacctgatatggtgttactggatttgggattggagggctctacaacaatcggtgtcgatatatgccggaatatctttaaacgttatccgggagtgagagtcttgatattcaccggagaaattttaaatgagaagctatgggtagatgtgctgaacgccggagcagacggaattatcttgaaaacaggtgaattacttaccaagacggatgtacaggccgtaatggatgggaagaagttggtattcaattatccgattctggagaaaatagtggagcggtttaaaaaatcggtggctaacgacgctaagcgtcaagaggctgtcatcagttatgatattgatgaatatgatgaacgtttcctccgccatctggcgttggggtataccaaagaaatgatagctaacctaaagggtatgcctttcggagtgaaatcgttagagaagcggcagaatgatctgatcggaaggttgtttccacagggtgaacgggtaggagtaaatgcaaccagactggtggtccgtgcattagaacttcgtataattgatttggacaatctggaagcagatgaagagtaa

SEQ ID NO: 3737 - DNA, 546 bp, B.fragilis
catagaacggatatgaagaagctgatattctttttgctgctgttactgagtacggcctcactttctgcccagtcggaacaaccttccgacagcatccggcatttgccttctaccgtcaagcaatacggagatttcctgatcgatatgggattgtttatagcagctcctcccaaactgccgaaatataaattcgaattacccgatgcaagcaaagactataaccggatcttcagtttgaatccggacgtcataatgacacaaggactatccaatgtgttcactccctccctttcatacggattcggttggggcggacacgatttcttctcgtctccacaacagctccagatgggatcgtttaaactgaaaaacggcatgcgtctgaacacgtatggggaatataatgccgatggcaaaaaagtccctaaccctgccgccatgccatgggaaaagaacaacttcaaaggggctttcgaaatgaaatcttccgatgggaatttcggtatccgcattgaagtccagcaggggcgcaactatccatattaa

SEQ ID NO: 3738 - DNA, 210 bp, B.fragilis
ttaaggcttttcatccggacttgttgcccgattatacgcctgtctattacgaacgactcaattaatctgtccgatgaaacgaccgacaatacctcttatgctgcttatagccgcatctatttttgtcttttttctgctgaatctgttgttgggctcggtttccattcccatcggttcggtatggaacatactttggggcggaacggatga

SEQ ID NO: 3739 - DNA, 228 bp, B.fragilis
ggtttaggtttattttctcagatacaaagatggactttttcaagaaagaatccgtggcgtttaatgaatggtgtaaacaaagatttttctattatcacatctcacatgaatttattgtccaattatgcaacaatcggaaatgtgtgtaaagacgtgtatctattttcgaaacttcgtcataaacttttcaccagttcttgttgccggttaaagaaatggattcgctga

SEQ ID NO: 3740 - DNA, 219 bp, B.fragilis
caggaaccctgtttttcgcaccttcatacgatctgcttgctaaactcggagagtaatagttactctccatatagtacagtttctgctatccaggcaaaaacattagctatgagtttggacgcattattattaatggtcccggaattattgtttatacggttatcggtagttgacgtcgaactggacgccgaactacctatatccgtatcaccccaataa

SEQ ID NO: 3741 - DNA, 957 bp, B.fragilis
gggagaagactgaacatcttctctttgaagaagcccgttaaattcaacaaacagtttgtaacggatgccgatgcctggtggaaagctgataatgggaatttcggtatcatcctccctccgaccggttctctcccggctgtgggctcccccatgtctccttggtcatgggattttcccggcggtagcggcagtccgttgagaatttcagattatgcaggctataatcctaaagccccacatctgttttcgatgcatccggaccccggcctgtatcccaattcgcaattcagatgctccatcctgctaaggcagaatgctgagatatcaattaataatatagctgatatcagcagggcttatatgggtgtggtggtaaggcatcaggcaaacggagaacttcgattccgtacactgaacaggtccgttatggagatgcagcaacaagaatatgcagtggtgttggatgttccgaattggccggacggtaaagtggatgtttatatggttgcttcctatgctgaagcttcagagcagtcttacagtagtataaatgtgactctgttttcaatgaatcagggtcctctagagacagcttacatggtcaagacccttgccaagcctgtaccgaacagctttaaatttgattataaggtcgttaatgactttgcgaatgaatatcatttggaatgtacatttacgtctattaaaggagcatgggagaaagcccgattctcagtattccttgagtctgatccgattggtgctttcctcggtggtatgggtgagtctttatctcctgctccgatcggagaaatgctgtcacagggagagtcgtatacattcaactctcaatcatttactcgtgtacagacttctcaaaataactatgtaaactatacagcgagatacttaggagacaattatcaatccggttctatcttctttagagccaaataa

SEQ ID NO: 3742 - DNA, 1344 bp, B.fragilis
aaaaataatcgccgaatttggggaattcaatctttcaccggaatgaaaacggaagatatagcgatcagcataaccggttattcttacagtaatataaaagagacgatacctgacggagttgataaggaggaaattgctgccgtgtacgaggaaatcattgatgaatatttgcaaaaaggaattccccgggaaataccggctttaataaatgtcagtggaattccgggggcaggcaaatcgactttttgcaaaaaactgcttgctatgcctgaaaattcaagtgcaatctatattggatttgatgcaatcatggaaaacgagcgtttaccctatattagagaagaggtcaaccatgcggaagaagcattcaaaagatgggagctttctgcaaggatcgccggttatgaattacttaagagagctatagaaaataagtatttgattatattcgatcattcgtctgcgctcccccaacacattgatttatttaatctgttattgtctgagggatacgaagttcactttaattttatttttatcccggaagaagaagccaggaggcgagcgaaaaacaggaaacgttatatacctccatattatattgaagaaagaagcaaaacccttcaatatttattgcctgaatataaacgaatttgtaccacttttaaacaaatagaaccaatgagaaccagacttatcatagcccgtcacgggaatacgtttcgcccggaagaaactccgacaagagtcggagcaaaaaccgatctaccattagtcgaagaatttaagggaagaagtatcggaagatatttaaaagaacatgatatgatccctgacgtaatctatgcggctccacttttgcgtaccatgcagacagcccggttagctgttcagaccatcggtctggattcagatatttctccattaaacgcttttgtcgagatcgactatggtgttgacgaaaataaaacggaagaagaagtgaggttacgtttaggaaatggaaatatcgaaaaagggaaaaaaataattgaagattgggataaaaatgcagttgtacctgatggatggaaagtagatccggaccaaatcattcatacttggctggatttcgcagagaagactgtgatacctcatcagacaactttacttgtcacttctaatgggattatacgctttgctccctatttgacgggagattttgagaagttcgcccaagagcataaaataaaagtggctccgggaggactttgtatttttgataaaaacgatggtgattcattctggacttgctctgcctggaatgtcaagccttatgaactatatgcagatagccactactga

SEQ ID NO: 3743 - DNA, 1356 bp, B.fragilis
aagtggctccgggaggactttgtatttttgataaaaacgatggtgattcattctggacttgctctgcctggaatgtcaagccttatgaactatatgcagatagccactactgaaaatacgatttacacctctcctgacgcatcaaagattttttgttatacgccttccattattgtcacaccaacgggacgtttaatagtttctttcgatttaggaggagaaggtgtaaaaagtatagagggccataagtcatccagagctggtggaagcagatttggacaagggaaaatattcatttctgatgataatggacagaaatggactttcgttcaaaatttcccgttttggcatgcacgtctgttcacaataggtaacagcatctacctgatcgggcatgccggggatatttgtatcatgaaatcggaagataatggtgaaagctggtctgacacctatttcctcacccacggagaaaagtggcattcttcagcctgcaatgtccttttttccaatgggaatgtatatttagccatggagcaacgttgccgattgaacgaagtgacaggatgggacgtagccggattatcccctacgctgtttcgagcttgtgttgaggacaatctttgccttgcatcttcatggagcagatctgaaaaatttatttataaggaagtgtttgatggagccaaattggattttttcggcattccgttttatgattgtgaaaccaataagcccaaggaaatagcgacaggtatcaacaatgctcccctaggctggcttgaagcaaatgtagttaaatttgtagataaagaccatatttggcatactgatttgaaagaagtttttcatctttttctaagagcccatacaggaggtgtcaattatgcacacctctttaaaatagaaatacaagacgaccaaagtatgattccctcattggagcacaccccttccggacaaaagatttcatatatcccatttcccggcggacatctgaaattctttatcatatatgatgaactgacaagattttattggttagtgtccaatcaggccacagactctatgagacgtgtcagctctttatcaaatataaagagatatggattacctaataatgaacgacaccggttgcaacttcatttttcaaggaattgcgtagactggtgttttgtcggaatggtggcttgctctacaaatgaattatattcaagaaattatccttcagcggtaatcaaaggagatgatttgcatcttgtctgccgatcagccgatgaacatgcactcaaccctcaatataataacatgataactcatcatatcgtgagtaactttcgtcagcttatatattga

SEQ ID NO: 3744 - DNA, 2121 bp, B.fragilis
aaaatgaaacgaatttacttgacttttgtgtttgcaggtgctgtctgctttcaggtagccgcacagaacgcggatgaagatcggatactttctgcggatagtctgattacgatggatggacgtttagacagtttgtacagatccttgcccgaagtgatggtggtaggtgaacgtccggtggtgaaagcaatgcagggaaaacttgtatatgatttgcctcgacttattcagaattttgcggtagacaatgcatatgacgcgataaaggaactccccggagtgagcgaaatgaatgataatctgactttaggaggaaaaagtgttacggttgtattggatggcaaagtaaccacaatgactcaggaacaactgaacactcttttaaaaagcattcctgccgggcgtattgaaaaggccgaagtgatgtattcggctcctgcacgttatcaggtgcggggggctatgataaatatctgcctgaaacagggagactccgggaaatccaccttgcagggtgagtttttcagtgattatcggcaaaagcattatgaatatttgactgagcgtgcgagccttctgtattcgggacataaattctctgcagactttctttactcttacagtcatgggcgaaactatttcctgacggataaagaggctttgcacgctttgtcagatggtacgatacatcccataagtacgaatgaatctcaacgaagccgttcgaatagacacaacctgcgtttagccggcgattatgtatttgccgcaaaccatcaacttagtgtgacatacaatgcccaatttgtgaatggttttaatctgagcactgtagacggcactcaaatttcgaatgcccgtacccgtatgaccgaccagctccataatgcacgcctcgattatcatatgccattcggatggaaagccggagtggaatatacttattatcattcaccttcttcacaattacttcacagtcggatggggagtgatgaactggattttcgtgttaaagactctcagcgtatcaatcgttggaaacttttcctctccggagaacatgatctgggcaatgggtggggaatgaattatggggcagtttatacgacaagtttggacaacagccatcaatattatcatgaccctgaaactgatgaaataatatcgggaaatagcaatatgaagtctcgtcgtcgggaacaaacacttaatttttacgccggatttaacaaggcttttggtgataaattgtctttagatgcctcattggctgccgaacaattccacacgactgtatggaatgaatggagcctgtatccgacttttaacattaactatgctcctgcaccgggaaatgtatggcaattatccctcagcagtgataaaagttatcccgattactgggctactcaggatgcagtttcttatatgggtggagggtattccgagattcacggcaatccttatttgaaacctgagattaactaccagctacagttgacttatgttttaaacagtaaatatatgtttaatgcatggtatagtcatactaaggataatgcaacacaaaccctttatcaatcaccggagcgattggttgaaatttataagtatttcaattttgattttgaacagcaagccggtgtacaggctgttgtcccatttgcgatcggacgctggctgaaatcgcgtttcacattgaccggcgtttacgatcgtcaaaaagacagtgacttttgggatattccttttgatcggaaagcatattatgcgatgttgaatatgaatcatacagtgactctgttctcacatccggatattaagctgattgtgagtggaatgatacgcagtaaggcgatacaaggcatctatgatttaccagcatccggcaacctggacatagcgctcaggtatggttttgccaatggaaaggcattgctgactcttcgatgtaatgacttgtttgaaacaggtcagatttcaccgcgaatttgttatgttatgcagaacgtgaccaaccattactctgctttccgtgaatttggtgtttcgtttacctataagtttggaggctataaagagaagaaacgggagggagtggatacctcacgtttcaaatag

SEQ ID NO: 3745 - DNA, 483 bp, B.fragilis
aaaaagaaacgtagtatgagtgtaatttttaaaacagtaaagcgcccgtcagatccgcgcgttgagaattctcccaaaaggtattatccgcaacttatcacactgggaaggtcggttgacttaaagtttattgcacaaaagattcaggaccgttcgtcactttcggtaggtgatattaagagtacgattcagaattttgtagagaaactgaaagagcagttgctggaaggcaaagcggtaaatatcgagggattgggtgtatttatgttggctgccaaatcgaaaggctccgaaaaacaagaggacatcactgctaaaagcgtggatagtgtgcgtatctattttcaggctaataaagaactgaaaattactaaaacagctacccgtgcaggtgagaagctggacctgatcagtctggatgattatctgaaagggacggccgatggaggaaacggagacatcgtggatgaccccacagcctaa

SEQ ID NO: 3746 - DNA, 702 bp, B.fragilis
tggagtattttaaaaaatgcaagaactatgtcactgagtaatctgctaattatattctcttcctcttttatggctttgtttcccgtggtgaatcctttgggaaacggttttgtggtgaatggcttttttaccgacctagatcccaagcagcggaaaaccgccatccggaaactgattcttaactttataataatcggtgtgggtactttggtcataggccacctgtttttgttaatgttcggtctggccatccctgtcattcagttgggcggtgggatacttatctgtaaaacggccatggagttgctcggcgattctaactctccggatcaggaagaatcgaaccggaacatggatagcctcaaatggaagaatatagaacagaagatattttatcccatcacgtttcccatcagcatcggtccgggcagtatatccgttatatttactctgatggcttctgccagcgtcaaaggtaaattgttgcaaaccggaatcaattattttgtgatcgcacttgttatagtttgtatggcagccatactttatatctttctttcccaagggcaaagaattattcagaaactcgggccggtagggaatcagatcattaacaagctcgttgccttttttacattctgcatcggcatacagatttccgtgacaggtatatctcagatatttcatttgagtatcttatga

SEQ ID NO: 3747 - DNA, 1611 bp, B.fragilis
caacaacaaaggttaaccattatctttgcctgcatgaaactcccaatcaaacatatcgccatacttgtaattgcttctctgatggccatctttgcctaccaggcatactggttggttagtatgtaccataccatgaaaagtgatatggaacattcgattatcgaggctatgcgcacaagtgattacaatgagatgatgttacgcatagaacgcatgcgtcgggatgaccaagatcatggtgaaatctctgtttccgccggatacaatgatgaaggtggaacactggttcgcagcagcactatggtccataaagaaaagattccgggaagtacaggaatacaacaagattccattctcaaaaccgaacggaaactggacaccctgatcgtcgttcgtaatgatcagaaagaaataaaagtagttccgcaagattccactgcgcaggaggtaaaagctgccatgctgcaaacaaaaggcgggctggacatactactgaaagatcagaataccatgctcgaactggccacttactttcaaagaggattgcactccggccttgacgttatcatggatcctgattttcaatcatacgatagcctgctgacactcagtttacaggaaagaggaatctcactgccgtatcggatagaatatctgcatttcggcaatacgcctgactccagtttacttttcaccgatacattaggaatgggcggtacggcgaactatatccccggaccggatgcccatacgtacgactacactttcgacatccattcccattctctctaccgccttcggatggattcagttgcaggagtgatcgtccatcagatggcaggaatacttattacttcattcatcattctgttgattttgggattctctttctggttcctgatccgcacattgctgaaacaaaaaacactggaagagatgaaaagtgacttcaccaacaatatcacccatgaactaaagactcccattgccgtggcatatgcagccaacgatgctttactcaacttcggacaagctgacgaaaaagccaaacgggacaaatatctaagtatcagtcaggaacaactgcaaaggcttagcggactggttgaacagatactgacgatgagtatggaacaacgcaaaaccttccgactccgtccggaagaaataactcttgctactttacttgaatcattgacagaacagcataaactcaaagcacaaaatccgattgacatcgactatagagtagaaccggcaaaccttacagtatttgccgaccggacccacttcagcaatatattgagcaacctgatagacaatgcagtgaaatattcaccgggaaaggccgtcatccgcattcattgccgcgaaacagcagataacggaaaagtggaaatttctgtcagcgacgaaggaacaggcatcgcacaagagaaacaaaaacatatattcgataaattctaccgcgtaccgaccggtaacctgcacaacgtaaaaggatacggactgggactctattatgtaaaaacaatgatcgaaaaacatggcggaacagtttgtgtaaaaagcgaacccggacacggtagcacattcaccatcacgttatga

SEQ ID NO: 3748 - DNA, 408 bp, B.fragilis
tatccgggaagagaaagggtacacgtatgggatttcggccggaatcatgtttatccgggcaacggtttgctgggtatcagtacagaaacaactaatgaatatgtagaacctctgatacaggaagtctacaaagagattgataagttgcagaatgacaaagtaactccggaagaactggccatggtgcgcaactatatgcttggagaaatgtgccgtaattatgagtcgcctttctcactggcagatgcctggatgtttattctgacatcaggtctggacgatgattattttgcccgttcgctacaagctgtgaaagaggttaccccggaagaaatacgggagttggcaggccgctatttgtgtaaagagagtttaaaagaggtcattgcaggtaaaaagttaacataa

SEQ ID NO: 3749 - DNA, 324 bp, B.fragilis
aagttgccagggagtgcattgtgtaactttttaaaatatacgagtatgttttccattatatctatcatgtttttaggtattggcatcggttatttgctgcgtaacctgaaatttctggagaaagtagaaaagagtacttcgcttacgatattcctgctacttttcgtgctgggcctttcgataggctccaatagtttaatcgtaaataatctgggtaaattcggatggcaagccattgtgttggctacttcaagtatcttgggcagcatgttggcttcttttctcgtattacgcctgtttttcaagaaaggaggaaagtcatga

SEQ ID NO: 3750 - DNA, 1713 bp, B.fragilis
ttgttaattttgcaactccattttaaaaacctaaaaactcccgatatgaaatcagacatagaaatagcacgtagtgttgagttgaagaaaataaaacaagtagcagaaagcatcggtattccccgcgatgaagtagaaaattatggtcgttatattgccaaaattcccgagtatctgattgatgaagagaaagtaaaaaagagtaacctgattttggttactgccattactgcaaccaaggcgggcattggtaaaacgactgtttctatcggtcttgcgttaggactgaataagattggcaaaaaagcaattgtcgctttgcgcgaaccttccttgggaccgtgcttcggaatgaaaggaggagcggcaggaggcggttatgcccaggtacttccgatggagaagattaatttgcattttaccggtgattttcatgctatcacttctgctcacaatatgatttccgcattgctggataattatttataccaaaatcaatctaagggtttcggtctaaaagagattctttggcgtcgggtacttgatgtgaacgaccgttctttacggaatatcgtagttggtctaggaccgaagaccaacggtattacgcaggaatccggatttgatattactccagcatcagaaatcatggcaattctttgtctttcaaaagacgtggatgatcttcgccgtcgaattgaaaatattcttttaggatatacctatgataataaaccgtttacagttaaagatctgggtgtggcaggagctataacagttctattgaaagatgctatacatccgaacctggtacagactaccgaaggtactgccgcctttgtgcatggaggtccatttgctaatattgctcatggatgtaattctatattagcaacgaagatggcaatgacttttggtgattatgtaattacagaggccggtttcggtgctgatttgggagcagagaaattctacaatattaaatgtcgcaagagtgggttgcagccgcgtttgacagtgattgtggctactgcgcaaggacttaaaatgcatgggggagttagcctcgatcgcattaaggagccaaacctcgaaggattgagagaaggtttgcgtaatttagataagcatgtccgcaatctgcactcgtttggtcagactgttattgttgctttcaataagtttgccagtgatacggatgaagagatggagttgcttcgtgagcactgtgagcagttgggagtaggctatgctatcaataatgctttttcagaaggtggtgaaggcgctgtcgatctggcgaatctggtggttgagacaattgaaaacaaaccatccgaaccattacagtttacctataatgatgaagatagtgtacagcagaagattgagaaagtcgcaaccaatttatacggtgcaagcgttgtgacctatagcacattgacccgtaacaagattaaattaattgaagaaatgggaatcggtcattatcctgtatgcattgccaaaacgcaatattctttttcagccgatccaaaagtatatggggcagtagataactttgaactccatattaaagatatcgttattaacaatggagccgaaatgattgtagcgattgcaggtgagattatgcgtatgcctggtttgccaaaagagccgcaagcactccatatcgatattgtggatggcaatattgaaggattgagctaa

SEQ ID NO: 3751 - DNA, 3288 bp, B.fragilis
ctcaaacctattttatttatgacgaaaaaaagtaacctatccttaaggtttacaagagtatgggaaaaacactgcctgaaaacagcagccgcaactttattactgtgctgcgcgctgcccgtacaagcaaaagccgatacttacaaaacacaagagactgcaagtatacaacagcaaacagtgaagaccaccggtgttatcatcgacaacaccggtgagcctcttattggagtttccgtaaaagtgcagggcaccaataccggaaccatcactgacctggatggaaaattctcaattggcactcccccaaaagctctccttgagttttcatttatcggttataaaaccattatcatggaagtgaccggaaaggaactccatatcactatgcaggaagattcaaaacaattggacgaagtggtagtagtgggttacggctcacaaaagaaagtaaacgttactggttctgtaagcatggtcaatgcagacgtcttggaatcacgtcccgtacaaaatgtgtcacaagcattacaaggggttattcccggactaaatatgtctgtaggaagtagcggtggcacgttggatggcaaactaaacgtgaatatccgtggagcgggtacgataagtgacggatcgagcagcagtccgctggtattgatcgacggaatcgaaggagacatgaacactgttaacccaaacgatattgaatcggtatctgtactgaaggacgcagcctcttcatcaatctatggtgcacgtgcggcattcggagtcatcctgattactacgaagagtggcaagagtggtaaaacccgtgtaaactattcgggtaatgtgcgtttctcagatgctattcagttgcccgatatggtggattcttacacttttgcacaatactttaaccgggcttcgaccaatggtggagaatctcctacctttgatgaaaaagcattgcaaaatatcctggacttccaaaacggaaaatttactgacccttctactcccgaatattatggagtggaggccggaccggacggcaaatggaaaagctatgcaggatcttttgccaatacagactggttcaaagagttctataagagctggacgccttctacggaacacaacctgagtatcagtggaggaactgagaaactgacctatatgatcagtggcagcttcctgaatcagaacggccttatcaggcatggcgaagataacttcaaccgctatacgatgaacgccaaaatttcggcaaaacctgcggaatgggtcacattgaactatacaagcaaatggacccgtgaggattatgaccgtcccacctacatgacaggtgcgttttttcataacattgcccgtcgctggcccacttgcgctccaatggatccaaacggccattatatgcccaacatggaaatcatccaattggaagagggaggcgtacaaaccagtcaaagaaattggtataccaatcagctgcaagccatcttcgagcccgttaaagactggcgaatcgtagtagaaggaagcatgcgtacgtatacgcgaaaacaacactgggctgtattaccgatctatggatatgacgtaaacaataaaccttatttattgtcatggaacggtggagcagcagggtattcggaggttcaggacgaacgtgaagatgaagattatttctccggaaacatttatagtgactatgcaaaaacaatcggtaatcattattttaaagtgatgggcggtttcaatgccgaactcttccggccaagcggaatgaccgggtttggaaccgacctgatcagctcgaatgtcccttctttaggattgacacaggacaatcagaaagcaagtgcatgggcacgtgaaagagcaattgccggtttcttcggacgtgtgaactataactataaagaacggtatatgttagaagccaatctgcgttatgacggttcttcacggtttgttggcgataagcgctgggggttgtttccgtcattctccgccggatggaatattgcacgcgaagacttcttccgtccattgaccggtgttatcggcactttgaagttaagaggttcttgggggcagcttggtaacaacaacacggataaggccaatgcctggtatccgttttaccagaatatgattacgggatctgccaattcgggatggttgatcgacagtaaaaagcaaaacactgcccaacttccgggtatcgtcaattcactgatgacctgggaaaccattgaatcatgggacattggtttggatttcggtttactcgataaccgtctgacaggatcggtcggctattataaccgttatacatacgatatgatcggtccggctcctatattacctcccgtgttaggggccctacctccccaagtgaacaactgtgatatgaagtcatacggttgggagttggaactttcatggagagatcgcatcagtgaatttgattatagtgcacgatttgttttatctgacgggaagcgtaaaatattgagatatccgaatcctacgaactcactctcttcggatgtatactataatggacaaatattgggtgacatctggggatacaaaacggtcggtattgcacaaacccaggaagaaatgaatgcacacttggccaatggaggtaccccaaattggggaacgaactggggagccggtgacgttatgtatgccaatcttgatggaaaagaaggtgtcaacaatggttcgaatactttggaagatcatggtgacctgacaataatcggtaacaacaccccaagatataatttcggtttgacgttgaccggggcatggaaaggattcgacttttcggtgttcctgcaaggggtaatgaaaagggattattggttggacgggccatacttctggggggccaatggaggattgtggcaatcgaccgcattcaaagaacatatggattattggcgtccagaaggcgatccactcggtgcaaacaccaatgcttattatcccaaaccctattttaatacggataaaaaccagaaagtacaaagcggatatcttcagaatgctgcatattgccgcttgaagaatgctcagataggttatactctgcccaaaatatggactcgaaaagcggcaatggaatcggtgcgtgtttatgtgtccggagacaatctggttaccttttcgggaatcagcggagtatttgatccggaattattgggtagcgactggggagacggtaagctctatcccttgcaaagaacgatttctatcggcttaaatgttaacttctaa

SEQ ID NO: 3752 - DNA, 225 bp, B.fragilis
ttactcaccatcataatggtatctttcagagtctcccccttggatgaactggtggctttgggatccgaaaatccgattacccgtgcgcctagtcgattggcagcagtttcgaaacttagtcgggtacgcgtagaaggttcaaagaacagggtagcgactactttgccttccaataaccggcggttgggattcttttcaaattgtttcgccatttcgagcatatag

SEQ ID NO: 3753 - DNA, 1224 bp, B.fragilis
aaagttaacataaaaatctgtcaaaagaaagtagctttagtgtataaattgtatatttgccaaatgaaaacaacaagatacatctatacagcactcattttagcggctctttcgcaagggaatgctgtcgcacaaaataaaggtggattcttcagcaaagtgcgggacaccttctcaacagaaatcaagataggaaattacacgtttaaagatggttccgtatataccggagaaatgaaagggcgtaagccaaatggtaaaggaaaaaccatttttaagaatggcgacgtttacgaaggggaatacgtgaaaggtaaaagagaaggattcggagtttacacctttccggatggcgaacgatatgaaggacaatggtatcaagaccagcagcatggtaacggaatctactattttatgaataataaccgttacgacggtatgtggtttcaggattatcagcatggtccgggtacgatgtattaccacaatggagatatctatgtgggggattgggtgaacgataaacgtgaaggtaaaggtacctatacctggagagacggttccaaatacgtcggtgactggaaaaatgataagaaagatggtaaaggcgtattggtatggaacgatgggtgtaaatatgatggcgactggaagaatgacgttcgtgagggcaaagggacctttgaatataccaacggtgaaaaatacgtaggagactggaaagatgatctgcaacacggaaaaggtattttctttttagggggtgaccgctatgaaggttcatatctacaaggagaacgaaccggtccgggtatctattatcatgccaatggagataaatatgtagggaactttaaagacggtatgcaggacggtgaaggtacatttacctgggctaacggtgctgtatatgaaggtgaatggaaagataataaacgtaacggacacgggatttacaaatggagtaatggagacgtgtacgaaggagaatggaagaataaccagccaaacggcaaaggcactcttactttgacgaacggaaccaaatataaaggtggttttgtaaatggaatgcaggaaggtaatggtgtggaggaagataaaaacgggaatcgctatgagggctttttcaaacaaggtaaaaagaatggcccgtttgtagaaacagataaaaacggaaaagtgattcgtaaaggcacctataaatttggacgactggaataa

SEQ ID NO: 3754 - DNA, 339 bp, B.fragilis
cttagaataatggaaaatcaagaaacaaaaatcagtaacgtaaccacttccatgaaagtggagaaagagatcaacggatttaaagtatccggaacggtcgaagtctataacgacagtaaacggatcaagcgcattgacgcttccgtacaaaaaacagattcgaaggccatggcacctttcaagtattcctttacggttacccgtggactgaacgatatggtcaatccatctgaggaaaatgaaccggaacgggaccaggctctgacagccggcatcgaatttgagaaagctgttgaacaggccgtatccggtatgatatttaacactatcgtagaataa

SEQ ID NO: 3755 - DNA, 465 bp, B.fragilis
gatactcaaatgaaatatctgagatatacctgtcacggaaatctgtatgccgatgcagaatgtaaaaaaggcaacgagcttgttaatgatctgattccctaccggcccgagtttctgaataattctttgcccttgggaaagaaagatataaagtatggctgccatacaaactataacaagtgcgatcacaaaataattgattccggtttgcaacaatttacctttgacgctggcagaagccatcagagtaaatataacggatatactgcccggaccgatgctgatgggaaacgtgatgggataaaatatcttctgttctatattcttccatttgaggctatccatgttccggttcgattcttcctgatccggagagttagaatcgccgagcaactccatggccgttttacagataagtatcccaccgcccaactgaatgacagggatggccagaccgaacattaa

SEQ ID NO: 3756 - DNA, 1173 bp, B.fragilis
aaaacaaaaatgatcataagaatagtccaaaatatacagagaatcaataaagagggtaatgctcctctctatatatccttttatttaggaaaggaaaaagttgttataccttgtaagttatctgtgcctacaactaaatttgattctaaaacaggaatgctcagaggtactaataaggaagcaaaagatattaatctcatcatagaacggttgaaagcaaaagttaatgatattctcgttaagtataggctcaaaaatctcacactgaataaagaagcttttatgagggaatataacaacccttcagattttaaatcctttcatgactttgtagcatcttatatgaagacttacagtaggagattagaaataggaacatttcgacatcacaaaagttgtatgagaaagtttaaagagtattgtgaaggcttacagtttcatgaactaacagaagatttcctcagagactatctaatttatatgaaaaaaactctatgcaacgcagattcaacggctcaacgtaatttatcaaccataaaaatatatgtatctgcggctataaaaaaggggtatatggaaaatgatccttttaaggattttggtgtaaagagaataaaaagtaatattgactatctcaccgaagaggaattgataaagttcattagtttatactatgatagaagattacctgaacgtttagaacgaacattaggtttctttttatttatgtgtttcaccagtttgcatatttctgatgctcgacacgtctgtcttgaacaaattaataatggaatacttacttattatcggattaaaaatagaaattgcaaaccggaagcaataaaaataccactttcaattccggcgttcaagatcatagaggaactccaaggaaaaagaaaagaaggacacctctttacttcattgcaatgtgatcaggttgttaataggcaaattaaagagatcgcatccatattagagataaagaaaaaagtgtcagccaaaacaggtaggcatactttcgctaccatatttctaaaaaaaacaaaggatgtagcgacattgcaaaagttattaggacatagtaatttgaaagaaacaatgatctatgcgcatgtacttgatgaaagcaaacaggaaggaatgcaatgcttcaactgcttcgctatttaa

SEQ ID NO: 3757 - DNA, 801 bp, B.fragilis
atacacagaatgatgaacaatagaatatactgcacatttatactgtcaatcattgcagtgatggtatgtgcacaaacagaacaaccgaaagacagtatcaaaaggcagcgcgaaactgtacctgaaattcgtcaggaactgcatatcaacgatagaaacatacaaacagacggtactcttccggacaacacccgacaagctgcagccggtgacagtatgactttccgtataccgtacccggaaagtattccgtccggttggatcgtccctcaattggggacctattccacccccttcatttgggattacgaccgttattacaatttcaacctttctcccaacagtaatctcagtactttcagcaattataacacttatctcagcataggcaccatcgtaaaggcgggtgctgcctactcgttctctcccaatgatcgctggatcttttcgggaggagtgtttgttgctaaatatacattgccaagccttcgcatccccacggctccgatggccggttcgcgctttgatgccggtatccacggaaaaattacctacaggcttacagaccatttatacctgaacgtgttcggccaatattcgctcaacgggcaacgaaactctaagaagggctatatggtccccgacttatatatgcagaatcatttcggaggaacagtcgactacatgttcaatggtaaattcggcattaccggaggagccatccacgaattcaatcccgtaaaaggacgttgggaaacgaaccctgttttcggtcctgtaattcatctaaaaaagaaataa

SEQ ID NO: 3758 - DNA, 1758 bp, B.fragilis
tactcaatgatcatgaaaactaccaaactccaactttcccttttagccctttttctggggtgcgcttctctacaggcacaatacaaatgggcagacccactcaaacaagactttcatacagtacgcggacaagcatggcaggacgaactgaaagattcttatgcccgcctcccgcaaagggcagaagataaagtacgcaaacctttatgggatttgtcgcggcaaagcgcagggctgtctgtcgccttccgttccaacgcatccgaaataaaggttcgctacgtagtaaaaggcggactctctatgccccatatgccggccacgggagtttcgggcatcgatctgtatgctacagacaataacgggcaagaacgctggtgtgccggaaattattccatgggagacaccattgtctacaatttcaggggactttcatacgcggctaaatccggcaacggatttgaataccaactattcctgccgctatacaacagtgtatcatggatggagataggtgttcctgccgacgcttctttccgtttccttccggtttcacaagaaaagcctctggtcatatacggcacttccattgcgcaaggagcctgtgcttcgcgtcctggcatggcatggggcaatatactgaaccggaagttgggacatccggtcatcaatctggggttctccggcaacggaaaactggaagaagcactcttcgatcttctgtcagagatcgatgcacggctatatatcattgactgcatgcccaatctggcaggaaaagaagcatcggccgtagtgtaccaacgcactttggagggagtgaaaaaacttcgtgaaaagagccgggcccccatcctgttggtagaacacgacggatatagcaatgaattcagttccgaaagcgcggaggaatcctatcgtgtggccaatgcagaactacgcaaggcatacgagacgctgcaaaaagagcaggttcctactgtctattatctgaccaaggaagaaatcggtatgccgatggatgccatggtagacggtgttcattccaccgacctgggtatgcagcaatatgcggacagttaccggaagaagataggtgagatcttacacgaagagagtgaagggcctacttcatgtatcccctgcaagcagcaaagagatccatacgactggtacggacgccacgaagagatcttgaaactaaataagcaaagtgctcccgaagtggtgatgatcggcaactcgatcacgcatttctggggaggcgaacctattgcacacaatcagtttggaacagaatcctgggataaacttttcaaaggaaagcgggtccgtaacctcggatttggctgggacaaaacagaaaatgtactgtggcgtatctaccacggtgagctggacggttttcaggcacagaacatttttctgctgataggcaccaataatctcttgttcaacaccgacgacgaagtcatagagggaatctgccgggtcgtaaaagcgattcgcgagcgtcagccccgtacaaaactctgcgtgatgggcatcctgccgagaaaagagatggaaacccgcattgcccaaatagatgcggcattgcaagagcgactgaacgacaaagattgtactttcattaatcttgctccgcaactgacgcataaagacggaacaatagaccattcactgttccgtgacgggcttcacccgaatgccgaaggatataaacgcatcgcaaaagtgctgaaaggctacttataa

SEQ ID NO: 3759 - DNA, 240 bp, B.fragilis
agattttacttgttttcattatctttttatttaggtggatatactacatttttttcagataacaaatataccttccagacagcaacgatttgtgactttaaaaatgtatttataaacaaaaagtgtctattgaagcaatccctgaaaaagaaagctctgataatgcaacgcaccgtcatcaaagggattgttcgtttcgataggcgcaacaaaagttacagattacttgtttacagataa

SEQ ID NO: 3760 - DNA, 321 bp, B.fragilis
acatcaggcgtgcccgcctggttggtcatttcatgttcgggagtgcttgtagccatcgtgaccgcttattgcggaccgattatgttcattggtttggcggttcctcatctttgccgtgccatctttcatacctcggatcaccgcatcctgatgccggccactttgctggcaggtgcttcgttggctttggtatgcaatctggttgcccgcatgccgggctttgagggagctcttccggtcaactccgtgactgcgctggtaggcgcgccggtcgtggcatcagtgttgttccgtaagcgtaaaagtgaattaagtgaataa

SEQ ID NO: 3761 - DNA, 867 bp, B.fragilis
atcaaaatagtttttaatatcataaacaattatagtatgaagaaaaataagattttaattattataccttcaaggtttgcgtcaacccgtttgccggagaagcccttagtgaaaatagcaggaaaagaaatggttttgcgcgttgcagagattgccaactatgtttgtaataaggtagaaggatgtaattacatcgtcgcaacagaccacgaaaaaatcgttaatttctgcaaggagaataatatagctgtaatgatgacttccgagaactgcaaaagtggaacagaaagatgctgggatgtcacaaccaaaattgctgagaaaccggattttatagtcaatctgcaaggagacaatccgttatgcccaccctggtttatagaacagttgattgaagcttggaaaaatgataaggaaggacaggtcttcactcccagccttcatttatcttgggaagagtatgaccggatgaaagaatcaaagaaaatcacaccatatagcgggacaacggttgaagtcgataaatttggatacgcgcttgcattcagtaaagctatgattcccgtgataagaaatgaagaaaaggtcagaaaaattcttgataaatctcctgtcagacgtcatatcggactttattcgtatacttacgacgcgctcaaaaaatattttgaagtagaagcttctccttatgagcttcctgaaggattagagcaaatgagatttttacataacaggatacctgtaaaaatgatagatgtagactatagaaaccgtaaatccatgtccggagttgattcaccggaagatatcgaaagagctgaaaaaataatcgccgaatttggggaattcaatctttcaccggaatga

SEQ ID NO: 3762 - DNA, 2115 bp, B.fragilis
atgttaacttctaattttaccagacaaattatgaaaataaaactgaaacatatttatttctgctcattaatcggaatgggcggattggcactgacttcgtgtaatgattttctggatcgttcgcccatcagtgacatcactccggaagattacttcaacactgtagatcaagtgggaagctatgttatcaattattacgatgactaccttgaaaactcaaatacgactaaaatgtatcaccaaagagcatggaactccggagtggtacgaaatgatgcgaacactgacaatttattgagtgatgacggaaacctggattattttgcgggaaataagcaagtacccgaagggaagaatattcaggaacctctgaatcgtattcgggtatggaattatctttttgagaaagtattacctaaagaaaaagaaggtacaatccccggagatgcagaactgttaaagcaatacatcggagaagcctattttttccgtgcgttggcatattataacgcattggtacgtttcggtgattatcccatcattaccgaagtattgccggatgattcggaaacactgatcaaaaaaagtcagcgtgccccgcgcaatgaagtggcacgtttcatcctaaaagatcttgacgaagctgtcagtcgactgaaggaacgtggttttcagaataaccaacgcatcaacaaacaggctgcattagtgctgaaatcaagagttgcactgtttgaagcaacttttgaaaaatatcatcagggaacgggacgcgtacccggcgatcccacatggcccggagccgccatgagttataacagtggaaaaacattcgatattgctggcgaaataaacttcttcctgaccgaggcaatgcaggcagcggtagctgttgcagaccatgttcaattggcagagaactcgcatgtaatgaatcctccatacaatacactttatggatggaatccttattttgaaatgttcagtcaaccggatctttcgaacgtggaagaagtactgttgtggaaacagtataacctgtcacttaccgtgtcgcattgtgtgggcgcccgccttaaaaacggagaccgtaccggactgacacgttcgttgatcaaaacattcctgatgaaagacggtctgcctatttatgcaagtaatagtactattgatgacagaacggtgtctgacgaaaagaaagaccgcgacgagcgcttgcaattgtttgtatggggagaaaaagatgcctggatgacagatgaaagagcggatacagtgaagaattacaataaggatcaggcgggaaactcagtgacaaatccggtaccggtaccttgggtaaaatctactgtaatcagtgatcaggaacagacacgtgatatcaccggttatcgttcccgtaagttctatccgtatgatgatgaacaaagtaagtcggacgaactgctggggaccaatgcctgtcctattttccgtgcttccgaagcatatcttaactacatagaggcttgttatgagaagaatggtacgctggacagcaaggcacaggaatattggaaagccatacgcagacgtgccggtgtcgatgaagactatcagaagacaatcgcccgcacggatctggggcgcgaagacgatctgggagtttactcaggagaccggatggtggacgctacactttacaacatacgtcgcgaacgtcgctgcgaatttattgccgaaggcatgcgctgggatgacctgaaaagatggcgctcttgggaccggctatttacggagccatatattgtggagggcattaacttctgggatgaagcctataaactttacacaaccgtagataaagacggcaatgaaaaatccgcggtggtagctgatggcagcacgtctgccaacatgtcgccaaaatcggacgggaaatacgtacggccattgcgtaggacacaaaccaataatcagctttatgacggatatacctggaaaaaagcttattatctggaaccactcggcttacaggacttgcaattgtcggccaccaatccggaggatatcaatacatctatgatgtatcaaaatccatattggcctgccggcacaggcaaagcgcttgaatga

SEQ ID NO: 3763 - DNA, 477 bp, B.fragilis
ataaccaattttctaaaacaacaacctatgactctaatcaaatctatctctggtatccgtggaaccattggcggaggcgcaggcgaaggactgaacccgcttgacattgtaaaattcacgtcggcttatgccactttgattcgcaaaacatgcaaatcaaaaagtaacaagatagtagtgggccgtgatgcccgcatttccggtgagatggtaaagaatgtcgtagtcggtaccttgatgggtatgggctgggacgtagttgatatcgatcttgcttctactccgacaaccgaactggctgttacaatggaaagggcttgtggcggtatcattctgactgcatcacataaccccaaacaatggaatgcattgaaaatggttgatgagcatggagaattcctgaatgcagccgaagggcaagaagtacttcgtattgctgctgccgagggagtcgattatgcggatgtcgatcatttg

SEQ ID NO: 3764 - DNA, 408 bp, B.fragilis
aaaattggttatttagtagttttagttcaatgctttctgaaatttacgaatatcgtagaaataggggtttacatattggtttgcactctgatgtcccatcttcgaaggtacaatattgtagccgtacgctttgtagagcacgacatcaaggcgaacgataccacttgcttcaatgtggtgcttcccggtttcgaaaattatccgaattactatacttatccggacgttttccgttatgtggataacggtacttcagtagccggtgtatttacagaggggtcgatgtatgccaaatatggtacgacggatgttcctcccggatggctgcttgctttaaagtatgttaccaattatgcccatgtgagaatgattggtcttcaccacggggctggaagaatccgcgccaat

SEQ ID NO: 3765 - DNA, 231 bp, B.fragilis
agtaccgttatccacataacggaaaacgtccggataagtatagtaattcggataattttcgaaaccgggaagcaccacattgaagcaagtggtatcgttcgccttgatgtcgtgctctacaaagcgtacggctacaatattgtaccttcgaagatgggacatcagagtgcaaaccaatatgtaaacccctatttctacgatattcgtaaatttcagaaagcattgaactaa

SEQ ID NO: 3766 - DNA, 660 bp, B.fragilis
aaaatgtactcgagtacaaagacggtgtcagctttctcggttcttctaccggatgggaggacaaagtggagatgggacacgggccgctctatgggtgtagagttcatggcacagaaaaccataggaaagacaacgggatggctggcatataccctggctaagagtgaccgtaagtttgccacaggaggaataaacaacggcgaacgctttccatataaatatgaccgccgacacaacatcgacctgacactcaatcatcggttcaacgaacggatcgatgtaagtgcttcctggatatttaccaccggaggtacgacaacgatccccaccgaactgacaggtattatccgtccgggcgacaacgactcatcgatagaagagggagactacgtcaagcatcgcaacaattatcgcctccccgccacccaccggttaaatgtaggggtcaacttcagcaagaagactaaacatggcatgcgcatctggaatgtcagcatatataatgtatacaatgccatgaaccccactctgatatatcgcacctacaaaaagactgaatatactcaaggcgaacaagcacaaggcaaccgcataccggtcattcggaaattcactctgttgccttgcattccttcattcagttatacatataaattctaa

SEQ ID NO: 3767 - DNA, 1083 bp, B.fragilis
gtacaaagatttatcgtatttttgccaactcaatatttatacaaacaagttatgctgactaaagtgattgctcaggctcatattgatcattttaccaaatggtttgaacgggccgacaaaatagtaattgtatctcatgtgtcacctgatggagatgccattggttcatcattgggattgtatcattttttggattctcaagataaaattgtcaatgtgattgtccccaatgcttttcccgattttttgaaatggatgccgggtagtaaggatattttgctgtatgaccgttaccaggaatttgccgacaagctgattatggaggcagatgtcatttgttgtcttgactttaatgcgctgaagcgtattgatgaaatgagtgatatagtggccgcttcaccgggacgcaaaataatgatagaccaccatctttatcctgaagatttttgcagaatcaccatttcacatgctgagatttcctctacttccgaactggtgtttcgattgatttgccggatgggatattttagtgatatctccaaagaaggagccgaatgtatctatacgggcatgatgacagataccggagggttcacttataactctaataatcgtgaaatctatttcatcatcagtgagttactctcaaaaggaatcgataaagatgatatttaccggaaagtctacaatacttattccgaaagccgtttgcgtctgatgggatatgtgttatcgaatatgaaggtgtataaagattacaaatccgcccttatttcactgacaaaggaagaacagggcaaatttgattatatcaaaggggatagcgaggggtttgtcaacatacctctgtctatcaagaatgtctgtttttcttgttttctacgtgaggacactgaaaagaaaatgattaagatttctctccgttcagtaggtaagtttccttgtaatcggttagctgcggaatttttcaatggcggcgggcatctcaatgcgtccggaggggaattttacggtactatggaagaggctgtaaaagtgtttgaacaagcattggagaaatataaaccacttttgaaagaataa

SEQ ID NO: 3768 - DNA, 237 bp, B.fragilis
agaacgttatctgacccttatcaaagaacatcccgaactattacaaaatgtgcctttaaagcatatagcctcttatttgtggattacaccacagtcgctgagcagaatccggagagaaatgaaaatgtaatttcggagcttgacacagcgacagagcgggtgaagacctcaacagaggctttgccatactcctctttccatatttctctcgttataccaatcattcgctccatttag

SEQ ID NO: 3769 - DNA, 465 bp, B.fragilis
cgtcaatttccgttcattttattcttgtgtgcaaataacaaatcttttgcatttaaaacacttgttatttgcatccaaagaacaagctttaacactgtgttaaaacaaagtctgttcctgatcgggagtttgattcttcaaacgaaagatttcagctggcttgtgatgcttactgtatatggagtggatagtgtgttgacaatcatacaccggttgttgctacatgaaaatattggtttgcctcaccggaaacatttgtatcagatcatggttaatgaattgagaataccgcacgtggtggtatcgttggtgtatatgattgtgcaaattgtgattatcatcgggtatttatattgccggggttatggtgattggtatttattgggctgtatccttttgctgagtggaatatatattgttcttatgcgcaaatattttcacttgcatcttttacctaaaagataa

SEQ ID NO: 3770 - DNA, 1125 bp, B.fragilis
attttattgttatatttgcatatactaaattttaaagccttattcaatatgttcaattcatttggcaatattttcagactaaccagctttggcgaatcccatggtaaaggaatcggaggagtgatcgatggatttccagcaggtatcgtcatcgatgaggagtttgttcagcaagaactaaaccgccgtcgtccgggacaatcggtaattactacctcccgaaaagaagctgataaagtagaattcctttcaggcattttcgaaggaaagtctaccggatgccctatcgggtttatcgtatggaacgaaaaccaacattctaatgactacaataacctggagaaagtataccgtccgtcacacgccgactacacatacaccgtaaagtatggaatccgcgatcaccgtggcggtggtcgttcttcggcacgtgaaaccatttcaagggtagtaggcggtgcattggccaaattagcattacgccaattgggtattcacatcacggcatatacttcacaggtaggtcctataaaactggaaggcaattacacggattacgatctggacttgatcgaaaccaacccggtgcgctgtcccgatccggagaaagcaaaagaaatgcaagacctgatttacaaaatcaaaggagaaggagataccattggcggtgtactgacttgtgtcatcaaaggttgtcctatcggacttgggcaacccgtatacggcaagctccatgctgcattgggcaatgctatgctaagcatcaatgccgcaaaggcttttgaatatggagacggattcaaggggctcaaacaaaagggatcggaacaaaatgacgtattctacaacaataatggccggattgaaacacgtaccaaccactccggaggtatacagggaggcatcagcaacggacaggacatctttttcagggtagcgtttaaaccggtggctactgttttgatggagcaggaaactgtaaacatagacggtattgatacaacactaaaggcccggggacgccatgacccgtgtgtattgccacgtgcagtgcctattgtggaagctatggcagcaatgaccatactcgactattatttattagatagaatgacacaactttaa

SEQ ID NO: 3771 - DNA, 1113 bp, B.fragilis
aaccaagtgtttttcactcttctctctttgttttcagtaatattcagtatctttgtcagaccaactacacaaacatccggaatgggagatgacaaaaacaaacgaatagattttgtggacttaacgaaaggagtctgcatcattctggtagtaatggcacacataggtggagccttcgaaaaacttgattatcactcgatgattgccagttttcgcatgcctctttatttcttcatctcaggcattttcttcaaatcctatgaaggccttttcggcttcttcatccgaaagataaacaagctgatcatccctttcctctttttctatctcagcgcgttctttctgaaatacattgtatggaaaatcgctcccggagtcttccagcttccggtcagctggacggaactcttagttgtgtttcatgaccatgcgctgatcaagttcaaccctcccatctggttcttgctggcactcttcaattgcaacatcttgttctatctggttcacagtttgcgcaaccggcggttaggtctcatgtttgccctcactttgctgatcgggacagccggattctatatgggcaagcatcagatagaattgcccctttatatggacgtagccatgagcgccctgcctttctacgtagccggattctggattcgccgttacaacttcttcctctttccccatcgtttcgacaagctgattccgttatgcatcctggcagccctggcagtgatgtacttcaccgccacattcgtgggcatgcgcaccaacaattatgccggcaacattttccaattttgggcctcagcctttgccggcatatttatgatcatgcttttctgcaagaagttcaaaaagctgcccgtcatctcgtatatggggcgttactcggtcataacactgggcatacacgcacctttactccattttgaatatccggttgtcagccggtttatccacaacgaatggggacaggccattgccttactgctgctgacgctgaccgtctgcatcattgcgacccccatattcctgaaactgattccgcaagcagtggcacaaaaagactttattaaaaccaaacaatcgacacaacaaggatcataa

SEQ ID NO: 3772 - DNA, 477 bp, B.fragilis
aggacccgcccgggagagaagaatttttatcggatcattgtggaacaacggaaatactggaaatactattgggaacaaaatgaccagacctgttggagttcggcaatgcagaaaagctttaaactgcaaacaaacgaagacgtggtgttgaccgacggcaaacccagtacggaagaagatgatgaaaacggactgttcggcactgtcaataacaagtatgccatatttgacgactcacgtttcaccgacggaagttatacgatgaacgtctataacgatatctacggatggggattctggggacaggagtatatctggataaagacggatgtctccattccgatactcagcattaccgaaaaagaatattattattttagaagcgtgaatctggtcgaatccgatgcctacgacaacaacctgagcgagcctatcgttttcccaaacaattggaaacggaggtaccggaatgggtag

SEQ ID NO: 3773 - DNA, 2742 bp, B.fragilis
ttaatgacgccattgaaagcaaatacgataatatcatccatactactgttgatcctcctgatgcttccgtacgaagctatggctcagcgtcgccgtgtcagggagttgaaagggccggtggtttattcacccccaaagaacgattcactgagagtcgacacactgaaaaacgatacattgaaagccaatgtattgaaggccgatacattgtcggcggaatcggtgaagaaaaagaaacaacccctggacgctcccgttgtatattctgccaatgactctattgtctttacacaaggaggatttgcccatttgtatggagatggaaaggtgaactacgagaacatcgaactgggagccgaaattatcaccatgaacatggacagcagtacggtctatgcccgtggagtgatcgactctgtgggagtggagaaggggaaaccggtgtttaaggatggagagactccttatgaaacgaaggctatccggtataacttcaagagtaaaaaaggatttatcaataacgtcgttacccagcagggggaaggctacgtggtaggtaacaatgcgaagaaaggcgcaaacgatgaactgttcatggagaatggacgatatacgacctgcgaccaccacgatcatccgcacttctatatgcagttgaccaaagccaaggtccgtcctaagaaaaatgtggtaacggggcctgcttatctggtagtggaagatgtaccgttgcctttggccgtaccgtttttcttctttccgttttccagcagctattcttcgggctttgtcatgccgagttatatggatgactccagccgtggtttcggtttgaccggtggtggttactattttgctgtcagtgatctgatggacctcaagctgactgccgatatttttaccaaaggttcatgggccgccaatatggaaaccaattataacaagcgttataaatattccggctcgttacaggccggctatcaggtaaccaaacttggggataaaggtatgccggactattcggttgctaaagacttcaagattgtgtggaatcaccggcaagaccagaaggcgagtcccaacagcactttctcggcaagtgtaaacttcgctaccagtagttacgaacgtaccaatatcaacaacctctataattctcagttgatgacccagaatacaaaaacttcgagtgtaagctactctcgtagtttcccggatcagaagctgacactcgcgggtactttcaacatagcgcaaaccatgcgtgactcttctattgctgtcaccctgcctgacttgaatattactctgagtactattttcccttttaagcgtaaacgtgcggtaggtgaggagcgttggtacgaaaagatctcattgcgttattcgggacgtttgaccaacagcctgaagacaaaagacgaccgtttgtttaaagccggtttcagggaatgggagaatgcaatgcagcataacatcccggtacaggcaactttcactcttttcaagtatttgcaggtggtaccttcatttaattacactgaacgttggtatacccgtaaggtgatgaagagctatgacgaaactacccagaaatgggatacacaccccggcgatacgattcatggattctatcgggtgttcaactattcggccagcctggctttaagtaccaagatgtatggtatgtaccagccgctgtttatgaagaaaaaagagatacagattcgccatgtctttaccccgcagatttcattgaatggctctccaagtttcgggcaattctgggaatattatcgtgatgcagacggtaatgatcagtattactcgccttattccagtcagcagtttggtacagctccgcgtgaaaagtccggaacggttagttttgatgtgtcgaacaacttggagatgaaataccgtaacaagaaagactctcttgtgaaagtcagtttgattgatgaaatcggtttcaatctttcttataatatggctgcaaagaagcaaccatggagtaacctgaatatgcgtttgcgtatgaagttcaagaagtttaataactatacgctgaatatgaacgcggtattcgcaacctatgcctatacattcgataagtcgggtaatgtaatagtgggtgaccgcaccgaatggtcttatggccgcttcgggcgtttccagggatggggatcttccatcaactatacattcaataatgatacctggaagaagttgttcgggaaagataaggataacgatcaaaagaagaaaaaggacggtgtcgacgaagaaaaaggaaattctaccggtgacgaagcggttactgagaagagggtagaaaaagcacaggcggatcgtgacggttatcaggtatttaagatgccatggtcgctgaatgtgaactattcgttccgtatttccgaggatcgcagtaagccgatcaatcgtaatacgatgcgttatccgtttaagtatacgcaaaatatcaacatgtcgggtaacctgaagatttccaataattggtcgtttacattcaattccggatatgatttcgaggcaaaggagatcactcagacttcttgcacgattacacgtgatttgcattgtttcaatatgtctgccagtatttcgcctttcggccgttatcgctattataattttacgattcgggctacggcaagtatcctgcgtgacttgaagtgggataagagaagtcagactcaaagtaatattcagtggtattaa

SEQ ID NO: 3774 - DNA, 1131 bp, B.fragilis
aaatatccaaccattatggcgactaaaattaaattaaacgattgcgtaccttgtatagccattcatccgggtgaaatcattaaggatgaattggatgcaagagaaatgaagcaaaaagagttggcttcacttatgagcatgcctacttcagtactcaatgatattataaagggacgtcgtgctgtaactcctgaagttgctgttttgctacaggaaattttaggaatagatgcttcatattggttatcattacaaaatcaatatgatatagaccgagcaaatataaataagaaaatagtagaacgaaaaaagaatattgagatatggaaagtaatttctcaatattgttctgttaaatatttcgagaaattaaatgttattggaacgaaaatatcagaaaacataaaaataatatattcaattttcggtgtaacttcagttgaagaactaatagcttcgttttcttcagaaaaggaactttcttattttaagaaatctgaacggttaaagagtgaccccattaacattttctcatggaaacattttgctttctatcaaagttcacaaatgctggatgttgccgattttgatgaaaacagtttagaaaggcttgtgcaggaattgaatcaaatgtttgttgtaaacataaacactattgataagacaaaagaaattctatcacgatatggaattaaatttatcatagtgcctaaattcgacaagacaccgattgatggattttctttttggcaaggaaaaaatccaaccattgtattaacattacgattaaacaaaattgataattatgctttcgctttattgcatgagatataccatgtttatatgcatcttttcaacaatagagaacagaaatatattgccatagaaggagctgaaataaataaatgcgaggaagaagcaaataaattcgccaagtgttctttaattggtaaagacttatggaatacattcctcaaacaacattccatgatatctccacatgcaatgcaaatgaaaataaaacaatttgctcatcaacataatatcaatgaggctattgttttaggattttatcagcatgatattaatttgtattctattaaaagctcaatatcaagagagataaaatag

SEQ ID NO: 3775 - DNA, 195 bp, B.fragilis
atccacaaaacatataaagctgaaattcctatatttgtaataaaaaaaagattactgtccaaaagtattataactaaaaaaatcttttacttttacttatatttctccggaatcttcctctcgatgatggcatcaaatacccgtgacaactctttaataaccaaaaaacatttctgtcacttgaaaattgggtaa

SEQ ID NO: 3776 - DNA, 1239 bp, B.fragilis
aatccgagaacgggctttagaaaacctgaagcaaattgcggcaggagaaagggacttcaggttttgaaaacgtcgccccgctctaatcgcctgcacattgccttgtttggtaaacgaaacagtggcaagtcgtcattgatcaatgcattgaccaatcaaaacgccgctttggtatcggacatcgccggtaccactaccgaccctgtatatcaaccgatggaaatacatggtatcggtccgtgtgtattcatcgatacagccggattcgacgatgaaggtgaactgggttccctacgtatcgaacgaaccttacaagctgcggacaaagccgacatcgcactgatggtttgttgcgatacggaactttccgaagagcaacgatggatagagttactgaaagagaggaatatcccctacctgttggtactgaataaagccgatctgttagagaaaccggatgaagtcgccgataaattggaacaacagacaggacaacaccctttaattgtcagtgccaaagaaaaaacgggcatagactcaatccgtcagtctattcttcatcggttaccggaacttaacgagcaaccggatattgtgggagacttggccaacgaaggcgatgtggtactactcgtgatgccacaggatatacaggctcctaaagggcgacttatcctgccacaagtacaaacactgcgcgaacttcttgacaaaaaatgcatcaccttgagctgcacaaccgaccagttggacaatgccctcaaagtcttgtcagctcccccctcattgatcattaccgattcgcaggttttcagaaccgtctacgaaaagaaaccgccacagagccggctaacctccttctcggtattatttgcccactacaagggagacattgactactataccgaaggagcgtatatcatcgaccaactgacagaaaattcccgggtcctgatagccgaagcctgtactcatgctccactgtccgaagacatcggcagagtgaaacttccacgaatgttgcgcaaacgtatcggagagcaactgcatatcgacattgtttccggaaatgattttcctaaggacctgaattgctacgacctgattattcattgcggagcctgcatgttcaatcgcaaacatgtcctgaatcggatagtcaaagctaaagcacaaggtgtcccaatgactaactatggaatagttatcgcatatatcaatggcatacctttccactga

SEQ ID NO: 3777 - DNA, 642 bp, B.fragilis
atctatccgacagaagcttttgctttttatctgggtttgttgatcgggatacgttataaagtagtgcgcagtttgaaatgtttatatgtttttggtatttgtatcttggctatgggaagttttcattgggtgagcagaatgatggaccgtccggtgcaaagcattgttttctataatgtccggggatgtccggtggtgcattgtatcgaagcttgtggcaagtcgtggttggcttatgcggacagcattccggatgaaagacggctttcgcgtgcagtagccggatattggaatagactgcatctggatgttccggttactataacagacaattttcattcgtccggtttttggatgcaggatcatttgcttatgttcggtaataaacgtatctgtatggttagtgacaatcgttggcggaacaaaaccgctgctgaatcgtttaacatagattatttgtatgtatgcaaaggctatacaggaaagttggagtcattggtaggtttgtttcattgccgggaagttattttggattcttctctgtctgcttattataaagaggcttatagtgaagaatgtcgccggttggggttgcattttatctccctttccgacgaaggttctgtgaggtttttgctctaa

SEQ ID NO: 3778 - DNA, 369 bp, B.fragilis
tttatttatttaattaaaacgagtatgaatcaatacgaaaccgttttcattttaactcccgttttgtctgatgttcagatgaaggaagcggtagaaaaattcaaaggcattcttcaggctgaaggtgctgagattatcaatgaagaaaactggggactgaagaaactggcttatccaatccagaagaagtctacaggattctatcagttgattgagttcaatgcagaacctactgtaattgacaagttggaattaaatttccgtcgtgatgaacgtgtaatccgtttcttgactttcagaatggataaatacgctgcagaatatgctgcaaagagaagaagtgttaaatcaaacaaaaaggaggattaa

SEQ ID NO: 3779 - DNA, 1533 bp, B.fragilis
tgcacgcttgcagaatactcctacaagccgtatctttgtaaccctaattctaaatactcaaatatggctttcaccaacaacgtaatgattgtgcgccacaagttgctggcaaaattggtaaatctctggaaagagaacaaattaacgaatgaaattgacagacttcccattgaactgagccctcgccgttcacgcccgctcggacgctgctgtatccacaaagagcgtgctgtatacaaatataaacttttcccgttgttgggtttcgatatgacagacgaaacggacgagctcactccactttcggaatacgcacgccaggcgttggaacgtaaaaacaaacagaaagaaaatatactctgcgtcatcgatgaagcttgttcatcttgcgtacaggttaactatgaggtgaccaacctctgccgtggttgtgtagcccgcagttgctatatgaactgccccaaggatgccatccgtttccgaaaaaacggacaggcaaagattgaccacgacgcttgtatcagttgcgggaagtgccatcaaagctgtccgtaccacgccatcgtattcattccggttccttgcgaagaagcctgtcccgtgaaagctatcagcaaagacgagaacggtatcgaacatattgatgagagcaaatgtatctactgtggcaagtgcctcaatgcttgtcctttcggagccattttcgagatttcccaggcttttgatgtccttgaaggcatccgtagcggtgaaaagatgatagcgatacctgctccctctatactcggacaattcaacacatccatcgaagcagtatacggagcacttcgccagatgggatttgccgatgtagtcgaagtagcgcagggagctatggacaccgtaagtcacgaagctgccgaactgaaagaaaagctagaggaaggacagccgtttatgacaacctcttgctgcccgtcttacatcgaattagtgaacaagcacataccgggaatgaagccttatgtttcttctacgggatccccgatgtattatgccgcccgcatcgccaaggaacgccacccggatgcaaagatcgtgtttatcggcccgtgtgtggccaaacgtaaagaagcccgccgcgatgaatgcgtggactacatacttacttttgaagaaatggcttcgatctttgagggactggacatccaacttgaacagacacagccattctcagtactctatacttcggtacgcgaggcacacggttttgctcaggcaggtggtgtaatgggagctattaaggcctacttaggcgaagaggctaagaaattctccgccatccaggtctcggacctgaacaagaaaaacataggcttgctgcgtgctgctgccaaaacaggcaaagcacaaggacagttcattgaagtcatggcctgcgaaggcggatgtatcagcggccccagtgcccataatgacgctatcggtggacgccggcagttgaaccaggaactgataaaacgccgtgaatcatatgaagaaactcatagataa

SEQ ID NO: 3780 - DNA, 2406 bp, B.fragilis
attggaatagctgaaaaaaactatctttgcatatcaacaacacatcacaaagataagattatgaagaaaaaagtactttccttgctggcattccttccggcatttacgacagtgatggcccagcagacggcagaagtgccggatgtatgtgcatttgtcaacccgatcatcggaaccaatggtatggggcatacatttcccggtgcttgtgctccgttcggacttgtacagttaagtccggatacagatacgattcctcacaacatagatggaacttatcaaagaaatgcgtatgaatattgtgccggatatcagtatcatgatccgacaattgtgggattcagccatacccatctgagtggtacgggacattcggatctgggtgatattttgattatgcccgccacaggtcaactgaagttgaatcccggaagagccggtactcctgacgagggataccgctcccgtttcagtcatgacacagaggttgctcgtccggggtattatgaagtggagcttgctgattatggcataaaggcacaactgacagctactcaacgggtaggaatacataaatatacttttcccgataatgcggacgggcacatcatccttgacctgatacacggaatctacaactatgatggaaaaactctatgggctaatttacgtgtggaaaatgacacattactgacgggctatcgtataacgaacggatgggcacgtaccaattatacatattttgccatctctttgtctcagcccatcaaggattatgggtatacggataaagggaaagctctgtataaaggtttttggcgacggtttaataccgaccgtaattttccggaaatgaccggtcggaagctggtggcttactttaatttcgatacccggcagaatccggagctagtgataaaagtcgctctttcggctgtgagcacagaaggtgcagtaaagaatttacaggcagaggctgccggaaaaactttcaatcaattggttgccgaggcaaattctgcatggaatcgtgagttggatgtactcgaagccaaaggaactcccgatcagttggccatgttttatacttcattgtatcataccatgattaacccgtctgtttatatggatgtagacggtcggtatcgtggactcgatcataatatccatacttccgaaggatttaccaattatactatcttctcattatgggatacatatcgtgcggagcacccttttttgaacttgctaaaaccccggcagaatacggacatggtgcagtctatgatccgtcatcagcagcaaagtgtacatggcatgttgccggtttggagcctgatgggcaatgaaggctggtgtatgagcggttatcatgcagtgtctgctttggctgatgcggttgccaaaggagcggatatatctgtcggggaggctttgatggcaatggatcatacagctaatgttccttattacgaaggagttgaagcttataaaagattgggttatgtacctttcgatcaaagtgggacggctgcttccactacattggaatatgcctatgacgattggactatttaccggacggctctgttggcgggagacgaccagttggccgatctttataagaaaagggcgaataattaccggaatgttttcgacacttcggttggttttgcccgtccccgttatagcaacggagagttcaggaaggaatttgatgcaatgcagacttacggggaaggatttatagagggaaattcatggaatttctctttccacgtgccccatgatgtggccggattgattcgtttgatgggaggtgagaagaagtttgtcagtcggttggatacactgttctcaatggcacttccccgcaaatattacgaaaagaatgaagatattgctgaagtaagtttggtaagaaggtatgtacatggcaatgagcccagtcatcacattccgtatctgtatgcctggacttcccaaccctggaagacgcaatactggctgcggacggtcatgaaccggatgtataaaaatgatattgacggcctgggcggcaatgacgattgcggccagatgtctgcctggtatctgtttacggcaatgggattttatccggtttgcccgggtactgaccaatatgtattgggagcaccttatctgccgtatatccgtatgaatctgcccaatggccgcactttcgaaataaaagcgccaaaggtgagcgatcgtaactgctatgtccggcaggtgaagctgaacggaaaggtttatgataagatgtatattactcatgccgaccttttggcgggaggaacacttgagtttgatatggctgcttctccgaataaaaagagggggcttgccaaagaagctaaaccttattccatgtctgaagagtag

SEQ ID NO: 3781 - DNA, 546 bp, B.fragilis
gatatgaaagcatttttttctttcgtagcagccttggtactttcactgtcgatggctgctcagaataaatcattctatgacttcacagtgaagaccatagatggcaaagagtatccactgtcaggtctgaaaggtaagaaggtgctggtagtgaatgtcgcctccaagtgtggactgactccgcaatatgcagagttgcaggagttgtatgatcagtataaagatcagaattttgtgattatcggctttcctgccaataacttcatgggacaagagccggggacaaacgaagagatcgccaaattttgttcggtgaactatgatgttaccttcccgataatggccaagatatcggtaaagggtaaagatatggctccgctttaccactggttgacagagaagaagctgaacggaaagcaagatgcgccggtacagtggaattttcagaagtttatgattgatgagaatggaaattgggttggttttgtagctcccaaagagagtcctttttcagagacgataatcagttggatagaaaaaaagtaa

SEQ ID NO: 3782 - DNA, 2364 bp, B.fragilis
agaaaggaggctttagtgagacgactcaaaaactcaaaacaatttaataagaacatgaaaaaactgattctgcttctcattttgattttttcattgcctgttgcagcacaaaatttcacaatcgggaagagcactttccttttgaatggcaagccttttacggttaaggctgccgagttgcattatacccgtattccggctccttactgggagcatcgtatcgagatgtgtaaggcattggggatgaatacgatttgtctttatgtattttggaacatccatgaacagactgagggacagtttgactttaccggacaaaatgatatagccgctttttgccgcctggctcagaagcatgggatgtatgtgattgtacgcccgggtccttatgtttgtgccgaatgggagatgggcggacttccttggtggttactgaagaagaaagatattatacttcgtacactcgatccttattttatggagcgcactgcaatctttatgaaagaagtcggaaaacagcttgcacctttgcaaattactcgcggaggaaacattatcatggtgcaggtagaaaatgaatatggtgcttatgcagttgacaaaccctatgtttcggctattcgtgatatagtgaaaagtgccgggtttaccgaagttcctctttttcaatgtgactggagcagtacctttgatcggaatggattggacgatttgctctggactatcaattttggtacgggagccaacattgaacagcagttcaagcgtctcaaagaggctcgtccggagactccattaatgtgtagtgagttctggagtggatggtttgatcattggggacgcaagcatgagacccgtcctgccaaaagcatggtgcagggtatcaaagatatgcttgaccgtaatatttcattcagtctctatatggcccatggaggtactactttcgggcattggggtggtgccaacaatccgtcttactccgctatgtgtagttcttacgattacgatgcgcctatcagtgagccgggatggactacggacaaatatttccagcttcgtgatctgctgagaaattatctgcctgcaggagaacaattgcctgagattcccgaagcttttccggtgattgagatacctgaagtggagtttactcagattgctcctctcttttccaatttgcccgaggctaaagagagtatggatatacaaccgatggaggcttttgatcaggggtggggaacgattttgtatcggactactttgcaggagcctgtcgaaaatggcactacgatgaagatcacagaagtacatgattgggcacaagtttttgccgatggtaaattgttggctcgtctggaccgtcgtcgtggtgaatttgtcttgcaactgccggctttgaagaaaggaacgcgtatcgacatcctggtagaagctatgggacgcgttaactttgatgagtcgattcacgatcgcaaaggtatcactgaaaaagtagaacttgtccgtggaaagcaatctgcagagttaaagaattggacggtttatagttttccggtggattattcgtttgtgcaagataaaagatataaaaatgggacagctcagactatgcctgcgtattataggactaccttccgtttggataaagttggcgatacgttccttgacatgagtacttggggtaaaggtatggtatgggttaatggccttgttatcggacgtttctgggagattggtccgcagcagacactcttcatgcccggttgttggctcaaagagggagaaaatgaaattattgttcttgatttgaaaggccctgagaaagcatctatccgcggactgaagaagcccatcttggattggttacgcaatgaaggggcttctacccatcgcaaagagggtgaacaactggacttgagtcgggaaactcccgttgccgaaggtacgtttgttccgggcaacggatggcaggaagtttgctttgatcgtcagagtatcggtcgttatttctgccttgaggccctttcggcacaaaaaggaaagaagatagcagccatcgccgaacttgatgtactgggtgccgacggtaagccaatttcacgtgaaaagtggagaatacgctatgccgacagcgaagagacacgtagcggtaactgtacgggagataaagtgttcgaccttcaggaatccacttactggatgacggtggctaaagatgcttatcctcatcaattagtcatcgatctgggtggagactataccgtaaccggtttccgctatttgccccgtgccgaaaagggatatcccggcatgataaaagattaccgggtgtacgtcaaaggggaagattttcaatactga

SEQ ID NO: 3783 - DNA, 1080 bp, B.fragilis
caaaaccattttaatataaagagtatgagaagaaaaataatgatggcaacattgattgtcatagctgtaaattttatctggagtggacaaccggtaaaagcatgtacgcgtgcagtatatattggtccggacaatatggtaatcaccgggcgtacaatggattggaaagaggatattcagtctaacctgtatcttttccctcgcggtatcaaacgggccggatataataaaggaaatacggtagagtggatttcgaagtacggtagcattgtagcaaccggatatgatatcggtacttgtgatggcatgaacgaaaaaggactggttgccagcttgttattcttgccggaatctatttatgtccgtcctaatgatactcgtcctgttatgggtatcagcatttggacacagtatgtgctggataattttgctacggtaagtgaggctgtagcagagttgaagaaacagactttccgtattgatgctccggatatgcctaatggttcggcatctacattgcacatggctatcactgatgaaacgggtaattccgctgttttggaatatatcgatggaaatctgattattcatgaaggtaaggagtatcaggtgatgactaattcaccccgttatgatctacagttggctgtgaatgattattggaaggaagtaggtggtttaaatatgctgccgggcactaatcgttcaagtgatcgttttgtacgcgcttctttctatattcatgctattccgcagacttcggatgcaaaaattgccgtaccgagtgtgttgagcgtcatgcgtaatgtttctgttccttttggaattacgactccggataagccttacatttcttccactcgttggcgttcggtttccgatcaaaaaaatcgggtatactattttgagtctactttaactcctaaccttttctggatagatttacataaagtcgattttagtccgaatgcaagtattaagaaattgtctttgactcacggagaggtttatgcaggagatgtagtgaaagatttcaaagacagtagatcgtttacatttatgtttgaattacccaaataa

SEQ ID NO: 3784 - DNA, 1416 bp, B.fragilis
ataaccaattttctaaaacaacaacctatgactctaatcaaatctatctctggtatccgtggaaccattggcggaggcgcaggcgaaggactgaacccgcttgacattgtaaaattcacgtcggcttatgccactttgattcgcaaaacatgcaaatcaaaaagtaacaagatagtagtgggccgtgatgcccgcatttccggtgagatggtaaagaatgtcgtagtcggtaccttgatgggtatgggctgggacgtagttgatatcgatcttgcttctactccgacaaccgaactggctgttacaatggaaggggcttgtggcggtatcattctgactgcatcacataaccccaaacaatggaatgcattgaaattgctgaatgagcatggagaattcctgaatgcagccgaagggcaagaagtacttcgtattgctgctgccgaggagttcgattatgcggatgtcgatcatttgggatcttatcgcaaagacttgacctataataaaaaacatatcgacagtgtattggcactcgatttggtagacgttgaggctatcaaaaaagctgatttcacagtggctatcgactgtgtgaactctgtaggaggtatcatcctgcccgaattgttggaacgtctgggggtgaaacacgtcgaaaaactctattgtgaaccgaccggaaactttgcccacaatccggaaccgttggaaaaaaatctgggagatatcatgaacctgatgaagggtggaaaagctgatgtagcgtttgtcgttgacccggacgtagaccgtttggcgatgatctgcgaaaacggtgtgatgtatggtgaagaatatacactggttacggtggcagactatgtattgaaacatactccgggcaatactgtatccaatctgagttctacccgtgctttgcgcgacgtaacccgcaaatatggtatggaatacaatgcttctgctgtaggcgaagtaaatgtagtgaccaagatgaaagcaacaaatgccgtgatcggtggtgaaggaaacggtggagtgatttatccagccagtcactacggacgtgatgctttggtaggtatcgcattattccttagccatttggcacacgaaggtaagaaggttagtgagttgcgtgcaacttatcctccttatttcattgccaagaaccgtgtcgatctgactccggaaatcgatgtagatgccattcttgctaaagtgaaagatatctataagaatgaagagatcaatgatattgacggtgtgaaaattgactttgccgataagtgggtacacttgcgtaagagtaataccgaaccgatcatccgtatatatagcgaagcatcgactatggaggctgctgaggagatcgggcagaagattatgaacgtaatcaacgaattggctaagtaa

SEQ ID NO: 3785 - DNA, 915 bp, B.fragilis
actgacagctacaaccggtaccggcattgggctggtcaatctcgacaaacgctatcgcctcttgttccgacaagaaatacaaatcacagaagacagaaacttcaccgttcgtatacccctcatccggaaagacctatgaaagcaatcatcattgaagacgaaaaagcagcggtacgaaacctgacttcactactcggcgaagtctgcccgcaaatagaaatcgtaacggaactcgacagtatcgccgataccatcgagtggttcaccgatcattcaatgcccgatctggtatttatggatatccacctggcagatgggtcggcatttgagatctttgaacacgtccacatcacctgccccatcattttcactactgcctatgacgaatatgccttacgggctttcaaagtcaacagtatcgattatttactgaaacctatcggaagacaggatatagaacaggcattagaaaaactgaccctgttcagttccggcaactccaaacctaccggtccggaaacaaacgaacttgtgaacctgatgcgtatgttaaaaaagcaggaaagctataaaacccatttcctgattccgataaaaggcgataaactgctccccgtttcggttgatatgatcctgttgttctacatcagagattgccaggtgaaagctgttctgacagacggaacggaatattcattcccacaaaccctcgacgaattgaccgaatgtctggacccgacactctttttccgggccaaccgccaatatctcctttcacgggaagccatcaaggatatagacctctggttcaacagtcgtctttccatcaatcttcgtcattcggtatcaggagagaagattttagtcagtaaagcacgtgtagccgaatttaaagagtggttcagcgttaaataa

SEQ ID NO: 3786 - DNA, 258 bp, B.fragilis
agattttctcttctacttcccccaaagaagctgtgtagagacacttttcaccacggaacacagagtaacacagagttttttttgttaataatcaacaatttaaaattgccactgtgttactctgtatcttctgtggtgagttttaacaccttaaattactttttttctatccaactgattatcgtctctgaaaaaggactctctttgggagctacaaaaccaacccaatttccattctcatcaatcataaacttctga

SEQ ID NO: 3787 - DNA, 882 bp, B.fragilis
acaatgaaatatacagaccgggaacttgaccgattactggagaaacttatcgcatccacccgctcgcccagaggaaaattctcggcagcggcaagctatcagatattagagaaacgattgccgcgtccggcacttcgcctcttctctttacgcaccttgtcggcagtagctgccatcgctttgctctgcttcataggatggaacacttactgctatctgaaacctgccgccctacagacaatttccacactggccgatacgcggaccatcaaactgcccgacggaacggaagtgacgctgaaccatttctcgtcactcacctatcccgaaaagtttaagggagaacacagggaagtgaacctgaaaggagaagcgtatttcgaagtgacgaaaaataggaaacactctttcatcgtacagacagagtcggtcaatgtagaggtactgggcactcactttaacgtagagtcctatccggacgatccggaagtgaagaccacgctactcgaaggttctgtagccgtgagcaataaaagcaattctgtacgtatcgtcttgaaaccaaacgaaagtgctatatataataaggagaaaaaaagcatgacccttgaagtttcagaccgcgttgccgaagagatagcctggcggaacggagaattgatttttaccaatctccccttgcaggagattgcccgccagttgtccaacacatttggcgtagatatctccataacagacactgctttgcagaattaccggatcacggcacggttctccagtgaagaaggtctcgaccagattctcgatctgctacatactgttggcaatttcaactattcatacaataataaagaaataacgattactactaaacttaactag

SEQ ID NO: 3788 - DNA, 1110 bp, B.fragilis
cggcgagaatacagaaataatccggtgtattgtcttatctttgtccccatgaaacgaatccgagctatatacaacgataaatacctcctatccaccctcatcatctcactggcagtggcggtgcttatccattttcccgaatcagtctctctttttgacggatttgagagtcataccctttttcccgggatgaaattcgctgatgtagccaacgagatcctctttacctttttgtcattgctgattctgtttgcagtcaacacccgactgtttcatttcaatcagacctcaatgaaaatcacatggcaaaaaattattctctcttttgtactaacctggatattaagcaatttcctgggacaatgctttgtatatttgcacaagacatttgatattcccgctatagatgccatggtgcaccactacctgcatccattacgcgatttcattatgtctagcctagtgaccagcagttgctatatcatctacctgatccgtcgccaacaacaagtaattgttgaaaacgaacaattaaaggcagaaaacatacgcaaccagttcgaagtgctgaaaaaccaactgaacccacacatgcttttcaattcgctcaatacgctgcgttcgctcgttcgtgaaaatcaagaccgggcacaagattacatccaggaactgtcacgcgtattacgatacacattgcaaggcaacgagtcgcaatgcgtcactctacgtgaagaaatggactttgtgtcagcctacatctttctccttaaaatgcgttttgaagataatctgcgattcgagatcaatataactcataattccgaagagtatttgcttccccccatgtccatacagatgctgattgaaaatgccgtaaagcataatgaaatcagcaaccgccgtcctcttaccatcacaatcgcgaccgattcggaagaaggactcctggtaagcaatcccatacagtctaaactgacagctacaaccggtaccggcattgggctggtcaatctcgacaaacgctatcgcctcttgttccgacaagaaatacaaatcacagaagacagaaacttcaccgttcgtatacccctcatccggaaagacctatga

SEQ ID NO: 3789 - DNA, 1398 bp, B.fragilis
atagatttgtatctttgcaccctcaaaataataggtatgacaggacaaaagacgcccactgcgctgggcaccgaaaagattggaaaactcttgatgcagtatgccattccggctattatcgctatgaccgcatcttcactttacaacatggtagacagcatttttattggtcacggggttggtccgatggctatttcggggcttgctctgacatttccgctgatgaatcttgcggcggctttcggttcgctggtcggagtgggggctgccacgctggtttcggtaaagctgggacaaaaagattacgatacggcgcaacgtgtgctgggaaatgtattggtgctgaatatcatcatcgggcttgcttttacgatacttacccttatttttctcgatcctatcctttattttttcggaggcagcgacgagactgtggggtatgcccgcgattatatgaaagtgatcctttatggtaatgtcattacccatctttacctgggactgaatgccgtgcttcgttcggccggtcatccgcaaaaggcaatgtatgccactattgctacagtggttatcaatacgattctcgatcctctgtttatttacggcttcggctggggcattcaaggagcagccatagccactatcctggcacaggtcatttctctgatgtggcagttcaggctattcagcaataaggaagagttgctccattttcatcggggcattttccggttgaaacggaaaatcgtattcgactcgctcgccatcggtatggctcctttcctgatgaaccttgcgtcgtgttttatcgtaatcctgattaaccaggggttgaaaaaatatggcggagatcttgctatcggtgcgtttggtattgtcaatcgtcttgttttcttgtttgtgatgattgtgatggggctgaaccaagggatgcagcccatagccggatataatttcggcgcccggctctatccccgggtgacccgtgtgttgaagcttaccatttatggagccaccattgtaacaactacgggtttcctgatgggaatgttgatccccggcttggccgtatctatctttacttcccacgaagaattgatccgtcagtcggccgaaggacttcggattgtggtgctgtttttcccgatagtcgggttccagatggtgacgtcgaacttctttcaaagcatcgggatggcgagtaaagctatctttctgtctatcacccgtcaggtgctgatactgattccctgcctgttgatcctgccccggtatttcggtcagacaggcgtatgggtaagtatgcctgtttccgacttgatagccagtctgatctcggcagggatgttgtggtggcagttccgcttgttccgtatccatggcagacaggctgcctga

SEQ ID NO: 3790 - DNA, 357 bp, B.fragilis
aatccttatctttgcagaaagataacgaattgcatgaatatctatacagaagatgaagcactaattgagttgttggaagagggttgcaccaacgacaaaagatacaagagacttcctaaggatgtaatcaaaggttatataaaagcatataatcatttaaaagcagccacaagaatagaagatttattcagaatcggaagtctgcattatgaacgattgaaaggagacttaaaagactttgaatcggttagatgtaccggacggtggagattaatatttcaaagctccacaatagacggttcattgataattactgaaatagaattaatagaaatatccaaccattatggcgactaa

SEQ ID NO: 3791 - DNA, 1599 bp, B.fragilis
cctggctgccaatttttctccgatctcttttccgccactgcccaactgacggccgatattgatgacataattaccattcatagtacttttgtatattggttcaatagcaaacatacacattatttccgaaagaagaaaataaataatgtaccaatatacagagtgccgcatttcttatcaattggtaacttttatccattttcagagtcgtatctttgcagccgcaaaaaaataaacattgtttttatgaaggacagcattgacttcggaaatatggaaattccgagactattcaggaaattattgattccaacagtacttggaatggtcttttccgccgtgtttgtaatcaccgacggtatatttgtcggtaaaggtataggcagtgatgccctggcagcggtcaacatcacggctccgctatttatgataaccaccggcatcggactgatgtttggagtgggcgcatctgttgtagcttccattcacctgtcacaaggtaaacgaaaagttgcgagtatcaacatcacacaggcacttgccttttcggccttacttattctagtgctatcggcactctgctgctatttcgcagagcctatcggccgattactcggcagctcggaacggttgttgcctctggtggtggagtatatgaattggtacgtacctttcctcgtattctacctgctcctaagcgccggcatgttttacatccgcctggacggatcgcccaactatgccatgatgtgcaacgccgtatcggccattatcaatatcatactcgattatgtcttcattttccaattgggctggggaatgatgggagctgcttttgccaccagcctgggcactatggtcggcggattgatgacactcatttatctcctccgtttttcccgtaacgtaggtatttaccgtatcaagctgagccggaaaagcatgcggcttacctgccgtaacatcggctacatgatcaggctgggatcttccgcctttatcagcgaggcatccattgccagcatgatgttcctggggaattatgtatttatcagccatttgggagaaagcggtgtagccgcattcagcattgtatgttacttctttcctatcatttttatggtatacaatgccatcgcccaatcggcacaacccatcatcagctataatttcggacaacagaacccgggacgggtcgcacgtaccatccggttggcattgaagacagctttaggctgcggcatttttttctttgctgccactctggtattcaatcaccaaatagtcgggctgtttatcgataaaagctaccaagcctatgatattgcggtaaacggtattccttactttgcagtcggctatctgttttttgcgctcaacatagtgggcatcggctattatcaaagtatcgaacgtgcccggcgcgccactgtcatcacccttttccggggaacattgttcatgctggcaggtttcctgctcttgcctccggtgctgggagtaaggggcatttggctggccgttcctttgggcgaactgctgaccttattgcttattatcggaatttacctgaaggactctttcgccgttcgccgatga

SEQ ID NO: 3792 - DNA, 510 bp, B.fragilis
cctttcatacaaagcactatgggactcatttatttagtcagaaagaaaaagttcagaacagccgaagggatcagagaactctattttgccatccagcggaaacttcagaaaagaggcggcaagaacgaagaagaccttgccgaaatcctttcggcaaacagttcacgaagcaaaggggaagtattgagcatcctcaccgatctgccggacgtgatagaagagatattgaaaaatggagaatccgtatccatcagagggttgggatcgtttcatgcctccattacaagcaatggcttcgagcatccggaagatgtattgcctcacgaggtacgggtatccaaagtatatttcattgccgaccgcaagtttacccaacgtgtcagccggatgaaattctttcgctacccactatccaaatatttcccaaaggacttgttacgacccgaaacaatcagggaagaagagactcgggaagaggaaccggagttcattcctgacgatgacgaatga

SEQ ID NO: 3793 - DNA, 438 bp, B.fragilis
atatcccggcaacttacctttgtaccgacattcaaacacttaaagactatgtttaaagccattgtacgtttttccataaaaaagaaattatttgtaggacttactacactcttccttcttatcggaggcatatatgcaatgttgactctgccgatcgatgccgtaccggacatcaccaacaatcaggtacagatcgtaacagtctctcccacacttgcccctcaggaagtagaacaattaatcacgatgcccatcgaaattgccatgagcaatatcatgaacgtggaagatattcgtttcgtaagtcgctttcgattgtcggtggtaacagtcgtatttaaagaaagcgtaccgaccctcgatgcccgacagttaattaacgaacagattcaatcggtagccggagaaaatccaccggagctgggcatgccgaaatga

SEQ ID NO: 3794 - DNA, 723 bp, B.fragilis
gaaatgcggcactctgtatattggtacattatttattttcttctttcggaaataatgtgtatgtttgctattgaaccaatatacaaaagtactatgaatggtaattatgtcatcaatatcggccgtcagttgggcagtggcggaaaagagatcggagaaaaattggcagccaggttaggcatcgatttctatgataaagagctgattaatctggcttcggaggaaagcggactctgtcgggagtttttcgagaaagccgacgagaaagcctctcagggtattatcggcgggttgtttgggatgcgttttccttttattagtgatggtgccatgccttgcaccaattgcctgagcaatgatgctctttttaaaatccagagtgatgtcatccggcatcttgcggcaaataaatcctgtgtgtttgtggggcggtgtgccgattacatcttgcgtgaacatccccgttgtgccaatattttcatttctgcttcgcaagaggatcgtatagcccgtctgtgtcgcatccacggaatttctgaagaagcagccgcagaaaaaatgaataaggcggataagaagcgttcagaatattataattactatagctataaaacctggggagcagctgcgacctatcatctttgcatcgattcttcggtattgggaattgatgaaacggtaaggtttatagaagaatttgtggtgaagaaactggctttgtaa

SEQ ID NO: 3795 - DNA, 2340 bp, B.fragilis
tatcatattaaaaacaatccaatatttattcctatgacaaaaccttcttacaaacagtggatagcagcctgtactctcacgagtacattgctattgggagcttgcggttccgctcccgttaccagagacgcatcaatcgtaccgttgcctaaccaaattcaacaatccggcaacgcttttgtactaaccccgaacactacaatcggtaccaccgacccggaattacagccagccgcccaatacctgaaagaaattctttcggccgccacgggctacgaccttcaggttaaagagggcaaggggacaatcactcttgcgaaagccaacatcgaaggaaaagaaggtgcctatacactttcggcaaaatcagaccggatagacatcacaggcaactcttatggaggggtgatagccggtatcgaatcgcttcgccagttattcccaccgcaaatcgaatccaaacaaatcgtagacagtgtggcatgggccattcccacggcagagattcaagacgccccccgattcgagtggcgcgggattatgctcgatgtatcccgtcacttctacaccaaagaggaggtaaaagaattactcgacctgatggcactctacaaaatgaataagttccactggcatctgacagacgatcaaggttggcgcatcgaaataaaaaaatatccgttactgacggagaaaggcgcatggcgtacctttaattcacacgacagatcgtgtatgaagtccgctaaatcagaagacaatccggattttctgattccggaaaacaaactccgcatcatcgaaggcgacacattatatggcggatactatacgcaggaggatatcaaagaagtgattgaatatgccaaagtacgcgggatagatatcattcccgaaattgacatgccgggacatatgttggctgctgtcagcaactattccggagtagcctgtaccgataaagtaggctggggaaccactttctcctcacccgtctgccccggaaaagaatcggcaatggaattctgtaagaatgtatatagtgaactgatcgacctgtttccctacaaatatgtacacatcggaggagatgaagttgaaaaagcaaactggaagaaatgtcccgattgccagaaacgtatgcgggataatcatctgaaaaccgaagaagagctgcaatcctggtttatccacgatatggagaaatttttcaatgcaaaggggaaagagatgatcggctgggacgaaatcatcgaaggcggactgagcccgacggctaccgtaatgtggtggagaagctgggcaaaagatgctcccgcaaagacaactcaacaggggaactccatcattttcactccaaacggacagttctatctggattatcaggaagacaaaaactctgtacgcaatatttataacttcaatccggcaatcgaaggattgacttccgaacaacaggcattagtcaaaggcgtacaaggaaacatctggtgtgaatggattccttcacgcgaacgcatgcagtatatggctgttccacgcttgctggctattgccgaactgggttggagccaaccctcacaaaagaactggaatgactttgcacaacgcatggcaaaccaattcgaacgcctcaacatcatgggtatcaattatcgcatccccgacttggaaggcttccatcgcaacaatgcttttatcggtgaaggaaccgtaaaggtaacctgcctcgatcccaatgccgaaattcattatacgacggacggcagcactcctactctgcaatcgcctaaatacgaagggcctattcaagtaaaagaaacaacggactttacgttccgcaccttccgtcccaacggaaaagccggtgacatctcccggacacgcttcatcaagagcgaatatgctccggctacgactgtcactccctctgccaaaggattgcaggctgaatggtatgagtttaaaggcaacaagtgtgcagacatcactaaagcaccgctgaacggaacttacccgatagaaaaagttatgattcccgaaaaggcaaaaggaaatataggactggttatcaaagggtttattaatgtgccgaaagacgatatctatacctttgcccttttgtcggatgacggcagtacgctggtaatagacggtgaacaggtgatcgataacgacggaccgcacgggccgcgtgaagttatcggccagaaagcattatcgaaagggtatcatccgatagaagtacgctattttgaccaaaacggtggccaactgaaaatgacggtaaccggcactgaaggaaacgaaattccgacaagtgacttatatgcaaactaa

SEQ ID NO: 3796 - DNA, 1743 bp, B.fragilis
ttaacacctaaaggtttcttaatccggaagtttatacctacttttgcacaaatcttcaaaaaacgtgcaatgataaaagaaaacttcattaaactctacgagaacagtttccgtgaaaactgggatttaccttgctacaccaactatggcgaaccggaaagttatacctacggtgaagtagccgaagaaatagccaaacttcatttactgttcaagcactgtagtttgcgacggggagataaaatagccgttatcggaaagaataatgcccgctggtgcatcgcttacatggctaccatcacatacggagccatcatagtgcccatcttgcaggacttcaatccgaacgacgtacaccatattgtcaatcattccgaatccgttttccttttcaccagtgacaccatctgggagaatctggaagaagaacgcctgacgggtatccgtgctgtcttttcactgaccgacttccgttgcctgcaccagagggacggagaaacagtacagaaattcctgaagcatatcgatcagtacatgacagatacttatccgaagggattccggaaagaagatgtgctctacaccaccctgtccaacgataaggtgatgctgctgaactatacttccggcaccaccggattcagcaaaggagtgatgctgacaggcaacaacctggccggcaacgtgactttcggtatccgtacggaactgctgaaaaagggtgataaagtgctttctttccttccgctggctcatgcttatggatgcgccttcgactttctgacagccacggcagtcggtacgcatgtaacccttctcggtaaagtgccctcacccaaaatcatcatgaaagcattcgaagaggtgaaaccgaatctgattattacggtaccgctggtcatcgagaaaatctataaaaacgtgatccagcccatcatcagcaaaaaaggaatgaaatgggccttgagcattcctctactggataatcagatttatggccagatccgcaaaaagctgatcgatgcgcttggcggacgcttcaaagaaatcattatcggtggagccgccatgaacccggaagtagaagagtttttccacaaaatcaagttccccttcaccattggctacggcatgacggaatgcggtccgcttatcagttatgctccttgggacaaattcgtcccctcttcatcgggcaaaatactcgatattatggaagcccgcatctataaagagaatcccgaagccgagaccggagagattcaggtacggggagagaacgtaatgaccggatattataagaacccggaagccactcaggaagtgttcactaaagacggatggttgcgcaccggtgacttaggcaccatggatgacgaaggcaatatcttcattcgcggccgactgaagacgatgatcctcagttcaagcggacagaacatcttccccgaagaaatcgaggctaaacttaataatcttccatttattcttgaaagtctcgtgatcgaacgaaacaaaaaactggttgccctggtctacgccgattatgaagctttggactctttaggactcaaccacgaagacaacttaaaaacgatcatggacgagaatctgaagaatctgaataataatgtagccgcctacgaaaaagtaagccagatccaactctaccccactgagtttgagaaaactccgaaaagaagtatcaaacgctatctatataacagtatagcagaagattag

SEQ ID NO: 3797 - DNA, 210 bp, B.fragilis
ctggaatataataatctattaaaatacacacacatgaaaggcttattaaagaatttaggattgctattaatcttagtcggagtaatcattctgattgcttgctctctgaccggagaagtaaacaacaacgctgtcttgggaggctcgatagtattggtggtactcggactgattacttatattgcgataaacaaaagaattgcagattaa

SEQ ID NO: 3798 - DNA, 1434 bp, B.fragilis
aacactaataagatgaaaaaacttttattaatcctcctactggtactggcaggagaaatcagcgcacaacaagcagcaacgattgtagtcaagactaccccggacaacgaaattgcttattggcctacaggcaaagaacacctgttctgcattgctctgggaaccaaagcacaagccggccctctgggagaatttgtccatcaattccgcaccgaccgccccggcatggtgcaggtatggacccaagggagtgattcttttacactctacctgacaccgggaagcaaagacaccattaccgtgaccaaagataccctgatcatcagcggtacaaactcggcctataaccgatgcctgaaaacagtgaacgattatcagaaatacagcgataaactggtgtacatgcagccgcacgaactgcgaggaatcacttcactggagcaatatcaccggctggcagacgccagaatgcggcaggcactcgacgctgtaaatacttccggactcaatgaagagtttctcgcggaacagcgtgcacacatcgattacatccgccgatctatatttatacacattgcaaggcagctgtcgagaaaagaaaaactacccgaagattggcaaagagaactgacagaagtcatcaattcatccgtcaacggtgattatctgcgttcctaccgcggaatcggattctttgtaaacgacctggttatgatgcagttcaccaacctcgaaaacggtgacctcaaagagataaaggattacgcctccttcctcttcgaccggtatcggaagttcttcacaggagacaatctgcaatacatgcaggcccagcttatctacgaagatgaatttcagggtagcaaaactccttcgatcccccaactatacgaaacttatagggcagagttccccaacagtccttttttgaacgtactcgaaccgggcgttaaagaaaacctgcgctttcagaatagccgtatcaccgacaaagactatcatattctgacatgcgactccaccatcaccagtctggaggatgcggtaaaaccctttaaaggtaaagttgtctatatcgatgtatgggctacctggtgcggtccctgcctcaaagagttccaatacctgcccgccctcaaggaaaaagcgcacaacatggacgttgtatacctatacatttcgatagaccgtccggaggagcggaagaaatgggaaaagaccatcgcataccatcaactgaaaggttatcatttattagtaaacgaaaagttaggaaaatcgctatacaccgaattgggaaacgaacggcaaatactgagtatcccctgctttgtcattattgataagacgggaaagatagtcattcgccatgccgcagcaccgagtgaacccgaaaaagtgatcgaacagttgagcacctattataacaagtaa

SEQ ID NO: 3799 - DNA, 1272 bp, B.fragilis
aaaagtaataaaaaaaatccatttacactgagtagatttcgaaactctgtttgtctttttatgaaaagaagaaaaatggagaaaaatcactatatacattatactgctgccgatttgttgaatgacgggactttcctggattcgatgcaacaccctacggagcaaagtgaaaagttctggtcacaactggaaaaggaaaatgaaacttttgccggagaattacgtatggcccgaagctttttaatggctgtggcggaaagccctcaaaaacggatgacagacgatgaagtggggacactttgggagcgaattagccggcaggtagcgatggagaaaagagtgaaaagaaaaaaacagttgcttttcttacgtgtggccgggattgctgcttgcatatcagtgttggcattgagcagttactttgttttttcacttatttcattttatgaagaaagttcttgttacagtttggccggtatttccgagccggatagcagtaatgacatacagctgattttatcggaaggacgtaagttggttatggatgggaaagaaagcaggttgcactacaaggaaggtggtaagatagctattagttccggaaagacccaattggacgaagaaaatgaaaccggttacaatcaattaattgttccttcggggaaacgttctttcataactttctccgatggtacccgagtagccgtaaatgccaatacccgtatagtatacccgtcagagttttcgggacataagcgggaaatttatgtgaatggagaagtctatcttcaagtatctcctgataaaaagcatcctttcgttgtgaaaaccaatcgcatggaagtagaagtgttgggtacggaatttaatgtaagtgcttacgattttacaaaaaatcaatcggtggttctagtatcaggtaaagtagaagtggatacatataaatatcctaaaaaagttctgaagcccaatgatatgttgacttatgacggacaagacgacgggctacgggtaaatacagtagatgtgtctgaatatataagttgggtggatggttattattgtttcaaccatgagaagattgaaatcataaccgaaaagctatctcgatattatggaaagcgtgtcatacctgattccggattgataggattgacttgtagtggtaagctcgatttacgagacgatttacgggatgttctggaagtattaagtaaaactatacctgcacaaatagagaccagagataattattttttattaaccaagtga

SEQ ID NO: 3800 - DNA, 2232 bp, B.fragilis
tcagaaaccaatgtagtagtcatgaaaaagcgaatctgttttgtccttatcctgtgtatcagtctgtttgttttctcacctgtacatgcccagcagcgtaagagtgttgctgtggtcttgagtggtggaggtgccaagggagtggcccacatcggcgctctgaaagtgattgaagaagcaggtatccctatcgattatattgtcggaaccagtatggggtccatcatcggcgggctttattccatcggttatactccccatcagctcgatagcatggtcaatcatcagaattggcctctcttgctcagcgaccgtatcagttgggaagaccagaccatgaccgaacgtcagaactcggaaacctacgtcctctctgttcctttaaagaagaatctgaaggccaatgtgttcggaggcgttatcaaaggccagaatctggccaatcttttttcggaactgacagtcggttatcacgactccatcaacttcaataaactgcctatcccgtttgcctgtgtttcggagaatatagtaaacggagatgaagtcgtatttcataacggagtgttggctaccgccatgcgcgccagtatggctattcccggcgtattcactccggtgcgcctgggtgataagattcttgtggacggtggcatgaaaaataatttcccgaccaacatagcccgtaccatgggagctgatgtcattatcggtgtcgatgtgcagaatgatctccggactgccgatgaactgaacaacctcagtgaaatcttcaatcagattatcaatctgaccgggcagacccgatacgaagagaatatcaaactggccactgtctatatcaaggtggatgtgaaagggtattctgctgcaagtttcaatattcccgcgctcgatactttggtgaaccggggcgaagaggctgcccgtgaacagtggaccgctttgcaaaagctgaagaagggaataggactgcctgagaactatgttgccccgcgtcatggcccgttcagttcattgtggtcttcgaaagacatttttgttaaggagatcacttttgacggcatcgaggatagtgacaagaaatggatcatgcatcgctgtcacctgaaggaaaacagcaagatgcgtatggaacagctttatgaagctctgaccaccttgcgcggcagtcaggcttactccaatgtcagctataaactgaccgacacccctcagggatatcagttgcacttcatcctggaagagaagtatgaacgtaatcttaatctgggtatccgttttgattcggaagagattgcctcgcttctgttgaacgtcaggagccggctcgatacgcgtgttccttcgtgggtttcggtgacgggaaggctgggaaaacgttatctcgcccgggtcgaatatacattggcaccgatgcagatgcgcaatttcaattttgcttatcagtttgagtacaacgatatcaatatctacgatcacggaaggcgttcctataacactacttataagtatcattcgggtgagtttggattctcggatgtatggtttcgcaacctgcgctttggcgccgggctgaattttgagttctttaagtataaagactttctttacaacaccggcgggcagcgtctggaggtgaagccccaacacttcttcagctattttgcacagttgcattacaatacgtacaacaagggatatttcccttccaaggggaccgatgtgcagggacgctactcgctctataccgataatctgacacattataaaggccatgctcccttctctgcccttgcggcatcatgggccggtgtcttttcactgaccgatcgttttgccctgattccctctttgtatgggcgggtgcttatcggtaaaaatataccttatccgtatctgaatgccatgggaggcgagaatttcgggcactatctgcctcaacaacttccttttgccggcatcacgaatctggagattgtggacaactctgttctggtgacaagcctgaagttgcggcagcgtatcggtagcaagaactatgtcacctttaccggaaacgtggctttccggaatgataacttttttgatatctggggagcaaaaccggtttggggcggtagtgtgggatatggttacgatagtctgttcggtccgctcgaggcttctttgggatactccagcagatctcacaaggtgggattttatgtaaatctgggatatgtcttttga

SEQ ID NO: 3801 - DNA, 591 bp, B.fragilis
aagccgtgcaatatgtataatgatgaacttattgaaagtagtaagataaaatggcagtcgtttctgaaaggagatgacgatgcctatgcatggctatattcccggtatgttcagcaactctatcagtacggatgccgttttacgacggatacagagatggtgaaagattgtgttcaagatgtttttgtgaatgtttataggcagaaggataggtactcttctcctccggataatgttaaaatctacttaatgtcttcattaagaaattctatttttaatgttttcaataaagggaatttgcatgacacttatatctccaatatcaattatgaattcgatttgtcggttgaagaaaaactgattgagacagaagatgaaacctctcagaagcatactgttgctcatttgctaaatacactctctcccagacagcgagagattatttactatcgtttttttgaaggattagattacagtgccatttgtgaattgatggggcttaattatcagtcagcctataatttacttcagcgttctctctccagattacgtgaaatgtatggtatattaccattcttttttctattttaa

SEQ ID NO: 3802 - DNA, 1314 bp, B.fragilis
aaaactcaaaacttaacactaaatagtgagttttcaacaaatttctgctacatttgcacattattttatatggaactacgtagaccacacatattatatatattgatttgcctttggctactcgtttctccatcaaacgtcagtagcgtctgggcaaaagatttcgttgtagttattgacgccggacatggcggtcacgatcccggagccatcggaaagatatccaaagaaaagaatatcaatctgaaagtagcattgaaattgggtaatctgatcaaacaaaactgcaatgatgtgaaggtggtctatacccgtagcaaagatgtatttataccacttgaccgccgtgcagagattgccaacaatgcaaaagccgacctgtttatttcaatccacactaacgctctggccaataaccggaccgcaaaaggtgcttctacatggacattaggtctagccaaatcagacgccaacctagaagtggccaaacgggagaactctgtaatcttatatgaagatgattacaaaactcgttacgccggatttaatcccaattccgctgaatcgtatattatcttcgaatttatgcaagacaaatatatggagcagagtgtacacttggcttcattggttcaaaaacaattccgccatcactgtaaacgggtggaccggggagtacatcaggccggattccttgtattgaaggctagtgccatgccaagcattctggttgaactcggttttatctctacgcctgaagaagaacgttatcttaatacagaagaaggaagttctactttggcaaaaggtatatatcgggcatttctctcttataaaagagaacacgaaatccgtttgacaggcagcagccgcactgcacttcccaatgatgatgaagtaaccgatactgaggttgcacagatagacagcacagaaagcgaaaacaaaaagccccaaaatactccacgcaccgacaagcttgtaacagaagcaaaaactcaacgcccaattgttgtagaaagcacaacaaacgactctgaaattacgtttaagatacaaatactgacctcttcacgtccactatctaaaaatgataaacgactgaagggattgaaagatgtagattattacaaggaaaatggactatacaaatacacttacggggcatcgtccgattataataaggtattacggacacgccgtaatacagtcactccattatttaaggatgccttcatcattgcattccgcaacggagaaaagatgaatatcaacgaggctatagccaattttaagaaaagaagaaataaataa

SEQ ID NO: 3803 - DNA, 297 bp, B.fragilis
atcaaacaaaaaggaggattaatcatggcacaacaagttcaatcagaaatcagatatttaactccgccttcagtagacgttaaaaagaaaaaatactgccgtttcaaaaaaagcggtatcaagtatatcgactacaaagatcctgaattcttgaagaaattcttgaatgaacaaggtaagatccttccgcgccgtatcaccggtacttctttgaagttccagcgtcgtattgcgcaggctgtaaagagagcacgtcacttggcgttacttccatttgtaactgacatgatgaaataa

SEQ ID NO: 3804 - DNA, 1344 bp, B.fragilis
ataaataaaaaagatgtacttatgaatagatttaattacataggaatgttagcttacgtcgcactgtctatgagcagttgtgatgatagttttgatgtaagttccaaagccgatggggttttggctgtttctcaggaagggtttaatacattgcaatcttataatgtaggcgaaaagtatacagcagatttatggatacaacaggggggcttgaagtcaactgccagtgtagtaagtttttctgtggacaaagctttgctcgattcaatgaatattgccgatggaacctcatatgaacttcttcctgctgactgttatcaattaacaaaaagttctgtcgatattcccgcaaacgaaaggctgttgaaaggtgagctcacttacgacccggctaagatacaagagctctccggatatgatcatttgaaatatgtgttgcctttacgtgctacatccagtggaatgccttttgtttcaggacgttctgttgtgttgttgggttttaaagtttcagaaccgattgtaactattatgaatgccggagtagaagagatcaacctggcagaagtaaaggagttacctgtacagatcggggtcccattcaccaataaatgggaaatcagctgtcgcttggaaagccgccagtcggtgattgatgcctataatacggctcacggtacttatttcagcatgcttccgtccgatgcctatgcggctcccgaaactccgattcttcatagtggagtaaatcaggttacagcaacttataaactgaaagacgatgtcctgccgggaaattatatgttacccgtgcaaatagcagaggtaacttctgatgctactatacgggctgataaggatgtttatgcagcttatagcattattaaagaaggggataaactttctaaaacagattggaaaattgtatcgttcactaccgaggaggcttcgggtgaaggcagcaataatggacatgccaaacatttaattgacggaaatgtcgagactttctggcattcgcgttggcagggaggatctgatcctttaccttatgaaataattatcgatatgaatcatcgggtcaaaatagctcagatagagttattgccacgtgggcgaggaagtaataatccgataaaggtaatacgttttgaagccagtgaagacgggacgaattgggaatcgatcggtcagtttggttttacgaatcaggatgccgcactaaaatattatgtaaaatcatccacggcacgctatatcaaattggtcattccggatggggtgggtaatggtacagtagctgcgattcgtgaattggatgtaaggggtacagtcgtcaactga

SEQ ID NO: 3805 - DNA, 1377 bp, B.fragilis
caactattgaacgtgaacgaaattcagaaatacattgcagagaatgaatcgacgatgatggaagacttgttcagcctcatccgtattcccagtatcagtgcattgccggaacaccatgatgatatgctggcatgcgcacaacgctggacacaattgctactcaaggccggagcagacgaagccatcgttatgccttcgaaaggtaatccgattgtatttgggcaaaagatagtggatccgaatgctaaaacagtgttgatatacgctcattatgacgtgatgcctgccgagcccctcgacctatggaagagccaaccgttcgaaccggaaatacgtgacggacatatttgggcacgcggagccgacgatgataagggacaagcatttatccaggtgaaagcatttgaatatctcgtaaaatacaacctgctggagaataacgtaaagtttatctttgagggagaagaagagattggttcaccaagcctggaagctttctgtgaagagcataaagaattactaaaagccgatgttatcttggtatcagataccagtatgttgggagccgaccttccttcactaaccaccggactgcgtggtctggcttactgggaaatcgaaataacaggtcctaaccgtgacctccattcgggacactttggtggagcggtagccaatccgatcaacgtactttgtggtatgttaagtaaggtaattgatactgacggacgtatcacaatacccggattctatgatgctgtagaagaagttccacaagcagaacgagaaatgattgcccacatcccttttaatgaagaaaaatataaggaagccatcggagtaaaagaacttttcggtgagaaaggatacagcactctcgaaagaaacagttgcaggccttcattcgacatttgtggtatttggggaggttacaccggggaaggttctaaaactgtactcccttccaaagcctatgccaaagtatcatgccgcctggttccccatcaagatcatcatgtgatctcaaaactttttgctgactacatccggcagatcgctcctgctacggtagaagtaaaagtgactgccatgcatggaggccagggatatgtatgtcccatatcactgcctgcttatcaggcagccgaaaaaggattcgaaatagctttcgggaaaaagccattggcagtacgccgaggaggaagtatacctattatatcaactttcgaacaggtgttaggtataaaaactgtattaatgggatttggcctagaatcggatgctatccattctcctaacgaaaacttctctttggatatattcagaaaaggaattgaagctgtagtagaattccatctgatatatggaaagaaataa

SEQ ID NO: 3806 - DNA, 900 bp, B.fragilis
caaaacatgaaactcattacaaaagaagtcaggataggaatagcaggtgttgcggccttgtgcttactcgtcttcgggatcaattatctgaaaggcatcaacatgtttaagcctgccagctatttttatgtaaaattccataatgtaaacggtctggcacaatcgagtccggtattcgctgatggtgtccgtgtaggtatcgtccgtgatattgcttacgattacaatcaaccggaaaatgtaatagtggaagtagaagtagatactgatttacgcataccgaaaggaagctcagccgaactggtacccgaactgatgggaggagtaagaatgaatattttattggccaacaatcctcgcgaacgctatacagtaggcgatacgattccgggaacgctaaacaacggcatgatggagaaagttgcagcaatgatgcccgctgtcgaaaagatgttgcccaaattagactctatccttacttcactgaacacaatcatggcagatcaaagcattccggcaactctgcattctattgaaaagacaacagccaatctcgaagttaccagccgtcaattgaaagtattgatgaacaatgatatcccacaattaacaggaaagctcaatactatcggtgataactttgttgtaatcagcggcaatctgaaagaaattgattatgctgccacattcaaaaaaatagacaccactcttagcaacgtaaaaatgcttacagaaaaacttaacagcaaagacaacactgtcggattactgttaaacgatccacaattatacaataacctgaaccaaacaaccattaatgcagcaaatctgcttgaagacctgaaggaacatccgaaacgatatgttcacttctctttgtttggtaagaaagataagtag

SEQ ID NO: 3807 - DNA, 894 bp, B.fragilis
aaaaaaatgaaaaaaatattttatccggtcctcttattggttcttgcggcatgcaaaaaccctgaacagacatccgaaaccatagttccggctcctgctattgccgacatcccgaccgatactgttacgacccaagtagacggaataacatcggctacttcaaagcccaatcaagtatctttcaacggcaccattgtattgcctccccaacgtcaagctacggtggccctcactatgggaggagtagtgaaacacacctcactcttaccagggcaacaagtacggcaaggtgccctgctggcaacactcgagaatcccgacttcatcgcactgcaacaaacctatctcgacagccatgcccaagcagaatatctgcaggccgaatatgaacggcaaaaaactctctcgaccgaacaagccgcttcgcaaaagaagtttcaacagagcaaagcagactatctgtcaatgaaaagcaagctggaagctacggcagcacagcttaccctattgggcatcgtcccggaagagttgctgaaaagcggcattcagcccttgctacaggtaaaggctcccatcagtggttatatcagcgatgtggcgatgaatatcggtaaatacatccaaccgggtgaagcactttgtgaggtcatcgacaaatcagcccccctgctttgcctgacaacttatgaaaaagacctggcagatatgaaagtaggtagtcccgtccagtttcgggtcaacggtatgggcaaaacagtgttcaaagctaccctggtctccatcggtcagaaggtggatgaagtaagtcgttcgctcgaagtatatgcccgtatcgatgatgtcaaccaacagtttcgtcccggcatgtatgtaacggcgagaatacagaaataa

SEQ ID NO: 3808 - DNA, 1203 bp, B.fragilis
aacatgatgaacacaaagtcttttttcatggttgccattggcgtttttgttttggcatcttgtaatttaaatcaagtcgaccaaacaggtctgttaaccgcttccgttcgtgatgcacttaattcgccggcaactttgtctattgctgatgagatagagtcagttgaatatatccctttggaaatgaccaatgatgatgcctcattgatagacggtgtggtagactttgccatcacaagcaaatacatttatgtattggtgggcaaggaagcccgtatcgtactgttcgatcgtcaaggacactttttgcgtacattccttcgccaaggccaaggtcccgatgactttaatggtatgataggttttatacaggctgatgaggctgataatcgtttctatgttatcggcaataaggttggcatatatacattggaaggtacgtttgtggaagacctgcctgtaaattctcccattatttatgctcatcaccttggtaacaagcgcattggtgccatcgctatgcctcttatgccgtttcagaacggtagttttggtattggggtatttcaagaggacggtgaggcgataattaccaaaaacgatttctattcgccgttggtaccccgtgaagattcaggctttacttttggagtaatgggttcaccttcggatgggaagcaggcgtcagtcttgtttaaaacagctagcaatgataccatttaccgtttgtcggcagacaccatacagcctgttttagtggccggtctaagcaattcggatgaagaggttattcgtgggctcaatattcgcgatattaaaagattccctgctaacggtgatatttttgtaagtgatatttttgagacgcctcgccgtttttatctgcgcatgatgctgaatgagaagtattatgtggcttcggtggacaaacacagtggagaaactgttgtggagcagtgtgatatccctgagacaagtgcttataacttggctgatatcaatatgcagttaggtatggtaggtagtaaggggcataaccggttcccggtatggggacgtgtcttaggaaataatttggtacaggttgttacaccttatgagatagaaacatttaaagaacaaactcaaattactgtaccacaagaattgcaaaaaagaaatgccaatgaaaatccgattttcatcatatataagataaaataa

SEQ ID NO: 3809 - DNA, 1053 bp, B.fragilis
aacgccgtgaatcatatgaagaaactcatagataaattaagggaggagcgcaccctcacctccgaagagtttgcacacctgttgtcgcactatgatgatgaagccttggcatacatcaatcagcaggcacgggaagtagcgaccgcacacttcggacagggagtctacatacgcggactgatcgaaataagtaattattgccggaataactgcaactattgcggtatccggaaagacaattggcgagccgatcgctaccgactcagtaaggagatgatttgggattgttgcgaacatggctacaaactcggattccgctcattcgttctccagggaggcgaagatccgaaacggtcggacaatgatatggaggagatcattgcggaaatccgccggcgatatcccgaatgtgccatcacgctgtctatcggtgaaaaaccggcgaaagcttacgaacgctattttatgaaaggcgccgatcggtatctgttacgccacgaaacattcaacagagggcattactactgtctgcacccctatgaaatgtccaacgaaagacgtatcaaatgccttcaggaactcaaacgaatcggtttccagaccgggacaggcatcatggtgggaactcctcgtcaaagagtggaatttctgatagaggatatacgttttatcgaaaacttccaaccggaaatgattggtatcggaccttttatcccccatcagcgaaccccattctgtgacgaaaaagcaggtagtgtagagctgaccttgttactgctctctatcttcaggctgatgcatcccaaggcactgatcccttcgacaactgcgttggcaagcctggcaccggacggcagaatacggggtattcttgccggcgccaatgtggtcatgcccaatctgtcgcctatcattgtaagaaacaaatataacctgtacgaccagaaagtagctttcggtgccgaagcggccgaaggactggccttattggaaaagcaactgacagcggtcggatatcacatcgactacagccggggagattataacaactaa

SEQ ID NO: 3810 - DNA, 192 bp, B.fragilis
ttgatcccgaagacgagtaagcacaaggccgcaacacctgctattcctatcctgacttcttttgtaatgagtttcatgttttgttatttagtctttttatttatttcttcttttcttaaaattggctatagcctcgttgatattcatcttttctccgttgcggaatgcaatgatgaaggcatccttaaataa

SEQ ID NO: 3811 - DNA, 1050 bp, B.fragilis
aacgccccgaaaagaaaaatgaataagatatctgtcgttatattgaactggaacggttgcgagatgctccgttcgtttcttccctccgtgcttcgatattcggaggctgaaggtgtggaagtctgtgtggctgataacggttctacggatcagtcggtggagatgctgcgccgcgagtttccctcggtacgccggattctgctggatgggaatcatggttttgcagatgggtacaatcttgccctccggcaggtggaggccgagtatgtggtgctgctcaattccgatgtcgaggtgaccggacactggttgcaaccgatggctgcctatctggacgcccatcctgaggtggctgcctgccagccgaagatacgcagttggcgacaaaaagaatggttcgaatatgccggagctgccggcggattcatcgaccgctacggatatccgttttgtcggggaagggtgatgggagtagtcgaagcggaccgggggcaatatgacaccgtactgccgatattctgggctaccggtgcagccatgttcatccgtctggcggactatcgcgaagcgggaggactggacggacgcttctttgcccacatggaagagatcgatctttgttggagactccgtgcccgcggacgtggaattgtttgcatcccccaaagtgtggtctatcatgtaggaggagctacgttgaagaaggagaatccgcacaaaaccttcctcaattttcgtaataaccttgtcatgctttacaagaatcttccggacagagaactggccggagtgatgcgtgtacgttgctggctcgattacatcgcggctgctacgtttgcgcttaaagggcagttgcccaatgcgaaagcggtggttcgtgcccgtcgcgaattcaagttgttacgtgacagtttccgggatgcaagagcggagaatctcagaaaaacttcctcacactttattcccgaacggataaaaagtagtatcttagtgcaattctatgtgaaagggcggaagttcttttcacaattatcagatttaaaaggatga

SEQ ID NO: 3812 - DNA, 231 bp, B.fragilis
aaagcaaagaaaatgaaaaaattagttttgatgttcgtagctatcgcagcagtatcattcgcatcttgtggtaacaaagcagctgacgctgaaaaagcaactgcagattctatccgtatcgctgactctatcgcagcagtagaagcagctgcagctgaagcagcagctcaggcagctgatactatcgcagctgacactacagtagtaactgaaactgttgtagctgaataa

SEQ ID NO: 3813 - DNA, 441 bp, B.fragilis
cttatgaagaagttattaagacctacaacctttgcactgcttacaatggcactgtgtttcactgcgtgtgagaacggcaacaactcttaccccaaagaatacctgggattcgaaaagaaagcgcaggatttctcttatcaaaagaatgcagaggaaacggaactgcaagtaaaaatcgttgcggctgataaaacaagtgaagaccggattgtcttcatcgagtcgcccgcacggccgacgaagcccggaagctcttcggcaccgttttataaaattaaagataataaaatcaccatcaagggtggcagcaaatctgccaaagccacaatcctggtttatccccggaaagtgggaacgaatgaatacattcagcttatctgccggcctcagaacggaaagtcggaaacgaccaagatgtctatccggctggtgaaaaaataa

SEQ ID NO: 3814 - DNA, 249 bp, B.fragilis
tggggtaacctgtaccgtaccaaaaggctcacgtggatacataaagtcatcacattattaatatggctgttgctcttcctgctcggcatcgatgtagaaggcatcgaagccatcgtgaaaggattgcatgccatcgggctggaagctctcatcatcacggcagctgccgtaaccggaagcacactggctgcctggggactttggtatctgctccatacacgctatcagaaaaaggaggctaaaccatga

SEQ ID NO: 3815 - DNA, 714 bp, B.fragilis
aaaatgattgatatggacgagaaactgcgtattttattatgcgaggatgatgaaaatcttggcatgcttttaagagaatatttacaggctaaaggttactctgctgagttgtatcctgatggagaagccggatttaaagctttcctgaagaataaatatgacttatgcgtgtttgacgtgatgatgcctaaaaaagatggcttcacactggcacaggaggttcgtgcggccaacgctgaaattcctattatcttcctgactgcaaaaacactcaaagaagatatcctggaaggatttaagatcggtgcggatgattatatcaccaaacctttcagtatggaagagcttactttcagaatcgaggctatcctgagacgtgttcgcggaaagaagaacaaggagagcaatgtttataagattggtaagtttacgtttgatacccagaagcaaatcttggctatcggcgacaaacaaacgaaactgactaccaaagaatcggaattgctgggattgctttgtgcgcatgctaacgaaatcttgcagcgcgactttgccttgaagactatctggatcgatgacaactatttcaatgcgcgtagcatggacgtgtatatcactaaactgcgcaagcacctgaaagatgatgattcgattgagattatcaacatccacggaaaaggttacaagttgatcacccccgaacccgaatcataa

SEQ ID NO: 3816 - DNA, 1350 bp, B.fragilis
ctttgcgctgaatatgcgtttttacagattatgatagataccactgtatttcaagataagacagccgtttattatacattaggctgcaaactgaatttctcagagacttcgacgattggtaaaatcctgcgtgaggcaggtgtacgtacagcccggaaaggtgaaaaggctgacctttgtattgtcaacacgtgttcggtgaccgagatggcggacaagaaatgccgtcaggccattcatcggctggtgaaacaacatcccggcgcttttgtggtggtgacaggttgctatgcccagttaaaacccggcgatgtggcaaagatagagggagtggacgttgtactcggtgcggaacagaagaaagatttgcttcagtatctgggcgacctgcataagcacgaaggaggagaagcctatacgaccgctacaaaagatatccgttcgtttgcaccgtcttgttcgcgaggtgaccgtacccggtttttccttaaagtgcaggatggttgcgattacttctgctcttattgtactattccctttgcccgcggacgaagccgtaacggtaccattgcttctttggtggaacaggcccggcaggctgctgccgaaggcggaaaggaaatagtgctgaccggagtcaacatcggcgatttcggaaagtccaccggagagaccttctttgatctggtaaaggccctcgatcgggtggaaggtatcgaacgttatcgtatttcttccatcgaacccaatttgctgacggatgaaattatagaatacgtatcccgttcacgcagtttcatgccacatttccatatccctttgcagtccggtagtgacgaagttctccaactgatgcgtcgccgctatgggacagaactttttgcttcgaagattgcgaagataaaagaggtgatgcccgatgcgtttatcggtgtggatgtgattgtaggtacccggggcgaaactgccgggtactttgagaaagcttatgaatttattcacggactggacgtcacccagctgcatgtgttcagctattcggaacgtccgggaacccaggccctgaaaatagaccatgtggtgactcctgaagagaaacaccagcgaagccagcgtctgcttgcactgtcggatgaaaaaacaaaagccttttatgcccgtcacatcgggcagaccatgcctgtcttgatggaaaagcccaaagcgggagcgccgatgcatggatttacggcaaactatattcgtgtggaagtggagagtgacgccgcgttggataataaagtagtgaatgttcttttgggagattttaatgaagagggtaccgcactgaaaggaactataacacaataa

SEQ ID NO: 3817 - DNA, 246 bp, B.fragilis
accggtggtgaccgaggcggtagaatcggtgaagaaaagaaagagaaagaaataagagcctattcggttacgaaatatatttcactacagagtatacagagagcacggagttttaattatgtagaatcactatataataactttgtgctctctgtgtattttgtggcgcgtttactttgtgatgtatcggttccggctgctgtctttccgcctatttttgtcaatagcagatttatgtattgttaa

SEQ ID NO: 3818 - DNA, 936 bp, B.fragilis
aatttaaacgatataacaatgctgaagttcttgaaaaattggacgcttccgatagctatgctggtaggtgctgttggttatccggtatttatcagcttttctttccttactccgatactgattttcactatgttgcttctcactttttgtaaggtatctccgcgtgacttaaaaccgaagccgttacacttatggcttttattgattcagatattcggatctttgattgtttatctgctactttatcgttttaataaaattgtggcagaaggagcgatggtttgtgttatttgccccacggctactgcggctgccgttattacatcgaagttggggggaagtgccgccagtctgacaacttatacattgatagccaatattggagctgcaattgctgttccgatcctgtttccattgatagaggccaatcccggtattagttttatagatgcttttctggtgattctcagtaaggtttttcctttattgatctgtcctttcttagcagcctggttcttgcagaggtttattcccaaagtgcataaagtgctgttgggttatcatgaactggccttttatttatggggaatttctcttgctattgttactgcacaaacgctttattctttgattaatgatccggcagacggacttacggagattatgattgcggttgtcgccctgatagcatgttgtcttcaattttttctgggcaaaacattgggcagtatatacaacgatcgtattagtggtggacaggctttagggcaaaagaatactattcttgccatctggatggctcatacttatctgaatccactttctgctgtagggccgggaagctatgtattgtggcaaaacattattaatagctggcaactttggaagaagagaaagaaagagagtgaaaaatgcagtaataatgtaagcggctaa

SEQ ID NO: 3819 - DNA, 480 bp, B.fragilis
tccgatggcctcagaatgctttcgtttcgtgcccgtcctgaaggttggccggaaaaacgcctgcatttgccaacagacttttctcctgtgtcacagatttatggtatatgtgtgcaaatggacggacttggggcggaatccgatgaatttgctttcgttctgtctctgtcccgatgcttttgctatattctctccgtatgcttctgcggggcaaccggagaaaaaaaagcaccggtgcggggttctgcacataacaatatatgtgaggaggcaaaacatatagacatcttacccgaaagaagtaagcattttccggaaatgcttacttcttttgcacagaatgtttgcttctttttgggaaaatgcaccgtgttcaacccgaaatacccccttctttggttggaaaaacctccgtcttgcaccgaaaagtctgctgctgcattctatttcatcctgtccggaagaagaaggagtcagtaa

SEQ ID NO: 3820 - DNA, 1902 bp, B.fragilis
actatggcagacagtaaagaaaaactcttctcagatttttctcctgtttccaccgagaagtggatggagaaggtcacagctgacctgaaaggagctgattttgagaagaaactcgtttggaagacaaacgaaggattcaaggtaaaacctttctaccggatggaagacctggaaggacttaaaacaaccgatgcgcttcccggagaattcccttatttaagaggcacgaagaagaatagtaatgagtggttggttcgtcaggagattaaggtggaatctccgaaagaagccaatgcgaaagctctggatattctgaacaaaggcatcgattctctttctttccatgtaaaagcaaaagaactcaatgcggaatacattgagacattgttgaacgacatttgtgcagaatgtgttgaactgaatttttctacctgtcagggacatgtagtggagcttgccgatttgttggtagcttatttccagaaaaaggattatgatttgacgaagttgcaaggctctatcaattatgacttcttcaataagatgctggccaaaggcaaagaaaagggaaacatggtgcaaacagccaaagccctgatcgaggctactgcacaattacccaaatatcgtgtgctgaatgtgaatgcactgaccctgaataatgcgggtgcttatatttctcaggaactgggatatgcattggcatggggcaatgaatatatgaatcagttgactgaagccgagattcccgctgccatcgtggctaagaaaattaagtttaattttggtatcagttctaattatttccttgaaattgcaaaattccgtgctgcccgtatgttgtgggcgaacattgtggcttcttacaatcccgaatgtctgcgtgattgcgaaaacaagggacctaacggtgagtgccgttgtgctgccaagatgaaggtacatgccgaaacatctactttcaatctgacattgtttgatgctcacgtgaatctgcttcgtacacaaacagaagcaatgtctgctgcattgggaggcgtagattcaatgacggtagttcctttcgataaaacctatgaaactcccgatgaattctccgaacgtctggcccgcaaccagcagttgctgttgaaagaagaatcacacttcgataaagtgattgacccggcagccggttcttactatattgaaaaccttacggtatctatcgctaagcaggcatgggaaatcttccttgccgttgaagaagaaggcggcttctatgctgctttgaaagccggtactgttcaggcggctgtaaacgaaagtaacaaagcgcgccataaagcggtggctcagcgtcgtgaagtcctgttgggtactaaccagttccctaatttcaatgaaaaagccggtgataagaaaccggtagaagcgacttgttgttgtggcgggcacgatacttgcgaaaaagatgttgctacattgaacttcgatcgtgctgcaagtcaatttgaggcattacgcctggaaacggaagccagcggcaaacgtccgaaggcctttatgctgacaatcggtaatctggctatgcgtcaggcacgtgcacaatactcttgtaacttcctggcttgtgccggatatgaggtgattgataatcttggttttgaaacggttgaagcaggcgtggaagcagcgatggctgccaaagctgatattgtggtgctttgctcaagcgatgacgaatatgcagagtacgctattccggccttccgggccttgaacggtcgtgccatgttcatcattgccggaaatccggaatgtgccgaagagctgaaagctgccggtatcgagaacttcatccacgtacgtgtcaatgtactggaaacgcttaaagagttcaacgctaaattattgaagtaa

SEQ ID NO: 3821 - DNA, 1431 bp, B.fragilis
tcaacaaaagacatgtataaagtagattcacctgatgctgtcgactttattaaccatcaggaaattattgaaacactggagtatgcccgcgcccatcggaatgaccgggaacttatccgaaatttaatagagaaagcccgcctttgtaaggggctcacccaccgggaagccgccatattgctggaatgtgctgaagaagatcttactaaagagatttttcatcttgccaaagagatcaagcaaaaattctacggcaaccgcatcgtcatgtttgctccgctttacttatccaactattgtgtcaatggttgtgtgtactgcccgtatcatctcaaaaataaaaccatcatccgcaaaaagttaactcaggaagagatatgccgggaagttattgccctgcaagatatgggacacaaacgcctggcactcgaagctggtgaagaccctgtgcgtaactcaatcgattatatactcgaatcaatccgtaccatctacagtatccatcataaaaacggagctatccgccgggtaaacgtgaacattgccgccactacggtagagaattatcgcaagctgaaagatgcaggtatcggtacatatatcctctttcaagaaacatatcataaagagaattacgaacagctgcatcccaccgggcccaaaagcaactatgcctatcataccgaggccatggaccgtgccatgcaaggaggaatcgatgatgtaggcatgggagtcctgttcggcctgaatacataccgctatgattttgtaggattgctgatgcatgccgaacacttggaagccgtttatggcgtgggaccgcatacgataagcgttccccgcatctgctcggccgatgacataaatgccgaagactttgaaaatgccatctctgacgagatcttccaaaagatagtagccgttattcgcatcagcgtaccctacacaggcatgattatttccacacgagaatcgcaaaagacccgtgaaaaagtgcttgacttaggtatttcgcagatcagcggaggatcacggaccagtgtaggcggttatgccgaagcagaaactccggaagagaactccgcccaattcgatgtcagcgacacccggacactggacgaagtggtcaactggttactgaaactgggctatattcccagcttctgtacagcctgttatcgtgccggacgcacgggtgaccagtttatgtcacttgtcaaatcgggacaaatagccaactgctgttcccctaatgcactgataaccttacaggaatatctggaagattatgcctcggaagagacgaaagctcgcggagtagccatgataaagcaagaaatgcaacatatccccaaccctaaaatccgagaacgggctttagaaaacctgaagcaaattgcggcaggagaaagggacttcaggttttga

SEQ ID NO: 3822 - DNA, 1350 bp, B.fragilis
ataaagaaagatatgattagtttgaacattgaaaaaacttttggattcatttccaaggaatcggtttctgcctacgaagctcaggtaaaagccgcacaggaagcgctggaaaacggcactggtaaaggtaacgactttctggggtggttgcatctgccctcttctatcagtaaagagcacctggccgacctgaaagctaccgcacaagtattgagagacaattgtgaggtagtgatcgtagccggtatcggaggaagttacctgggtgcccgtgcggtgatcgaggcattgtcaaacagcttcacttggttacaggaaaagaaaacagcaccggtcatgatttatgccggccacaatattggtgaagattatctgtacgaactgactgagtttctgaaagataaaaaattcggtgtaatcaatatctctaaatccggtacaactacagagaccgctctggcattccgcctactgaagaaacagtgtgaagatcaacgcggcaaagagatggcaaagaaagtaatcgtagccgttacagatgccaagaaaggtgcggcacgcgttactgcagataaagaaggatacaaatctttcattatccctgacaatgtaggaggacgtttttccgtgttgactccggtaggtttattgcccattgcagtagccggattcgatatcgagcaactggtaaacggtgctgccgacatggagaaagcttgtggagccgatgttcctttcgcagaaaaccctgcagcgatttatgccgctactcgtaacgagttatacaagaacggcaagaagatagagattcttgttaatttctgcccgaagcttcactacgtaagcgaatggtggaaacaactttatggagaatctgaaggaaaagataataaaggtatcttcccggcagcagtcgatttctctacagacctgcactcgatgggtcagtggattcaggaaggtgaacgcacaatcttcgaaacagtgatctctgtagacaaagtgaaccataagttagaagtaccttcggatgaagctaacctggatggcttaaacttcctggccggcaagcgcgtagacgaagtaaacaaaatggccgaattgggaacccaattggctcacgtagacggaggagttcccaatatgcgtatcgtgattccggaactgagcgaattcagcatcggacaattactctatttcttcgaaaaagcttgcggtatcagcggctatctgctgggcgtaaatccgttcaaccagccgggtgtagaagcatacaaaaagaacatgtttgctttactgaacaaacccggatacgaagaagaatcaaaagctattcaggcaagactgtaa

SEQ ID NO: 3823 - DNA, 183 bp, B.fragilis
acaggttcggaaaccattgaaatgcgtacccggcaattgatagataccgatatgcctatgtgcatgaatgatactgaaaatctgaccgctgtgcaaacagacatgttgcgtgtcgtagccaatggtgaataccgcttcaattctattcctgtagtgcggaaatatgaattgggaagcgcgtaa

SEQ ID NO: 3824 - DNA, 1329 bp, B.fragilis
ggaagcgcactttatcacctattttcattgttctgtttacaatttaccatttacaatctacaaattaaggcaaatataactacttttgtcgtcgcaaagaaagaaatgatgaaagaaaacccgaaacatatccgtattagcgaatacaattatccattgccggatgaacgcatcgctaaattcccgttgcctgtgcgcgaccagtctaagttactcatttatcgtcatggcgaggtcagtgaagatgtatttacctctctaccggaatatttgccagccggaagcctgatgatattcaacaacaccaaagtgattcaggcacggctccatttccgcaaagagacaggagcactcatcgaggtattttgcctggagcccattcaacccaatgactacgtactcaactttcagcaaacggaacatgccgcctggctttgcatggtaggcaatctgaaaaagtggaaagacggtccgctatgtcgtgaaatgactgtaaaaggattcccgatcacgttgaccgccacccgcggtgaatgtcgtggcaccagtcattggatcgatttccggtgggacaatccggaagtaacatttgccgatattctcgaagtgttcggtgagctacctatccctccctacctcaaccgggatacggaagaaagtgataaggagacctatcagacagtctattcaaaaataaaaggctcggtggccgctcctacggcaggtttacatttcacccctcgtgtactggatgccctgaccgaaaaagggatcgacctcgaggaactgactctccatgttggcgccggtacttttaaaccggtaaaaagtgaagagatagaggggcacgaaatgcatacggaatatatatccgtatcacgcagtattatcaaaaagctgatagaccacgacgcttgtgccattgccgtaggaacaacttctgtgcgtacccttgaaagcctctaccacatcggcgtaacactggctaacaatccggaagccacagaagagcaattgcacgtaaagcagtggcaaccttacgaaacggaatgtgatgttcgccccgtagtagccttacagaaaatattaggttatctcgaccgacatggaatggaggcactgcataccagtacacagatcattattgctccgggatatgactataagatagtcaaggcaatggttaccaattttcatcagccacagagcactctgctattattggtttcggcatttgtgaaaggcaactggcataccatttatgattatgcactcggacacgatttccgctttctgagttatggagattcatctttattaataccttaa

SEQ ID NO: 3825 - DNA, 246 bp, B.fragilis
taccgtgcttgttcccttgagataccgatgaaaatatataaggcggctgcacaggctgacaaacatattgcagcggcgcttccggtgaaaaacggaagggtagagctgataattatattaaggagcaaagtattgcctttgaatatcatagatacggaagtatttcggaagtacccgcctttgaataaaactaatactctatggttttgttatctaaatgcagataacaaaaccattttaatataa

SEQ ID NO: 3826 - DNA, 1776 bp, B.fragilis
gaaaagtttcgtatttttgcctccaaaattgagttaatatctaacgaaatgaacatattagaactaagtgaacaggaaatcatccgacgtaacagtctgaatgaacttcgcgcgatgggcatcgaaccctatcccgcagcagagtatgtaaccaatgctttctcaactgatattaaagccgaattcaaagatgacgagacaccccgccaggtatccgtagccggtcgcatgatgagccgccgcataatgggtaaagcctctttcattgaattgcaggactctaaaggccgcatccaggtatatatcacccgtgatgacatctgcccgggagaagacaaggaaatgtacaacactgtgttcaaacgcctgctcgacttaggcgacttcatcggaatcgaaggcttcgtattccgcacacagatgggcgaaatcagtatccatgcacaaaagctgacggtactcgccaaatcgatcaaaccactgcctattgttaaatacaaagacggcgtaacttacgactcttttgaagatcctgaattgcgttaccgccagcgctatgtcgacctggctgtcaacgaaggtgttaaagatattttcatcaaacgcagcaaagtatacagttccatgcgcgaatacttcaactcaaagggatacatggaagtggaaactccgatcctgcaggccattgccggaggagcagccgcgcgtccgttcatgactcaccacaatgctttggatattcctttatacatgcgaatcgccagtgagctttacctgaaacgccttattgtcggcggttttgaaggtgtatacgagatcggtaaaaacttccgtaacgaaggtatggaccgtacacacaatccagaattcacctgtatggagatatatgtagcctacaaagactacaattggatgatggaatttactgaaaaaatgatcgaaaagatctgtctggacgtaaacggtactaccgaagtaaaagtaggcgacaacatcatcaatttcaaagcgccctataagcgtgtcactatgctgggagccatcaaagagcacaccggttacgatctgacaggaatgaatgaagagcagattcgcgaagtttgcaagaaactgaacatggaaatcgatgatacgatgggtaaaggtaaactgatcgatgagatcttcggtgagttctgcgaaggcacttatatacagcctacattcatcacggattacccgatcgagatgtctcctcttaccaagaagcatcgtgacaaccctgaactgacagaacgtttcgagttgatggtaaacggtaaagagttgtgtaacgcatattctgagttgaacgatccgatcgaccagttggaacgtttcgaagaccagatgaagctgagcgaaaagggagatgatgaagcgatgatcatcgataaggacttcgtccgtgcattggaatatggtatgcctcctacttcgggtatgggtatcggtatggaccgtctgactatgctgatgaccggtcagtcgaccattcaggaagtattgttcttcccgcagatgcgtccggagaaagtcgtaccgaaagacagtgcttccaaatttatggaactgggcattgccgaagagtgggtacctgtcatccagaaagcaggatacaatcaggtggccgacatgaaagaggttaatccgcagaaattccaccaggatatttgtggcatcaacaagaaatacaaattggaactgaccaatccgtcagttaacgatgtagccgagtggatacagaaaattaaataa

SEQ ID NO: 3827 - DNA, 333 bp, B.fragilis
caccgaattcgacagatcgaacttaatctattattgataaatgatatttatctgtgtaaatcggtgtactctgtggtgaatacgagtttaggtacaccctccgatacacggattataattcagttccgctccataacacaaaaaatcgatatcatgataaaacttaaactaagcattcttgtatgggcgatcggcctatcgatgaccgccttttctcaaacaacttcgtccttgcgggcgaaagtgttaaccttgaacgactatccggatgctctccggttgtgggagttatataacgattccgcttctgtagaacaaaaaaatccgtcatag

SEQ ID NO: 3828 - DNA, 552 bp, B.fragilis
cgcgtacatcgcgggcatacgaaaccgtcagaggtccttgttcatgcgggacatgaaccctttaagatggcccgcaaggaagcgggcatcgatagaacccccgacaatactgttaacaaataccaattttccgccccattccaatggaacttcctcagtacccttcacgttaatcttaaattcctgtccgccgaatttatacatatcgggcacgggcattccttcataatagggttccactatcagatgcacctcgccgaactgtccggcaccacccgattgctttttgtgacgatagtcggcacgggcggcttttgtgatggtttcacgataagggatcttcggttcttcaaatttcacctgaagcttttcattgttctccagacgccatttcaacgtacggaggtggaattctccctggccatgcacgatggtctgtttcagttctttcgattgttcgatgacccaagtcggatcttcctcacgcatacggttcaagatggccatcatcttttccgtatcggcctcgttcaccggcttgatggcgcgtga

SEQ ID NO: 3829 - DNA, 1704 bp, B.fragilis
ttttgcacccgtttacataaaattataaactactatattatggattggttacaagatttattatggaaccccaactccgtagcccacatcgtcttcctctacgctttcgtagtggcggcaggtgtctatttgggaaagatcaagatcttcggagtctctttaggggttacctttgttttgtttgccggcatcctaatgggacattttggcttcacaggcgatacccatatcctacatttcatccgcgaattcggattgatattgttcgtattctgtatcggtcttcaggtggggccttctttcttctcttcatttaagaaaggcggaatgaccctaaacatgctggccgtaggaattgtggtattgaacattgccgtagcaatggcgctctatttcattctgggaggcagaatcgagctccccatgatggtaggtatcctgtacggcgcagtcacaaacaccccgggactcggtgccgcacaagaagcactgaatcaattgagttactccggcccgcagattgcattaggttatgcctgtgcttatccgttgggagtagtaggtatcataggctctatcatcgcagtgcgttacatcttccgcatcaacttcgccaaagaagaagagaactggaatcaagagactgacggcactcaccacaagccacaccttatgagtctggaagtacacaacgaagccatctacggaaaaaccctgggcacaatcagcagcttcctcggacgtccgtttgtttgttcgcgcatccgtaaaaacgggcacgtcagcattccgaaccacggcactatcctggaacagaatgaccagttatttgtggtatgttcagaagaagattcagatgccattgtagcctttatcggacgcgaagtgcaagtagactgggagaaacaggatatgccgatggtatcacgtcgtatcttggtaaccaaaccggaaataaacggaaagaagctcggtatgctgaacttccgcagcatgtataatgtcaacattacccgtgtcaaccgttcgggtgtcgacctgtttgctaaccccaacctgatactgcaagtgggtgaccgtgtcatggtagtaggctccgaagacgctgtagaacgggtagccagcgtgcttggtaactctttgaaacgcctcaacgaaccgaacattatcacattgtttgtgggcatcttcctgggtatcctgtgcggtagtcttcccattgcatttccgggtatgccgactcctgtcaagctcggccttgccggcggaccgctggtggtagccattctgataggacgtttcggacacaaactacatctggtaacttatacaactcaaagcgccaacctgatgatacgtgaaatcggtatcgttctcttccttgccagtgtaggtatcgaagccggagcaaatttcgtggatacggtaatccatggagatggtctgctttatgtaggttgcggtttcctgatcacgattattcctttgctgataatcggggtcatagcacgttcgtattataaaatcaattacttcatgctgatgggattgattgcgggtagcaataccgaccctcccgcattggcctattccaatcaggcaaccggtagcgacgcaccggcagtaggttattctaccgtatatccgctatcgatgtttctccgtatccttgcgggacaaatgatattgttgctaatgatgtga

SEQ ID NO: 3830 - DNA, 936 bp, B.fragilis
agagggtaccgcactgaaaggaactataacacaataaacatgaaatcgaaactcctctatttgttgacctatgtaggaatgtggcttttggctgttcttccgtttccggtattgtatgcactgtccgattttatctatttctggctgtatcatgtgatcggttaccggaggaaggtggtacgtaccaacctgaagaactcttttccggaaaagtcggcagcagaattgaaggccatcgaacgcaagttttttcattatctttgcgactatatgctcgaagatgtgaaaatgctgcgcatgtcggagaaagaactttgcaaacggatgacctacgagaataaggaaacctacctccggatgatagacgaacggggcgggattgtcctgttgataccccattacgctaattttgagtggattacgggtatgggaatgattatgcgtccgggcgatgtgcccgtgcaggtatacaagcccttgaaagatgtctatctggatggactctttaaatacatccgtgcccgtttcggaggatataatgttccgaaacactctaccgcccgcgaagtgattaagttgaagcgtgctggcaagaagatggccatcggattgattaccgaccaatcgcccaatatgcatgaagcccattattggactactttcttgaatcaggatacggtatttatggatggtgccgaacgtatcgccaagatgatggattttccggttttctattgcgagctgcggaaggagcggagaggatattgccgggtagacttcgatctggtaaccgaccgtccgaaggagacagccgacggggagattaccgaaatatttgcccgcaggctggaacagaccatccggaaagaaccggcctattggctatggtcgcataagcgttggaagctgaaacgccccgaaaagaaaaatgaataa

SEQ ID NO: 3831 - DNA, 1902 bp, B.fragilis
ttaataaatagaaagatgaaaaagcaaaattctatatacactttgttgatagcgctattgtgctttgttagttcttgcgactatttgggagtttccgatcaacttgcaggaggtttgcagaataccgaacaggtgtttgataatgtatcgtatacaaagagatggtatgccaatgtttttgccggtatccccgattattcagggattaacagcgtgaatgtgggagctttcaaaaatccctggacgggtatgtgtgatgagctggtcgttgggtatggaaactcttccaaatacaataattcggatagaaatgctgccaacatgggttttcatcgttatggtgactgttacaaatacattcgtcaggctaatatttttttgcagaaagcacatccgataatgactacgggaacccaaggagaccagttgttggaagacgagctgacacagatgaaagccaatgtgcgttttatgcgggcattttatcactatttgttgtttgaacaatacggtccgatcatcttggtaaaggacaaaatatacaatgcgactgaggatcaggatgtaccccggaatacagtagatgaagtaatagagtatattgattccgagctcacagctgttgcttctgaattgactcaggagcctatttttgaagataaggactatcgtgcctggccgactaaaggagttgctttggctgttcgggcaaaattgtggttgtatgctgcaagtcctcttttaaacggtggataccgcgaagctctgtcggtgacaaatccggatggtacccgtctgtttcctgattatgacgccggtaagtgggagaaagctcttgctgcttgtaaagactttattgactatgctgaggccggaagatatgaattatacaaagagtataaagacgataacggtgctgtcattgatccggataagtctgtgtataatctgtttcagaaatatacacatgagattatctgggctacggcaaataatgattgggggggaatgaatggtgatgctttcgaccgtcgtattgctccccgttgcgaaaaaaatggcttaggttccactggagttactcaggaactggtcgatgctttttatatgaaagacggtttccctgtttcggctacagcctatttgccgcagtctacactttatcaggaagaagggtatgggacttacaaagatcagaatgataacttttctaagaagtataccaatgtgactgtcagcaatcgctatctcaatcgtgaacctcgtttttataatacagtctttttcaatggacgtcaatggccagtgagctgtaatcaggtattattttacaatggtggtaactccggcgtacaggagggacaggctaccctgaccggttatatgcttttcaaacgtttcaatcgttcggtcagtttaactaatccgggagtagcctcccagttccgtccctctattattttccgtttggcagatttctatttgatgtatgctgaggcagccaatgaagtcaatcctaatgacgcgagagttttgaaatacctcaatctggtgcgtgagcgtgcaggactccccgatatagagactttgaatccggctattcgtggtaatcaggaattgcaacgggctgccattcaacgtgaacgccagattgaactggccacagaggggcagcgctattttgatgtgagaagatggatgattgctgataaaaacggggaaggtcgtcagaatggctatgtgcacggaatgaatgtacgcggtgagtcgaatgataaagaagatttcaatcgcatagtggaagcaagccagattgtatttaaccggaaaatgtatctgtatcccatgcctgattccgaaatgagaaagaccaagaatctggtacagaatccgggatggtga

SEQ ID NO: 3832 - DNA, 1065 bp, B.fragilis
attgtaaacagaacaatgaaaataggtgataaagtgcgcttcctcagtgaggtgggcggaggaatcgtaaaaggattccggggaaaagatattgtattggtggaagatgctgatggatttgatatcccgatgcagatacgcgagtgtgtggtgatcgatacggatgattataatatgacccggaaggctgctcctgcgccaaagaaacccgaagaacccgtcaaaccggtaaagcctgagattccggtagttcgttcggccgaagtgcggggtggtgatgttttaaatgtttttctggcttatgtgcccgaagacgtgaaagctatcagcagtacttcgtttgaggcttatttggtaaatgacagcaattattatttgtattatacgtatcagagtgccgaaggaaaggcctggaaaacccgttcgcatggactggtggaacccaatacgaagcttttgctggaagagtttactaaggatatgctgaatgaaatggagcatgtggccgttcagttcattgcttttaaagatggacggacagcgcctttgaaacctgcggtttgtgtggagttgcgtatcgatacggtgaagttctataaactgcatacattccgtgagtcggacttctttgaacagccggctttggtttatgatattgtgaaagacgatgttcctacccgtcaggtatttgtttcggctgaggaactgcagtctgtattgatccagaagaaggaagtggataagcctaagtcacaaccgattgtgaaacgtggcggaaagaatgaaattcttgagatagacttgcacatcaacgaattgctggatgacacacgtggcatggggaatgccgagatactgaattatcagttggataaattccgtgaagtgatggagaagtacaaagccaaacgtgaacaaaaaatagttttcattcatggcaaaggtgacggagtgcttcgtaaagcattgattgatgaattaaagcgaaaatatagtaattgccgctatcaggatgcttcatttcaggaatatggtttcggagcaaccatggtgaccattaaatga

SEQ ID NO: 3833 - DNA, 486 bp, B.fragilis
tgtaagcggctaataaataagattataattatggatatcatttcattacggaaaagccctcaatatttagaggaggcaattgcttatttccaaaggaagtgggctgacgaaaatagtagaatggtttatgataactgtttcagaacttgtttggagtcggaatctcctctgccacaatggtatcttctgataaatggagaaggagaaattataggttgtgccggacttgccacaaatgattttaattcacgtatggacttatacccgtggttggttgctttattcatcgaagagcagtatagagggcataattacggaaacttactaatcaaagcagtagaagaggatacccggcggttaggcttcgggaatttatacttgtgtacaactcatacaggctattatgaacattttaattttgtatatataggagattgctatcacccttggggggagcatacacgtgtctatcaaaaagaaatataa

SEQ ID NO: 3834 - DNA, 534 bp, B.fragilis
aacatgcaaagcgataataatcaggaaatgttccccatcgtagacgaacagggaactattacaggagctgctacacgcggcgaatgtcatagcggaagcaaactattgcatccggttgtccatctgcacgtattcaactcaaaaggtgaactttacttgcagaagcgccctgaatggaaagatatacagccgggcaaatgggatacttccgtaggcggacacatcgatctgggagagagtgtagaaatagctttaaagagagaggtcgccgaagagctgggtatcacagacttcacaccggaactcctgacaagctatgtctttgagtctgcccgtgaacgggaattagtctttgtgcataaaacggtgtacgacggagaaatacatcccagcgatgaattagatggcggacgtttctggagttatgaagaaatcaaaacgaatttaggaaagggtgtctttacaccgaactttgaaagtgaaatagataaagtagagattttctcttctacttcccccaaagaagctgtgtag

SEQ ID NO: 3835 - DNA, 576 bp, B.fragilis
gtatttatgagacgatcaattcttgatatattccttttcttgctggttatcatatccactgcggcatgcaataacgatcttcctttcgacttgaaggagaatccgcccaagttagtgatgaatgccattatcaacgccgacagcacctacaacaccttgtttctgaacctcaccggcagaaaccagatcggacaaataaaaggagccaccgtagaagtacgcatcaacggttctctcagtgaaactctccgtcccgatccgcatagcagcgataaagggcgcttttatataaacagtgctttccatccgggcgatgtggtccgtatagatgctatgacggatgacggcgaacaccacgcatggaccgaagtcaccgtacctcaacccatcgggaagatagaaaaggtggatacggcctccatcatgagaaagccgagtaactatggctacggaactccgccaagacgacatctccgttaccaaatcaaaataaaggacccgcccgggagagaagaatttttatcggatcattgtggaacaacggaaatactggaaatactattgggaacaaaatga

SEQ ID NO: 3836 - DNA, 2187 bp, B.fragilis
ctagacatgagaaaatccaatccggatttccaccacatcagaagttacattctgatgtgtgtggtttccctaaccttttcgacaatctatgcgcaaacaccggaacccaagctcacactcaaactgcaaaacaccagcttgtcagaagtcatccggcagatagaacaggataccggcttctcttttatctatggagaggaggtgaagctcgaccataaagtcagcctcaacgtacaaaagaaacctctcagagaagtcctgaacctgctattcgccaataagccgataagctataaaataaccgggaagcatatcttattacaaaaaacgccccccaaacccgtaagccggaagttcactgtcagtggatacgtgaccgacggagcgtctgccgaaacgctgattggtgcaaatattcttgagagtcgtcatcatcagggaactaccaccaatccttacggtttctacagcatcacgctgcctgaaggagaagctcgactgagtttctcctatttgggatataccggccagcaacatgtgctgaacttaaccgcagatactctactgaacatccggatgaaagacaacaatatgctgcaagaagtagtcatcgtgtcggacaaagccgaatcgggagtcatggccacccagatgggagccagcgaaataccgatgacccagataaaaaacacacccagcatcctgggagaagccgatgtgatgaaagccatccagctgatgccgggcgtacaagccggaatggaaggctctgccggactctatgtacgcggcggaggccccgaccagaacctgatccttctggacggagtaccggtatacaacgtagaccatttattgggcttcttctccgtctttacacctgaagccgtgaagaaagtgacacttttcaaaagctccttccccgcccgctttggcggacgcctctcttccgttatcgatgtgcgcaccaacgatggcgacatgaagaactatcacggagtggtcagcgtggggcttctgaccagcaaaatcaatttcgagggaccgatcataaagaaccggacttcgttcaacatttccgcccgccgttcgtacatcgacctgctggccaaacccttcatgcccaaagacgagaaatacagttattacttttttgatgtcaatgccaagatcaaccataagttctctgatcgcagccgcctgttcctcagtgcatacaatggcaaagaccattttatgacaaagtatgacgacacttactacggtgacgaagacaagtacagggatggcggaaagatgaactggggaaataccatcgtttcgggacgctggaactacatctttaacaacaagctgttcagcaataccacagtcgctttcaataactataagtttgacgtcagtacattcaccaagaatgagatacatacaaacaaccaaatcacctggaaccgctataaggccgattataaatcgggaatccgggattggagcgctcagatagattttgactataaccctatccccacacatcatgtcaagttcggagtgcaatatctgcaccatagcttccgtccggaagtctccacctcgaagatattcgacaagaccggagaaaccatcgagcgggacacgacgtattatactacctccaacagtgagatccttgcccacgaagcatctgcctatcttgaagataacttcaatctgagcagtcgcctgcgtatgaatctgggtctgcacttctcgactttccaagtgcaaaagaaaaactacttctccgtgcagccccgcatctccgcacgctatcagctcagcaaagatgtagtattgaaagcttcgtatacgaaaatgagccaatatgtacacttgatttcatccatgccttttgccatgcccaccgacttatgggtacctgtcaccagcaaaatcaaacccatgcaggcccatcaggtctcgttaggcggttactatacgggaatcgacggatgggaattctcaatagaaggatactataaaggaatgaaaaatgtactcgagtacaaagacggtgtcagctttctcggttcttctaccggatgggaggacaaagtggagatgggacacgggccgctctatgggtgtagagttcatggcacagaaaaccataggaaagacaacgggatggctggcatataccctggctaa

SEQ ID NO: 3837 - DNA, 2154 bp, B.fragilis
agtaagatgagaaaagattttaaaaacttagatatctacgcagcattccagcccgctaacggtgcggaatggcaaaaggctaacggaatcgaagccaactggaagactccggaacacatctgcgtaaagcctgtttataccaaagaagaccttgaaggaatggaacacctggactatgctgccggtcttcctccctatttgcgtggtccgtattcagtgatgtatactcttcgtccctggactatccgccagtatgccggattctctacagctgaagagtcaaatgctttctatcgccgtaacttggcttccggacagaaaggtctgtcggttgcgttcgacttggctacacaccgcggctatgaccccgaccacgaacgtgtggtaggtgatgtgggtaaggccggtgtatccatctgttcactcgagaatatgaaagtcttgtttgatggtatccctttgaacaagatgtccgtatctatgactatgaacggtgctgtactcccgatcatggcattctatatcaatgccggactggaacaaggagctaaactcgaggagatggccggtacgatccagaatgatattttgaaagaatttatggtgcgtaatacttatatttatccacctgcattctcaatgaaaatcatctctgatatttttgaatatacctcacagaagatgccgaagttcaactctatctctatctccggttatcatatgcaggaggctggtgcgacagccgatatcgaattggcttacacattggctgacggtttggaatatctccgtgcaggtgttgccgcaggtatcgacattgatgcttttgctccgcgtctctctttcttctgggccattggaacgaatcactttatggaaattgccaaaatgcgtgcagcacgtatgttatgggcgaagattgtgaagcaattcaatccgaagaacccgaaatctctagcactgcgtacgcactctcagacttccggttggtcattgacagaacaagatccgttcaacaatgtgggacgtacttgtatcgaagctatggctgctgcactgggacatacccagtcgttgcataccaatgctctcgatgaagctattgctttgccgacagacttttctgcacgtattgcccgtaatactcagatctatattcaggaagagacttatatctgcaagaacgtagacccgtggggtggatcttattatgtggaatctctgaccaatgaattggctcacagtgcttgggaacatattcaggaaatcgagaagttgggaggtatggcaaaggctatcgagaccggtattccgaaaatgcgtatcgaagaagcggctgcccgtgcacaagcacgtatcgacagcggatcgcagaccattgtcggtgtaaataagtatcgtcttgaaaaagaagatccgattgatattcttgaagtagacaatactgctgttcgtaaagagcagatcgagaacctgaagcgtttgaaagaaggtcgtaatcaggccgaagtggacaaggcactggccgctatcactgaatgtgtgaaaaccggtaagggcaatttgctcgagttggcggtagaagctgcccgtgttcgtgctacattgggtgaaatctcgtatgcttgcgaacaaatagtaggacgttataaagcaataatcagaactatatcaggcgtgtattcatcagaaagcaaaggcgacgctgactttaagcgcgcttgcgaactcactgagaagtttgcaaagaaagagggacgtcaaccccgtattatggttgcaaagatgggccaggacggtcacgatcgtggtgccaaagtagtagctaccggatatgccgattgtggcttcgacgtggatatgggaccgttgttccagactcctgccgaagcagctcgtgaggcggtagagaatgatgttcacgtagtgggagtttcttcgttagctgccggacacaagaccttggttccgcagattattgaagaactgaaaaaactgggacgtgaagatatcgtagtaattgccggtggtgtaatacctgctcaggattacgatttcttgtataaagctggtgtggctgctatttttggtccgggtactccggtggccaaggctgcttgtcagattctggaaatcctgatggatgaggattaa

SEQ ID NO: 3838 - DNA, 219 bp, B.fragilis
cgacgcaccggcagtaggttattctaccgtatatccgctatcgatgtttctccgtatccttgcgggacaaatgatattgttgctaatgatgtgataactatacaccctgatacagcaatggccagttaccatgtttttatttacatagtaattggccatttctatatggtaacagcttctattacaaagccagtttcttcaccacaaattcttctataa

SEQ ID NO: 3839 - DNA, 606 bp, B.fragilis
accatgaaaggcagtctcattatcgtctctttcttcattgtcggcactctgtgcggactttttcagctgatcccgtacgatttcagccaaagtaaactcagtttttatgccttatgcggactgatgttctgcgtcggcattagcataggcaacgatccgcagacactgaaaagtttccggtcactgaatccccgcctactcttcctgcccgtcatgaccattctgggaacattggctggatgtgccgtagtcagcctctttttgtcccatcgttcaccgtccgattgtatggcggtaggttccggattcgggtattattcactctcaagtatattcatcaccgagtacaaaggagccgaattgggtaccatcgcattgctttcaaacatcatgcgcgaaatcatcgctttgctttgtgcccccctattggtaaagttcttcggaaaactggcccccatttcagtcggaggagccaccaccatggacacgactcttcccattatcacccgttgttccggacaggaatttgtcatcgtctccattttccatggattcattgtagactttagcgtaccgtttctggtgacattattctgctccatatag

SEQ ID NO: 3840 - DNA, 2736 bp, B.fragilis
aaattaattttaaaacctacacaacaaaaaagatttaagcttatgagaaaaccttttatgctaatatcagttttaccgataactgttcatattagtcatgataccgatactggcagtaatcgtatcggtgggataccagaaaaatatgcgtttaagaataaagtattaagatcaatttgctttgttctgtttttattatctatcggactcaattcagcctttgcccaagtccgtaatgccgccggacttgtggtggatgagaatggccagcccttgattggagtacaaattaaattggaaggaactactacaggagttattaccgatgtagatggcaatttctcgataaatgccaaaaaaggggacatacttcttttttcgtatgtgggctacgaaccacagcggataacctataaaggtgaaaagattttggctataaaaatgcttccaaacaccgaattgttggatgaagtagtggtaattggttacggcaaacagaaaaaaaatagtgtagtaagttctattaatgccatcgggcctaaagaactggcagtatcatctaacagaaatctgactaattccttggccggacaggtgccgggcctgattgccgttcaacgttcgggtgagccgggatatgataactctgagttttggattagaggtgtaagttcttttaagggaggtacgaatccgttggttttagttgacggtgtgcctcgtaatatgcaagatatcgaacccgacgagattgaatcgtttactttgctgaaagatgctgctgcgacggctgtatatggggcagagggtgccaacggagttattttgatcacttctaagcgtggaaattcacaaaaacccaaaatatctcttcgtgccgagtccactttgcttactccgactcgtctacctaaattcatgaattcagtggagacactcgatctgtataatgaagctttaaataatgaaggaacagccagtatacgcacagcggaagaaattgccatgtatggtccgggagccgatcgtgatctttatcccgataccgactggttgagggagatgttgagagagcatacttacaatatgcgttatactcttaatgtaaggggaggttccgaacgtgcgcgttattttgtttccggagcgttttatcaggagaacggtatctttaaagaaggtaagaaaaacgagtatgacaataatatcgggctaaaacgttataatttacgtagtaatatcgattttgatgcaacgaaaacgactttagtaaaagtagatataagtgggcaatatttgcagacaaactatccggggacaagtacaaatactatttttaattcgatgtgccgcaccccgtcttatctgatgcctgctgaatactcagacgggacaattgccggacatccgcgtccttcgggtaatcgggtgaatccgtataacttgcttatgaattctggatatgccaaagaatggagaacatctatccagtcgaaactggaagtagaccaaaaattagactttatcaccaaaggactgaactggaaaggtctgatcagtttcgatgcagacatgaaatatatagcaaaacgtacaaagacacctactcaatatctggcgaccggacgtgatgaaaacggtggattgcaatttaagaaagtagtggaaggcagcgacgtattgaccgagaaactggaaaactcttcgaataaaaagatatattttgagacttcgttcaactataaccggacttttgcgcagaaacacgatgtgactgctatggttctttacatgcaaaaagagactcaatatcataataatgctctaccttacagaaagcagggacttgtgggacgtgctacatatggctatgacgggcgttattttatagaaggaaacttcggttatacaggttccgaaacctttgccaaaggatatcgtttcggctttttcccggcaatgggattggcatggtatgtcagtaacgaacccttttatccggaggtattgaagaaggtggtcaataagttgaaatttagattttctatcggccgtacgggaaatgatgataccggtggcgaccgtttcttgtatcgtggtacgatgaaacaggataatggaggatatgatctcggtttcagcgatacgggaggtatgggaggtattggtaatggaataaccgaagcccggtttgaagctccttacctttcatgggaaattgaggaaaagaagaattacggtattgatctcgggttattcgacaaccgtattgatttgcaagttgactatttcaataataagcgtaaaagcattttgttgcagcgtaatacagtgtccaatgtaaccggcttccagcagatgccttggcagaatttcggtattgtgaagaatcatggagtggatgccagtctgatccttaaccagaaaatagggcaggtcaatctgagtgcacgtggaaactttacgtttgcccgtaatgaaattatcgaatacgatcaagtgccacaggtatatccttggttggagaaaagaggcacccgactcaactcaaataaactatatattgccgaggggctttatacatatgatgactttatcatcaatggtgaggggctcaaccgtacttatgaattaaaacccggggtcgtttccggcctttcaagcggtgtgcgtccgggtgatatcaaatacaaagacctgaacggtgatggtaagattggtcttcgccacgtgcgc

SEQ ID NO: 3841 - DNA, 795 bp, B.fragilis
tacataattttaactgaactattttataaaaagctcgttattaataccacttatcaattaataacgagccttatgaatacaatgtttttcaacgcggtatcttgtttttttgtatgcgccggtcttatcatagcccttattctggcaattaatgtaatatttcacaggcaatccatgaaaataatgaatatagtgtgggtacttaccggattatggggccattatttcgctttgtttgcttattatacttttggtgtccgaaaagataatatggtggcaacagtacctatggagaatatgaaaatggatatgaagatatcgatggagatggatatgtctgaagtacgtccacaatggcagtctatcactttgtcggcacttcattgtggagccggttgcactttggcggatattatcggagaatggtttacatactgggtacctttgcagataggaggaagtttaatagcaggtagctgggcactcgattttgtattggcattgattctcggtgttttctttcaatttattgcaattcgcgaaatggaagctatctcttttcgtgaagctgtttctcgtgcctttaaggccgattttttttcattattagcttggcaggtagggatgtatagctggatggctgttgctacttttatactttttaaagatgaatctctggaaaaaacatcctggacattctggtttatgatgcagattgccatgcttttgggattcatggtgtcctatccggtgaatgcatggttgattaaatcgggtatcaaaaaaggaatgtaa

SEQ ID NO: 3842 - DNA, 1179 bp, B.fragilis
aagataattattatatttgcaataattataaatataataattttagttatggcggttattaatccttttgtagttggaggatacgtttctcctcgttatttttgtgatagagttgctgaaacagaaaacttgatccgtaacttgatcaatgggagaaatgtggctcttgtttcaactcgccgaatgggaaaaacgggattgataaggcattgtttttatcagcctttgattaaagaaggctattatactttctttattgatatatatgcgacttcaagtttgaaagagtttgtttttgctttgggtaaagggatttttgagaagttaaagccccaggggaataaattcatagatcgtttcttttctataattacctctttaaggattggatttaaattagatagtattacaggagaaccgattttagaacttggtttgggagatattcatgctcctgaaactactttagaagaaatctttatctatctggagcaggcagacaagccttgtattgtagcaatagatgaatttcaacaaatcagttcatatccggagaaaaatctggaagctattttaaggactaaagttcagcattgcagtaactctaattttgtttttgcaggaagtcagaggcatataatgatgaatatattcaacagtccttccaggccattttatcaaagcgtgagtatgatgcacttaggagcaattcctttggaggtatataaaccttttgtgaagggattgtttgaggagaatggtaagaaagtgacagatcaattggtagagaatgtatataccctgtttgatgggcacacttggtatgtgcagttaatgttgaatgaactttttattttgacagataaaaagggtatctgtgatgtacctatgataaatctggcactaaacaatataattgctacacaagactttacttttcaagaaatattttctcgtcttccggaaaagcaaaaagagataatgattgccattgccaaagagcagaaagcaaaaggagttacttctgctgcatttattaaaaaatatcggttgacttctgccagttcggtgcagtcggggttgaagggtttactggaaaaagacatgttgactcaggagtctggagggtatcaggtgtatgatagacttttcaatatctggcttaggaggaattactga

SEQ ID NO: 3843 - DNA, 1737 bp, B.fragilis
atcttatatatcatgaaagtatatcagacgaacgaaattaagaacattgcccttcttggcaatgacggctcaggaaaaaccactctcacagaagcgctgctctatgagagtggtattataaaacgtcgcggcagaatcactgccaaaaacaccgtaagcgattactttccggtagaacaggaatatggatattctgtcttttcgaccatcttccatgtagaatggaacgggaagaaactgaacatcatagactgcccgggcagcgatgactttgtaggcgctgccatgacagcactcaatgtaacggatacagcaattttgctgttgaacggacaatatggagccgaagtgggaactcaaaaccacttccgctataccgagaaactgggtaaaccggtgatcttcctggtgaatcagctcgataacgagaagtgtgattatgatatggtgcttgaacaactgaagtccatctacggtcccaaagtagttccggttcagtatccgctggctaccggtcccaacttcaactcgctgatagacgtgctgttgatgaagaagtactcttgggcacccgaaggcggtgcacctatcatcgaagaaattcctgctgaagagaaagataaagccatggagttgcacaaagcactggtcgaggccgctgccgagaacgatgaaggcttgatggagaaattcttcgaacaagattcactgacggaagacgagatgcgcgaaggtatccgtaagggtctggctgcacgtggcatgttccccgtattctgcgtatgtgcaggcaaagatatgggggtacgtcgtttgatggaattcctgggtaatgtagtgcccggtgtatcggaaatgccgaaagtgcataatacccgtggtgaagtggtggaacccgatcccaacggacctacctctttgtatttcttcaagaccggtgtggaaccacacattggtgacgttcagtatttcaaggtcatgagcggaaaagtgcatgaaggagacgactttaccaatgccgatcgcggttcgaaagaacgtgtggcgcagatttatgcttgcgccggtgccaaccgtatcaaagtagaagagatggtggcaggtgacattggctgtacggtgaagctgaaagatgttcataccggaaatacactgaacggtaaaggtgccgagaaccggtttaattttatcaaatatccgaattctaaatattcacgcgccatcaagccggtgaacgaggccgatacggaaaagatgatggccatcttgaaccgtatgcgtgaggaagatccgacttgggtcatcgaacaatcgaaagaactgaaacagaccatcgtgcatggccagggagaattccacctccgtacgttgaaatggcgtctggagaacaatgaaaagcttcaggtgaaatttgaagaaccgaagatcccttatcgtgaaaccatcacaaaagccgcccgtgccgactatcgtcacaaaaagcaatcgggtggtgccggacagttcggcgaggtgcatctgatagtggaaccctattatgaaggaatgcccgtgcccgatatgtataaattcggcggacaggaatttaagattaacgtgaagggtactgaggaagttccattggaatggggcggaaaattggtatttgttaacagtattgtcgggggttctatcgatgcccgcttccttgcgggccatcttaaagggttcatgtcccgcatgaacaaggacctctga

SEQ ID NO: 3844 - DNA, 3528 bp, B.fragilis
taccctcatatcatccaacccctgattagattaaactacgtaaaaacaaatttgttaatcaaatcgtacaaatgtatgaataatcatggaatttttagtcccgataggactaaagtaagaactttattatcaataaaaagtatttttttgtttttgttattcacttttgcattcgaaatggcttatgcttcaagtgtttactctcaaaccaaagtctttactatgcaatctgccgagaaaaccgtattacaggtttttaaagaaatagagaagaatagtgagtttataatcttttatagagacggtgttattgacttaaaccggaaggttagtgtaaatgtggttaaccagtctgttgataaaatactggagcagttactggcacataccgataatggtttcaccattaaagaccgtcaaataatcatttataaaaaagagacttctgcgacaccttcggtttcacagcaaaaaaacaaaattaaagtaaccggggttgttactgatgcaaaaggtgagtctatcatcggtgctaacgttgtcgtaaaagggaatcctaccataggtgccattaccaatatggaaggacgttatgaagtgatgcttccctcggacgatgtcattttattggtttcatatttgggatataataccgaagaaatcaaagtaaagggacgtcgtaatatcaacgttgttttgcatgaggactcaaaagcactcgatgaagtagtgatagttggttacggtaagcagaagaaggaaagtgtggtggtctccatgagttctatcaagcccaaagatattgttgttccttcccgcagccttaataatagtcttgccggtcaggtagcaggtctgatcgccgtacaacgttctggagaacccggttatgacaatgctgaattctggattcgtggagtcagtacttttgccgggggaacttctccgctcgtacttgtcgatggagtgccgagaaatatgagcgatattgaaccggatgaaatagaaacattttctgttctgaaagatgcagctgctactgctatttacggcgcagaaggagctaacggtgtagtattggtgactactaaacgtggccgtgttgaaaaagctaaaatatcttttaagaccgaacacaccatttcatcacctacccgccttcctgagtttgtaggttctgccgattatcttagtttatataatgaggcattgcgtaatgatggtgaaggaccgcagttttcagatgaactgatagcccattaccgtaacaacgacgatccggatttgtatcccaataccaattggattgacgaacttctccggaagaacacctttagtcatcgctatacactcaatgtacgcggcggtactgagaaagccaagtattttgtgtcgggagcctattataacgaaagcggattattcaagaacaggccaaatgggatttatgataccaatattggtatagaccgttttaacttgcgttcgaatatcgatatggctgtatcttccaccactactgtaggggtagatctcgctatgcaataccttattaataattatccgggaacgggtacttccaccattttccgttctatgttaatcacgcctccttatgctttccccgcagtgtacagtgatggtaccgtagccacgtatgcccaggaaagagatgcgaacatgcgtaacccttataacttattaatgaattccgggtatgccaaagaatataggacaggtatacaatcgaaagtaaatgtcaaccagaaacttgattttattactaaaggtttgtctgcaaacttaaatgtaagttatgactacgatagtgagatgattattcgtcgcgagtataatccgacacgataccatgccacaggccgtgatgaattagggcagctgattttttccacagtagtatcgggtaatccggatattcaagatcccaaaaacagtgcgacatctgctaccaagaaaatttatatcgatgcatctatcaactataagcgtacatttggaaagcatgatgtgggagcaatgttactatatatgcaaaaagaaacgcaacagcataatgttccccttccattccgtaagcaaggattcgtaggacgtgctacatatggctatgatgggcgttactttattgaaggtaattttggttataccggttctgaggcatttgctgaaggcaatcgttttggcttttttccggcaataggtgctgcttattacctttccaatgaatcattttatccggaagcaataaaaaaagtggtaaataaactaaagctaagagcgtctgtcgggcggactggtaacgataaaaccggacaggaacgttttttgtatcgtcccacttttactaccaatgccggcggatttacgcagggtatcggtgatacgggcggaactaacggaattggtaacggaattgttgaaggacgtttcgccgctccttatctggcttgggaaattgaggacaagcagaattatggtttcgatctgggactgtttgataaccgcatcgatattatcttcgattatttccgttctgagcgtagggatattttgttacagcgtcgtactgttccacaattgggcgggcttcgtcaagacccgtggcagaattttggtaaagtacgtaatcagggtatagatatgtcgatgaatctcaatcaacagataggtaaactgaaacttagtgctcggggaacctttacttttacccggaataaaattcttgaatatgatgaactacctcagaagtatggatatcaagctgttaccggtacaagagttagtgagaatactctttatatagccgaccgcctttatacagaagacgattttatagtcagtaccaatgctaacggattgaaaacctataaactccgttcggaacttccacgtcctactttaggaggactgattggcccgggtgatatcaaatatgtcgatgtaaatggtgatggcgtgattgactcttatgatcaggtaagaggagtgggtaatccgagtactcctgaaattatttatggatttggtcttaacgctgagtacaaaggcttctatgcgagtatcttttttcagggagcaggcaatacatctgttcttctgggaggagccacttccgaagggtggtatccgttctcttggggcgtcgaccagtccaattatcgcacgtttgctttagaccgctggactgaaaacaatcccagtcaggatgttattattccgcgtttgcataagaacaatgccaataatgccaataatcgggtggcaagcacttggtggttgcgtaatggttccttcttacgactgaaaaatatagagttcggttatcagcttcctaagaaatttatggataagattggttttgaggctgcccgtatttatattatgggatataaccttgctgtgtgggatgacattaaatatttcgatccggaagccggtaatgccaatgcgggtttgaattatcctttgccccgtactttcactctcggtttagactttacattctaa

SEQ ID NO: 3845 - DNA, 201 bp, B.fragilis
aaaacgattttcatgccgggaaatgggagccgacataccgggaaaagtagcggaagcaaccgtgtaaatgaggaaaacaacggctctaaagtaggtgaacaccggctctgcaagctttggaaaccggctctgcgggaacacactgttagtagtataaaaaatagggagaagccaatgcttctccctattaccgtactttaa

SEQ ID NO: 3846 - DNA, 435 bp, B.fragilis
accgacatcttctttttgatcggttttcacagcaggcattgcagactttgcatagctatcgtgccgttatgttcagccctacgatgtttttgtgattgtaaggtgaaacatattatcttgactggtggaacggatacggcccgtagcatagcaaaagctattccggctactccgctttcggcagagaccggagggaagaatgtcattattctgactgcctcgggggatcgtgatcatactattatgaatattgtcatatcagtttttggtaatgcgggacagaagtgttctgcctgttcgttgttggttgagcgttcggtatatgaagataagaacttccaaaagaaactgattgatgtggcttccagcatgaaagcggggagtgtttggaatccgggtaatgtagtggggccaatgataacgaataaaaaatga

SEQ ID NO: 3847 - DNA, 738 bp, B.fragilis
gtatatatcatgtttcaggaagcaattgcgcaatatctcaagcaaaatcattatgaatctatccaactgaaatccgtgcttttcgatatggacggcgtacttttcgactccatgccttatcatgccgaagcatggcacaagaccatgaaggcccatgggctgaatttaagtcgggaagaagcttacatgcacgaaggccgtacgggggccggaactatcaacatcgtatgtcaacgtcaattgggacgtgacgccactcaagaagaaatagagagtatttatctcgaaaagagcatcgaattcaacaagcatccccaagccgaacgcatgccgggtgcatgggaattactacaaaaaatcaaagcggaaggtatcatcccgaccgtggttaccggttccggacaagcctcactgctggatagactcgagcataactttccgggaatgtttcgtcaggaattgatggtgactgccttcgatgtcaaatacggaaagccgaatccggaaccctatctgatggcattggaaaaaggaggattgaaacctaatgaagctattgtcatcgaaaatgcccctttaggtgtagaagccggacataaagccggaatattcaccattgctgtcaacaccggacctctgaacggggaaatactgctgaatgccggtgccgatttattattcccttcaatgcaagccttatgtgaatcctgggagaaattagtccgactcctacattaa

SEQ ID NO: 3848 - DNA, 1458 bp, B.fragilis
tccgtctccatttattttgtagctttgcttcgtataatctttaaaatccgaaaaaacatgaaaagctacaaattattattggcatttaccttattccttgcatttgctttcaatatgaaagcacaatacgttcacgaacgttccgaccaatatacgcctcctgaagatagtctggtaatacaaaaactacatcactggcaggaccagaaatttggaatgctgattcactggggtttatattccgttgcaggaatcgtagaatcatggtctatctgttcggaagaggcagattggattccacgcgacagcactatggcctatgaagactacaaaaaatggtattgggggctgaaagattcattcaatcctacccgtttcgatccggagcaatgggcacaagcggcgaagtcagcaggtatgcgctatgcaatatttacaactaagcaccacgacggattcaatatgttcaatacggctttctccgatttttcaatagccaaaggccccttccaaacagatccccgggcagacgttgccaaatacgtgtttgaggctttccgtaacaatgatttaatggtaggagcctatttttctaaaccggactggcattcggaatattattggtggccgcgctacgccactccccgacgtacacaaaattacaacattgacaagaatccctggcgttggaatcagttcaaagagttcacttacaatcaaatcggagagttaatgcataactacggtccgatcgacattttatggttagacggcggatgggtaaacaatcccggaacgaagtcagttttagacatggaccgtatttcacaaatggcacgacaggcacaaccgggtattttattcgtagaccgtaccatccatggcaaatatgaaaactatcagaccccggaacagcaaattccggacaaacagctcccctacccgtgggaaacttgtatgacactgggagtagactggggatatactccgcatgcagtattcaaatcaccagttacagtaatagcaaagctaatggaaatcgtagcaaaaggaggaagtttattactaggtgtaggtcctacccccgaagggatattacaggatgagattgtcagccgtctgcaaaccataggaggatggatgaagaagaatggtacggctatctacaacactgttacaacaccccaatattatagtgaaggtatctggtttaccatgaataaagatggaaaaacgatgtatgcattatatagtaatccggaaactgaaaagtttcccgactatatagaatgggaaaacaatatccctgcaaaaagaagtgccatctattgtttacagaacgggaaaaaagtaaaatgggaaataaagaataaccgagtacgtgtctacctgcctcaaaacctaaagacagaagttaatgcactcgcattctcttttaccagacaagctattcaataa

SEQ ID NO: 3849 - DNA, 516 bp, B.fragilis
tatgattgcatgaaaaaactatttttccctttactgtcgttatgcttgctgactaccgcttgcaaagattctgttccaagtcctacgatcgaaatgcagggactgtacgtcaatgacggagagatggattatacccggcaaatggaggccttacctcctctcaaagtagatgatgaactcgaaatttcattgaaactggacggcaatggagaggagttgaatacgtttctggtaaaagaggaaactccgggtagtaaagagactgctgtggagattgattttaatgatttgccggaagagacgctcagtgatgataaagagtttacggataaggataatggcaagttagggtttaaggatggagtttctcagactcaaataggtatcagggcaaaggtgcagcaagtgaccgaagatggagtgaaacttaaattctaccttttctccaaacctgttaattgtgaaggggccaagtatgaattggaaatcaaaacttccgataaacaagacgattga

SEQ ID NO: 3850 - DNA, 3858 bp, B.fragilis
tatgaccgcatgggactacgcaccattcaagactggatggtgaaacgtcagttatccggtataccgggtattgtagaaatcaacagttttggcggctatctaaagcaatatgaagtagccgttgacccgaatgcccttttttcattgaacatcaccatcggtaaagtattcgaggcgctgagtaaaaacaaccagaacaccggaggaagctacatcgaaaaagccaaaaacgcttattacatccgttcggagggcatgatcagccgcactaaagatatcgagcagattgtggttgccaaccgcaacggcatcccggtacacatcagcgatgtgggcattgtccgttttggagcacccaaacgttttggagcaatgaccaaagacggaaaaggcgaatgtgtgggaggtatcgccatgatgttgaaaggggccaatgccaatgtagtcacacaagagctggaaaaacgggtagaaaagatacagaaactattacccgaaggagtaagcatagagccgtatctgaaccgctcggaactggtaaaccggaatatctctaccgtagtgcacaacctgattgaaggagctattatcgtatttgtggtacttatcatctttttgggcaacatacgtgccggacttatcgtagcttcagtcattccgctggctatgctgttcgcattcatccttatgcgtattttcggagtgacagccaacctgatgagcctcggcgctattgatttcggtatcgtagtagacggttccatcgtgatagtagaaggcatacttgcccacctatacaacaataaactgaatggacgcactttatcgggaaccgaaatggatgaagaagtggagaaaggtgcttcgggtgtagtacgttcggctacattcgccgtattcatcatcctgatcgtattcttccctatactgacactgagcggaatcgaaggaaaatatttcactccgatggcaaagacattggtattctgcattatcggcgcactgcttctctccctgacttatgtacccatgatggcttctctttttttaaaacacaccattatggtaaaacctacatttgcggaccgtttcttcgaaaaactcaatgtcatatatcaacggtgcctgcatttctgcctccgcttcaaatggcaaacagttaccgtggccttcgctactttaattggttcttttctgcttttcggacgactgggagctgaatttatccctactttggacgaaggggactttgccatgcaaatgacattaccggccggcagctcactttcggagagcatcgaagtttccaatcaggccgaaaaattattgatggaccggttcccggaaatcaaacatgtcgtcgccaagataggtacagccgaggtacccaccgatccaatggcagtagaagatgccgatgtaatgattgtgatgaaaccctttaaagagtggacctctgcatcgagccgggcggaaatggtagaaaaaatgaaagaagccctccagcccctggaaaatcgtgcagagttcaacttctcacaacccattcagttacgtttcaatgaactgatgaccggagccaaagccgatatagctgtcaagttatatggtgaggatactcacgaactttacgcaaaggcgaaagaagccgcccgcttcgtcgaacaagtttccggggcttccgatgtcattgtcgaacagactatgggactgccccaactggtagtgaaatacaaccgcggaaaaatagcccgatacggcattaatatcgaagaattgaatacaatgatccgcacagcctatgcaggtgaagtaagtggcgtcgtattcgaaaatgaaagaagattcgatttagtagtacgccttgatcaggaaaaagtggcggacctcagcctcgacaagctcttcatacgcacttcggaaggcatacagattcctgtcagcgaagtggcaagcatcgacttggtgaacggaccgctccagattaaccgcgacgccaccaaacgccgcatcgtaatcggagtcaacgtacgtgatgccgatattcagcaggtagtatcagaaatacaacagatactggataagaatatcaagttacaacccggatattactttgaatacggaggacaatttgaaaatttacagaatgccatccgtacactaaccattgtaataccggtagccttgatgctgattctgctgattctgttcttcgccttcaagaatgtgacctatacactgatggtattctctacagtaccattatcactgataggcggcattctggcactctggttacgcggacttccgttcagtatctcagcaggagtaggattcatcgctttgtttggcgtagcggtactaaatggaatcctgatgatcaatcacttcaacgatttaagaaaacaaaataaatatgccatgaccaccaatcagattataaaaagagggacaccccacctgctacgtccggtatttctcaccggactggtagcctcactgggcttcgtaccaatggccatcgccacatctgccggagcagaagtacaacgccctctggcaacagttgtaatcggaggattgattctatccactatattaacgttgattatccttccggtcttttataaaatagtcaatgcggcaagtgccggttggaaacagcctaagagacggttgcatctgttcatcctgctaccggcacttctgctgagtgccaccgccacggcacaggccccacaaaccgtcagcctagaacaagcgatagagatagccaagcaaaaccacccaagactgaagatagccacaacggccatccggcaggcacaagccggacggggagaaattgtagaagcgactcccaccacattcaactattcgtggggacagttgaatggtgaaaataagaaagacaaggaaatggctttcgaacagagtctgggttcattgttgacgccgttttacaaaaatgtacttatcaaccgacaggtacaaacaagcacttactacctccaaatggtcgaaaaggagattacggcagaagtaaagcgcgcatgggcctattatcagtatgcctccgggatgtcttcactctatcacgaccaagaccggatggctgccgaattaaggcgtatcggtgagttgagatacgaacagggagaaatcaccttattggagaaaaacatgatgactacactggcagccgatttacacaatcgactcttccaggcactagaagagaaaaaagtagctttggcccgctttcaatggagttgttatgcagatgacccgattacaccgaaagatacgataatgacactcttccccaccgattgtgagcagagaagtacctccgaagcccatctcggattcttcaatagccaagcttccgaagcacgggcaatcttgaatgtagaacgcagccgtttctttccggaattaagtatcggatacagccgccaggatattttgccactgaaaaatctaaatgcctggatggtgggtgtatccttcccgatctacttcctgccacaaaaaagtcggatcaaacaagcgaaattagcagtttcggcggcacaaatacaggccgaagccaacatccgagaattgaacaataaaataacagagttgagtgctgccttgcgacgttacgaagaaagtctccggttctatacttcgtcggcactcaaagaggcagacgaactggtcaaaacagccaacttacaattacaacacagcgaaaccggtattgcggaatttatccagtcggtcagtgctgcccgtgaaatacgcaaaggctatatcgaaactatatatcaatacaacatagcttctttagaatacgaactttatcaataa

SEQ ID NO: 3851 - DNA, 2679 bp, B.fragilis
taccggttaataaattatctcgtttttattttgatataccaaaaaacattcatagctttgcaggcacgtttgttaatgataagtaagcttctacatatttacttattaataaagaaatctaagacacattgcatcgtggaaaagcaaatttactcttacgaggaagccttcgaagaatctttacgatattttcagggcgatgaacttgctgcgcgagtttgggtaaacaaatacgcagtaaaagactctttcggaaatatttacgagaagtcaccgaaggatatgcattggagacttgccaacgaggtggctcgcattgaagcaaagtaccccaacgcactaagttccgaacagttgtttgagctgtttgatcattttaagtatatcgtaccgcaaggtagtccgatgacaggtataggtaacgattatcaggttgcttcactttccaattgctttgtgattggtattgatggttctgccgattcatacggtgccatcatcaaaatagacgaagaacaggtgcaactgatgaaaagacgtggtggtgtaggtcatgatctctcgcacatccgtcccaaaggttctcctgtgaaaaactccgctctgacttctaccggtctggttccgttcatggaacgttattccaattccacacgtgaggttgctcaagacggacgtcgcggcgcactgatgctcagtgtatcgatcaagcatccggactcggaagcatttatcgacgccaaaatgacagaaggtaaggtaacaggagccaatgtttcagttaagctggacgatgcattcatgtcagcagccgtagaaggcagaaaatatacccaacaataccctattgactccgatcacccgactacggtaaaagagatcgaagcttccaacctatggaaaaaaattgtgcataacgcatggaaatcagcagaaccgggtgtattgttctgggataccattattcgcgaatcagtgcccgactgttatgcggacctgggatataaaacggtttcgacaaacccttgtggtgaaattccattatgcccctacgattcttgccgactgttggccatcaatctatattcatacgtagtcaatccgttcaccaaagatgcctacttcgacttcgatctcttccataaacatgtagcactggctcagcgcatcatggatgatatcatcgatctggaattggagaagatagaacgtatcatcgagaaaatcgatcaggatcccgaaaacgaagaagtgaaacacaccgaacgcggactgtgggaaaagatctataagaagagtggtcagggacgacgtaccggtgtcggtattacagccgaaggcgatatgcttgccgctctcggaatgcgttatggaacagaagaagcgacagagttttcagagaaagtgcacaaagcagtcgctctgggtgcttatcgttcatcagtggatatggccaaagaacgcggagcattcgatgtatatgactcggaaagagaaaagaacaatccgtttatcaaccgcttgcgcgaagccgacccggcattgtatgaggatatgaaaaaatatggtcgccgtaacattgcgtgcctgaccatcgctcctaccggcacaaccagtctgatgacccaaactacctcgggtatcgaaccggtattccttccggtatacaaacgcagaagaaaagtaaacccgaacgataccaacgtacgagtcgactttgttgacgaaaccggagatgcctttgaagaatacatcgtattccaccacaagtttgtgacttggatggaagccaacggctatgatccggctaaacgatacactcaggaagaaatagacgaactggtagcaaaatcaccttattacaaagcaacgtccaacgatgtggactggttgatgaaggtgcgtatgcaaggtaaaattcagaaatgggtagaccactccatcagtgtgaccatcaacctgccgaacgatgtagacgaagaattggtaaatcgcctgtatgtggaagcctggaagtcaggctgcaagggctgtacggtttatcgtgacggttcccgttcaggagtgctgatctctgcgaagtccgacaaagataagaaagaggaactccctccttgcaaaccaccaacggtagtcgaggtacgcccgacagtgcttgaagccgacgtcgtacgcttccaaaacaacaaagagaaatgggtggccctggtcggcttgctcgacggcagaccttatgagatattcaccggtctgcaagacgatgacgaaggaatcattattccgaaaagcgtaaataccggacgcatcatcaagaacgtcgatgaaaacggaaacaaacgctatgacttccagttcgagaacaaacgcggatacaaaatgaccatcgaaggtctgtctgagaagttcaataaagaatactggaactatgctaaactgatttcaggtgtacttcgctggagaatgccgatcgaacaggtgatcaaactggtaggttcgctgcaattggacagcgagaacatcaacacctggaagaatggtgtagagcgtgcgctgaaaaaatatgtgcaggacggaacagaagccaaaggcaagaagtgccccaactgcggaaacgagacattagtttatcaggaaggttgcctcatctgtaccacttgcggtgcatccagatgtggataa

SEQ ID NO: 3852 - DNA, 2718 bp, B.fragilis
ttaaatctaatatatatgatagttacatttcatattgaatatcgcacaagctggggagaagaagtcagaatattaggttctgtccccgaacttgggaaaaataatccggagcaggctgtagcccttaccacagtagacggcattcattggagcaatgaaatatccattcaattgccggccgaaggggttgtcgaatacagttatcacatatatcgtgacggtaaggccatccgtaccgaatggaactcctttccgcgacgcatctatctgccggccgacgttaagaaaagcctgcgcatcaacgactgctggaagaatcttccggagcagcaatacttctacagttcggcatttaccgaagcactgctggcgcaccgcgaacgaagcgcaatccccaaaagctacaaaaaaggattgatgatcaaggcttatgctccacgcatcaacagtaagtactgcctggccatctgtggtaaccagaaagcactcggcaactgggacccggacaaggcatggcccatgagtgatgccaactttccggaatggcaagccgaactggatgcttccaaactggaatttccgctagaatacaaatttgtattgtacaataaagaagagaagcgtgccgaagcttgggagaataaccccaaccgctatctggctgctcccgaaatcaaagcaaacgagacattggtcattgccgaccgatatgcctactttaatattccttcctggaaaggtgcaggcgtagctgtccctgtattctcactaaagtcggaaaaaagtttcggtgtaggagacttcggagacctgaagagaatggtggactgggcggtcagtaccaaccagaaggtagtacagatcttaccgatcaacgataccaccatgactcatacatggacagactcttatccctacaacagcatttccatttatgccttccacccgatgtattccgaccttaaacagatgggcaacctgaaggataaagaaactgctgctaccttcaaccgaaaacaaaaagaactgaatgcactttccgccatcgactacgaagctgtcaaccgggtgaaatgggaatatttccatcagatattcaagcaagaaggagaaaaggtgctggcttcgaaagccttccgcagcttcttcgaagccaacaaagattggctgcaaccgtatgctgcattcagctacctgcgcgatttataccatacaccgaacttccgcgaatggccccaatactcggagtacaatgctcaagagattgaagaactgtgccgccccgacacggcggactatgcccatatcgccatctacttctatatccagttcaatcttcacctgcaattgctcgaagccaccacttatgcccgcgagcatggagtagtgctgaagggggacatccccatcggtatcagtcgcaacagtgtagaagcctggacagaaccttattatttcaacctcaacggacaggccggtgctccacccgatgatttctctgtcaacgggcagaactggggtttccccacctataactgggatgtgatggagaacgacggttataaatggtggatgaaacgtttccaaaagatggctgaatactttgacgcctaccgcatcgaccacattctgggattcttccgcatctgggaaatcccgatgaatgccgtgcatggattgctgggacagtttgtacccgcccttcccatgagccgtgaagagatagaaagctacggactctctttccgtgaagagttcctgcggccgtatatccatgaatatttcctcggacaagtgttcggaccacataccgactatgtaaagcagacgttcatcgaaccgactgaaacttacgaggtgtaccgtatgcgtccggaatttgatacccaacgcaaggtagaagccttctttgccggcaagaacgacgaagacagtatatgggtcagagacggattatatgccctgatcagtgacgtattatttgttcccgaccgcaaagacccgaacctgtaccatccccgcatcggcgtgcagcacgactttatctaccgtgccctgaacgactgggaaaaaacagcattcaaccgcctttacgaccagtactactatcatcgtcacaatgacttctggcaacagcaagccatgaagaaattgccacagcttacccagtctacccgcatgctggtatgtggcgaagacttaggcatgattcccgactgcgtggcatgggtgatgaatgacttacgtatcctgagtctcgaaattcagcggatgcccaagaatccggcagaagaattcgggaggctgaacgaatatccgtaccgttcggtctgcaccttctccacccacgatatgtcgaccctgcggggctggtgggaagaagactatcagcagacccaacgctactacaatcagatgctgggacattatggtaccgctcctgccatagcaacgccggagctgtgcgaagaagtagtacgcaatcacctttacagcaattccatcctctgcatcctatccctgcaagactggctgtcgatggatggaaaatggcgcaacccgaatgtacaggaagaacggatcaatatccccgccaatccgcgtcattactggcgctaccggatgcacctgacactggaacaactgatgaaagcagaaagcctgaatgaaaaaatcagggaattggtgaagcagacaggcagaaatccggaaaagtaa

SEQ ID NO: 3853 - DNA, 450 bp, B.fragilis
aaccaaacaatcgacacaacaaggatcataattgcattaattatcctatttttgccggaagatacatcaattataaaacttatgactacccagcattatatcttcctggaaaacgtacgtttctacagttatcacggagtggccccccaagagaccgccatcggcaatgagtttatcatcaacctgagactgaaaacagacttcggcaaagcgaccgaaaccgatgaagtggaagataccgtgagttatgccgacatatatgccgcactgaaagaagagatggaactgccttcaaaactgctggaacatgtatgcggacgaatcgtaaaaaggctcttccgggactttcggaaaatcagggagatagaaatcaaactggcgaaaagaaacccgcccatgggagcagacatcgactctgccggagtagagatgcattgcacgcgagactga

SEQ ID NO: 3854 - DNA, 2160 bp, B.fragilis
gaaaaacaaatgatagtttgcatagccgaaaagccctctgtggcacgtgatattgctgatattttaggagcccgcgaaaggaaagaagggtatattgaaggaaacggataccaggttacctggacattcggtcatctttgtaccctgaaagaacctcacgaatatactcccggctggaagtcatggagcctgggcagcctgcctatgattcctccacgttttggcatcaaactgatagagaatcctacttacgagaaacaattccatattattgagggattgatgcaaaaggctgatgagataataaactgcggtgatgccggtcaagagggggaactgattcagcggtgggtgatgcagaaagccggagcgcggtgtccggtaaaacgtttgtggatctcttcactgacagaagaagctattaaagaaggatttgcgaaactaaaagatcagaaagattttcaaccactttatgaggcggggatgtcccgggctattggtgactggttgctggggatgaatgccacgaggctctatactgtaaaatatgggcagaatcggcaagtgctttcgatcggacgagtacagacccctacactcgcactgatcgtcaacaggcaactggatattgaaaattttcagcctaaacaatattgggaactgaaaaccatgtatcgtgatacaactttctcggcccttattcgtaaaagtgatgaagagctggcggctgaagaagaaaagtccggtggtaaggctaagaaaacagagaaccggggcattgatccgatagctaatcgtgaagaggggatggcattggtggaacgcattaaagatctgccttttgtcgtgacttctgtggctaaaaaagacggaaaggagtatgctccccgtctgttcgacttgacttctcttcaagtggaatgcaataagaaatttgcctattctgccgatgaaactctgaaacttatccaatctctttatgaaaagaaagtgaccacctatccacgtgtagatactactttcctgagtgacgatatttatcctaagtgtccgaatatcctgaaaggactgaaagattatgaagtacttactacgccgttggcaggagcttcattgcctaagtcgaaaaaggtttttgatagttcgaaagtaaccgatcaccatgccattattcctacaggagttcatccgcaaaacctgacggatatggagcgtagggtatttgatttgatagctcgccggtttatagcggttttttatcctgattgcaaagtttctactacaacagtgatgggagaggttgatagtatcgagttcaaggtaaccggtaagcagattctggaaccgggatggcgggtagtatttgccaaagacgtaaaagatctgaatgaagaaaaagaaggtgaagatgaaaacgtgcttcctgctttcgtgaaaggggaaagtggtccgcatataccggatttgaatgaaaaatggactcagccgcctaaaccctatacggaagctaccctgcttcgtgcgatggaaacagccggtaagctggtggataatgatgaacttcgggatgcattgaaagaaaatggtatcggccgtccttctactcgtgcagctattatcgaaactctctttaaacgtaactatatccgtaaggaaaagaagaatctgatagctacccctaccggagtggaattgattcagttgattcatgaagagttgctgaagtcggctgaactgacgggtatctgggaaaagaaattgcgtgagatagaaaagaaaacttacgatgctcgtcaattcctggaagaattgaagcaaatggtgtctgagatagtaaatagtgtgctatctgataatacgaaccgtcgtatcaccattcaggaggctacagcggtagaagaagaaaagaaaaagaaagaaccgaaaagacgggaacggaaatctgctactccgaaggaaaagaaaggtaaatcggagcctgcaacagtcgatgtgtcttctaccggtcaatctgttcgggcggatgccttaaaagaaacagattctttggtagggaaactttgtccggtttgcggaaagggagtgataatcaagggtaaaactgtttatggctgttccgaatggaaaaatggatgcacttatcggaaagcgttcgaatag

SEQ ID NO: 3855 - DNA, 1158 bp, B.fragilis
aacgcaaaaataactcagaccatcatggcaggcatatacatacacgtccccttctgtaagacacgctgtatctattgcgatttttactcaacgacgcgaagcgaatggaaaggacgctacatcgaagcactctgcaaagagctggaaatgagatatacttacctgaaaggaaagcctattgagacgctctactttggtggaggtactccttcgcagctcgacgaaaaggatttccggaaagtattcgacaccgtccgccgggtttatgggatggagaattgccatgaaataacccttgaagccaatccggatgacctctgtccggaatacctgcaaatgctctccgaattgccgttcaaccgcatcagcatgggcatccagacatttgacgacactacgctcaagttgctgaaacgccgccacaatgcggctcaagccattcgtgcggtagagttgtgccgtgcccacggtttcctcaacatcagcatcgacctgatctacgggctccccggtgaaacaacggaacgctgggaaaaagacttgcaacaggctattgccctagacgtggaacatatatcggcttatcacttgatttacgaagaaggtactcccatttataaaatgttgcaaaagcatcaggtcgaagaggtggacgaggacagcagtgtccggttcttcaccttattaatagaccggttgcgtgaagccggatacgagcattatgaaatatccaacttctgcaagccgggcatgtattcgcgccacaacacttcgtactggcagggagtaagttatctcggctgcggcccgtcggcacactctttcgatggacaaacccgggaatggaactgctcttcgatcgaaaaatacatgtccggcattgaaagcggacaacgggacttcgaacgggaagagcgggatctggccacccgatacaacgaatttatcattacctctgtccgcactcaatggggaatttcactcgaacgcctcagtaatgattacggaacgcaactggagcagtattgtctcaaaatggcacgtccttctttagaaaacggcaaattagaaatatacgaaggtgctttgcgcctcacccgcgaaggaatttttatttccgacagcatcatgagcgacctgctctgggtggaaaactaa

SEQ ID NO: 3856 - DNA, 468 bp, B.fragilis
catgatgaaataaggaggaaaagtatggaaattatattgaaagaagacgtagtaaacttgggttataagaatgacatcgtaactgttaagtctggttatggtcgtaattacttgatccccactggaaaagctgttattgcttctccttctgcaaagaaaatgttggctgaagaactgaaacaacgtgctcacaaacttgagaaaatcaagaaagatgctgaagcattggctgctaagttggaaggcgtatcattgactatcgctacaaaagttagctcaaccggtactatcttcggttctgttggtaacatccagatcgctgaggaattggctaaattgggtcacgagatcgacagaaagatcatcgttgtaaaagacgctgtgaaagaagttggtgcttacaaagctatcgttaaactgcacaaagaagtttctgtagaaattcctttcgaagtagtagctgaataa

SEQ ID NO: 3857 - DNA, 1005 bp, B.fragilis
tttatagaaatgaaattacccggtaagatagcgataatgggcggaggaagctgggctacagccatcgcaaagatgtgtctggctcaggaagagtctatcaattggtatatgcggcgcgacgaccgcatcgccgatttcaaacggctcgggcataatccagcctatctgacaggcgtaaagttcgacatgaagcgcatcaatttcagctccaacatcaacgatgtggtgaaagagtctgatacgctaatcttcgtcaccccttctccatatctgaaagctcacctgaaaaagctgaaaacacggatcagagacaagttcattattaccgctatcaaaggtattgtccccgatgacaatctgattgtttcggaatactttaacaaggaatatggcgttcctcccgaaaatattgccgtactggccggtccatgtcatgccgaagaagtggctctggaacgtctctcttatctcaccatcgcttgtccggacaaggataaagcacgcgtttttgcccgtcgactgggcagcagtttcatcaagacttctgttagcgatgacgtgataggaattgaatacagttccgtactgaaaaatgtatatgccatagcagcaggcatctgtagcggtttgaaatatggagacaacttccaggccgtactgatatcaaacgctatccaagagatgaatcgattcttaaatacggtacatccgataaacagaaacgtagatgaatctgtttatctgggtgatttgttggtgaccggctactctaacttcagccgtaaccgtacgtttggtaccatgatcggtaagggatactctgtaaaaagtgcccaaatcgaaatggagatgatagcggaaggatattatggaacaaagtgtattaaggaaatcaataaacatcatcacgtaaatatgccgatactggatgctgtatacaacatcttatatgagcgcatatctccgatgattgaaataaaattgctgactgactcgtttagataa

SEQ ID NO: 3858 - DNA, 387 bp, B.fragilis
ttttcaggaataacaattaaaaaagtaggtattatgaaaagattaggattaacattagtggcagcgctatgccttgttgctactacatttgcagcaggcaatcaacctacagttgcaaaatgggaaggtaacatcaatgtgaataaattgggtaaatacctgaatttatcttctgtacaggcagaagaagtagccaacatttgcaactattttgacgaacagatgggaagagccaccactgcgaaaaagaacaaggataccatggttcgtaacgctgtttacggcaatctgaaattgatgaaaaagacgttgacagatgctcagtacactaagtatactacaatattgaacatgactttgaagaacaaaggcatcgaagtaaagtag

SEQ ID NO: 3859 - DNA, 786 bp, B.fragilis
gatagaatgattattctttttatatctttgcagaaaaaagatatgatggatacagttaagaacagaaggacaatccgcaaataccagcaaaaagatattacgccggatttgttaaatgatttgcttgaaacttcatttcgcgcttctacgatgggtggaatgcagctttatagtgtggttgtcacccgtgatgccgagaaaaaagaaatactttctccggctcattttaatcagccgatggtaaaggaggctccggttgtattgacattttgcgcggattttcgtcgtttttgcaaatattgtcaggaaaggaatgcggagccgggatatggtaatttaatgtcctttttgaatgccgctatggatactttattggttgcacagactttctgtacgcttgccgaggaagccggattgggtatttgctatttgggtactactacctataatcctcaaatgatcatcgatgctttgcacttgcccgagttggtgtttcccattactacagtgactgtgggatatccggcggaatctccgaaacaggtagaccgtctgccgatagagggcattatacatgaagagagctatcacgattataccgccgaagatataaaccggttatatgcttataaggaatctttgcctgagaacaagttatttatagaagagaatcagaaagagactctggcccaagtattcacggatgtccgctatacaaagaaggataatgaatttatgtctgagaatctgttgaaggtacttcgccggcagggctttatggattaa

SEQ ID NO: 3860 - DNA, 522 bp, B.fragilis
tctttttttgtgttacgagataggatttgtcaaagaagacatttatctttgcaaagttgcttaaacaataatttcatgatcgaacaatttaactttgatatcaggctgatctttgccatcttgaatggtaaggtctctgctgccattaatcggaaactataccggaacttcagacagaacggtctggaaatcagtccggagcaatggacggttcttatttttctctgggaaaaagacggagtgacacaacaagagttgtgcaatgcaacttttaaagacaaaccgagtatgacccgcttgattgataatatggaacgccaacatctggtggtacgcatctccgataaaaaagaccgccgtaccaatctgattcatctgaccagaacaggaaaagagctggaagaaaaggcccgtatcatagctaaccggacccttaaagaggcgctgcatggcatcacagtcgaagagctaagcgtaagccaggaagtattaagaaaaatattcttcaacaccaaagattaa

SEQ ID NO: 3861 - DNA, 681 bp, B.fragilis
aatacatttgtacgggatatacttaagatacagaaattgaaaaaactctattggtattttttttccttgttagcctttggatatatgttccaggcttgcgacaattcgaagacttatgctgaaatgctggatgaagagaaagacgcagtaaacgcctttattaaaaaacacaatatccagactatttccgagagtgactttgaagcaaacggatataaaacggatacgaccaagaacgaatacgtggctttctcaaacggagtctacatgcaaattgtggataagggtatagttaccgataaaccggaaaatgactctatcaagaataacaatattgtagccgtacgctttgtagagcacgacatcaaggcgaacgataccacttgcttcaatgtggtgcttcccggtttcgaaaattatccgaattactatacttatccggacgttttccgttatgtggataacggtacttcagtagccggtgtatttacagaggggtcgatgtatgccaaatatggtacgacggatgttcctcccggatggctgcttgctttaaagtatgttaccaattatgcccatgtgagaatgattgtaccttcgaagatgggacatcagagtgcaaaccaatatgtaaacccctatttctacgatattcgtaaatttcagaaagcattgaactaa

SEQ ID NO: 3862 - DNA, 465 bp, B.fragilis
  unsure (305): Identity of nucleotide sequences at the above locations are unknown.
agggttcatgtcccgcatgaacaaggacctctgacggtttcgtatgcccgcgatgtacgcgtcattgtatatgaagaaaagatgcaccgggtagactctaatgaaatttcgttcatgctggcggaacgtaatgccttcagcgaagcgtttaagaacgccggaccgaagattctcgagcccatttatgatgtggaagtcttcgtaccgtccgataagatgggtgacgtgatgggtgaccttcagggacgccgtgccatgatcatgggtatgagcagcgaaaacggttatgagaaactggtggctanagtgcctttgaaagagatgtcttcttattcaaccgctcttagttcgcttaccggaggccgtgcttcgttcattatgaaatttgcaagttacgaactggttccgagtgatgtgcaggataagttaataaaagacttcgaatccaaacaaacagaagagtaa

SEQ ID NO: 3863 - DNA, 1584 bp, B.fragilis
ttagggagtgttaattttgttgctatgaaaaagtcaacaatctggatattaggcattattatgggtctttcctttctgagtttgctctatttacaagtgagctacatcgaagaaatggtgaagatgcgtaaagaacaatttaatacatccgtgcgaaatgctttgtttcaggtttcaaaggatgtagagtatgatgaaacgcaacgttggctgttagaggatatcactgaagcggaacgcagagcactggctcagtcttcttctactaccgaacagaaaaacggtttaattcagcaatcggagcgttataggttcaagtcaccggacggaaccctgtattcggagtttgaactgaagatgattaccaccgagccgtcgaaagtgcccaaagccatgatttccgaaaggcatggccggaataccattccgcagacatcacggagcttgactgacgctattaaaaataggtatatgtatcagcgttttctgctcgacgatgtggctttgcggatgatttacaaggcaagcgataaatcgattggcgaacgggtgaactttaagaagctggataattatctgaaatcgaactttattaataatggtgtagagttgctctaccatttttcggtgatcgataaagatggacgtgaagtatatcgttgctcggactacgaagacggagggagtgaagactcttatacgcaacctctgttccagaatgatccgcctgcgaagatgagtattgtgaaggtgcactttcccggtaagaaagattatatcttcgactcggttagttttatgattccttcgatgatattcactatcgtactgctgattacattcatcttcaccatctacatcgtcttccgtcagaagaagttgacagagatgaagaatgactttatcaacaacatgacgcatgagttcaagacaccgatatcgaccatctcgcttgctgcccagatgctgaaagaccccgcagtcgggaagtcgccgcagatgttccagcatatatcgggagtcatcaatgatgaaacgaagcggttgagattccaggtggagaaggtgcttcagatgtctatgttcgacaggcagaaagcaacgctgaagatgaaggaactcgatgccaatgagttgattaccggagttatcaatacgttcgctttgaaggtggaacgctataatggtaagattacatcgaaccttgaggctaccaatcctgttatatttgcggacgaaatgcatatcaccaatgtgatattcaacctgatggataacgcggtgaaatacaagaagcccgaagaagacttggtgctcaacgtgagaacctggaacgagcccggtaaactgatgatttcgatacaggacaacggtattggtattaaaaaagaaaacctgaagaaggtgtttgataagttctatcgcgtgcatacaggtaatctgcacgatgtaaaaggtttcggtctgggactggcttatgtgaaaaagattattcaggatcataagggaaccatccgggcagagagtgaactgaatgtaggaactaaatttattattgcattacctttattaaaaaatgattga

SEQ ID NO: 3864 - DNA, 1467 bp, B.fragilis
aagttttgcttaattaataaatgtattacagccgctatgagtgaatcgagtcatgtcggcctatggaaccgctgtcttgaaattattagagacaatgttcctgagtcgacatacaaaacatggtttgttcccattgttcctttaaaatatgaggacaaaacgttaatcgtacaagttcccagccagtttttctatgaattcctggaagataaatttgtggacttgctacgtaagacgttatataaggttataggcgacggcacgaagttgatgtacaatgtgctggtggacaaaagttcaggggcaaccgtgaaccaggagtctactacccgctctacggctattccccaatccggacttccccgtgttgatgaaaggaaagctccgggcttgctgcgtgcaccggccgttcaggatcttgatccccatctaaatccgaactataactttgagacctttattgaaggatacagtaataagctttcaagaagtgttgccgaagctgttgccgagaatccggcaaaaacagtcttcaatccgctgttcctccatggagcatcgggagtaggaaagacccatttggccaatgccatcggtacccgcatcaaagagttgtatccggacaaaagagtgctttatgtttcagcacatttatttcaggtacaatataccgattccgtacgtaacaatacaacgaatgacttcatcaacttctaccaaacaatcgatgtattaattattgatgatattcaagaatttgcaggtgtcaccaaaacacaaaacactttcttccatatctttaatcacctacatcagaatggcaaacagctgatattgacttccgaccgtgctcctgtattattgcagggtatggaagagcgcttactgacccggtttaaatggggaatggtagccgaattggagaagcctaccgtagaactgagaaaaaatatattaagaaataaaattcatcgggatggattacaattcccttcggaagtaatcgactatattgctgagaatgttaatgaaagcgtgcgtgacctggaaggtattgtcatttccatcatggcccactctaccatttacaataaagaaatcgatctggacctggcacaacgcattgttcgcaaagtcgttcgttgtgagacaaaagctgtcactatcgatgatatcatcaacgtagtttgcaagcacttcgatttggagtcatctgctatccataccaaatcaagaaaaagggaagtcgtacaggcacgccaagtagccatgtatttagctaaaacacatacagacttctctacttccaaaattggaaaattcataggcaataaagatcatgccaccgttttgcatgcatgcaaaacagtaaaagggcaatgtgaggttgacaaaggattccgatcggatctggaaaacatagaaactttactcaagaaaagaaacgtgagtaacggtgaacggtag

SEQ ID NO: 3865 - DNA, 666 bp, B.fragilis
cctatgaacgtacaaatagaagagagctggaaaactcatttagaaccagaatttgagaaggattatttccgcacactgactgaatttgtcagaagtgaatatagccagtatcagatctttcctccgggaaagttgatattcaatgcattcaatttatgtccgtttgataaagtaaaagtagtcattatcggtcaggacccctaccatggtcccggtcaggcacacggcctttgtttctcggtgaatgacggagtagcctttccaccttctctggtgaacattttcaaagaaataaaagaagatatcggcacgccagccccgtccaccggtaacctgacaagatgggctgaacagggtgtcctgttgctgaacgccaccctgacagtacgcgcccaccaggccggttcacaccaacgtcgcggttgggaagagtttacagatgctgccatccgtgtcctggccgaagaaagagaaaatctggtattcatcctttggggaagttatgcacaaaagaaaggtgccttcattgaccgtaacaagcatttggtactcagttcggcacatccttctcccctctctgcctacaatggcttctttgggaataagcatttcagtaaaacaaacgaatacctgaaagcccatggaaaaacagaaataaactggtaa

SEQ ID NO: 3866 - DNA, 531 bp, B.fragilis
aaggatgacgttatggaaaaactaattcgaagaatcgggctggtagcgcacgatgctatgaaaaaagacctgattgaatgggttctttggaactcggagttattgatgggacataagttttattgtacaggtaccaccggtacgctgatacaggaggcattgaaagagaaacatcccgatgtggagtgggattttactatcctgaaatccggtcctctgggcggcgaccagcagatgggatcgcgtattgtggatggagagatcgattatcttttcttctttaccgacccgatgactcttcagccgcacgatacggatgtgaaggcactgacccgtctggcaagtgtggaaaacatcgtcttttgttgcaaccgttccactgccgatcatattatttcaagtccgctcttccttgatccggactatgaacggacacatccggactactcgggctatacgaaacgtttcgagaataaaccggtggtgaccgaggcggtagaatcggtgaagaaaagaaagagaaagaaataa

SEQ ID NO: 3867 - DNA, 570 bp, B.fragilis
aattataaagtcatgaccgaatcagaggttcgaaaactactcagacgaatgaaggagctggattcgcaaacagcgttccgggccttctacgatatgacgtacgaccgtctctaccgcatcgcctactactatgtaaaacgcgaagaatggtcgcaggaaatcgtactcgatgtgttcctgaaactctgggaacagcgcagctcgcttcccgaagtcaaaagcattgaggactattgcttcatattggttaaaaacgcttcactcaactatctggagaaagaaaacaggcgtaccacggtatctaccgagacattgccggaacccgaagcacaaagcgactcacccgaagaatcgatgatcagtgaagagttgtttgccatttatgtgaaagcactcgaccgcttgcccgaacgttgcagagaggtattcatccgcatccgggaagagaagcaaagctatgcacaggtagcagaagaactgggtatcagcaccaagaccgtagacgctcaactccagaaggcaaccatccggctgaaagaagcaatatcgatggtgaataatgatcgataa

SEQ ID NO: 3868 - DNA, 540 bp, B.fragilis
aatatgaaagtgcttgatttgatagacaaatattatcctcaggataatgaactgaaacatattttgaacgtgcatagccggtcggtggctgataaagctctatggatcgccggaaaacatccggaactgaatctggatactgtctttctggaagaagccgccatgctgcatgatattggtatcttcctgacacatgctccgggtattcaatgttttgggacggaaccttacatttgtcatggatatctcggagccgggcttgtccgtaaggaaggtttccctcgacacgcattagtctgtgaacggcataccggggcgggactttcactgaaagatattatggatcaaaaacttcctgtcccccatcgcgaaatgttgccggtgagtatggaagaacaagtgatttgctttgccgacaagtttttttcgaaaacccatctcgaccgtgagaaaactgtggagggggctcgtaagagcatcgccaagtatggagatgaaggtttgcaacgttttaacaattggtgtaagctatttctttag

SEQ ID NO: 3869 - DNA, 1128 bp, B.fragilis
aacgatcaatttgataacattttagcctattgttcatacagatatagatattattcatatctttgccgacaaataacaatcaataaacctatgagttacctaataaaacctcagaattataaacctttgcttgacctgaaacagacagaactgggcatcaaacaaattaaagagttcttccagctgaatctttcttcggagctgcgtctacgccgtgtcacagccccactcttcgtactcaaaggaatgggtatcaatgatgacctgaacggtatagaacgtcctgtctcatttcccatcaaggacctgggcgatgcacaagcggaagtagtacactcactcgctaaatggaagcgcctgaccttggcagattatcacattgaaccgggttatggtatttatacggacatgaatgccatccgctcggacgaagaactgggcaatctgcattcactttatgtagaccagtgggactgggaacgggtaattactgccgaagaccgtaatgccgacttcttaaaagagatcgtaaaccgcatttatgccgctatgatccgtacggaatatatggtgtacgaaatgtacccgcaaatcaaaccttgcctgccacagaagttgcactttatccattcggaagaattacgccagttgtatcccgatatggaacctaaatgccgcgaacatgccatctgtaaaaagtatggagccgtatttatcatcggcatcggttgcaagctgagtgatggcaagaaacatgacggacgcgccccggactatgacgactataccagcaaagggttgaacgacctacccggactgaatggtgacctgttgctctgggacgatgtgctgcaacgctccattgagttgtcctcaatgggtatccgtgtagacaaagaggctcttttacgccaggtgaagcaagagaatcaggaacaaagactggaactctatttccataaaagattattgaatgatacgcttccactctctatcggcggcggtatcggacaatcacgcttgtgcatgttctacttacgcaaagctcatatcggcgagattcaggcaagtatctggccagaagaaatgcgtcgtgaatgtacagcccttaatatacaccttatttaa

SEQ ID NO: 3870 - DNA, 636 bp, B.fragilis
aggactctttcgccgttcgccgatgatacgtatctttgcatcattcaaacagatgcaaagagtcttatggaaacatttattgaaaagttcagaaacagctatcatctttcagaaaacgacacgcaaaccctgctcagctatatggaggagatccgtttcaaaaagaaagaagtcatcgtccatgaaggctccaaaaacggaaatctgtatctgataaagcagggcatctggcgtgcccattatctgaaagatggagtggacactaccatttggtttgccggtgcaggcgaagctgccttttcggtatggggatatgtggaaaatactgcatcgcacatcacgattgaagtcatgtgcgatagcatagcctactgtattccgggatcaaccctgaacaatctttatgcttcatcgctcggactcgccaacctgggacggcaactgatggaacggcaactgctcagcctcgaaaactggctgatcagcgccggaagccccaaagctaaagaacgttatctgacccttatcaaagaacatcccgaactattacaaaatgtgcctttaaagcatatagcctcttatttgtggattacaccacagtcgctgagcagaatccggagagaaatgaaaatgtaa

SEQ ID NO: 3871 - DNA, 1560 bp, B.fragilis
gaatattttccttcatctgttattatattatttagtgaaattaataaaagaagaactatgaacaaaccctatttcattgcatttttactctctttagctttatggacagtcattccttctgtttttgccggagatgttgttttaaaagtatttgaagggaaaccacgtatcaattctcctcatatcacaggtaattatccttcaactccatttatcttttatattccgacttccggtcagcgaccgatgcagtggagtgcggaaaaactccccgaaggactggaactggattccaagactggaattattagtggagtcgtgacttccaaaggagattatactgtaaccctgaaggctgagaatgcattaggtgtaagtgtgaaacaattggtcatccgcattggtgatgaattattattaactcctccaatgggctggaacagttggaatactttcggacagcatctgacagaagaattggtcttgcaaacggcggatgcgatgataacgaacggaatgcgtgatttaggatattcctatatcaatatagatgacttttggcagttgccggaacggggggctgacggacatctgcagattgataaaactaagtttccacgtgggataaaatatgtagctgattatctgcacgagcgtgggtttaaattgggaatttattcggatgccgccgaaaaaacttgtggcggcgtttgcggtagctacggatatgaagaaacagatgcaaaagattttgcctcttggggagttgacttgttgaaatatgactattgcaatgctcctgtagatagggtagaagccatggagcgatatgcgaaaatgggaagggcactacgggctaccaatcgttcgattgtctattcagtgtgtgagtggggacagcgtgaaccttggaaatgggcgaagcaagtggggggacatttatggagagtatcaggagatatcggtgacatttggtatcgggatggaaatcgtgttggtggattacatggtatattgaatatccttgaaatcaatgctcctctgagtgaatatgccagtccatccggttggaatgatccagatatgttagtggtcggaatagatggaaagagtatgagtattggttatgagtcggaaggatgtactcaggaacaatataaatcccattttagcctgtggtgtatgatggcttctcctttactttccggaaacgatgtacggaatatgaatgatagtacattaaaaatcttgttggatcctgatttaatagccattaatcaggatgtgttaggtaggcaggcagaacgcagcattcgttcggatcattatgatatttgggtaaagccgttggcagatggatgtaaagctgtggcttgctttaaccgggcaagctctccgcaaactgtgatattgaatgaaaatacgattgccgatttatcattcgagcagatatactgtttggacagccatttgacaaagagtggtagtgattcaaaagaactgatagtaaaactggccccatatcaatgtaaggtctatattttcggtaaaacagattga

SEQ ID NO: 3872 - DNA, 504 bp, B.fragilis
aactataaaccacctacgcacatgaaagacctgactattacctctgtaatcaaagtatatgaatatgatgaactcaatgatacagaccgtgccttattggatgacgccatcgaggcaacccggcgcagctatgcaccttattcgcacttttcggtaggagcggcagcactgctggccaacggtgtggtagtgacaggaaccaatcaggagaatgcggcctatccgtccggactctgtgccgaacgcaccacgctattttatgccaactcgcagtatcccgaccaagctgtggtgacacttgccatcgctgcacgtaccgagaaggactttatcgacactcctatcccgccctgcggtgcttgtcgccaggtgattctggaaacagagaaacgatataaacagcccatccgtatattgctttatggcaagaagtgtatctacgaagtacaaagcatcggacatttattacccctgtcatttgacgcatcagccatggaggattga

SEQ ID NO: 3873 - DNA, 1281 bp, B.fragilis
aagcaaagacccatgatgataaagcaaatatttaaaatgatatggaaccaacgtcgcttgaacggttggatatggatggaacttctggtcgtattcgtggcactgtggtacctggtagatatgtttgtggtacagttgtattcttatacccgtccgatgggatatgatatcacgaactgctggaaactttcgttcgatgtgtatcccgaggatgccgacgagtatgtcaatgacaccacccagactcaaaccgaaggggaggcgttggccaaaatccttgaacgcctgcgtcgtgcaccggaggtggataatgcttgcgttgctttctactcttcaccctattccggtggcaactcctggacacagatcatgccctgtacagccgacagcagcaagttcaaagagcaatcttatcatcaatatatcgtttctgccgaattctatgatgtattccgcatcaagaaccgtgaggggaaaccgcttagcgaactgctgactcagaaacagttgtcgtattttataactcctgcgttggagaaagattttttcggctcacaatcggcagtaggacagaaggtgcgttatccgggcagtacgcgggagattcatattgcggcggtaacagctccggtgcgtattacagaatttgtaaagccggaacccgaacttttctttacgatgtggcccaaggaactggaacgccaggtaaatgctaccggagcatctaatatggaggttactgtccgaatgaaagaagaactgacatcggaacagatgggacattttctcaaccgtatgaagaatcagttgacggaaaacaatctctacataaccggcatggaagatatgaagcaacagcgcagtgatcgtctgcaatacgaatggcgaaagatcagtatcaacctcctgctgtctgtcttcatcctgctcaatgtacttttcggtataacgggaacattctggctgcgcatcgagcaacggcgctgcgagaccggcctgcggatggcactcggcagtacgcgccggcgggtagggtggttctttactgccgaggggtggctattgctcaccacggtggttccgttggtattggttgtcatattcaatatggtacacatggagattcccgatttatacaatctctctttcacttggtggcgctttgcggtcagttttggtggggtgctgctgcttatgggactgatcattgcactgggcatctggttgcctgcccgccgggccatgaagttgcagccggccgaagcgttgcattatgaataa

SEQ ID NO: 3874 - DNA, 246 bp, B.fragilis
aggcatcataccggatgccggacacaagatctttcatacgtttttaagtttagatgttgcagtaagaacaatatatcctcaagaatgattgacccctactccctaaagaaagcaaaagaagacgaagaagataaaatgttaaaagaggtgaggttaccaattgggcaagtgcaaacagatatcccattaacctgtctattattcaaagagtacgttccacgcaatgatcagcttaaaaaccgatag

SEQ ID NO: 3875 - DNA, 990 bp, B.fragilis
ttagtaacaacacgcccgacctctttatcctggacgagcctaccaacaatctggatatacaaagtatcgaaatcatcacagctaccgttcggaactatacgggcagtgtactgcttgtatcacatgatgaatattttgcaaaggaaaccggcatcagaaagagtatctttttataattttgcaccgtttaaaaagaataatcccaaaatgataaatacagaaaccaactaccggtggttcatcttttaccaagatcagttactgttggaaaagaacgacaatgctttttccatccccacgggcaagaatgcccctgtcaccattccggaaggaataaccgtacacaccatcaccacggcaacgggcatggtatgcaaagctttctacacagactctccgatagccgaaactccggaatacgtgcagataggattgcgcgcttcttatgattacttgtcgccggaacactatcaggccgcaggcaaggttcacgaaattctctactgggaccgcagcaaccgtttctgccccacttgtggaactccgctggtacagaaagaacccattatgaagaaatgcccgaattgtggcagagaaatctatccggtcatctcaacagccatcctggtattggtgcgcaaagaggactccctgttattggtacatgcccgcaactttaaaggtactttcaatagcctggtagccggattcctcgaaacaggcgagacattggaagagtgtgtggcaagggaagtaaaagaagaaaccgggctcgatgtgaaaaacatccgttatttcggcagtcagccctggccttatccgagcggactgatggtgggatttatcgccgactacgccggtggtgacatccacctgcaagatgacgagctcagctccgggaacttctataccagggatcacttgccggaacttccccgcaaactcagcctggcacgtaagatgatcgactggtggatcgcacaacagtaa

SEQ ID NO: 3876 - DNA, 642 bp, B.fragilis
tctttgcatcagaaagttaaacccataaaaagaaatagcatgaaagagaaatttatcactctgctcacagtagcatccggtctgaaaggtttcggactaaagtttatccgcgtagccatcctcgttgttttcgtatggatcggcggtttgaagtattttcattacgaagccgacggcattgttccgttcgtagccaacagcccgtttatgagtttcttctatgccaaagacgcacccgagtataaagagcacaaaaaccccgaaggcgcctatgtccccgccaaccgtgaatggcacgaagcgaacaggacctacacgttctcttacggactgggagctctgattatgtccatcggaattctggttttcttaggcatcttcttccccaaagtggcacttgtaggcgacacactggccatcatcatgacgcttggcactctctccttcctggtgactactcccgaagtctgggttccgaacctgggaagcggagaatacggcttccccttactgtccggtgccggacgtctggttattaaagatatcgtaattctggcgagcgccgttaccctactctccgactcctcacagcgtgtactgaattcattgaagaaagccgactgggaaaagcgaaacaaataa

SEQ ID NO: 3877 - DNA, 864 bp, B.fragilis
cgcatcagccatggaggattgattatgataagaacttaccagaccaaactgaaaggtatgctggcactgactaccagctatcacaccgaaaagagcctgcagaaagaaaagagtttatataaattcatctgggtacgcaaaggaagcatcaccctcgagatagaccatcaggaagtgatactggccgagaacgaggtcatctccctttccaacctccagcacctggaatttctctcgatcgacggagagtacctgacggttctgttcaacagtaacttctattgcatttacggcaatgaccacgaagtgtcatgcagcggattcctgttcaacggttcttcgcatgtcgttcgtttcatgctcaacgaatcggaacggaggtcgatggaagacgtagtgggattgctggaccgtgagttcaccgtgtcggacaaccttcaggaagaaatgctccgcatcctgctcaaacgtttcattatccaaagcacgcgtattgcccgccaacggctgaacattacccaggaaaaagaatacagcttcgaaatcatccgccagtattataacctggtggacgaacacttccggaccaagaaacaggtacaggactatgccgatttgttgcacaaatcgcccaaaaccctttcaaacatcttttcttcctgcaaattgccgtcacctctgcgagtcatccacgaacgggtggaagcggaagccaagcgactccttttatatagtaataagagttcgaaggagattgccgacatcctgggattcgaagaccaatcttccttcagccgtttctttaaaaatatgaccggagaaagccccgtacaataccgaaattcggtagaagggaagaattga

SEQ ID NO: 3878 - DNA, 1437 bp, B.fragilis
ggaggaatacatatgaataagataaagaatttatttgtaattatactatttgccttggtcgccttttcctgcagtgatatattggacaagggaccgcttgacaaatattcggaaaatgatgtgtggaaaagtactgacctgacacaagcattcatttatactgcgttggcaaatgctacgaatatgatggtttggaaagacaattggacggataatgaagctatcatggaagatgggcgggatgtgaatgcagaattgatagaccgttattatgatgccggatggaataagtatgaagatatccgtcgttgcaatatggtgttggcacgtgttccggaagcaccctttacgaatgcggaaaaggctaattttatagcacaggctaagacgatacgtgctatgatttattttacgcgtgcccgcttgttcggtaaactaatgttagtaaaagaacttattgatccggaagcggatatgaaattccctcgtacggctacagtgaaagaaacttatgatttcatactgaacgacctcagggaggctgctcctgatctgcctgtagatgctccgtccggtgcattgtcacgcggtgttgcctacgcattgttgggagaagcagctttgcatggggctgcatatattgagaatggacaggaggagtattaccggatagcggcaaaggcctgtgaagatctgtttgcactggacaaatactcactggatggtaactacgccggtatgttcaatgattacgatcattcattggcttcgagcgagataatcctggcacaatggagaagtgctgaaaatacgaacttttcagatacgtggatgcagagattggtacctaatattgatccctctaaattgattgccgatgtgcaggcaaagtatcccttggtagaggagatggcaggttggccgcaaagatttccttctgttgatttggtaaatgattatcttgtagttgatgaggatggaaaagccaaagagtgggaccagacttcttattataagaaattcctagttgacggagggacggttgaagatgctatttacaagaatcgtgataaacgattcaaagcttctatcgtttacgacggatgttcttatttcgctaatagggtgtggcttcgtgagggaggtaatctttattatacttctaaaacgacagaattctggggaatgccggtatcaggatatgtttatcggaaatgcgtttatgaagccaaacgtttgctgaactcggaaaaaacggattatcattatactttgttacgtttgggacgctcttatctgaattatgcggaaataaagttgcgccaaggtgataaggaaacggctattgactatatcaataggacgagggtaactcatggcgggtttgccggaattgcaaaaatccttatcactggaagatacctggaaagagtataa

SEQ ID NO: 3879 - DNA, 1404 bp, B.fragilis
agatacatcctaaaagtaataagaattatgaaacaatatgatgccattattatcggtttcggcaaaggaggcaaaacactgactgccgaattagccaaacgcggctggaaggtcgcactgattgaacgttccgccatgatgtatggaggtacctgtcccaatatagcttgcgtacccaccaagcggcttatccacgaagccgaaaaggtgagttggctctatcctaccgattacgagaagcaggctgaggcttacaaagctgccatagcacgcaagaacgagatgacagcagcttcaagggccaatatgttcaataaactgagcagccttcccaacgtgaccatctataccggaatggcatcgttcgtttcaaaggatgtagtgaaagtaaccctccccgacgaagtgatcgaacttcagggaaagaagattttcattaataccggctctaccagcattataccggccattgacgggctgaaagacagcaagcgggtatataccagcacctcactgatggaactggacgtattgccacgccatctgatcattgtgggcggcggctacatcggcctggagtttgcctcgatgtacgcaagcttcggcagtaaagtgaccgtactcgaaggaggcaataagtttattgcccgcgaagaccgtgatatagcagatgccgttaaggagacactcgaaaagaaagggatagaaatccgcctcaatgcccgtgcccaatccatacaagacacagccgacggcgtgacactgacttacacggatacagccgacggaaagcctgtcactatagaaggcgacgccatcctggtagccacaggacgcaaaccgatgaccgaaggtctgaatcttcaggcggccggagtcgaagtagacagtcacggagctatcgtcgtaaacggttatctgcataccactgccccgaacatctgggcaatgggtgatgtaaaaggcggattgcagtttacttatatttcgctggatgattaccggattatccgggatgaccttttcggcaacaaagaacgcacggccgacgaccgcaatccggtggcatactcggtatttatagacccgcctctctcacacgtcggactgactgaggaagaagccatcaaacgaggatattccttcaaggtgtcacgccttccggcctccgcactgccgcgtgcacgcacgctgcaacagactgacggcatactgaaagccatcgtcgacagccattcgggacgtattatgggttgtacactgttctgtgccgaatcttccgaagtcatcaatgtggtaaacatggcaatgaagacaggacagcattatactttccttcgcgatttcatctttacccatccgagtatgggcgagggactgaacgatttgttttcaatagattag

SEQ ID NO: 3880 - DNA, 900 bp, B.fragilis
atgaatagcaaactcctcaggctgattgccatagttacagtccttgcttttgctgcaggtgcccaggcgcagcgcaggaattcccgttacgtagattatataaataagtatagtgccctggccgtgcagcaaatgaaagagcataagatacctgccagtatcacattggctcagggattgcttgagagtggtgcgggcatgagtacgttggctcgtaaaagtaataatcacttcggcatcaagtgtggcagcaattggaatgggcgtaccgttcgtcatgacgacgatgcccgtaacgagtgttttcgtgcgtaccgcaatccccgcgactcgtacgaggaccattctgcattcctgaagcgcggagcccgctatgcattcctttttaaactgaagataaccgattataaggggtgggcgcgtggtttgaaaaaggccggatatgccaccgatccttcgtatgccaaccgtctgataacgatcattgaagattacgacctctataaatatgaccgtaaggggggatggagttcgtcgaagagtgaaccgacggtgctcaatccgcatcaggtttacatagcaaacggcatcgcttatatcgtagcccgtgacggggatacctttaagtcgctggccaaagagttcgatatccgctggaagaagctggtgaagtacaacgatctgcagcgtgactatactttgatgagcggtgacatcatctatctgaaagagaagaaaaagcgggcatccaaaccttatacggtctatatcgtaaaagacggagactccatgcataccatttcgcagaaatttgccatccggctgaagaacctgtacaagatgaaccgcaaggacggagattatattcctgaagtgggagacaggctgaggctgagatag

SEQ ID NO: 3881 - DNA, 903 bp, B.fragilis
aaacgtatgaaagatcttgtgtccggcatccggtatgatgcctctaatgtgattagtcaggctatagggccaagtaaagaattttgcatgggatatttaaatcccggcgttgtgggtggtgaaggatatatttcgactatgaaattgtcagtcggcacagtcgacgtgaaagacctcgatgcaataaccgaaaggattgtagcgaaggatcgttgtgagaaaaacgatgcgtatctcgggcaagtcaacctgatgaaagcctcgtctttttgcggacagaatggagccatctggggatttgacctggcgatgcacgatgacattgccaaaaggaaagagatgcctatctacatgcaggcgcaacccgaaggagcggacatccctgtttataatatccgtccgttgctggaggcaaccgaacgtctgttcggccgtgccaaagagcgccgtttccctgtgcttccgggagcttacgtaccgggaggtagcagaaaagttgtggcatgcggtcctgtatgggtatggtctgtaatcggcctggccattctgaaagaccgtagtaaaggagcttgcctgtttgtaaaggatgcaggtacttatggagacgattcgacaacagaaggtgaagccatcggttttctggaaggtatacttcgcaaagcgaccaacagtattgccctttgcggtgaagatcaggatgtgatctacgaccgtatttacatcggttataaatatacatttgtagaacccggtcaggtaggttgtgccctgtcgtgcactcctgccgtttatatggcgcaaaatgctattcctgccgatatgaaaccggccgatctttgccagatgactatcagtgactgggaagagaagctggggctggaagagttgacgatcttcgaatag

SEQ ID NO: 3882 - DNA, 471 bp, B.fragilis
agtattacgaatatgaagaaacttataaatactgttttgttactatttctgataggtatcgtttcatcgtgcctgaaatcaggattggatgatttggaggcctataatgaggctgaaattactaatttgaactttgaataccgttggtgggatgaggctaaggatcagatggctgttaaaacactcaacattgaaaaacaaatttcgcaagacgacaatctgattacctgtaagctgacggttccagcggccggtgggagttttacagatgctgtcaggcaaaatgtatcattaagtaatctgattgcttatatggatctttctactgctgccagaattacgcccttaaacggagcgcctaagttgggtaatccgggtgacttttcagctaaggagtttaaatatcaggtgactgctgccgacggtacgaaaagagagtggacaataaagattacggattttgtgaaataa

SEQ ID NO: 3883 - DNA, 1293 bp, B.fragilis
gccgtgtgccttttaatatgcaaaattatgataacaatttatctcaaacaatcctataacttgctgaaggagaaccgtttcgtaaatggtatctctattgcgggtacagctttgtcggtagcggccgtgatgcttatttatcttgtctaccaagtaaatttttctgcgtatgcacccgagtctaaccgatatcggattctgtttgtgagcagtttgcaggcatgtgggagtgacggtcatcccatcaacaacggtggtatgagccataaggttgtgcgcgaatgcctttatcctttgcagactcccgaggcagtgactgcttttacttccggagatcttccggtcaacgtacacggacagcagttttacgataaatatgctatcaagtttaccgatgacggtttttggaaggttttcgattttactttcttggccggcggtccttttacacataccgattgggagtcgggcatacgcaaggcagtcatttctgacaagctggcgcgcagactgttcggtactgttgaggcagtgggacaaactttgcgtatgaattatgccgattaccggatatgtggtgtggtgaaagaggtcagtcgggctgccgaaagttcctatggtgatgtgtggataccctataccgccaacgcttctttattgaaagacaatatctcttattgtgaaggtactaccggagagtttcaggcttgcattctatcgcgttcccggtccgactttgaggccatccgccgtgagatgttgaagttacagtcaactttcaatgcttcgctcaccggtacgaagctggattatatgcattctcctttcactcaatggcaggctgtattgggcacgaatggcttcagtgagggaaccgtgggcgaatggttgaaatcgaccggtgcggtgatcctttttcttttgttgttgccagcccttaatataataggtataaccctgacacagtttcgcaaacgccgtagcgagattggagttcgtaaagcgtttggcgcatgttcgttctcgttggtagaacaagtggtgatcgaaaatttactgacctcttgcatgggtggcctgatcgggttgctgctgtcattcggcttgctgtcactctgcaaatcgcttttcttttcgggagatgtttcgctgacgcacgacatgctgatacagcctctcacttttgtggcagctttcttttttacgttgatattgaatctgctgagtgctgcgattcctgcctggcgagcttcgcggatgcctattacggaagcgttgcatgatatggaataa

SEQ ID NO: 3884 - DNA, 1254 bp, B.fragilis
ctatatatggacagagaaattcctaaagaggtgcgcaataaagagcgtaataaaaagattatccgtttttcggctatcggtatcgtcgggataataggtatcagcgtactgatttcgttgttgcgtacaggcgtgcagaaaaaggaccttgtgttttctaccgtcgataagggtacgattgaagtcagtgtcagtgcttcgggcaaagtggtgcctgcttttgaagagatcatcaattcaccgatcaatacccgcatcgtggaggtgtatagaaaaggcggtgatagtgtagatgtaggtacgcccatcttgaaactcgacttgcagagtacggaaaccgactataaaaagctgctggacgaagaagaaatgaaacgttataagctcgatcaggcaaaagtgaacagccagaccaaactgagcgatatggcgatgcagatcaaagtgtctgaaatgaaacttgcccggatgaaagtggaacttcgcaatgaacagtatctggacagccttggagccggtacgaccgacaaggtgcgccaggccgaactgagctacaatacttcccgccttgaactggaacagcttaaacagcaatacaccaacgaaaagcaaatagcagccgctgacctgaaggttcttgaactcgatctcaatatgttccgtaaaggacttgccgaaatgaagcgtaccttggacgatgcccagattcgttcgccgcgcaaagccatccttacttacatcaacaaccagatcggagcccagattccgcaaggcggacaggtagccattatttccgacctgagccatttcaaagtggatggtgaaatagccgatacttatggtgaccgtgtggcagccggtggcaaagccattgtaaagataggcagcgagaaactcgagggaatcgtgagcagtgtcaccccgctttcgaagaatggggttatttcattctccgtgcaattgaaagaggataacaacaagcggttgcgttcgggacttaagaccgatgtatacgtgatgaacgctgtgaaggaagatgtgctgcgcatagccaatgcttcttattacgtaggccggggcgagtacgatctgtttgtgatgacttcggatgatgaaatcgtaaaacgtaaaatccagttgggcgactccaactttgaatttgtagaagtggtgagcggattgaacccgggcgacaaggtagtagtcagcgacatgacgaactacaaaaataagaataaactgaaagtgaaataa

SEQ ID NO: 3885 - DNA, 1596 bp, B.fragilis
accgccatgtgtattcaagtacaacaaatcacctatatccatccagacaaagaagttctcttccggaatctcagtttcaccgtcggcagaggccggcaattggccctgatcggcaacaatgggtgcggcaaatcgacattgctgcaaattatggccggaaaattacaaccgtcttcggggaacgtgctccgccccgacgacctctattatgtgcctcaacacttcgggcaatatgatgaaatgagcattgcccaagccctcgggatagaccggaagcagaaagcacttcatgaaattttgaacggaaatgcctccatcgatcatttcaacatcctcgatgacgactggaacatcgaagaaaaagccttagccgccctcaacggctggggactcggaaacaggtccctttccgaatccatgcacacactgagcggtggagaaaagacgcgggtcttcctggctggcctggaactgcaagagccttccgccgtattgatggacgaaccgaccaatcaccttgacaaccaaggacgcaaccgactgtacgaatgggtaaagaaatgccgttccaccctgatcgttgtcagtcacgaccgcactctgctcaacaggtttcccgaaacctgtgaactgagccggaacgcacttgtgtgttacggaggcaattacgaattctacaagcagcagaaagaactgcaacagaacgccctgcaacaacaactgaacgagaaagaaaaagaactccgccaaatacggaaactggcacgcgaagtagccgaacgaaaagaaaagcagaatatacggagcgaaaaatcagtacctaaaaaaggcatctcccgcatggcggttcacaccctgaaggaccgggcagaaaaaagcaccaccaaactggcggacatccatcagaataaatcagagaaactgaccagcgaacgtagcctgatacgcaacaggctggccgaaaatactttacttaaaaccgacttccatgcttccgccttacatacgggaaaaacattgctggctgcccataaaataaacttttcttatggaaattcgcctttatgggaggttccactctgctttcaactgaagagtggcgaccggatacgaatcgaaggagacaatggaagcggcaaaacgactttattgaaattggttacgggtgacctattgccaacatcgggtacactggaacgcgccgggttcagttatgtctatctgaatcaggaatattccatcatctgcaaccagctgacggtgcttcaacaagcagaatcattcaatgtacgtgccctgccggagcacgaaataaaaatcaggttgaatcgctttctcttcccggcaacgagctgggatcaaccttgcatccaactcagtggaggcgaaaaaatgcgactcgctttctgctgcctgatgattagtaacaacacgcccgacctctttatcctggacgagcctaccaacaatctggatatacaaagtatcgaaatcatcacagctaccgttcggaactatacgggcagtgtactgcttgtatcacatgatgaatattttgcaaaggaaaccggcatcagaaagagtatctttttataa

SEQ ID NO: 3886 - DNA, 339 bp, B.fragilis
ctcatggcgggtttgccggaattgcaaaaatccttatcactggaagatacctggaaagagtataaacgtgaacgccgtatagaactggtcagtgaaggcgaccgatactggagtgtacttcgttggggtaaggctgacggtctggaggttgttccggaactgatagttgaacagaagttcatgaaaatagctcctgatggaaaatcttttgagatacttccgttacccatttaccaaagtgataatgagcgtacttttaccaagaaacattatttattccctgtgccgcaaggacaacgtgatttgaatccaaatctggatcagaacgagggatggtag

SEQ ID NO: 3887 - DNA, 192 bp, B.fragilis
ggtttgttcatagttcttcttttattaatttcactaaataatataataacagatgaaggaaaatattctcaaatatcttccttcatcatttcaatcagtaatccgaataacctcaatcgttattcttatttcacaaaatccgtaatctttattgtccactctcttttcgtaccgtcggcagcagtcacctga

SEQ ID NO: 3888 - DNA, 585 bp, B.fragilis
atagacggcttcttcagccccttggtgaagacttatacggatgtgaacggtgatggtaaaatagacggtgaagaccaggtacgtatcggaaagccgacaatgcctcactttacttatgcctttgatttttctttgggttatgaaggattcactttgtccggtttactttatgggacaggtgaacgctacatgacttttggcaatcgttatcagtcaggtgaaggaaaatacctgtattatgaaaaccagttgaattattggagaccggacaatacaggtgcggattttcctagaatttcgatcagttccggtgtaaacggaaataataataaggcaggatcgactttctggatgcggaatgcatcatatcttcgtctgaaggatttgcagttgagctatgactttaaatataaatacctgaaaaaatgtgactggttgcagacgtgtcgtgtgaatctgagtggtagtaatcttttcactatttcaggtgttagcaaatttttcgatccggaaacatcaagtaccagcggcgacggctatcctgtacaaagagtttattcaattggtgtaacaataggtttttaa

SEQ ID NO: 3889 - DNA, 480 bp, B.fragilis
ttattaaaattacatattatgataaaactttatttaaaacaatcgtggatgctgatccggcagaacaaactgttcagtagcctctatgtgctgggcacggggcttgccattgccatgacaatgatcattgccatcgtgtattatattaaaatagctcctatctatccggaagtgaaccgttcgctgacgatgcggatgaaaggggtaagcgccatgcatgtcaaaggagggggaaattcatattcctgttcttatgaaatgctgaaagactggttctatccattgcaatcggcggagctggttaccgctgtaaacgaacactttctgacccggaagggatcttatatacaaccggccgggggaggcgagcaaataccggctctggtaaagtataccgatcctaatttttttcggttgttcgagtgtgaattactggatgggtcttcaccacgaggctggaaggatccgcgggggtgctat

SEQ ID NO: 3890 - DNA, 466 bp, B.fragilis
  unsure (10),(11),(12),(13),(14),(15),(16): Identity of nucleotide sequences at the above locations are unknown.
agtgctgttnnnnnnnaaatgcacggcctcttcgaaccccgctgtgaagaccatctggatgctcccgatagatgctccctggccgatgggtggagaaatcgatatcatggaacgtctgaatcacgatacaatcgcttatcagactatacataccaattatacgtacaatctgggtatcaaagacaatccgttatcacactccgtaggtgcgatcaatcccgacgactacaatgtatattcagtagaaatgtatccggacagcattgcattctatatcaatgacacacatactttcacctatccccgcatcgaaacagacaaagaagggcagtttcctttcgatcagcctttctatctactgatcgacatgcagttgggtggctcgtgggtaggggctgtagacccgaaagaacttccggtggagatgtatgtagattgggtaagattctatcagaaagagaaatag

SEQ ID NO: 3891 - DNA, 216 bp, B.fragilis
acaatacgtccgatacttttgttatatttgcataaacttaaaaaaagagacgacatgaagtacatttgcaccgtttgtgatttcatttacgatccggagataggtgatccggaaggcggaatcgaacccggaacacagtttgaagatattcctgatgattgggtatgccctctgtgtggagttggaaaagaagatttcgaaccgtataatggctaa

SEQ ID NO: 3892 - DNA, 1272 bp, B.fragilis
gcggcgggcacctgtctcggttatcagataatcctcctcattgcggatgcctccgaagtctttgtaagtctccactttatcgtaattgataaagtcggtgaacttcttctggcccttccagagatctatcagttcgggaataaagtagatgcccggctccacggtatgtacaaaacccggctccaacggaatggccagacgctgcgacttacggccgaactgcgtgctcttgggctgtccgttatagcccacccagagttcacccagattctccatgtcatgcacgtcgagccccatcatgtgtcccagcccgtgaggatagaacaaagcatgtgcaccctcgcgcacagcgtcttcggcatttcccttcatcagcccgagtcctttcaaaccttcgaccatcacacgtgccgacaagtcgtatacatccatataaggaatacccggacgaagtgctttcaccgactccaggtgcatggcgttctgtatctcgtaaacctcgcgctggcgccgggtaaactttttatcggcaggaacggtagacgacatatcgcctgcataacccatctccgtttctgcgccggcatcgatcaggaacagatcgcccggcttgacgatattgccatgataatggttgtggagcgtctgtccgttcaccgtagcgatggtagcaaacgaaaggtcaccccctgcggcatgcgccacggcttccatggctgccgatacttcccactcgcgcatcccgggacgcaggatcttcatggccgtaatgtgcatatccgccgtaatatcgcaggccttctcgatttcgacaatctcctcggacgacttgtagttacgctgcgcgatcaccgcacggataaacggcaccgaaccctcctgacgcgcggaaggcactcccagccagtccatcaacttcagtttatgctctgcacggtagggcggcaggtaatggatggcctgtcccttctgtaccgccttgtgcagatagctcacaatgtcggccgaaggcatggtgatgtccactcccacccgctcactcttttccttcagtgtgggctgagtccccatccatacgatatgatcgatggtcagttcatcaccgaatataatttccttatcttcatcaatgtcgattatagccgaaagcccggcaaacgaaaggccgaagtagtagagaaaggtagaatcctgacgatagcggaacgtattgtcctcgtagttcaatccacactcgtcgtttcccagaaacaacagtactccggagcctaa

SEQ ID NO: 3893 - DNA, 201 bp, B.fragilis
gcactgtctgcgtcaaattggggcacttggacaattacctttttctcggtgatgtcggtcgaagtggtcttgctgccgtttgttccgcaggagaaagcagaaaacaggatgaaagctgacagtatgaacatagagtttcttttcataattatgcttttggagtttaaagcctcaaaattaatgattttcactgtagggtga

SEQ ID NO: 3894 - DNA, 213 bp, B.fragilis
tataaagaagcctcaaagaaccagcgtcagggagagtatatccatttgatagcgtattacacctttagacgtcactctgacactattcatcctaatctactgacacgcactaaaacacaaatcatcaaacaggaagaagaaaatgcatacaagacgcatataacatgcaataagatgcaacatcgaccgaagatttccaataaatatgcatga

SEQ ID NO: 3895 - DNA, 789 bp, B.fragilis
atgaaaacggcgatcaaattaattctgatttatctgggaatccagcttatttgcggtgggctgatcggtattccttttactatcattgcccgtatgaatggtgggagcgtagatgccacccgggtttcggagttgacattggctccttcgatgctgctttccatggcagtgatgtttttttatttatggaaagcacactatatacccaaagacaagacaagttggtcattcatttcatttccatttctgatcataacgtttctgataggcttgtcgatgactgtcctgatggatatgttgactgccgtcttatcttgggttcctgatattctggaacagcagttcgacgctctccagtccggttggttaggcattgtggccattactttgttggggccgattcttgaggaacttctgttccgtggtggtgccactaaggcattgcttgaacgctattctccccggaaagccatcttcctttcggcactgcttttcggagtatttcatttgaatccggctcagatagttgcagccttctttggaggccttttgctggcatgggtttattatcggacacgaagtctgattccttgtatcctgatacacattgtgaacaacagtatttctgtcatgctgagtctgacctatcccgatgcagatacaatcagggatgtgacgggtacgactccctattatctattgatagcagtggcggctatggtgttcgtaggctgttttcttcggataaagcaggttacggttccgggaacgtggcggaaagatgaatga

SEQ ID NO: 3896 - DNA, 423 bp, B.fragilis
cggaaccatcaacatcagcctcaacaaccgcaatctgccggagctgcgcatgagccgcgacttcacggagatggtcgaggaacatacgaagaacaaggccaaccaatcgaaagaatcgaaagaggccatgatgttcctcaagcagaagatggacgccgcacaaggcttcatcgacgccgtgaagcaacgccagaatacattgatgaccaccatgcaggccatcatcgacctgcaacgccccttcttcctcgaaggcgacgagtcattgctccgcccgatgattctgaaggacgtggcggaacgcaccgggctggacatctcgaccatctcacgcgtcagcaacagcaaatacgtgcaaacgaattacggcatttatcccctgaagttcttcttcagcgacggatacaccaccgaagacggtga

SEQ ID NO: 3897 - DNA, 654 bp, B.fragilis
ataataagtcataatatgaaaagaagattgaacatactatgtttactggtttttctggtattctgttattcggtgtttaatatggggcgtgatttcggtcatggcttttccgaagggatgaagataagtcattccggtaatcaaagtgtagaacaggctatcaactttcggattgccacactgatgcccaaggatttttcgtcctttaaagattctgtctataatgaaaagaccggctcttatgtccccgttgcctatacgcagatggttacgaatgtgaaagtcgacaggagtacctggatgatggttgcccaggtgatttccgggcttctggctgtttttgccatcattgcgtcaacagtgctttttattcagctgattgtagctatcaataaatcggatatttttaattggaagaatgtccgtcggttgcgatggttgggagtcgccttgttgctgaactttattagtgaggcagtgccggccctgatgaatgattatgagttgtcttcagtcttctcgttgtccggatattctatggagacaagcatagattctgtgatgctggtcattctgggactggtttcactaattgtaggcgaggtattcgccatcgggttgaagatgaaagaagaacaagatcttactatctga

SEQ ID NO: 3898 - DNA, 915 bp, B.fragilis
atgaacttacaatttcccccatttctgcacgaaggcgataaggtagccatcgtatcgccttcaagcaaaatagacagtatattcctgaaaggtgccaagacgcgtctaagctcctggggacttactcctgtcatgggagatcatgtccgaagttcatggggctcgtatgccggtgccacccatcagcgcctcaaagattttcaggtagccatggacgatgaagaaattaaggccatcttgtgcagccgtggtggttacggagcggttcacttgctggataagctggacttcacacgctttcgtaaccacccgaaatggctgatcgggttcagtgacatcactgcgctccacaacttatttcaatacaatggttttgcctcactccatgctcccatggcacgccatctcgctgtaacaggagaggaggatccatgttcattatatctccgcgacattcttttcggtaaactgcccggatataaatgccaccgccataagttgaatcatctgggacaggccaaaggcatcctgcgaggcggcaacatggctgtgttccacggtctccgcggaacaccatacgatattcctcccgaaggtacgatcctcttcatcgaggatgtgggcgaacgtccttatgccatcgaacgcatgatgtataacctgaaattgggaggcgtacttgaaaagttatccggacttatcatcggacaatttaccgaatacaaagaagactattcactgaaaaaggacctttacagcacactggatgccttggtgaaggagtatgacttccccatatgttatgactttccggtgggacatgtgacagagaacctaccactaatcaacggtgcggaagtggagttcgtatccggaaagaaaggagtggaattgttaataaaccctcctatctga

SEQ ID NO: 3899 - DNA, 195 bp, B.fragilis
ttcaatccacactcgtcgtttcccagaaacaacagtactccggagcctaatgtttttttcagcagggctctgcgctgcgtatatgtctctttgctgaacataatggtatatattaaagttatgatggcaaagataggaacaaaggatgaattgacaaaggagataaagcaaataagattcacagcagagcaataa

SEQ ID NO: 3900 - DNA, 1833 bp, B.fragilis
tcaggatttaaacacatcctctcccgctatttttttcggggggagacgttatcagacggtaagctccaacaacacttctcctttggtattgagtactttcaccttaagtatgtccttcttcttttcaatcaccattaccgttgcacttttcatgctataaccgccaccgataatcaccgggaagttattgccaaggctgcctttgggatgataggcatattcatgtgtatgcgcgttaaggctgatattgaaaggtgctttctccagaagtttaccccaaagcccggaacacagattctcgtagtcgtttccgtaaagcggaatgtgatgaatcagaatccgcttagcggctttcttaaattctttggaagcgagctcacgcttcaaaaatcctacctggtcattacgcagcttcgtaaagtcgttgagtccgtagtatacccaatgatcatccggcttatcttcaccgcaatcgagcattacgatacgggtatctccccagttgaaggagccgtaagtcttatcgcctacataatcgaacaggctgtgcaggcctaccgaataggcattccggatctcgtgattaccgcgcataaagaagacaggtacgcgatcaccctccacgccttcggtcagttcgctgataaaggctgttgcctgatcgtgattggcggggtcgtctacacaatcgccgttgaacactacaaaatcatagtcaatcccctttatctgttcgcacaatgcctgaaacgtcttcgattgtttatgcaggtcgttgaacaccacggccgtaaaactgtcatcaccggctgcgggcaacgtgaactccctgagttctgtacgggctgtattgccaaacacctttttgtaggcctggtaaagcaggatctcctgcgaacaggtacgataataatatttctgtccgggctgcaaactatcgaggcgaatcttgtgaagagtattgccacaaacaacttgaccatccagaagggtacgtgcgcgcttcagattggaagggtccgtgccgtactccacccagcaataggccggcacgttggtctgccacatcaccgtgattccacctcgtacgggattctgaagatagggtttggtacggcaaatccgattctcgggtaccgccatccgtacttctaccacaaaaggacgatgatcggacgccagaggctcatcgatcaccggggccgagttgacaacaaaagtaggcgtttcctgtttcagagcaatcaggtagtcgagcgtctccttcggttcggaagccggataagtgagctgcttcgggttggaaagtatctggaatgtactcttcaaatctttgataaagccggagtcggcatccgagttgaagtcaccggcaaggaagaaaggtttccgggtattggctgcaacggacttcaggatttcgagagacttcatccgatcctcttcggtcagagaaaggtgcgtacacgcaaagacatactccgggaactcggcgacaagcagcgtgcgtgcctcttcacgtcccggaagggcgaaggtttgcacacggagcggagtctctttcgaaagtataccgatgccatactttcctccgtcataatcgatggcaggcgcaaagcagggatgcaattgagtgcgttccgccagttccttgagaacatcggtccggttgctccgggcagtcatgctgtccagttcctggatggcaacgatgtccggacgggcgttgttgatcacattggctacacgctgataattgcatataccgtccatgccattggcgttacggacgttgtaggtcatcaggcgcagcacatcttcagcctgggctga

SEQ ID NO: 3901 - DNA, 1941 bp, B.fragilis
actatgcgtaaattaaaaaatgtcctccgggcatcttcatgctgtgctttttcaatcttaatgtgtctcccggccgccgggcagaatgcatggagcgaagctgactgcgtgaccctgctggacagtacctcggtaaccgtgcagccaaacggctccggaagttttgccgtgtacaaatcgtttaaagtacagactcccaaaggggcagtgaataaccatgtgatcaagtatgattatgatccgctgacggcctttgcccgtttcaagcaagtcaccgtgcagcgtgccaacggcgaaaccatgcaggtagacgtgaccaagacctgcgattatgccgctccggcaagggctatttattggggagcccgtcagatcatgctcgaactcggacgcctggagccgggagatgtcgtttcctacgaaatcagtaagaaaggctttacttatgctctgctggcaggagctgaagatgatgacgcacgtttcattccgcccatgcgcgggcagttctacgacatcgttcctttttgggtgaatgaacccacccgtcgcaaggtatacgttgtcagtatgccaatggaaaaagagcttcagttccagttctataacggtgtctgtacctcgtcaatgcgttatgaggacgggcgaaaggtatatacgtttgccgtggacgaagtgcttcctttccggaaagagcccaatatggtggatctttttgacgaagccccgaagctgatgatgtcgtctaccccgaaatgggaggataagtcgctctggtttcacgacttgaacgaggcatacggcagttttgccgcactgcccgaggctcagaagaaagtggacgaactgataaagggaaaaaagaccgaaatggagagaatcgccgtattgacccattgggtagccgataatatccgttatgcaggcatcaccatgggcgaaggcgagggctttacgctccataatacgaagatgaactacaccgaccgctgcggagtatgcaaggacattgccggcacactgatctctttcctgcgtatggcgggatttgaggcctatccggccatgacaatggcgggaagccgcatcgaaagcatccctgccgatcactttaaccactgtgtggcagtggtgaagctggcgaatgggacgtatatgcccctcgatcctacctgggttcctttctgccgcgagttgtggagcagtgccgagcagcagcagaactatctgcccggcattccgggaggttccgacttgtgcctgactccggtttcggctcccgagaatcattatgtccgcatcactgccgataacaaaatcgatgcaaagggcacgctgaaaggttcgtttaccatcaccgccgaaggtcagtcggacagcagcatccgccgcatctttacgcagggctggcagaccgaatggcaaagcacgatggaaagccagttgctcaacgtatctcccaaagcccgtatgctcggagtggactacggaaaggcgccgaaggattatcaggcaggccccattcgcatcacgttccgttacgagataccggactatgcgctggtcggtgaccgggaattattgttgaaaccgatggtgatgaacaacctctatacgagcgttctctcgttcctgcgcatcgataccggcttggaaacccgccaatacggcttccgtgatgcttgctctcgtctggtcgaattggacgaaacgattgccctgccgcggggatatcgcctggcgggagagccgcgcagcgaacaaaaggccgctccggcagccgacttcgaaggttcgttgcagcaggttggcaacaaactggtgctgaaacagaaactcgccttgaagaagcgcatctatcgggcagccgactgggaaggattccgtgctgcggtgaatgcctacaaaagctttgcggattatttgattgttaaactctaa

SEQ ID NO: 3902 - DNA, 567 bp, B.fragilis
tctgtggtaaagttgattcattccatctcgttatcaatcaatctcaaaagtagaataaatatgactccaatcgtaagcattatcatgggtagcacttccgaccttcctgtcatggaaaaggccgcacagttactcaacgatctccatgtaccgttcgaaatgaacgccctctcggctcaccgcactcccgaagctgtggaagagtttgccaagaatgcccgctcacgcggcattaaagtaattatcgctgctgccggtatggctgcccatctgccgggcgtgattgccgcatcgaccccgctgccggtcatcggtgtacccatcaaatcgtctcttgacggaatggacgcccttctggcgatcgtacagatgcctccggggattcctgtagcgactgtgggtatcaatggcgcactgaacgccgccatccttgccgtacaaatgctttcattggaagataaagaactcgaagcaaaattcatagcctataaagaaggactgaaaaagaaaatcgtaaaggctaacgaagaactgaaagaaattaagtacgagtttaaaacaaactaa

SEQ ID NO: 3903 - DNA, 474 bp, B.fragilis
tcctataaaaacatgagtggattgtattataacttggcgttgcgaaacagtgatctgagagataaagattctgaaaaactgtattattgtgttttaaaaaacagaggagtgctggatcaggatacgtttgtcaattatctgagtcagatcaccggaataaaagaggctatatgtctgggagtactctcgaaattgggagcggctgtcatcaattatctgaaagacgggcaaagcgttgatattccgcatttgggtacttttaatctgactgcgagcagcaccggcgtgaaaacgcttgatgaggcgaaagcgtcacaaataaaggctatcaatctacgcttttctgctaaagaagagactgacttagtgctgagtcgttgtgcgttaacccgaagcgtctcattaacaaatacaaatgatgtgattaaagagaaggatccaagcggtgaaatcgtggatgatcctactgcatag

SEQ ID NO: 3904 - DNA, 645 bp, B.fragilis
gctttcaaaaacagaatagagatgaaaagaaaaggaattaaaaaccttatttttgattttggtggtgtattgattaatctcgaccgtcagcgttgtatagaaaacttccggaagttgggattagagaaggtggacgaattgttaggcatgtattctcagcagggaatctttatgcaacatgagaaagggttgatctcgtcagcccagtttcgtgatagtatccgcgggcagataactcaggaggtgacggatgagcaaattgatgctgcttggaatagtttcttggtggatattccacgttttaagcttgatatgttattgaaactccgcgagaaatatgtggtctatctgctgagcaataccaacgagatacattggaagtgggcatgtgagcatgcgtttccgtatcggggtttccgtgtagaagactattttgaaaagatgtacctctcgtatgaaatgaaaatggtaaagcccgctgaagagattttccggggagtgcttgatgatgcaaacctcgatccgcgcgaaacttttttcatagatgactccgaagccaactgccagggcgcccaggcattgggcatctctacctatacagtgaaacccggtgaagactggaggccgctttttgccgagaattaa

SEQ ID NO: 3905 - DNA, 1839 bp, B.fragilis
ggaggaacccttatgagaaaactattattgctcttattctcagcactttttgtgctgtcagcccaggctgaagatgtgctgcgcctgatgacctacaacgtccgtaacgccaatggcatggacggtatatgcaattatcagcgtgtagccaatgtgatcaacaacgcccgtccggacatcgttgccatccaggaactggacagcatgactgcccggagcaaccggaccgatgttctcaaggaactggcggaacgcactcaattgcatccctgctttgcgcctgccatcgattatgacggaggaaagtatggcatcggtatactttcgaaagagactccgctccgtgtgcaaaccttcgcccttccgggacgtgaagaggcacgcacgctgcttgtcgccgagttcccggagtatgtctttgcgtgtacgcacctttctctgaccgaagaggatcggatgaagtctctcgaaatcctgaagtccgttgcagccaatacccggaaacctttcttccttgccggtgacttcaactcggatgccgactccggctttatcaaagatttgaagagtacattccagatactttccaacccgaagcagctcacttatccggcttccgaaccgaaggagacgctcgactacctgattgctctgaaacaggaaacgcctacttttgttgtcaactcggccccggtgatcgatgagcctctggcgtccgatcatcgtccttttgtggtagaagtacggatggcggtacccgagaatcggatttgccgtaccaaaccctatcttcagaatcccgtacgaggtggaatcacggtgatgtggcagaccaacgtgccggcctattgctgggtggagtacggcacggacccttccaatctgaagcgcgcacgtacccttctggatggtcaagttgtttgtggcaatactcttcacaagattcgcctcgatagtttgcagcccggacagaaatattattatcgtacctgttcgcaggagatcctgctttaccaggcctacaaaaaggtgtttggcaatacagcccgtacagaactcagggagttcacgttgcccgcagccggtgatgacagttttacggccgtggtgttcaacgacctgcataaacaatcgaagacgtttcaggcattgtgcgaacagataaaggggattgactatgattttgtagtgttcaacggcgattgtgtagacgaccccgccaatcacgatcaggcaacagcctttatcagcgaactgaccgaaggcgtggagggtgatcgcgtacctgtcttctttatgcgcggtaatcacgagatccggaatgcctattcggtaggcctgcacagcctgttcgattatgtaggcgataagacttacggctccttcaactggggagatacccgtatcgtaatgctcgattgcggtgaagataagccggatgatcattgggtatactacggactcaacgactttacgaagctgcgtaatgaccaggtaggatttttgaagcgtgagctcgcttccaaagaatttaagaaagccgctaagcggattctgattcatcacattccgctttacggaaacgactacgagaatctgtgttccgggctttggggtaaacttctggagaaagcacctttcaatatcagccttaacgcgcatacacatgaatatgcctatcatcccaaaggcagccttggcaataacttcccggtgattatcggtggcggttatagcatgaaaagtgcaacggtaatggtgattgaaaagaagaaggacatacttaaggtgaaagtactcaataccaaaggagaagtgttgttggagcttaccgtctga

SEQ ID NO: 3906 - DNA, 1680 bp, B.fragilis
cgtgaaatgaaacagatgttacaaatatattgcaaaaataataatatttctaaagaattccctattgggagctcacttttggatatttattacggctttaatcttaattttccttatcaggtagtcagtgctaaagtaaataatcgctctgaaggactcaattttcgtgtatataacaataaagatgtagagtttctggatgtaagagattcttcgggaatgcgtacgtatgtgcgttctctctgctttgtgctctacaaagctgtcagcgaactctttccgaatggcaaactttttgtggagcacccggtatccaaaggatacttctgcaatttgcggatcgggcgccccgtcacacttgaagacgtgtcacaaataaagaaacgtatgcaggaaattatagcggaagacattacctatcaccgcattgagtgtcatacaactgaagccgtacgtgtattcagtgaacggggcatgaatgacaaggtaaaattactcgaatcttccggttctatctatacctattattatactttgggaggtactgccgactattattacggtaatctgctcccaagtacaggatttatccacttattcgacctcgttaaatactacgacggactgttgctgcgtattcctaacaaagaaaacccatctgtactggaagatgtggtaaaacaggaaaaaatgctcgatgttttcaaagagcacctacgatggaactacatcatgggattgaacaatgtgggagatttcaatattgcttgtgaagagggacatgccacggacctgatcaatgtggcagaagctctgcaagagaagaaaatagcacaaatagccgatagcattttccaccgcggagaaaacgggactcgtgtaaaactggtgttgatttctggaccgtcatcatccgggaaaacgacttttagtaagcgactctccatccagttaatgaccaacggcctgaaaccatatcccatctcactggacaattattttgtagaccgtgaagacactccattggatgaaaacggcaattatgactatgaatccctttatgccctcgacctggagttattcaatacacaactacaggctttgttgcgtggcgaggaagtagaactgccccgctataactttatgttgggaaaaaaagaatataaaggtgataaattgcggatcgacgaacatacggtattgattcttgagggaatacacgcccttaacccggaactgactccgcaaatcccggcagcaaataagttcaaaatatacgtctctgccttgacaaccatctcgctggacgatcataactggatcccaacgacggacaaccgacttttgcgccgtattatccgggacttcaactatcgcggctattctgcccaagagactatctcacgctggcccagcgtacgcgccggagaagataaatggattttcccttatcaggagaatgccgatgtgatgttcaactccgcccttttatttgaatttgccgtgctccgctgtcatgccgagcccattcttaccagcgtgccacgtaactgtccggaatatgctgaagcataccggttgctgaagtttatcaaatatttcactcctgtacaggataaggagattcctccgacctcacttctgagagaattcctgggaggaagcagttttaaatattag

SEQ ID NO: 3907 - DNA, 1002 bp, B.fragilis
aacccggtgaagactggaggccgctttttgccgagaattaaaataaataggagaaacagcatgcagataatccgtaatataccgggagttctacccgaaccatgtgttgccaccatcggtttcttcgatggagtacatatggggcatcgctttctgatagaacaagtcagagagttggctgcggctcgtggattgcgttctgcactgattacttttcccattcatcctcgtaaggtgatgaatgcagactatcgtccggagttattgaccacttcggaagagaaactggcgctgcttgaagaaacgggcgtggattattgctttatgcttgattttacacgtgaagtatcacatctgactgcccatgaatttatgtccgatatcctgagagaccgttatcgggtgcagatacttgtcatcggatatgaccaccgcttcggacacaatcgtagtgaaggctttgaggattattgccgttatggctctgaaatgggaatagaggtgattcgtgctcgtgcctgtgtgtgtgatgatcttcatataagctcttctgtcattcgtaagatgttgcatcagggcgaagtagatcgggctgcacgttgtctgggttacgactattttctggatggtacggtggtgagcggttatcaggtaggaaggaaaatcggattccctacggccaatctcagtgtagacgatcctgataagttggttcctgccgatggtgtctatgcagttcatgtcacgttcgacgggcatacttataatggtatgctcaatatcggtactcgtcccacgatagggaatggtcccgaacgttcgatagaagtgaatatcctccattttcattccgatatttacgataaatttatccggctctcttttgtaaaatatctccgtccggagctgaagttcgatgggattgaaggattgatagcgcagcttcatcaggatgcagccgatgtggaagcgcttttggggaaaatacaaaatgtcaattga

SEQ ID NO: 3908 - DNA, 558 bp, B.fragilis
tccccgggtgaagaccagatgtttctcaatccggtgaaccgggagaagtatccggcatttgtccttgtacctcaatgtcccgaaaaagactattgggcgtatacctcccgtccctcttcctttattccttcggagatgccggtaggacaagagatcactcctgtactgcgtgcagtaaaagagttgttggatacttatcttgatttgcctcaggtggatcgtaaccgtatctatgtggtcggtctttctatgggaggcatggcgacgtacgatcttgctgtccgttttcccgatacgtttgctgctgccgttcccatctgcgggaccgtgaatccggtgcgtctggccgatgcagcaaatgttcgtttccgtatttttcacggtgatgccgacaatgtagtgcctgtagaaggctcgcgtggggcttataaagcgttgaagaacttgggagcggaagtggaatatattgagtttcccggttgtaatcatggaagctggaatccggctttcaactatcccggattcatggagtgggtctttgctcagcgtaagagataa

SEQ ID NO: 3909 - DNA, 1581 bp, B.fragilis
ctttgtcactgtttaaaaccaaatcgcatgaaaatatcgactttaatcctgaccatcctcgtttgttttagcacaatcgtcgatgcacaaggcacacaaaacagagcaaatgaactgatgaaacaagcgcagagtagtctggaacaaaaagaatacactaaggcgcgttatcttttcatccaggcctatggcgctttcgcaacgcaggaaaattatccgaaagccgtggaatgcggaattcagggagcagctctgtaccatcgtgaaaattattacaaagaggcattcgacctctgtagaggaatggatcagctagtctgggccggtgaacaaaaacagcagaaacaattttacccgctacgtttccaaatcaccaaagagagactgcagatgtacatcggactaaagaatgcggcgcaggctaaaattcaattggataagttggcagaaaccgtaggcctggccaagaacgattcattaagcgagaacctactatacacacaggcaagttattactacacattcgggcaaaacactcagggagacgcgtgctttcagaaattaatcaaccaatataaagctcaaaagaattacgataaggtcaacgaatgctataaaaaactgattgccatcggacgtaaatctaacaatgcctcactggtggcccgcacttacgagaacttcatcgtctggaccgattcggtaaaagcaatgacggcacaagacgaactgaacgtactgaaacgcaagtatgacgaaagccagcagatcattcaggagaaagaagacacactttcgggcaaacagtatatgatcgtcgggctgtgcacactggtagtaatcctgattgccggtctgatatttgtggccatcgtactgcttcgtttcattgccggtaaccggaaactgaaaaagagtgtacagatagccaatgaacacaatgaactgaagacacagtttatccagaatatttcagcacagatggaacctacgctggatacactcgcctcttctgccgccgagctgtcggacaaagcacctcaacaggcacagcagatgcaaggacaagtagccgccctgaagaagttcagcaatgatatacaggaactttccacattggaaaactctctgaccgaaccttatgaaatgaaggagatcaacgtaaatactttctgtgaagctaccatggataaggtgaaagagtttgtacaacccgaagtttcgaccgtagtcaatgctgccaaactccagatcaagaccaatcctgaacaactggaacggatcttgattcacttgctgaagaacgctgcggaatataccgaaagcggaaagatattccttgatttcaaaaagagaggcgcacatacgcaccaattcattatatcggataccggtacgggtattcccgttgagaaacaagagaacctgttcaagcccttcactgaaatcaaagacctgacagaaggagacggtttaggactacccatctgcgccctgatagcaaccaaaatgaacggcagcctgacactggataccagttataccaaggggagcaggtttgtactcgaattacatacataa

SEQ ID NO: 3910 - DNA, 1689 bp, B.fragilis
tttaatgtatgtatctgcatgactgcaaagaacgacgattattttcatttgggcctgactgatcaagaagttctccaaagccgggagaaatatggtgccaacctactgacgcctcctaagcgtccttcgctcctgaagctttatttggaaaaatttgaagatcctgttgtacgtgtgctgcttattgcagctgtattctctcttatcatttccgttatcgagaatgagtatgccgaaacgatcggtattatagccgctatcctgttggcaaccggtatcggtttctatttcgaatacgatgccaataagaaattcgatttactgaatgccgttaatgaagagactttagtaaaggtgattcgtaacgggcgtattcaggagattccgcgtaaagatgtggtagtaggtgacattgtggtattggagaccggtgaagagattcccgcagatggcgaactgatagaagctatttctttgcaggtgaacgaatcgaacctgaccggggaaccggtgattaataaaacaataatcgaagccgattttgatgaagaagctacgtatgcttccaatctggtgatgcgcggtacaactgtggtcgatggtcatggatcgatgaaggtacttcgtgtgggagatgctacggagattgggaaagtggcacgtcagagtacggaacaaactacggagcctacaccattgaatatccagctgaccaaattggccaacctgatcggtaagatcggttttaccgtagccggacttgctttccttattttctttataaaagacgttgtactgtatttcgattttggggctctgaacggttggcatgactggttgccggtgttggagcgtacattgaaatatttcatgatggcggttaccctgatcgtggttgccgttcccgagggattgcctatgagtgtgacactcagcctggcactgaatatgcgccgtatgcttgccactaacaatttggtgcgtaagatgcacgcttgcgaaacaatgggggcgattactgtgatttgtacagacaagaccggtacgttgacacaaaatctgatgcaggtgcacgagcccaatttctatggtttgaaagatggtgggaaactgacagatgacgatatcagcagactgattgcggaagggattagtgctaactccactgcttttcttgaagaaacgggaaagggtgagaagccgaaaggagtaggtaatcctacggaagttgccttgttgctgtggctgaatagccagaaacgtaactatcttgaactcagagaaggagcacgggtgctcgaccaattgacgttctcgactgaacgtaagtttatggctactttggtgaagtcgccgttgataggcaaaaaggtattatatataaaaggtgcgcccgaaatcgtgcttggcaaatgtaaggaggtgattctcgatggccgtcgtgtggatagtgtggaatatcgttcgactgtcgaagcacaattactgggttatcagaatatggctatgcgtacacttggttttgcattccgtttggtggaagataacgaaccggatgactgtgtggcacttgtttcagaaaataatcttaatttccttggagtcgttgccatttcccgacctatacgttccgatgtgcctgcggcagtagctaaatgccatcgggaagttttggtatcaagattgtga

SEQ ID NO: 3911 - DNA, 1728 bp, B.fragilis
actatgatgtggcagattgtattatcactggtatgtgtggcttttttaggagctattctgtgggaaaagagacaaggtaagttaatgcaatctgcatcggaccggaaactggagaatgtaaattgtctgtttgatgcgattctgacgcatattcatgcgtatgttttggtaatcgattctgatttcaaagtcctgaaaactaattattatgatttgactcatctcagtccggacggtaaagagaagcgcgtaggtgatctgttgcaatgccggaatgccttgtctgccaaagggggatgcggaacccatgctttttgccaggaatgtccggtgaggggagcaataggaaacgctttccgccagaagaaagaatttactgatttgcaatcatcactgaatattgccatagacgagcatgaatttgtaaagtgcgacgtaatgatctcgggagtatttatgactctggatagtgaagagcgcatggtgctgacggtgcatgacattacttcgattaaacaaacggaagaggcgttggccgaagcgaaggaaaaagcggaaaatgcagatcgttccaagtccgcttttctagccaatatgagtcatgaaatccgtacgccactgaatgccatcgtcggcttttccgaactgctggcagcggccaatacagaagaagaaaagcaaaaatacctggagatactccatacgaacagcgaattgctattacagctggttaatgatattcttgatttgtcgaagattgaggccggtacattggagtttgtttattctgatgtcgatatcaacttgttactgaatgatttggaacaattgttccgtatgaagataggctctaactcgcctgtacagattataacagagtccgggttgccctcgtgtatggttcatacggatcgtaaccgaattgctcaggttgtgtccaattttgtatctaatgcaatcaaatttactacagagggtagtatccgtatcggatatcagtcttccgagaatggacttcggttttatgttagcgataccggttcgggtatttcggcggataaattggagggtgtcttcgatcgttttgtgcgtttgcaaagtgataaaaacggtaacggactcggactctctatctgtaagacgattgtaaataagctgggtggggaaatcggagccgaatctgaggtaggcaaaggaagtaccttttggtttacattgcccgaacattccgatattaaacccaaagtcatcattgagaaagagcaggaagaattgccttctgcagtacgggttccggttatcgatgcgggaagtgataaaaaactgagcatactggtggccgaagatatggaagacaattatcgtctttgcgaagctatcctcgcttcacgttacgaattacattgggctcacaatggtgaagaggccatttctcttttcctgaaattccaaccggacattatcttgatggatatccgtatgcctgaggtgaatggctacgaggctacggaggctatccgacagatgtcggctacagtgcctatcattgctcttactgcttttgcgtatgaagaagaccgccagaaaatcatgcatagcggctttaccgatttccctgacgaagcccatttcgtcaaaagtactgttgggaaaactggaatccttaaaaaagatttaagaaacatcttataccggatttatgttgtacttttgcaacttctaatttaa

SEQ ID NO: 3912 - DNA, 273 bp, B.fragilis
gccggtatccggtggaacggtctccaaacgataagcggtgatccgtggaaagaggatgtgtcgaaactcgcattcaccacagattacacgaatgtatacagatggatactgttatctatcaatagattaagttcgtcctgtgaagttctgtatcactctgtggtgagttatggtatacccccgttctgcaggtcacgctccgtagagctcctctcctgtgcctctctgcctatgcagctctgtggtgaaacaggcttccgcgacatcttttag

SEQ ID NO: 3913 - DNA, 1548 bp, B.fragilis
aggaaaaaccggagggagcggggaagacatggagggggtgttccggaaagatattcccggcctcttccatggcgggacggttattgctctgctgtgaatcttatttgctttatctcctttgtcaattcatcctttgttcctatctttgccatcataactttaatatataccattatgttcagcaaagagacatatacgcagcgcagagccctgctgaaaaaaacattaggctccggagtactgttgtttctgggaaacgacgagtgtggattgaactacgaggacaatacgttccgctatcgtcaggattctacctttctctactacttcggcctttcgtttgccgggctttcggctataatcgacattgatgaagataaggaaattatattcggtgatgaactgaccatcgatcatatcgtatggatggggactcagcccacactgaaggaaaagagtgagcgggtgggagtggacatcaccatgccttcggccgacattgtgagctatctgcacaaggcggtacagaagggacaggccatccattacctgccgccctaccgtgcagagcataaactgaagttgatggactggctgggagtgccttccgcgcgtcaggagggttcggtgccgtttatccgtgcggtgatcgcgcagcgtaactacaagtcgtccgaggagattgtcgaaatcgagaaggcctgcgatattacggcggatatgcacattacggccatgaagatcctgcgtcccgggatgcgcgagtgggaagtatcggcagccatggaagccgtggcgcatgccgcagggggtgacctttcgtttgctaccatcgctacggtgaacggacagacgctccacaaccattatcatggcaatatcgtcaagccgggcgatctgttcctgatcgatgccggcgcagaaacggagatgggttatgcaggcgatatgtcgtctaccgttcctgccgataaaaagtttacccggcgccagcgcgaggtttacgagatacagaacgccatgcacctggagtcggtgaaagcacttcgtccgggtattccttatatggatgtatacgacttgtcggcacgtgtgatggtcgaaggtttgaaaggactcgggctgatgaagggaaatgccgaagacgctgtgcgcgagggtgcacatgctttgttctatcctcacgggctgggacacatgatggggctcgacgtgcatgacatggagaatctgggtgaactctgggtgggctataacggacagcccaagagcacgcagttcggccgtaagtcgcagcgtctggccattccgttggagccgggttttgtacataccgtggagccgggcatctactttattcccgaactgatagatctctggaagggccagaagaagttcaccgactttatcaattacgataaagtggagacttacaaagacttcggaggcatccgcaatgaggaggattatctgataaccgagacaggtgcccgccgcttaggaaagaagattccgctgacaccggacgaggtggaagcgttaagatag

SEQ ID NO: 3914 - DNA, 1491 bp, B.fragilis
agcattaaacgtatggcacaaggttcccgtcagatacaatcgcaggcgcagcagcagatacaaacgctctcaccgcagcagattctggtagtgaaactactggagctaccggctgtggaactggaagaccgtgtacatgccgaactgctggagaatcccgcccttgaagaaggcaaagaagaaagcacctccgacgagaccacccctgccgaaacctccgaaggagagacggaaggcgatacggactatgactcgctgagcgactatctgaccgaagacgacatccccgactataaacttcaggaaaacaaccgctccaaaggcgagcaggcagaagagattccgttttcggacgcaacgtcattctacgagatcctgagagaacagctcggcgaacgcaacctgaccgaacatcagcgcgaactggcggaatacctgatcggttcgctggacgacgacggcctgctccgcaaatccctcgaaagcatcggtgacgaactggccatctacgccggtatcaacgctacggaagaggaactggaggaagccctgagaatcgtacaagatttcgaccctcccggactgggcgcacgcagcctgcaggaatgcctgctgatacagatccgccgcaaaaaacagtcccactgcacagaccctctgctggagacggaagaagaaatcatcagtgaatgttacgaagagttcacccgcaagcattgggaaaagatcatcaaaaagctgggactggacgaagaacacttctataaggcacttgaagagatcaccaagctcaacccccgtccgggcgcatcgctgggtgaagccatcggacggaacctgcaacagatcgtccccgatttcatagtagacacctacgatgacggaaccatcaacatcagcctcaacaaccgcaatctgccggagctgcgcatgagccgcgacttcacggagatggtcgaggaacatacgaagaacaaggccaaccaatcgaaagaatcgaaagaggccatgatgttcctcaagcagaagatggacgccgcacaaggcttcatcgacgccgtgaagcaacgccagaatacattgatgaccaccatgcaggccatcatcgacctgcaacgccccttcttcctcgaaggcgacgagtcattgctccgcccgatgattctgaaggacgtggcggaacgcaccgggctggacatctcgaccatctcacgcgtcagcaacagcaaatacgtgcaaacgaattacggcatttatcccctgaagttcttcttcagcgacggatacaccaccgaagacggtgaagagatgtcggtacgcgagatacggaagatcctgaaagaatgcatcgacagcgaggacaaaaagaaaccgctgaccgatgacgaactggccgaaatactgaaagagaaaggatatcccatcgcacgccgcacggtggccaagtaccgccagcaactcaacattccggtggcaagactgagaaaataa

SEQ ID NO: 3915 - DNA, 243 bp, B.fragilis
aaaattaatagaattatggctataatagtaaaccttgacataatgatggcccgaagaaaaatatctttgggggagttggcagagaagattgacattacgcctgccaacctttctatcctgaaaacgggaaaggccaaagcgattcgtttctctacccttgaggcgatctgtagagtgctagattgccagccgggggatattctggagtatcaggtggatgaagaagatggaggtacgtcataa

SEQ ID NO: 3916 - DNA, 1473 bp, B.fragilis
aagaaattaagtacgagtttaaaacaaactaaaaagatggatttattcaactactcccgacgggaaacttcggaagtgaatattggggccgttccgttgggcggccccaatcctatccgtatccagtcgatgacaaatacccccacacaagacaccgaggcttgtgtggcccaggcaaagcgcattgtagatgccggcggagaatatgtccgtctcactacacagggggtgaaagaggccgaaaacctgatgaacatcaatatcggcctgcgcagtaccggctatatggttccgcttgtggccgatgtacacttcagcccgaaagtagccgatgtagcggcacaatatgccgagaaagtgcgcatcaatcccggcaactacgtagatcccggacgcactttcaaacaactggaatataccgacgaggaatatgccgccgaactgcaaaagatacgtgaccgcttcgtccccttcctgaatatctgtaaagagaatcatacagccgtccgtatcggggtgaaccacggctcactgtccgatcgcatcatgtcacgctacggtgacacgccggaaggtatggtagagtcgtgcatggaattcctgcgcatctgcgtagacgagaagtttacggatgtcgtcatctcaatcaaagcatccaacacggtggtaatggtaaagaccgtacgcctgttggtatcagtgatggaacaggaaggcatgtcattccctctccacttaggtgttacggaagccggcgacggagaagacggacgtatcaaatcggctttgggcatcggcgcattgttggctgacgggctgggcgacacgatccgtgtctcgctgagtgaagaaccggaagccgagattcccgtggcacgcaagttggtggactatattacaagtcgccggaaccatccgtacattcccggcatggaagctccggatttcaactacctttctccggtacgccgtaaaacacggccggtacgcaatatcggcggagaccatctgcccgtggtacttgccgaccgcatggacggacgtatggagacccatccgcaatttacaccggattacatttatgccggacgtgctttgcccgaacagacagaacccggagttcaatacatcctcgatgccgacgtatggaaaggagaacctgacacgtggcctgccttcaattatgcacaattggagttaatggtaacatgcgtagccgaactgaaattcctcttttaccctttacatggcgcttaccggggaagttgtcgcatgcctgaagcaacaccccgaagcagtcgttgtctcacaaagcaaccacccgaaccgtgtaggcgaacatcgtgccctggcacatcaactgacggtggagggattacagaatccggttatcttcttccaacactatgccgaagatacagccgaagacttgcaggtcaaagccggtgcggatatgggagccttgatctttga

SEQ ID NO: 3917 - DNA, 675 bp, B.fragilis
aggagtacgagatcagcatcaccgttccccggggggcaacatctggaatatgcccttaacaaccacaaggcaaaagcttccgtaaccgaatccgaagggatgaagcaagtcagctggaccctgaagaatctgcccgccctcagccgtgaaccgcaggtgtcggtgatcggcggtgatttgcctctgctgactgccacgactgaggagaaacccctgtcatttctgacgtcacaatggcaaccggaaggagatgccgggattcgtgcgctggccggaaaactgactgccggagcgaaggacgataaagaaaaagtaaccgcgatacgtgactatgtgattgataatctttactattcgtccctcccgttggcggaaagcggttatcgcatccgtcccgccgcagaggtgatccgttcggcatacggcacggaggccgagaaggcgaatctgatggccgcattgctgaaagcggccggactgaaagccgggataggggcggtctgcgctccgtccgagaatacggcatcactgggagtaggcagcatccgcgatactatttgtgtggaccaacgccgaaggcagccaacagggtctgtcagtgaaaggcaaaactccctcagccgtttcgtggcagaaagattatgcctatgtagcttcattgacgcagccgtttga

SEQ ID NO: 3918 - DNA, 1170 bp, B.fragilis
ctttccggtgggacatgtgacagagaacctaccactaatcaacggtgcggaagtggagttcgtatccggaaagaaaggagtggaattgttaataaaccctcctatctgactcaccctacagtgaaaatcattaattttgaggctttaaactccaaaagcataattatgaaaagaaactctatgttcatactgtcagctttcatcctgttttctgctttctcctgcggaacaaacggcagcaagaccacttcgaccgacatcaccgagaaaaaggtaattgtccaagtgccccaatttgacgcagacagtgcttacaagtacatacaggcgcaagtcgacttcggaccgcgcacaccaaattctaaaggtcatgttgcctgtggagactacctggccgccaaactggccgaacatggagccaaagtgatcagccaaaacgctgaattacccgcatacgacggtacactgctgaaagcacgcaacatcataggatcttttaagcccgaaagcaaaaaacgcatcgcactctttgcgcattgggatacccgtccatgggccgacaatgatccgaatgaaaagaatcatcacacaccgatactgggcgccaatgatggagcaagcggagtgggtgtattactcgaaattgcccgccagatcaatcaacagcaaccggaactgggaatcgacatcatctttctggatgcggaagattacggagcacctcagttttatacaggcgaacatcgggaagaccagtggtgtctcggcgcacaatattgggcacgaaccccacacgtagatggctataatgcccgcttcggaattttactcgatatggtgggcggcaaagatgctactttctttaaagaagtatattccgagaaatatgccaaaggtatcaacaagaaggtatggaaaaaggctaacgacgccggatacggacgttactttattaacgaagtaggcggtcagatcactgacgatcatctgtttatcaatcgcttggcaggtatcccgactatcgacatcattccaaacgacgaaaattgtgaactgtccagcttcggaccgacctggcacaccgtgaatgacaatatggatgccatcgaccgctctacactcaaagctgtgggacaaacggtactggaagttatttataacgagaaataa

SEQ ID NO: 3919 - DNA, 1047 bp, B.fragilis
atgccatcgggaagttttggtatcaagattgtgaccggggatactccgggcaccgcaactgagattgcgcgtcagatcgggctgtggaaaccggaagatacggaacgcaatcgcattaccggagttgcttttgccgaattgagtgatgaagaagcattggatagagtgatggacttgaaaattatgtcgcgtgcccgtcctaccgacaaacagcgtctggtacaattgctgcagcagaaaggagccgttgtggctgtgaccggagacggaacgaacgatgcgccggcgctcaatcatgcacaggtagggctttcgatgggtaccggaacttcagttgccaaagaggccagtgacatcactttgctggacgactctttcaacagtatcgggactgctgtgatgtgggggcggtcactttataagaatatccagcgtttcatcgtatttcagctgaccattaactttgtggcacttctcatcgtattgctcggttctattgtgggaacagaactaccgttgactgtgacccaaatgttatgggtaaatctcatcatggatacatttgccgctttagctttggcttctattccgccaagtgagagtgttatgaacgataaaccgcgtcgcagtactgattttattattagtaaagcgatgcaacataatatattcggtgtcggtacactctttctggtagtactgatggcgatgatatactactttacaaatgccgacggtggaatgacggtacagcggttgaccatttttttcaccttctttgtaatgcttcagttttggaatctgttcaacgcccgtgtgtttggcactaccgattcagcattcaagggtcttacgaagtcgtacggaatggaattgattgtactggccatcctgggtgggcagtttcttatagtgcagttcggtggagctgtattccgtacagaaccgctcgactggcaaacatggcttatcatcatcggttcttcttctctcgtcttgtggattggagaattgattcgcttggtcaaacgtttaactcagaaatga

SEQ ID NO: 3920 - DNA, 438 bp, B.fragilis
ttatttatcatgtcaatcaacgaattacaagacgaagtcgttgctgaattcagcgacttcgatgactggatggatcgctaccagttacttatcgacttaggaaacgagcaggaaccgctcgacgagaaatataaaacggaacagaatctgattgaaggttgccaaagccgtgtatggcttcaggcagacgaagtagacgggaaaattatctttaaagcagaaagcgatgcactgatcgtgaaaggcatcatagcactgttgattaaagtcgtatcgggacatacacccgacgagattcttaattcggaactctactttatcgacagaatcggtctgaaggaccacctatcccccactcgtagcaacggattgttgtcgatggtgaaacaaatgcggatgtatgcactcgcattcaaagccaaagaggccaaaggctaa

SEQ ID NO: 3921 - DNA, 393 bp, B.fragilis
aaactaatcattatgaacttcccacagaatgtaaagtacactaacgaacacgaatggatccgcctcgaaggcgatgtagcttatgtaggtatcaccgactacgctcaggagcaactgggcgacatcgtatttgtcgatattcctactgaaggcgaaacactggaagcgggagaagtgttcggtacgattgaagtagttaaaacaatctctgacctcttcctgcccgtagccggtgaagtggtagaacaaaacccggcactggaagagaatccggaattagtgaataaagatccgtatggcgaaggctggctcatcaaaatgaaacctgccaatgcagcagaccttgacaacttgctggatgccgaaggatacaaagcagtggtaaatgcataa

SEQ ID NO: 3922 - DNA, 543 bp, B.fragilis
tcgtcacacatgactaaaatatatacccttctgctcctctgcctgtttgcgctgactcttccggtcaccgcccgggaagcggaatttaagaaaatcaaagaaagctggaccctgcaggctgatggtacgcaggtttatcgtcagtcgaaagtcctgacgctgtacactcacacggccatgaaccgcacgtatggggagtcgttcattacgtacgatccccgttatcagactttgcagattcacgagtcgtatacccgccagaaagacggaaatatcgtcaagacccccgccaatgctctggtcgaagtgctcccctcggcagcagccaatgcgccggcattcaatgctttgcgcgagatggtagtcgtacacaccgggctggaactcggagctaccatctatctggactattccattacaaccaaaccggggtatttgccggggattcagatctgccggttgctggagcactcttcgccggtgaaggagtacgagatcagcatcaccgttccccggggggcaacatctggaatatgcccttaa

SEQ ID NO: 3923 - DNA, 708 bp, B.fragilis
aaaagcataataaaagaaacaaacaaaatggctgaagaagagaagatagagcaacatatcatagctgacaggacactgatccgtacagccagaatcatttcgggaatactgactccattctctatccccttcctggcttttctggtattgttcctgttctcttacctacgcatcatgccgttgcagtacaagctcatcgtattgggaattgtctactgcttcaccatcctgatgcccaccatgaccatcttcctgttccgcaaagtgaatggctttgcccgccaggacctgagcgaccgtaagaaacgctatgtaccgatcctgcttaccatcatctcgtacgtattctgcctgatgatgatgcacaagctgaacattccctggtacatgacgggcattatactggcttcactggtggtgctggtcatctgcatcattgtcaatctgaagtggaaactgagcgaacacatggcaggtatgggcggcatcgtgggcggactggtttcgttcagcgcgctgttcagttataatccggtgtggtggctatgcctcttcatcctcgtggcggggatattgggttcggcacgcatcatcctgcaacatcacaccctcggcgaagtacttgccggctttaccgtcggtttcgtctgctcactgctggtgctccatccgctcagcaatgttttgttccgtatatttttattttaa

SEQ ID NO: 3924 - DNA, 693 bp, B.fragilis
aattcctcttttaccctttacatggcgcttaccggggaagttgtcgcatgcctgaagcaacaccccgaagcagtcgttgtctcacaaagcaaccacccgaaccgtgtaggcgaacatcgtgccctggcacatcaactgacggtggagggattacagaatccggttatcttcttccaacactatgccgaagatacagccgaagacttgcaggtcaaagccggtgcggatatgggagccttgatctttgacggattgtgtgacggaatttatctcttcaaccaaggcaaactgagccatgcagtgattgatgccactgctttcggaattctgcaggcaggacgtatccgcaccagcaagactgaatatatttcttgcccgggatgcggacgaacactgttcaacctgcaaagtacgattgcccgcgtcaaagaagccacctcccacttgaaggggctcaagataggcatcatgggatgcattgtcaacggaccaggcgaaatggcagacgccgactacggttatgtaggagccggacgtggcaaaatcagtctttataaacagaaggaatgcattgaaaagaatattccggaagaagaagccgtagaaaagctgatagaactgattaaagcaaacggggactatgaagagaagacttcttccctgtcctctcccaaagaaaaggaagacaaatag

SEQ ID NO: 3925 - DNA, 438 bp, B.fragilis
gtgaatctttctccggttaccgtgagaaaagtctatgcattgcagcccgacgcggcaaatgccaaagatggctatgtggtcttcaccctccccgtagagcgtggcagcctggccgattcacagtacgtccggttcaatagcaagcgcacttcgaaccttttgttgcccggactggcgggtgaatctttcacctataccatagatactcctgcaggtatggaacctgtcactcggccgatggagaagaagatggacaatgccgtaggtacattaaccatttccatccgtcccgaaggagcgaaaacgcgagtgatccggagcctgaagttgaagaaacagatgattcgcccggcggattatgccgctttccgtcaactgatgacagagtacggggcggtggacgggctgacgctggtgtacagaaaacctcttccctga

SEQ ID NO: 3926 - DNA, 1698 bp, B.fragilis
acggaatattctttttatgattttttaaagctcattggctcgttaggactttttctttatggaatgaagatcatgagcgagggcttacagaaagtcgcaggtgacagattgcgaggaattctgacagcaatgactacaaaccgggtaacgggagttttaacaggtgtgttgatcaccgcccttatccaatcttcttcggcaacgacggtgatggtggtcagttttgtaaatgccggtctgctgacattggccgaatccattagtgtgataatgggtgctaatatcggtacgacagtcaccgcatggatcatttctatttttgggtttaaagtcgacatggctgcttttgcccttcctcttttagccattgcccttcctcttattttttcgggtaaaagtaaccgtaagtctatcggtgaatttatctttggtttttctttcctctttatggggctttcgtacctcaaagcaaatgcccccgacctgaatgccaacccggaaatgctggcttttgtacagaactatacagatatgggatttttctcggttctgctctttttatttatcggtactattctcactatgatcgtacaggcttccgccgcgacgatggctattactttaattatgtgtgccaacggatggatcagcctggaactgggtgccgcattggtcttgggtgagaatatcggaactactattacagccaacctggctgccctgactgctaattcacaagcaaaacgtgctgctttggctcactttgttttcaatgtttttggtgtgatctgggtgctgattattttccatccttttatggtattcgtcaattgggtggtcgataccttcttccatccgggaagtgcagaggtggctatttcttataagttgtccgctttccactctatttttaatatatgtaacgtctgtctgctgatttggggagtgaaactgattgagcgtaccgtgtgtgccattattcgtcccaaggaagaagatgaagagccacgcttgcgctttattaccggaggtatgctttctacggccgaattatccatacttcaggcccgtaaggagattcatctgttttccgagcgtattcatcgtatgtttggtatggtacaagatctgttgcatactgaaaaggatgatgacttcaataaacttttcagccggattgagaaatacgagaatatcagtgataatatggaattggagattgccaattacttgaatcaggtatctgaagggcgtttgagctcagaaagtaagcttcagatacgtgccatgcttcgtgaggtaaccgagattgaaagtattggtgacagttgctataacttggcacgtaccatcagccggaagcgtcagaccaatcaggatttcacagagaagcaatatgagcacattcatttcatgatgaaactgaccaatgatgctctgtcgcaaatgattgtcgtggtcgagaaacccgaacatcagagtatcgatgttaataagtcattcaatattgagaatgaaattaataactatcgtaaccaactgaagaatcagaatatcctggatgtgaataataaagaatatgattatcagatgggcgtttattacatggatattatcgccgaatgtgaaaaactcggtgactatgtagtaaatgtagtagaagcgagcagtgacgtaaaagaaaagaaagcgtcttga

SEQ ID NO: 3927 - DNA, 1656 bp, B.fragilis
atgatctgttctttcttttttatctatttttgccccttgagaattttaattattaatctaactatcatgaaacgaaaagcgactttactatttctcgtgacattcgtgctgctgctcggtgcagtcgcacaggaaaaattgaaaacagtgatcgaacccctgcaaaatgaaagatggtggggtggattcgtggctttaggaaatcaaatgccattcaatgatcacttgcggatgcaagacatgtcacgcaataatatgaacaaccaagtagtgccgttcatgctttcttcggagggcaggtatatctgggccgaaaatccgttttgttttgaagtaaaggatgggcagctgattatttattcagactcggaaaagatagagccggtgaaggccggaactacgctgaaagaggctttgctggctgcatcggctaaacattttccaccttcgggaaagattccggaacctactttcttttctcttccgcaatataatacctggattgagctgatgtatgatcaaaatcaggaagacattatgaattatgcccataaagctgtggagaacggatttcctcagggggtgtttatggtagatgataactggcagagatattatggtaactttgacttcaaaaccgagaggtttccggatccgaaagggatgactgacgagttgcaccggatgggattcaaggtgatgttgtgggtggctccctatgtttcgcccgatagtcccgaattccgtgaattggaagcaaaaggatatttgttgaaagataaaaacgggcgcacggccattattcattggtggaatggttacagtgcctgttatgataccacaaatccggaggctatgaattatctgaaggaacagttaaaagccaatcaagaaaaatatggtatcgacggatttaagtttgatggtggagacgtagcttatatgacaggagagtatacttttcatgataagaatgccaatgtgaatacttttatggaaaaatgggctgagataggtttgagttttccttacaatgaattgcgtgcatcttggaagttgggtggccaggcattggtacagcggctgggtgataaagattattcttggcgtgcgactcagttattgattcccgatatgactgctgccggattgttggggcattattatacttgtcccgatatggtaggcggaggacaattcggagcttttctgaatgtgaagaaatttgatgaagaacttattgtacgttcgtgccaggtgcatgccctgatgccaatgatgcaattctcggtagctccttggcgtattctcagtaaagagaatgtggctatttgtgcgaagtatgcccatcttcaccagcaaatgggagattatattttggagttggcaaaacatgcgtcaaagaccggtgaacccattgttcgccacatggaatatcagtatcctcaccagggattcatcgattgcaaagaccagtttatgctgggggataaatatctggtagctccgatgctgacatccggaacaagccgtaccgtaatgttgccaaagggtagatggaaagatgatcggggcaaggtgtttaaagggccgcggacaatgacaatagatgttccccttgaacgtttgccatattttgagaaactgacgaaataa

SEQ ID NO: 3928 - DNA, 327 bp, B.fragilis
ttcgtacctttgcatcgctttaagagaaaagcactacttaaccgtagttttggagaggtggcagagtggtcgattgcggcggtcttgaaaaccgttgtactgcgaggtacccggggttcgaatccctgtctctccgcaataaacgctgaaaatcagcaaattataaaacaaacacccaattttatacccaagaatgtaaagttgggtgtttttattttatttaagacgaatcatattcgctcggaaaataatttgataaaaaacagaacaaacgaaaaaaacaaccaattcattttccgtaagatttcgtatctttgcagtaaataa

SEQ ID NO: 3929 - DNA, 219 bp, B.fragilis
ataactatctcaaaaaaaaatgctgaaatatgcgatattcacgagaaactaagtacacatattgccagacatagctacgccacaagtattagccttacaaacggtgtaagtatggaaaatctagcaaaaatactggggcatactgatacatccataacaagaacactttgcacaggtgctggaccaaagtattatggaagatatacagaaagtaaatag

SEQ ID NO: 3930 - DNA, 1395 bp, B.fragilis
ggtccggcctcggtatttttgaaaaaattcattaataattccgatagtttttgcgtgagtccgtactttggtgtaatttgcggtcatgaaactattcaaacttatatggaattcttagtaattattcttttactcgtactgaatggcatttttgccatgtacgagattgccttagtatcctcaagtaaagcacgtctggaaaccctggtcagcaaagggaacaaatctgcccggggagtattgaaacaattggaagaacccgaaaaatttctttctaccattcagattggtatcacgctgatcggtatcgtatcgggtgctttcggtggagtagccattgccgatgatgtgactccgctctttgccatgataccgggagccgaagtctatgcaaaggacctggccatgatcacaaccgtaatcgtcattacctacctgtcactgattatcggtgagcttgtacccaaatccatcgctctcagcaatcccgagcgctatgcaaccttgctgagtcccgtcatgattctgctgaccaagatttcattcccttttgtctggttgctcagcatttccacccgcctgctcaacaaactgatcggtctgaaaagcgaagaacgcctgatgactcaggaagaactgaaaatgattcttcaccaaagcttcgaccaaggtgtgattgacaaagaaaaaaccgaaatgctacgtgatgtctttcgcttttcggataaacgtgccaacgaactgatgactcaccgacgtgatctggtggtgctacatacgactgacagcaaagagaaagtgcttcagatcatcgacaacgagcatttcagtaaatacctcctgattgatgacgacaccgacgaaatagcaggtgtggtttctgtgaaagatatcatactgatgataggtagcgaacaggaattcaaccttagagaaatcgcacgtcccgccttgtttatacccgaaagtttatacgctaaaaaagttttagagctatttaagaagaacaaaaataagttcggagttgttgtaaacgagtatggcagcacagagggaatcattaccctgcatgacttgaccgaaagtatctttggagacattctggaagaggacgatacggaagaagaggaaatcgttcgccgacaggacggctccttgttggtagaggcttcaatgaatatcggagattttatggaagagatgggaatactctcttatgatgatatcgaatcggaagactttacaactttaggcggattggctatgttcctgataggacgtattcccaaagccggagatatattcacttacaaaaaccttcagttcgaagtagtggatatggaccgtggaagagtcgataagctgttggttattaagagagaagaggaggaatag

SEQ ID NO: 3931 - DNA, 294 bp, B.fragilis
tattctcaatcaatgcgcttttattttaatgatcttttttcagctctgccgcacattcagcacaacagcctttcaagacataatttatacttcgtacagcaaatccctcgggtaaatcgaccacaggaacgtggatattctcaaggcaaaaagtcttatgacaatattcacaataaaaatgtgtatgtagatcctttaccgcacaagtacattcactatcacaaaccgcatatttcaaagaccctgtaccatcatctacactatgtgccaaatgatgagagacaaacaaagtaa

SEQ ID NO: 3932 - DNA, 1410 bp, B.fragilis
aattgcaaatcactgataatcatatactatctaaagcgcagagtaaatctaaatctttctgaatatcttttgctattccaaatattgggtgtatatttgggtgtagaatttcaaacgcacccaattatgaatatcaaacgtaacatcatttttgcattggaaagccggaaaaagaacggtgtgccaatcgtagagaacgtacccatccgtatgcgtgtcatatacgcaagccaacgcatcgagtttacaacaggctaccggattgacgtagccaaatgggatgccgacaaacaacgggtaaagaacggatgcaccaacaaactaaaacaaagcgcatccgaaatcaatgcggacttgctgaaatattatgccgagattcaaaacgtgttcaaggagtttgaggtacaggaaaccataccgaccacccaacagctaaaggatgcgttcaacctgcggatgaaagacaccagcgaagagcagcaggaagaaacacaaataagtttttgggaagtattcgatgagtttgtaaaggagtgtggcaatcagaataactggacggcatccacctacgagaaattctcagcagtgaaaaaccacctcaaagagttcaaggaagatgtaacctttgaatacttcaacgagttcggcttgaacgagtatgtaaatttcctgcgtgacaaaaaggatatgaggaacagcaccatcggcaaacagatgggattcctcaaatggtttctgcgctggagcttcaagaaagggcatcatcagaatattgcatacgacactttcaagcccaaattgaaaaccacctctaaaaaggtgatattcctgacttgggacgaattgaacaggctgaaagattatcggataccgaaagacaaacaatatctggaacgtgtcagggatgtttttctgttctgttgcttcacaagcctgcgatattcagatgttcgtaatctgaaaagaagcgatgtgaaacccgaccacatcgaagttaccacagtcaaaacggcagacagcctgataattgaactgaacgaccacagtaaaaccatactcgaaaaatacaaggaagtccattttgaaaaccacatggcactgcctgttatcagcaatcagaagatgaatgattatctgaaagaactgggggaactggctgaaatcaacgagcctgtacgggaaacatattataaaggaaatgaacgtatagatgaagtcaccccgaaatacgcattattaaccacccatgcaggaagaagaacattcatctgtaatgcgctggctctcggtattccggcacaagtcgtgatgaaatggacggggcacagtgactataaagccatgaaaccctatattgacatagcggatgatattaaggcaaatgccatgaacaagtttaaccaactataa

SEQ ID NO: 3933 - DNA, 2142 bp, B.fragilis
ctccgcaaatcaaggtggcagatgcagagattatttcttctgcgattacagattccacctatttgtccgatcataatgcacatctggctgatttggaattctaaaccgtataaacgaattgtaaccatgaaacagattttgcatatattactcatcgccttgatgctgatgggcttttatagttgtgttccgaagacggaattagcctctccggacggacatatcaaagtggcttttactgcggataccgatggaaagatgatgtatcgggtgactgtcaacgatacccttttattggataactctccgctcggtttcgaagcgaaagagggaatcgatcttaatcggggatttcgtgtggtgaacactgtctttaccgataaagacgagatctggacgcaaccttggggagagaataaaacgaaccggaatcattataatgaaatggcggttcttctgaaaaatgccgctaatgtggaattgactcttcgttttcgtgcatttgatgatggtgtagcctttcgttacgagtatgaggtgccaggtgtcgactctttgttgatcaccgatgaactgactgctttccactttcatgaagacgggacctcttggtctattcctgccagtttcgagacttatgaattgctgtactcgaaacagaagatcagtgaagtggagaatgccaatactcctttcactttcaaaacatccggaggggtgtatggcagcattcatgaagctgctctttatgattttccggaaatgactttgaagaaggatggtgaaaatactctgaaatccgaacttgcctcatggcccgatggaattaaagctcgtaaagagaatcgttttaccactgcatggcgtaccattcagatcgctccgcaagctgtcggactgattaattcgtcgttgatccttaacctgaatgaaccttgtaaactggataccaccgactggatcaagccgatgaaatatgtcggtgtctggtgggggatgcatctgggagtggaaacctggaagatggacgatcggcatggcgctacaaccgccaatgccaagaaatacattgattttgctcatgccaataacatcgaaggtgtgttgtttgaggggtggaacgaaggatgggaaagttggggaggtatgcagagttttgactttactaaaccttatgccgactttgatatggatgaaataactcgttatgcacgtgaaaagaatgttcagatcatcggacatcatgaaaccggtggaaacattcccaactacgagcgccagatggagaaggcaatcaagtggtataccgataagggtattcatattctgaaaacaggttatgccggtgcttttcctgacggacattcacatcatggacaatatggagtgaaccattatcaaaaagtggttgagacggctgcccgttatcgtatgactcttgatgcgcacgaacctatcaaagataccggtatacgacgtacctggcccaatatgatgacacgtgaaggcgcccgcggtatggagtggaatgcttggagcgagggtaatcctccttcacatcatgaaatgttgccgtttacccgcttattgggtggtccgatggactatactccgggtacttttgatattttgtttacacagacgaaagattctcctaaacgtcagaagtggaatgatcaggataagggcaatagtcgcgtcaatacaacattggccaagcagttggctaattgggtgattttatattctccgttacaaatggcatctgatatgattgagcactatgaagggcatcctgccttccagttcttccgtgatttcgatcctgattgtgacgaatcgagggcattggccggtgagccgggagagtttgtagcagtggtacggaaggctaaacagaattatttcctgggtgcctctacgaatgaagaaccgcgggtcttgcctgtcagtcttgattttttagagaaggggaagatttataaagcaatcatctatgctgatggtgagaaagctgattggaaaaccaatccgacggagtatcagattacggaacaggaggtgactgcagacgatacgttgaatatccgtatggcagccggtggcggacaagctatttcatttatgcccttgcagaaataa

SEQ ID NO: 3934 - DNA, 1863 bp, B.fragilis
ttaaagatgtcaatcatggataataaaggattctatataaaagcgattcttgctaccggaacaaaagttcaggactcacgtgttgatttcaacaaaggttgtaatttgattcacggacaatcagatacaggcaaaagtgttgtcttttcgattattcaatatctattgggacaagaagatcctcccaaagaagcaactgaaggaaaggaatatgatacattttatatgcaaatatgtatgtattttaatgatgaggatgtctataccatacagcgtaaactgacggataaaacaaaagtttatgtaaaacattgtagtatagaccagattcatgacatgcatatcaagcaagaaatatacagtgtgaaatcaagtgaaaaaccatcatcatactcttccttcctattaaaactatgcggttttgacaataccataaagataaaacaaaaagatagtaaattctctaatttgtattatacacagctaagacacctgctcatgttgggggagcaaagaattgttgatgacaggtctattttcttaccttcaggaatacctagtgatgttacaaaagagaaaagtgttatcagttatttatactctggtgaaggagatcctgaaattgatggattagaagacaaaaagttgcgtaaagccagaattacaggtaaaatagaatatgtacaagaggaaataaaacgactggatcaaactatcgaagatataggagacgtttcatttgcaggattagaggaagccttaaatgtgaataaaataaagagtgaaattaagaatgccgctcaaaggctagacatactgtacaaacaaaaacatactaaaaatgaagagttagacaaatggcaatcaaaaattttatttgagcaagagttatataatagattgttactattaaaatctcattatgaattagatatagaaagatataaaggaattgaagaagcacgtgaacttctatcaatcctgacatacagagaatgtcctaaatgtcatactaaactgcaaacagactcgtttgatttagaagatgaacaatttattgctgctatagagcaagaatctttttccgaccagtgcaagttgagaagtttgaatgagtacattaaagagaaaaaagcatatttaaaaaaatgtaaagaaaaaatcgataaacttgaaatagaaaacatttctattaataaccagatttccgaaacagaacccaggctcacatcctttagggatttattaaaaagaattgaattaaattgggaaaaaaagacgagattaaaacatcttgaagaagattcattcagattaaccaaagagttgagtgaactaaaaaaatcattgacaaataagcaggtattaaccattccgtcacgtaataaactaccggcaaaagaattctatgataccgtaaaggagaaaatggtggcatggaatcttgaaaatcatgaaacaatagtgatgaatctggatgattttgactttacacttggcggtaaacgtcgtattacttgtggtaaaggctatagaggtattactgctacagcaatcatgatgtcattggtagaggattgtatttatagaaatgtaccttttactcggttacttgtgactgattcgccaatcacagctcactttggtaaagaggataaaaaaacagatgcagatgatttagaagaaaacgttcaacgttctttctttcaatatatggaagataaaaactggaactatcaattaatcatgatggacaataagcatccatatacagaccagaaaaagataatgaagaatattcattttattgaattttcagaaaccggtagaaaggggttttatgtaggaaaaaggaaagaataa

SEQ ID NO: 3935 - DNA, 225 bp, B.fragilis
catccttcgtccatcaggcttttaatgttgggtatgtctgccttgggcacactatacgcaccccagccgtccaacgcaatcaatactacatgttttgcctgccgtttagccgcccaagccacattgcagaatccgatcgcaagcaaacatactaaaacaaataactttttcatggtattctatctatatttaagttttgtcttttgtgtatcttctattctttaa

SEQ ID NO: 3936 - DNA, 510 bp, B.fragilis
caactcactttttatattaatttaaagcacttaacaatgaaaaaagtaattatgttagcagccgtcgttgctgcattggtatcctgccaatcaaaaggaacgaaagctgaagaagcagtcgcagacagtctggcagtagctatggaacccacaatggaagaaacccaggtatatgaaggtgtgcttcctgctgctgacggtccgggcatccgttacgtgttaactttgaacacactggcgaacgcaaccgatacaacgtatacactggacgtcacttatctggatgctgaaggtaaaggtaaagacaagacttttacttctaaaggaaagccggtaaaagtggagaaaaccgtcaaagataaaaagaaaacggccatcaaactgaatccgagtgacggaagtgaacctgtttatttcgtaattgccaatgatactaccctgacactggctgatgacagcctggaagtatcggaaagcgatctgaattacaacattatccgtgtaaagtaa

SEQ ID NO: 3937 - DNA, 1176 bp, B.fragilis
caattaatgtttaaccaaaccaatttaaaatttagagaaatgaaaaaaagtatttttatgtttgcattggcaacattgatgagcgcaagtgtatttgctcaagacaatgatgcaaaacgtcttccgggatataaaacaacctttgaaggcaatggattttggaacaactggttcatgtcagcaaactttggtgcacaatctctgttcgcagaaaattcaaaagacgctaaattcagaaacacaatcactttcatgccgacactttctgtaggtaaatggtttaatccttactggggagttcgtttacaaggtacaggcggttcactgcacggatttacttctggcgctaactcaatgttgcactatcaatatggtgctgttcacgcagactttatgttcggactgatcaacttctttgctccttataaagaaaaccgtcgttttgacatcgttccttttgcaggtattggtggagcatttattcgtaaaggcgaccagtcgtttacaatcaatgcaggtatccaggcacgttaccgtatctcaaaacgtttcgatattaacgttgaataccaaggagctatcctggatgacgatatggtggttcgcggtggttttccgaatgatggaatcagcggtctgacagccggtgttactttccgtttcggcaaaacaggtttcaagaaaggctactcttcacgtcagtacaacgctatcaagagcaactactctgatctggaagcaaactacgcaactttgaaaaaagaaaatgctgcacaacaagctgaaatagcagaactgaaagcacgtaaaccggaaattgtcaaagaagaaacaataatcgacaattctgaaatcaaggctcttccgagtacaattactttcccattcaacagcagcaaaatcgagctttcacaggaagttagtatcttcaatattgctgaattcctgaaagcaaatccagaaatccgtgttcgtctgacaggttatgctgacaaacgtggctcagaacaagctaacagaattgtttctgaaagacgtgccaatgcagtaactgaagtgtttgtcaacaaatacggaattgcaaaagaccgtatcactacagagttcaaaggtaccagcactaagtttgaaaatgatgactggaaccgcgcagtagtggtagagctgatcaagtaa

SEQ ID NO: 3938 - DNA, 504 bp, B.fragilis
actcccgacccgtcatccgatgcgcgtgccgtacctatttatcagacaacttcctatgtgttccgggattcggcccatgccgccgcacgatttggattgcaagaccctgggaatatttatggacgactgaccaattccactcagggagtattggaggaacgcatcgcagcacttgaagggggagtaggtggtcttgccgtggcttccggagctgctgccgtgacctatgctattgagaatatcacccgttccggtgatcatattgtggctgccaagaccatttatgggggcacatataacttgctggcgcatactctgcctgcttatggagtaacgaccacttttgtagatccgtccgatctttttaatttcgaacgggcgattcgtgaaaatacaaaggcgatattcattgaaactctgggaaaccccaattccaatattatcgatatggatgccgtagctgccattgcccataaatatcggattcccgctgattgtggataa

SEQ ID NO: 3939 - DNA, 183 bp, B.fragilis
tcatatctaccgttactattttcgtggattatgcgccttttgctctcaatatgtcactctgagcgaatcggaagaaatcgtgcaggatactatgatgtggctatgggaaaacagaaaaacccttataccggaacttactttaaagactcttctctttactatcgtcaagaacaaagcgcttaa

SEQ ID NO: 3940 - DNA, 207 bp, B.fragilis
tacaactcacccgggaaaactactaacctctatcaccctttttttattaaactttatcaatacaacacacgcaaagaagcaccgaagactttcatccccgatgcctctcgcccccttatctacaatctaaacacctctattgcttcacatataaatttatctcagcaaacccggtataattatccggagtcagacagtttattctga

SEQ ID NO: 3941 - DNA, 999 bp, B.fragilis
ataatcaaacccatgaaacgaatttatttattgttggctatcctgttgggaagccttcagctggcaaatgcacagcaacagactcttcagtttaacaaagacggtaagtttaagattgtccagtttaccgatgttcattatatctataatgatcctcgttcggatgtatcgatcgaacgtatcaatcaggtattggatatggaaaagcccgaccttgttctttttacgggagatgtgatttatggtaaaccggcggaagaaggaatgcgtacagtgctgaatctggtatctaaaagaaaaatcccttttgcggtgactttcggtaaccatgataacgaacagggactgagccgtgaagaattgttgaagatcatccaatctgttccttttaacctgacacagactactccgggtatttcgggagtgacaaattttatcttaccggtgaaggcttccgacggcaagcgcaatgcaacggttctttattgtatcgactctcattcttattcacagatcaagggagtgaatggatacgattacatcaaatttgaccaaatacagtggtatcgtgagaacagtaagaagtttactgaagaaaataatggcgttccggtttcgtcgtatgcgttttttcatatagctttgccggagtataatcaggctgcctcttccgagagtgcaatactttatggcattcgtaaagaaaaagcatgcgctccccagttaaattcgggcttgtttgccgccatgaaagagatgggagatgtgagaggtgtatttgtgggacacgaccacgatgatgattatgccgtgtcatggaagggaatcttgctggcatacggacgctatacgggtggcaacacagtatataatcaccttacaaatggtgcgagagtgattgagttggatgaaaatgcaaatagtttccgtacgtggatacgcctgaaggaaggggtcgtacaacaggtaacctatcctgccgatttcattaaagaatag

SEQ ID NO: 3942 - DNA, 774 bp, B.fragilis
ctgccattgcccataaatatcggattcccgctgattgtggataatactttcggtacgccttaccttatccgtcccattgagcacggggcagacattgtggtacattctgccacaaaattcattggcggacacggcagttcgttgggaggagttattgtcgattccggtaaatttgactgggttgcttccggtaaattcccgcaactgaccgagccggatgcaagttatcatggggtacggtttgtcgatgctgccggggctgctgcctacattgtccgtatacgtgccgtgttgctgcgcgatacgggtgctgccatcagcccgttcaatgcttttatcttgctgcaagggttggagactttgtctttgcgtgtagaacggcatgtggccaatgctttgaaggttattgattttctggtgaaccatccgaaggtagcggctgttaatcatccatcattgcccggtcatccggatcatgccatctatcaacgttattttcctggcggggcaggttctatcttcactttcgaggtaaagggaggaacggaggaagcgcagaagtttatcgatagtctgcagatattctctttgctggccaatgtggccgatgtgaagtcgctggtgattcatccggccactaccacacactcgcagttgaatgcgcaggagctggaggaacaggggattaaacccggaacggtcagactttcgataggtacggagcatattgaggacattattgatgacttacgtcaggcattagagaaaatttaa

SEQ ID NO: 3943 - DNA, 195 bp, B.fragilis
agacaatatactgagaaacaaacaaatggaaaagtgattccacagacaaattgtccggatttcattcataagcatataatcttctatttcacaaagctttgcatctttacaaaatcagacaatcttaaaataaatgaagaaatatttgcaaccaacaaaaactatttatatttttgcgaccgttttgcgaattag

SEQ ID NO: 3944 - DNA, 183 bp, B.fragilis
ggacctttcacccaaaattcgcccatgtgtgacacatcaaaaacaccgacactgttacaaactgtaaggtgttcgtcgatgatacccgaatactcaataggcatgttatatcctgcaaactcgtgcatcttagcaccaagtgcaatatgtttctcggtaaatggagtggttttcatgaaatga

SEQ ID NO: 3945 - DNA, 1338 bp, B.fragilis
aactttcccacaaaaatagcagataaaaacgagagacgaaaccatttttatataactttgcacagaattcacaaagtatatcgaaccgggccaatgaagaaaaatgttttgttcctgttgctactcggcctgctcaccacagtcagtgcgcaaccgacacaccgaataaagggaactgtgattgacaaagccagtcgtcaaccgctggaatttatcaatgtactggtcttagggctgggacgcggaggagtgacagatgccgaagggcacttcaacatcggagaagtccctccgggcatttatcgtctgcaggcgtctgctgtaggatacaaaaccatactcacccccgaatatatcgtctctactaaagatctcaccatccaaatagaaacagaagaaaacctgaccgaattagaaggagtcacggttactgcttctcctttccgaagagacccggaaagtcctgtagggctacgtatcatcggattgcaggaaatcgagaaaagccccggagccaaccgggatatctcacgtattgtccaatcttatccgggcgttgccttctcccctgccggatatcgaaatgacctgatcgtacgcggaggatctccttccgaaaaccgtttctatctggatggagtagaaattcccaatattaatcatttcagcactcaaggggcctcgggaggtccggtgggcatcatcaacgcagacttgattcgtgaagtcaatttctatacgggagcttttccgaccgacagagggaatgccatgagttcggtactcgactttaagcttcgggacggagatatggaacgcaattcattaaaagcaactttaggagcctcggaagtctcgttagcatcgaacggacatataggaaagaagacatcttatctggtttcggtgcgtcagtcatacctccagtttttatttgacatgttggggttacctttcctgccaactttcaccgacgcacaatttaaactgaaaactcgcttcaatgccaacaacgagttgacaatactcgggctcggaggaatcgataacatgaaactgaataccaagctggatggagaaaaagcggaatacatattgagttacctgcccaagatacagcaggagacttttacactgggagccgtataccgtcactatgcaggcatacatgtacagtctgtagtcgtcagccacagttacctgaacaaccgcaataccaaatatctgaataatgacgaaagcagtgcggacaacttatccctgaagttgcgctcagtggaacaggagaccaaattccggatagagaacacctcgactttcggtaaattggaaaattaa

SEQ ID NO: 3946 - DNA, 705 bp, B.fragilis
aaaacgttaacaagatactggcatatcataaaaaaatgcgatatttgcggaatgattcagatagagactatacttgatatactggttaaaggattcgttatcggcattgtggtttctgcgccgctggggcctgtaggtgtcctttgtattcagcgtactttgaacaaagggcgttggtatggatttgtcaccggactgggggcttcgttgagtgatattgcttatgctcttttgacgggatatggcatgagcttcgtattcgattatatcaataaaaatattttttatctgcaactcctcggaagtatcatgctattggcttttggtatttatacattccgcagcaatcctgtgcaatccattcggcctgtatcggccaataaaggttcttatttccacaacttcattaccgcctttgcggttacactttccaatccgcttattatttttcttttcatcggtctgtttgcccgttttgcttttgtgcaacccggagtattggtctttgaagagattacgggctatctggccattgccctcggagcgctggcgtggtggtttggaataactttctttgttaataaagtgcggacgcgattcaatttgcggggtatctggattttgaaccgggtgattggcagtatcgtgatggcagtatccgtgttcggactcatattcactttgctgggagaatctatttattga

SEQ ID NO: 3947 - DNA, 312 bp, B.fragilis
aaaaagggaactatttctttacagaaacagccccctcttcgtgatttaggttataaaatatttttgttatctattcgtcttaggagtcaatattatattgttatcctcacatttataatcgaaacgtttggtaagagcgagtatagaaagaatttgtcttatatcatcgtccgtactaaaagtacaggtaaaacggtccttttgcagttgtgcatccgaaataatgaaatgaacatcaaaatgtttttcaagacactgcactatttcctgaagtgtggcctgttcgaatttcagttttccgttaatccatag

SEQ ID NO: 3948 - DNA, 321 bp, B.fragilis
atagattggacgatgacaaatcttcaagagttattattaaaacccgtctggcagatgacaggcgaagagttcatatttctaagcaagtacgcttccaaccaaacggaagcgcagccacagcccgttacggacacagaaagaaagtatgtgtacggaatacttggcattgccaaattgttcgggtgcagtctgcctaccgccaaccgtataaagaaaagcggaaagatagacaaagccattacgcaaatagggcgcaagattatcgtggatgcggaacttgcccttgaactggctggaaagaaaaccggaggacgaaaataa

SEQ ID NO: 3949 - DNA, 1329 bp, B.fragilis
attatatttgcgacaacaataaacattagaatggaaaataacagagaatatcatataggaagaacggactttgacgcatttgttcatgccgtcggttcggaaatagaacaggcgcaagtccggctgattgccgcagccaatgcgcaaatgctgttccattactggaaaatgggcaactatatcctgtatcatcagaacttgcaaggctggggaagcaaaatcatcaagcaactggcaaaggctatccggttcaattaccccgaaaagaaaggttattcggagcgtaaccttacttatatgtgccaatttgcacggtcatatccgttgaacgtgctacgaagtttcattgatacagacacaaggctgtctgttccaagcatacagaatgttacagatgaagtattgaaactgaacaacggacaatttacgcaggaacttactgcgcaaatacaatccgctgattgtcaatctttagaaattacgcaggaagttcctgcgcaaattcaggatgtggagaaaacagtttctgccatttacaggatggagattagggaaatagaaaaagttttcctgaaatcccctgttgccaaaataaactgggcaagccaaatggtcatacttaacggttcgttaccgttaggcataggatattggtatatgaaacaggctgtagaaatgggctggagtagcaatgtgctgaaaatgcaaattgaaaacaacctatataacagacaaatcaacaacaacaaggtaaacaatttcacagccacacttccagcaccacaaagcgaccttgccaattacctattgaaagacccgtacatcttcgatttggctggagcgaaagaaaaggcagacgaaagggacatagaagagcagctggtaaagcacgttacccgttatttgttggaaatgggcaatggttttgcctttgtcgcccggcagaagcattttcaaataggtaacagtgatttctttgccgacttgattctatattctattccgctacacgcatacattgttgtagaactgaaagctactccattcaaaccggagtatgcagggcaactgaatttctacatcaatgtggtggatgacaaactgaggggaaaaaatgacaacaagactatcgggctgttgctgtgcaaaggaaaagatgaggtggtagcacaatacgcattgacaggctacgaccaaccgataggcatcagcgattatcaactgagcaaggctatacccgaaaacttgaaatcagctttgccaagtgtggaagaggtggaagaagaactggcatctttccttgacaaggacaataatccccaaaattga

SEQ ID NO: 3950 - DNA, 807 bp, B.fragilis
gacaactctgcaacatacacaggactttgtttgggacacttaccgaaaaaagttttttttctgagtgaaatgtcccagcagttcgtcgaagactatatgttttggttattgacaaagaaagggtgtagtcacaatacttcgactaaatatctgaagaactttaaaaagattatccttctttccctagcaaaaggatggttgaagaaagaccctttcgctgaatataaattcacgcttgaggcagtagaccgcgatttccttgaagattctgaaatccagaaaatactcagcaaagaaattgcaatttctcgcttggtccaggtgcgtgatacttttattttttgttgctttaccgggctggcattttcggatgtcaagcaattgaagcaggaagatattgtcgaagattccaacggggttaagtggatcaggaaagaacgtcagaagaccaagattatatgtaatatccctttgagggatattccgctgcagattctgaagaagtatgagaataatcctcagtgtgtcatcaagggagtgttgctgccgattctatgtaatcaaaaaatgaatgcgtacctgaaagaattgggagatatttgcggggttaacaagacgataaccatgcataccgccagacatactttcgcgacctatgcgctcgccaatggggtatcgatggaaagtgtggcgaaaatgctcggccacactaatctacagatgacacggcattatgcacgtacgctggataggatagtagtcaaggagttgtttcagattaaggacaattttgagatggcgaattga

SEQ ID NO: 3951 - DNA, 228 bp, B.fragilis
agtgcggacgcgattcaatttgcggggtatctggattttgaaccgggtgattggcagtatcgtgatggcagtatccgtgttcggactcatattcactttgctgggagaatctatttattgataggagaaaagacagaagatgaaaatagcgcaacaactcaaggagaagaacattgccgaataccttatttatatgtggcagatagaggatttgatccgtgccaatga

SEQ ID NO: 3952 - DNA, 996 bp, B.fragilis
gggctgtcagcgctgccattgtttctatgctggctactgtcccgcccggaggcaatcattgggaatatatctgcgaccattgtgggaaagctttcgaaaagccggttacggaattcaacccttctgctttggaagagaaagattgaaaagacaaactctaaaaaacatagattaaaaatgaaaagaagaaatttatttttggcttgtctgcttttatttgtattgccgcttagtgccgcaagggtagatacgctgatggtgaagagtccctctatgaataaggaggtgcaggtgttggtagtgacccctgatgttgctttgggaaaaaatgcagcagcttgtccggtactttacttgttgcatgggtatggcggtcatgctaagacctggattcagataaaaccgaacttgccggaaatagcagatgaaaaagggatcatttttgtgtgtcccgacggcaaagacagttggtactgggacagccccaagaatccggcgtaccgatatgaaacgtttgtttcttcagagttagtgaactacattgaccgtaattataaaacgattgctgatcggaagggacgtgccattaccggtctcagcatgggaggacatggggcaatgtggttaggtattcgccataaagacgtgtttggagcggcaggaagcaccagcggaggtgtcgatatccgtcctttccccaaaaactggagcatgaacaagcagttgggtgaactggcctcaaataaaagaatatgggacgaacatacggtagtcaatcaactcgataagattcagaatggtgatcttgctttaattatagattgcggtgaggatgatttttttctgaatgtgaataaagactttcacgatcggttgttgggccgcaagatagatcatgattttattacccgtcccggtgaacacaatggaaaatactggaataattccattgattatcagattcttttcttcagcaagttctttgccggagagtaa

SEQ ID NO: 3953 - DNA, 189 bp, B.fragilis
atggttaaagcaatacccattataatcaaaggccgcggaatcaaaaataaagccgctattgccaatgaaacaatagtcacggtttcctgtttagatacacgcgaagtgaacaattcggaatatggttcggaacttgtttcaacttcattgagatccgcttcgtgtcctataaccaaagcagtcttttga

SEQ ID NO: 3954 - DNA, 1296 bp, B.fragilis; identical to SEQ ID NO: 845

SEQ ID NO: 3955 - DNA, 2241 bp, B.fragilis
ctgattaattttatggaactgaataagacctttaaagatggactttggagcaaagaaatcaatgtaagggatttcgttagtaacaacatcactccttataaaggggatgcttctttcctgcaaggacctaccgaacgcaccaaagctgtctggaatcactgtctcaaagctctcgaagaagagagaaacaataatggtattcgtgcactcgactacacaactgtatctactataacctctcaccctgccggctacatcgataaagagaacgaactgatcgtcggactacagaccgatcaggtgttaaaacgtgccatcaaaccgtttggcggaatcaatgtggttatgaaagcttgccgtgaaaacggagtggaagtagatgacagagtcaaggatatcttcactcactatcgcaagactcataatgatggggtattcgatgtgtataccgaagaaattcgttcgttccgttcattgggattccttaccggacttcccgacaactatgcacgcggacgtatcatcggtgattatcgccgcctggctctctatggtcttgaccgtctgatagaagctaaaaaagaagatctgcataatctgacaggtcctatgactgaagcccgcattcgtcttcgcgaagaagtagccgagcaaatcaaggccctgaaagagattaaagtattgggcgaatattatggtttggatctgagccgaccggcatataccgcacaggaagctgtacaatgggtgtatatggcttatctggctgccgtaaaagagcaggatggtgctgccatgtcactgggtaatgtatcttcattcctcgacatctatcttgaatatgaattaagccagggtacgataaccgaaacattcgctcaggaactgatcgaccaattcgttatcaaactccgtatggtacgccacttgcgtatgcagtcgtacaacgatatttttgcgggtgatcccacatgggtgaccgaatctatcggtggacgtttcaatgatggacgtaccaaagttactaaaacttctttccgcttcttgcagacactttataacttaggcccgtcaccggaacctaacatgactgtactatggagccctgagttacccgaaggtttcaaagcattctgtgcacaagtatctatcgacacttcttccgtacaatacgaaaacgacgacctaatgcgtgaagtccgtcaatcggatgactacggaatcgcttgttgtgtttcatatcaggaaatcggaaagcagattcagttcttcggcgcacgtgccaaccttgccaaagccctgctactggctatcaacggaggacgttgcgaaaatacaggtacagttatggtaaaagacatccctgtattgaccggtgaaacactgaagttcgaagaagtaatggccaactataagaaagtattgatacaaattgcacgtgtatacaacgaagcaatgaatatcatacattacatgcacgataagtattactacgaaaaggcgcagatggctttcgtggatactgatccccgcattaacctcgcttatggtgtagccggactttcaatcgccatcgattcactgtccgccatcaaatatgcacatgtgaaagcccgtcgcaacgacatcggactgacggagggattcgatatcgaaggtgctttcccttgtttcggtaatgacgatgaccgtgtagaccacctgggtgtagacctggtatatttctttagcgaagaattaaagaaactccccgtatataagaatgcccgtcctaccctctcgctgctgactatcacttcgaacgtaatgtatggcaagaagaccggtgccactcctgacggacgcgccaaaggcattgcctttgctcccggtgccaaccccatgcacggacgtgataaaaatggtgcaatcgcctcactgagttctgtagccaagttgcgttatcgcgactcacaggatggtatcagcaatacattctcgatcgttcccaaatcattgggagcaacacaagaggaccgtatcgacaatctggtgaccatgatggacggatattttacaaaaggcgcacaccacctgaacgtaaacgtgctgaaccgggaaatgttgcaggatgcgatggaacatcccgaaaagtatccgcaactgactatccgtgtctcaggatatgccgttaatttcgtgaaattgagccgcgaacatcagttggaagtaatcagccgcagtttccacgaaagaatgtaa

SEQ ID NO: 3956 - DNA, 3336 bp, B.fragilis
aaacattttctaattaaaaaaaagaacaagatgaagaaatcagtgaaacacaagtttcagtacttgctattttttctattgtcgatgcctgcttttatctttgcttcagcgcaagatatacgggtgaatatcgactttaccaaagcctctttgggcagtgtcctgaatgaaataggacgtcaaacctcattatctattgtgtataacaccggggatgttaaccccactcaacctgtttctatcaaggcttctaacgaaaatatcacgacggtcatgaaccgtctgcttcgtggaacgggactttcctattctattatgaacaaacatcttattctttcgaccactgataagaaccattcgattcaacaggagaaagttacggttacaggaaatatttcggatgccaaaggcgaaccactgatcggagtgagtattttggtgaaaggaacatcgaacgggacaattaccgatatgaacgggcacttctccttgccggttgcgaaaggagatgttattgagatctcctatatcggttatgctccgcaggccattacggtgacagactccaagcctttgaagattgttatgaaagaagacgcagaagtgcttgacgaagtggtagtgactgccttaggtatcaagcgggcgcaaaaggcgttgagttacaacgtacagcaagtaggtggtgatgctatcaatacagtgaaggatgccaattttatcaactctttgcaaggtaaagttgccggagtaacaatcaataactcagccggtggagttggttctgcttcgagagtcgtgatgcgcggtaccaagtccattacgaaagataataatgctctttatgtaattgacggtattccgatgttcaatgtaagctttggtaagagtgaaggttcttttgccacccaaagcggttcggacggagtagcggatcttaacccggatgatattgaaagtatcaatatgctgaccggtccttctgcggcagctttgtatggtaatgcggctgccaatggagtcgtattgatcaataccaagaaaggatctgccgaaaagacaactctgactgtcagcaataatacgatgttctctgacgcatatatgatgccggagatgcaaaaccggtatggaaacaatccgggagaatttgcaagctggggcaataaaaccaagcaaagctatgatccttcccgtttctttaataccggagtgaatgtaattaacgctatttctttttcgaccggaacaaagaaaaaccagacctatgcgtcggcttcaacaaccaatgcgacaggtattttgcctaataacagttatagccgctacaatttctctatccggaatacggccactttcctgaaagataggctgactctggatgtaggtgccagctatatcattcagaatgacaagaatataacggcacagggacaatacttcaacccgctgccggcactctacctctttccccgtaacgacaattttgaggagatccgtatgttcgaacgatatagcgaaagccgtggagtgaacgtacagttctggccttacggacatcagggattaagtttgcaaaatccatattggattatgaaacgcatgaaccgcaagacagaaaagaagcgctacatgattaatgcaagcttaacttataagctcacggattggctcaatgtagccggacgtgtcaaggtggataattccgatattcgcatgactcaggaacgttatgcatcgactctgactacctttgccggtgccaatggtttctattccgatcaaaatcgtacggaccgcaatacgtatgccgatatgatggtaaacattgataagagaataggggacttctcgctgaatgccaatatcggtgcgtctatcaaggatttggtttacgaacaaatggggaatgaaggtgatttggcagggatacctaacttctttacagtgagaaacatcaattatgaaagcaattataaacctaaacagttcggatatcatgaccaatctcagggtgtatttgccaatatagaattgggatggcggagcatggcatatctgaccctgaccggacgaaatgactgggagtcccaacttgcatttaccaagcattcttcattcttttatccttccatcggaggttctgtcgttttatccgagatgttccggttgcccgagtttatttcttatgcaaagttacgtggctcatacagttctgtggcttcatcttttgaacgttatttatcgaatccgggttttgagttcaatgaacaatcccatcagtggggatcttcaaccactctgcctgccaccaacttgaagccggaagatacccgttcgtgggagatcggtttgaatgccagactgtggaatcatttcagtatagatgccacttactatcattcgaatacctataaccagacctttaatatcactctggcatcgtcgagcggttattcttcggccattgtacaaacgggtaatattcagaactacggtttggagttggcgttaggatacaataatacatggggagactttagctggaacagtagtctgacttatacgatgaatcgtaataaagtgaaacgtcttgccagcggtgctacgaatccgataaccggtgaaattatcgatatgcccgaactgcgtatggctgtgctgggtgccgacggatatggccccagagttatattgagagagggcggaacaatgggagacctctatgtggataaagggttgcgtacagacggtaacggtaatatctgggtagattctcagacaggcaaagttggagtgcaggattatgccgaaccgaagaaaattggtacgatgaatcctgatttcaacatgggattcagcaatacattctcttataagggcatcaatctgggagtggttctgactgctcgtgtcggtggattgtgcgtctcgaacactcagggtatacttgattattatggtgtgtccaaagctacagccgacgctcgcgatgccggaggagtgtggatcaataacggatttgtagatgccaaatcttattatcagaccatcggtggttctaccggagggttgggacagtactatacttatagtgcaacgaacatacgattgtccgaactgaacctaagctacacgttacctcgtaaatggtttaataataaagtaggcataacggcaggtatcgtagggaagaatctttggatgatttattgtaaagcaccgttcgatcccgaaatgacaccttccactaccagtaacttctatcagggagtagattactttatgcaaccgagtacacgtaatattggcttcaatgtcaaatttcaattttaa

SEQ ID NO: 3957 - DNA, 207 bp, B.fragilis
atgaaatcttataggctgccttgtttcgtatgtccggtgcccgataaatggggagtggctttcgttttgatacctttttcttcttttagctgtcagaaagagaagaatatcccttggggagtaaccgggtcttttgcggttcaagtcaaacgggaggagcggaggtgccgaaacagggcgttttttcctcagaaagcaggcttttga

SEQ ID NO: 3958 - DNA, 231 bp, B.fragilis
gctttccattattatctcttaccaagtaatcaaaaagtaaatgcttatctgaaagagattactgatatttgtgatattcataagaacctgacttttcgcgtcgcccgacatatgatggcaacaactatttgtttggcgaacggtatgcttattgagagtttgtccaaggttcttggctggtctaatataaaaacactcaactttatgctaagattactgatgaaaagctaa

SEQ ID NO: 3959 - DNA, 240 bp, B.fragilis
agaatcattcttccccaattggataaattaagagagtctttgaatgaggtggctaagtctttacgggagattctccataaaatacaagtatctactgcctctaaagtatatagtgattgtctgctctctgtcaggttgggtgaactgagtgggacatcattttctaatgcaaaaaatatgataaattctctgccctctcttagaatcgtactttttacaatccctttctcaacaaaatag

SEQ ID NO: 3960 - DNA, 393 bp, B.fragilis
tataaaacctatttgatcatgaaacgaaaattattctttatgagctgtatagcttttccattgttctattccgcttgtaccttaaaagtagaaaagtgtcctgctattcaagaaaatgctattccgcattctaagacttcacgtgaagaacatgaggctaaatctattacgcttcacgaaaagctgcatgctacctttagtgtaagccgttctgacaagccatcatatccgaattactatggaggagcatttatcggagataatggtaggctcattgtgttggttaaagaggaccttagcctaaaaggcggacttgaaaaaacgcttaaagtcatcgttttttcaagttcaagcttgcgactattcctatcaagaactattggatttcaatga

SEQ ID NO: 3961 - DNA, 1185 bp, B.fragilis
gtaccgggctactgtttacggacaatgtcgagatgcccctcgagattcgaaaagattgtttatggttttgcaaataagaggagtcggcacatgatatttaatagagaagaacaacacctaatgttggaaggcagtgtgctttccaaggaggacgtgaaaaggctggtggcttgtcacacggaggaggcatcgggatttttgtacgaactttaccgatttctggaagagtggttcagtgattctccttatctgacagtgaaaacttccggttctactgggactcccaaactgctgaaggtccgtaaggagcagatgatgcaaagtgcccggctgacttgtgagtttctgggacttcgacaaggagatagcgtattgttgtgtatgcctttgcaatatattgccgggaagatggtggtggtccgggcattggtggcagggttgaatctggttatccggactccttccgggcatccgatggcggacgtggacataccgcttcgctttgccgctatggtgccgttgcaggtttacaacacactgcaggtatcggcagaaaaagagaggctctgccggaccgatattcttattataggcggaggggcaatagatgcagggttggaagctgagatacggcaattaccggttaaggtttattctacgtatggcatgacagaaaccctttcacatattgctttaagacagttgaacggaccggatgcgagtatgttgtaccggccttttccttcggtacggctttctctttcgtccgaacatacattggtgatcgatgctccattggtttgtgataccactttggtgacaaatgatgttgcggagatttatcccgatggcagcttctctattttgggcaggaaggataataccatcaataccggaggtatcaaagtacaggcagagcagatagaagagatacttcgtccctggatgagagttccttttgcaatcacttctgttcccgatgccagattaggagaggcggttgtgcttttggtagagaagggggcagatgcagagttaccggaaacaaagatgaaggagcttctgtctaaatatcagttacccaagatgattttgtcagtcggggctatacccttgacggaaacgggaaaaatcaatcgtgccgcttgccggcaacttgccctcacttatcggacagatcgctaa

SEQ ID NO: 3962 - DNA, 213 bp, B.fragilis
tgcttttctcttaaagcgctgcaaaggtacgaatcattttttaacttgcaaattattccgcaaaaaaatattagaaaagtatatttggaagtaataaccgccctctggcttctccccataaataggtatttttatgctattcaacataaaataggacccttttatatacctaaaccgaaaaaaggttgtaaatttgcgcgctctaaaggataa

SEQ ID NO: 3963 - DNA, 1065 bp, B.fragilis
actgtattatacgtaacagtgtatgatataggtattaaagatttggttaaaacaatggatgaaacaaaactactgaactatctgaaaggagaatcagatgccgaagagtgtctggaagtggaggcatggtatcatgcttctgcagaacacaaaaaacaactggaccaactttattatatgctttttgtcggtgaacgtaaggtggcaatggatggtgtggacaccgaaaattcgctaagcgttttgaaggaccggataaagcacaaagagtcagagaaaaaatcagtgcatagaatacgtgtatcaaaatggaaacgttacgcgatgcctttggcagctttcctgtgcggtctgttggtgtctgtcggtgccctatactggatttcctccggaaagtcggcaggatatatttttgctaccgaatcagggcagcgggcacaggcagttttaccggatggaacgaaagtatggttgaatgcttcaacacagatcgtctataagccttctttctggaagcgggaaagacaggtcgacttgagtggtgaggcttattttgaggtatcacgtaataagacaaaaccctttgttgttaatagtaatgatgtcaggacttgcgtgctcggtacaaaattcaatgtccgggcacgtccgtccgaagaaaaggtggtgaccactttattgaagggatcagtaaaagtccaattgccggggcagtctgaagaggaaggtattttgttgaagccgggacagatgctgagtgtggatacccgtacgatgcaacccatgcttacagaagccaaccgtccgggagatgtattgctatggattaacggaaaactgaaattcgaacaggccacacttcaggaaatagtgcagtgtcttgaaaaacattttgatgttcatttcattatttcggatgcacaactgcaaaaggaccgttttacctgtacttttagtacggacgatgatataagacaaattctttctatactcgctcttaccaaacgtttcgattataaatgtgaggataacaatataatattgactcctaagacgaatagataa

SEQ ID NO: 3964 - DNA, 2502 bp, B.fragilis
ttcatgatatatccccagaattttgagcagaaaataggattcgaccaaatcagacaattattaaaagacaaatgtctcagcacattaggagaagagagagtgaatgaaatgaatttttccgatcactttgaagaagttgatgaactgctgaatcaggttgcagagtttgttcgcatcatacaagaggaagataactttcccgaccaattttttttcgatgtccgtccctctttgaaacgaatccgaatagaaggaatgtacatggacgaacaagaattgtttgatctacgacgttcgttggagaccatccgggacatcatccgtttcctgcagcgcaatgatgaagaagaatcggattgtccctaccccagcctgaaaaaactggccggtgacataactgtctttccacaacttatcaccaagattgatggcattttaaataaatatggcaaaatcaaggataatgcttcgaccgaactgtcacgcatccgacgggaactggctaacacgatgggaagtatctcacgttcgcttaacagcatactccgaaacgcacaatccgaaggctatgtggacaaagacgtggcaccaaccatgcgcgacggtcgattggttattccggtggctccgggattaaaacgtaaaatcaaaggaatcgtccacgatgaatcggccagcggaaaaactgtatttatcgaaccagcggaagtagtggaagccaacaaccgtatccgtgaactggaaggggatgaacgccgggagatcatccgtatcctgactgagttctctaacaccctgcgtccttctatcccggaaatactgcaatcgtatgaatttcttgccgagatagacttcattcgtgccaaaagtcacttcgccatccaaacaaacagtatcaaacccagcctggagaacgagcaattattggactggacaatggccgtacacccactattacaactttcgcttgccaaacatggaaagaaagtagtgccattggacatagaactgaacctcaaacggcgtatccttattatatccggtcccaacgccggaggtaaatccgtatgtctgaaaacagtcgggttactacaatatatgctgcaatgcggcatgctcgtacccatgcatgaacgaagtcatgtaggcctgtttggcagtatcttcatcgacatcggtgatgaacaatccattgaagacgatttgagtacctattcttcacacttgaccaatatgaaaatcatgatgaagaactgcaacgaacgaagtctgattttaattgacgaattcggtggaggtacagaaccccagatcggcggagctattgccgaagctgtactgaaacgattcaacataaagggtactttcggtgttataactacacactaccagaatctaaaacattttgcagaggatcacgaaggtgtagtaaacggtgccatgctatatgaccgtcatctgatgcaggcacttttccaacttcagatcggtaatccgggcagttcattcgctgtagaaatcgctcgtaaaatcggattaccggaggatgtgatcgcagatgcttctgagattgtgggaagtgaatatatcaatgccgacaagtatttgcaggatatcgtacgtgacaaacgttattgggaaggaaagcgtcagactatccgccagcgcgaaaagcatatggaagaaaccattgcccgctatcaggctgagatggaagaattacaaaagtcgagaaaagagatcatccgtcaggcaaaagaggaggcggagcggttgttgcaagaatcaaatgcacgtatcgagaataccatccgtaccataaaagaggcacaggctgaaaaagaaaaaacacgtctggtacgccaggaactggcggacttccgtgaatcgatagacaacctgacttccaaggaacaggaagataagatagcccgaaagatggagaaactgaaagagaagcaaaaccgcaagaaggagaaaaagcaaaacggtaccaaagaacagccggcagttcaacaaactcccaaagcgactcccatcaccgaagggtgtccggtacgtatcaaaggacaaagttcggtcggagaagtacttgaaatcaacgggaagaatgccgtggtagccttcggcagcatcaaaacaactgtaaagacggagcggctggaacgcagcaacgcagtcccccaaaaacaagagtctgccaaaagttcttttgtcagcaaccagactcaggacagcatgtacgaaaaaaagctgaacttcaagcaagatatcgatgtacggggaatgcgaggagacgaagctctacaagctgtaacctactttgtagacgacgccatcctggtcggtatgagccgggtacgcatcctacatgggaccggtacgggtatcctgcgtacccttatccgccaatatttgcaaaccataccgggagtccgccattttgccgacgaacatatccaattgggaggtgcaggtatcacggtagtcgatttggcataa

SEQ ID NO: 3965 - DNA, 1539 bp, B.fragilis
tcatgcccgtattttacaagcttttctggaggaacgtttgaaaaagtgatttctaggagaaacctatgccaacacgaatcttttttgtacttttgcgccatctttttaaaaacaacatcaaaaaagaatcatatgggaggttttttcggaacagtctcgaaaacgagctgtgtgaccgatttattctacggcacagactataactcacacctgggaacaaaacggggaggacttgcgacatatagtgaagaacagggatttatccgctcgattcataacctgcagagttcatatttccgtaccaaatttgaggaagaactggataaatttaaaggaaatgccggtatcggtattatcagtgatacagacgcccaacctattattattaactcacatctcggtagatttgccattgttacggttgctaaggtcacaaaccttaaagaactcgaagaggaactactttcacaaaacatgcatttcgccgaacttagttcgggtagtaccaatcaaacggaacttatcgctttattgattattcagggtaaaaattttgtagaaggaatagagaatgtatataaccatataaaaggttcgtgttctatgcttctgttgacagaagatggagtgattgccgcacgagataaatggggacgtactcctattgttatcgggaaaaaggagggcgcttatgcagccacgagtgaatctaacagttttccgaatcttgattttgaaatagaacgctatttaggacccggtgaaatagtccgtatgcatgctgaccgtcttgaacaacttcgcaagcctgatgacaaaatgcaaatctgttcatttttgtgggtgtattacggttttcccaattcatgttatgaaggccggaatgtagaagaggtacgctttacgagcgggttgaaaatgggtgaacaagatgactgcgatgctgattgtgtttgtggaattccggattcgggtatcgggcaggcattgggttatgcagaagggaaaggcattccttatcatcgtgctattaccaagtatactcctacctggccccgtagttttactccgagcaagcaggaattacgttctttggtggcaaagatgaagttgatccctaaccgtgctatgctccaagataagcgtattattttttgtgatgactccattgtgcgtggtacgcagttgcatgataatgtgaagattctttttgattatggtgcaaaagaggtacatatgcgtatcggatgcccaccgcttatttatggctgtccgtttattggttttacagcttcaaagtcggatatggaacttatcaccaggcagataataaaagaactggagggagatgaaaataagaatttggataaatatgctactacaggttcgccggaatatgagaagatggtaggcatcatcgccaagcgtttcggactttcgtctctcaaattcaacacgattgaaacactgattgaagccatcggattgccaaagtgtaaagtttgtacccattgttttgacggatccagttgtttctaa

SEQ ID NO: 3966 - DNA, 1581 bp, B.fragilis
atcattcatctcaaatcaatcttcgatataatgttagactcagctataaaagaacaattacgtaccatcttcgccgcattggaggcgaactatacattcgacatcaccgtctcaccgcaacacgaaagccgcaccgaacttctggaactcctgaacgatgtggcatcctgctccgagaaactctcttgccggatcaatgaaggcaaaggactggaatttacacttctcaaaggagaacacaggacaggtatcaccttccgggccgttcccaatgggcatgaattcagttccctactgcttgccatcctgaatacggacggaaaaggaaagaactttccggacgaaggcatctgcaaccgggtaaaatcattgaaaggacctgtccgcctgacaacttacgtgtcactgacctgtaccaactgccccgacgtggtgcaagcactcaacgccatgaccacgctgaacggacagattcagcaccagactgtggacggagccatcaaccaggcggaagtagaggcactgaaaatacagggggttccttctgtcttcgcagacggtaaactgatccacgtggggcgtggtgactttggcgaactgttggccaaactggaagaacaatatggaacggagacgaacagtgcggaaacttccatcaaaaaatatgatgtgattgtagccggcggaggtccggccggttcggccgctgccatctattcggcccgtaaaggcttgaatgtagcggtcattgccgaacggatcggcggacaagtaaaagaaacagtaggcatagagaacctgatctccgtaccttcgacaaccggaagccagttggccgataatctgaaaacccacatgtcacaatatcccatcgatttgctcgaacatcgccagatcgaaaagatagagcttgatggaaaggataaggttctgacagccaaaggaggagaacgtttctcagctccggcggtaatcgttgccaccggtgcaagctggcgcaaactgaacgtaccgggcgaagcggaatatatcggccgtggggtggctttctgtccacactgcgacggacctttctacaaagggaaacaggtggctgtcgtgggaggaggaaattccggaatcgaagcagccatcgacctggcaggtatctgctccaaagttacggtgctcgagtttatggacgagctgaaagcggatcaggttttacaggaaaaactgaaaagcctgccgaatgtagaagttcttgttcattcgcagacaaccgaagtagtaggcaatggagataaggtgaccggcatccgtgtcaaagaccgcaaaacagaagaagaacgggtgatcagcctggatggcatctttgtacagatcggtttggtagccaatagtggtattttccgcgatgtggttgaggtaaatcgtccgggcgagatcgtgatcgatgcacattgccgtaccaacgtgccgggaatttatgctgccggagacgtttccaccgtcccctacaaacagattatcatcgcaatgggagaaggcgccaaagccgcattagccgcattcgaggatcggatgcgaggagaaatttaa

SEQ ID NO: 3967 - DNA, 849 bp, B.fragilis
atattaaatctcgaaacaactatattattaactataaaaactcacaaaatgaaaaaaagaattgtttttattgcggcacttttatgcggaatgtgcttcacgacagcatccgcacagttcaaaatcggtggaaagaaaatcaatgtaggcaaagtggtacaagccggtagcgacgcagcgaaagccatcaccttgtccgactcggacatcgcagccatgagcaaagaatacatgcaatggatggacacccacaatccgctgaccgcagccgacagcgaatacggcaaacgcctggagaaactgaccggacatatcaaagaagtagacggactgaaagtgaatttcggagtatatgaggttgtcgacgtgaatgcttttgcctgtggtgacggcagtgtccgcatctgtgccggattgatggatattatgacggacgatgaagtgatggcagttgtcggacatgagatcggtcacgtgattcatacagactctaaagatgccatgaagagtgcatatcttcgttcggcagtaaagaatgctgcaggagcagccagctctaccgtttccaaactgactgattcggaactgggagctatggcagaagcattagccggtgcccaatattctcagaagcaagagagcgaagccgatgattatggtttcgaattcagcatcaaacataacattgatccgtatgcaatgtacaatgctctgaacaaactactggaactctcagccgaggcccccaaagagtctaaattccagaaaatgttctcttcacaccccgatacagccaaacgtgtagcacgcgccaaagaaaaagcagacaactatactaagaacaagtaa

SEQ ID NO: 3968 - DNA, 2625 bp, B.fragilis
gacaggactcacaacggaaaaaccaatctcccatctaacccaagatacgaaatgaaaacacctaaaatattaaaggtacatttgctattatacctgttttgcctgagtgtatctgcacaaaccacggacagtattgtccaaaaactaagccaatacgcctacctgatcgataatttttcgaaatatatccctcaagagaaggtttacatgcaatttgacaataccagttattaccaaggtgataatatctggtttaaatgtttcctggtcacttccgacctgcatccggccactgacctgagcaagactttatatgtcgaattattaaatcccggtggtgaagttatcgacaaacggacattaaaaatagaaaacggacaatgccacggagatttcacactaggccaactcccgttttattcaggattttatgaaattcgtgcctacacaaaatatatgctgaattttggaggagatatcattttctcaagactgttgccggttttcgacaaacctaaggcagaaggcgactttacggaaaaagagatgcggaaatatgcgacaggaaactacccgctggagcgtcccaaaccgacaaaaagtaaaaaagtaaatttaaagttcttccccgaaggtggaaatctggttcgggggatagaatccgaagtggcttttgaagcgacagatacctatggaaaccccattaccctcaccggtattgttattaacgaagaaaaacaagaaacagcccgtttcaatgtcacacatgatggacggggaattttcaattacacgcccacgggagagaaacaaaaagcaatagtcgaatttaatggcaaaaagcaccagttcaatatgccggaagccttaccggaaggatatacattacatgccgacaatttatcatacacagacagcattgaaatagcagtgcaaaagaattccaataccccctccgacgtattgggactggcagtcatcagcggaggcaaactatacaaattctgcctgatcgatgtcgaaggtaatgaaacgattcgcttcaaaatagataaaagtaaattagtacccggagtttcccgaatcgcgttattcaacagtaacggagaggtcctatcggatcgtttgatatttacctatcccaaagagcaattatccgttcaggtacaggcagacaaagagacatacgacccttacgaattggtaaaccttgaattcaccctgaccggaaaagaaaagattccggtacaaaccccatttgccctatctgtgagagacggcatgaatgaagtagaatcagggcacaatatgttgaccgatcttttattaatgtccgaaataaaaggatatgtcaacaatccccaatattatttcgaatcccgggacgatacacgccgcaaggcaatcgatctcttattaagagtgcagggatggcgccgctactcttggaaacaaatgacaggaattgagtctcttgaccttaaatacggaccggagcaaggtatcgaaacgcgagggcaggttgtctctttcgtccggcaacttcccaagcctaacgtagaagtgtcctgcttcctgaagaaacgcggggagaatgaggaaaacagcagtttcatcgaagccatcactacagatagtttaggacacttctcactaatatccgatatatacggaaaatgggacttgatattggcagttacagtcaatagaaaaaagaaagattaccgtattttattggataggctattcagtcctgctccccgaaaatatcattatgcggatatgcaggtaagcattgccaatgcagaaaaagagaaagaacttatgcccgaagtggaaaccactcccctacctgaagaggatatcgaagccttctttgccgcttacgcagattcgctggcaaaggcagataaccatgaaaagaactaccgtttaaaagaggtaaccatcaaggccaaaaagagaaccaaagaaaaagagatatatgaaagccgttcgaaatcgattgcttattatgatgtacattccgaactggacgacataaaagacagtggaaaatttattggtgacgacatacacgaacttatgatgaacatgaataaaaatttcagtcctgtttcaggacgaaattacctgtattataaaagtaaaatgccgcttttcgtaatcaactatgaacgcacccggcatacagaaatggattataataagtacaaatatataagactcgaagccattaaatcgatttatatcactgaaaatctatctacgatctgccagtatgcagatccgcgattgactccgttcgatgtatccgacttatacagttgtgccgtactgatcgaaacatatccggaaggcaagataccgacagaagcagggaaaggtgtccgaaaaacatggctcgacggttacagccaagttaaagaattctatcaccccaattattctgtgctccctcctgtccccgactatcgtcgtacattatactggaatccgtctgtcactccgaataaggagggaaaagcacatatccggttctataataacagtagatgccggaaactgaaaataagtgcagaaactatcacaacgaatggattaatcggtacctacgggaattga

SEQ ID NO: 3969 - DNA, 288 bp, B.fragilis
ttagcctgtcatcgcagccaagaacataacaataatcaaataacgtttgcaggctgtacagacgggcaaaaagactatacactaattttgtattatgaaatcaatagaattgtttgttgcatgttgtttgtcataagttgtttaggtaagtctcaaccaaagcaacaatctgccgatttatataggttgcccttatgtaatgaatgtgtgaaaaatgaaatttattgtgctttgacactaatgggatctgttgaagttgatgatttaaatgaaaatacaaataaatag

SEQ ID NO: 3970 - DNA, 195 bp, B.fragilis
tcaatttgtctctatactcaaacatattatttcctttctaatattattcttggttatgtctatgaaatatttttatttcagaataatctctatttctgcctatataggctattatatttgcattatattctgatttctactttttttgatttcttggaattaatatttatttgtatttttgatctatatatataa

SEQ ID NO: 3971 - DNA, 969 bp, B.fragilis
acctatcgtcttatggatatacagacagcgaaacaaatcaaaatagcggattatctgcacagtttaggattttcacccgtcaaacaacagggcataaacctgtggtataagtcaccactaagggaagaaacggaagcatcgttcaaggtaaatacagaacgtaaccaatggtatgattttgcactcggcaaaggtgggaatatcatcgcactggcacaggaactttattgttccgaccatgtgccttacctcttgcaaaaaatcgaagaacagacaccccgtattcgccccgtgtctttttcttttggcaagcaatcatcttccgagccaagttttcaacaactggagattgtaccgctttcttctcctgccctgcttgcttatttgcaggaaaggggaataaacattgcaatggcgaaaagagaatgcagtgaagcgcacttcacccataatggcaaacggtatttcgccatcgcctttcccaatgtgtcgggtgggtatgaaatccgcaaccagtatttcaagggatgcatcgcaccgaaagagatttctcatatcaaacagccgggaacagcgagggaaacatgttatgtgtttgagggatttatggactatctttcatttcttactttgagattggagaattgcccgaaatatcccgaactggacaggcaagattatatggtgttgaactcagtagccaatgtttccaaagcaatctatccgttgggaagctatgagcgcatccactgtttctttgacaatgaccgtgcaggaatggaagccatgcagcaaatctataaggaatacggcagggacttatacatccgtgacgcttcgcagacatacagcggatgcaaggacttgaacgaatacttacagaaacagactgaaagaaacaggcaagttcaatctgcaaaaggggtgcgcagccaaccaccgaaaaagaaaaacggctttcggttatag

SEQ ID NO: 3972 - DNA, 321 bp, B.fragilis
caaaaactacataactatcagaatatcagacaaataaaagaaaacaaaacgataggttcgggagattttcaatatataaaaaacgcctgtaagttactcacttacaggcgtttacatcacctagcggagagacagggattcgaaccccgggtacctcgcagtacaacggttttcaagaccgccgcaatcgaccactctgccacctctccagaactacggttaagtagtgcttttctcttaaagcgctgcaaaggtacgaatcattttttaacttgcaaattattccgcaaaaaaatattagaaaagtatatttggaagtaa

SEQ ID NO: 3973 - DNA, 561 bp, B.fragilis
gagaaaagacagaagatgaaaatagcgcaacaactcaaggagaagaacattgccgaataccttatttatatgtggcagatagaggatttgatccgtgccaatgattgtgatgtcgaccggattgaggagaatatcgtttcccgttatcaagtgagcgatgaagagcgtcgtgaactgacagaatggtatgccaatctggcttcgatgatgcgggaagagggagttcgtgagaaaggacatctccagattaaccggaacgtaatcatcaacctgaccgaattgcacgctgccctgttggcatcacctaaatttcctttctatagttcggcttatttcaaagcattaccctttattgtagaattacgaaataaaaacggtcagaaggaagaaccggagctggaaacctgtttcgaagctttgtatggcatgatgctgttgcgcttgcaaaagaagccggtcagtccggagactacgaaggcaatggaagctatcagtagctttttgtctatgttggccaactattatgataaggatagaaaaggagagttaaaactggaataa

SEQ ID NO: 3974 - DNA, 219 bp, B.fragilis
gttagtatgcagttcaaagaacaaaagctgttcttcaacacacatacaaattcagtaaaccttctgacaaaagaaaaatatgaaaatcttctgatattccgcatctccgcaaacagaacattacggttaccgataagattcgtcattgtcggtagtttccgttatcaccagaattacactacctttattaagaaagcaacgacaaaatccattttctaa

SEQ ID NO: 3975 - DNA, 252 bp, B.fragilis; identical to SEQ ID NO: 860

SEQ ID NO: 3976 - DNA, 198 bp, B.fragilis
aaatcaaggcaatatactgattttcgtaaaataaaagacaaggttaattatccggtgtaccggggaaaatgcaaattgcaaatgcttgatatacagctagatatagcggaggataggttccctgtctctccgctgaaaacaaaaaaacaaagttataagtccttgaatttcaataattcaaggactttctttttttag

SEQ ID NO: 3977 - DNA, 933 bp, B.fragilis
agaaaatttaaaaaaatggatatagcagcattattatcgggaggagtggacagttcggttgttgtacatctgctttgtgagcagggctacaagcctacactgttttacatcaaaataggtatggatggggcggaatacatggactgttctgccgaagaggatatagaactgtctactgccatagcccgacgctacggtttggcactggaggttgtcgatttacatcgggaatactgggataatgtggctgcttatgccatagaaaagatacggaaggggcagactccgaatccggatgtgatgtgtaacaagctgattaagtttggctgtttcgagcagcaggtcggaaaagatttcgatcttacggcaaccggacattatgctacgaccttgcaactaggcgggaaaacctggctgggtacagccaaggacccgataaaagatcagactgatttcctggcccagattgactatttgcaggtttcgaaattgttgtttccgataggtgggctgatgaagcatgaagtgcgtgagatagcgttgcaggccggattgcccagtgcctgtcggaaggatagtcagggaatttgctttttgggcaagataaattataacgattttgtccgtcgctttctgggagaaaaagagggggcggtgatcgaatttgaaacaggtaagaagattggtactcatcgcggctattggtttcataccattggccagcgaaaaggattgggattgggaggaggaccctggttcgttgtgaagaaggatattcaggataacattatttacgtctcccacggttatgatgccgagcagcagtatggttatgaattcaggatgaaagactccaattttattacagataacccgcgggaaggctcgacagtcgaggaggacgcactcattgaatatccgctatacacctga

SEQ ID NO: 3978 - DNA, 1077 bp, B.fragilis
agtcttcataatgatattgttttttttgagttaatactatatttcttctttttatctggaacaaagatacggcacaaaatgattcgtgtcaaactgaaaatttctatctttgcattgatagattctatatctttaataaatcagagaacgatgactatacaacaattggaatatattctggctgtggaccagttccggcattttgctaaagctgccgagtattgccgggtgacgcaacctactttgagtgcaatgatccaaaagctggaagacgaattgggggtgaaactgttcgaccgtagcatgacaccggtttgccctactgccattggtaagaaagtgctggaacaggcccgtaagattctttcggaagttatctgtgtcaaggagatcatcagcgaagaacagcactccctgtcgggtacattccgattggcagtgttaccgacgattgcaccttatcttctgccccgtttctttccgcaactgatggagaaatacccggatcttgatatacgggtgatggagatgaagacgcccgacattcgcaaggctctgctgaccggtgaagcggatgctgctatcattgccagcatgctggatgatgccgcattaacggaagagaccttattctacgagcaattcttgggctatgtctcaaagaaggaaccgttgttcaagcacgatgtgattcgtacgtccgatgtgacaggggaacggctttggcttcttgacgaagggcattgcttccgcgatcagttggttcgtttttgtcagatggaagcggttaagatcagccaaatggcgtatcggctgggtagtatggaaacctttatgcatatggtggagagtggtaaggggattacgtttattcccgaactggcagtgatgcaattgagcgaagagcagaaagaactggtccgtccgtttgctatcccgcggcctacccgtcagattgtcctggtgacccggaaagacttcatccgcaccagtctgctgcaggttttgaaagaggagattcaggcggcggttcccaaggagatgcttaccctgcaggccgttcagtgtctggtataa

SEQ ID NO: 3979 - DNA, 927 bp, B.fragilis
ctgatgaataaaaagccgataagccctgtatgttgggtgcctactgtttactttgctatgggattgccgtttgtggccctttcgatggtttctgtccttatgttttccgatatggaagtgtcgaatgcacagattgctttctggacttctctcattatgcttccctggacattgaagcctttatggagtccgtttctggaaatgtttaaaacgaaaaagtactttgttgtcgctacggaaattattaccggactggcatttgcattggtagcactttcgctgccgctgcccgacttttttcgttatgccatcgctctgatggggatcattgctctcagtggtgcgactcatgacattgcgggggacggagtatacctgactgaactgactgctacccagcaagccaagtatatcggttggcagggagctttttataatctggccaagatacttgccaacggaggcttggtttggctggcaggtatgctgaaggatgaatttggagtggtacatgcctggatgattgtcatgttgatgtgtgcgggtattatgattctgatcggtctttaccacatccggattttgccttcgggaggaggagcttccggtgaagtgaatacgatgagtgacgcattgaatatgctttgggaagtcatccgctcttttttccaaaaaaaacatattgctttctaccatgcctttatcatttggtacccggtggcccaaggaatttgccatcaagatggtaccgttgttcctgaaaacgtcggttgccggatggggattgggactcagcactcaggatatcggactggtatatggtacgttcggagcgggagcttttattctcggttcgcttttggccggttattacatttcggctttcggacttcggaagactttgttttctttatgttgcgcttttaa

SEQ ID NO: 3980 - DNA, 498 bp, B.fragilis
ttatttgataacttaaaaaaggaaagaacaatgaaaagaataagttttttattagcagccctattaatgatgggaggaatggtgatggcacaaggtccgcgcagaggcggtcaggatatggacccgaaaacacgtgccgaacgcatgaccgagcgtatggcgaaagaatactctttgaatgaaactcagaagaaagagttgcttgaggtcaatatggctttcgtacaaaagatgggagagcgtcccggaagaatgaagccggaaatgagacaaggtaagaaggggcagagtcaggctaccgacagctgcacttgtaaacaggataggagaaaagctcctcgcatgtccaaagaggacagagaaaagatgcgtcaggagatgaaagcttcgcgtgagtcctacgaggctggtctgaagaaaattatgacgaaagaccagtatgctgcttataccaagaagcaggccgagcgggagcagagaagaggaggtggaagataa

SEQ ID NO: 3981 - DNA, 1599 bp, B.fragilis
ttcttcatcctcaattctcgaaatatggcagataatacagaaatactaagacggcgcactttcgccattattgcacacccggatgccggtaaaacttcgttgactgagaagttactgttgttcggcggacagattcaggtggcaggagcagtaaaaagtaacaagatcaaaaagacggcaacttccgactggatggagatcgagaaacaacgtggtatctcggtgacaacttcggtgatggagtttgactatcgggactataagattaatattctggatactccggggcaccaggactttgccgaagatacctatcgtaccttgacggcggtagacagtgtcatcatcgtggtagatggagcgaagggtgtggaaacccagacccgcaagctaatggaagtctgccggatgcggaatacgccggtaatcatctttgtgaacaaaatggaccgtgaaggtaaagatccgtttgacttgctggatgaattggaagaagaactgatgattcaggtacgtcctctgtcttggcctatcgaacaaggcccccgtttcaagggagtttataatatctacgaacagaaactggacctatatcaaccttccaaacaagtggtgacggagaaagtggaaatagatattcattctgacgagttggatcggcagatcggcgatacgctggcagataagttacgcggtgatttggaattgatagaaggtgtatatcccgaatttgatgtagaaacatatctgcagggagagtgtgcaccagtctttttcggttcggctttaaataattttggtgtgcaggaactgctcaactgttttgttgagattgcccccgccccccgtcccgtacatgcagaagaacgtgaggtgatccccgaggagcctaaatttaccggttttattttcaagattacggctaacatcgaccccaatcaccgttcgtgcgtggccttctgcaaaatctgttcaggtaagtttgtacgaaacgccccttatctgcatgtacgtcatggtaagactatgcgtttctcctcacccacccagtttatggcacaacgtaagacgactattgacgaggcttgggccggagatattatcggtttgccggataacggaacatttaagattggcgatacgcttaccgaaggagaacaacttcatttccgtggtttgccgagcttctcaccggagatgttcaagtacatagagaatgccgatccgatgaagcagaaacagcttgccaagggcatcgaccagttgatggacgaaggtgtggcccagttgtttgtcaatcagttcaacggtcgcaagattatcggtacggtaggtcagttgcagtttgaggttattcaatatcgtttgctgaacgaatacaatgcttcttgccgttgggagccgttgagtttgtacaaagcatgctggattgaaagcgatgacctggaagagttggaagcattcaagaaacgtaaatatcagtatatggccaaggatcgtgaaggacgcgatgttttcctggccgattcgaactatgtgcttcagatggcacagatggatttcaaaaatatccggttccactttacaagcgaattctga

SEQ ID NO: 3982 - DNA, 774 bp, B.fragilis
gataaaaccaacaagaaacttatgaagaaatttaatttaataacttttgccgtcatcctgatgttattgcccattttacagtcatgtctggacgatgccaacaacgacgagtgggtcacttgtcctccgggtggaatattggccatcggcacaatgaagattcccaatgcggacactccaagggactttttcattgcattggacaatggagacaatgtacttccggcagatacggccgatatacgcaacaggaaatacactgttgcagaaggtcaaagagtcttcgttggctatctgcagatgggagaagagaaacccggatatgagaacggtaaaatattcacgatagaagatatattgacgaaagagatcatcccactgacggaagctacagcagacagcattggagacgaccgtatcaacgtcacagcgcatgcacttacgaaagattatctgaccatcgaatatcaatatctgggcagcatgaatgaaaataaaaaacacatgctgaacttggtacaaaacgaaataacaggtcccataaaagatgacggatatatctatctggagttccggcataatgcctttaatgactcccccaatcaattgggttcgagccttgtttctttcaagctggatagtatagccgagcaattggcgacagccaaaggaataaaactccgtgtgaacaccatttatgacaatatacagtatgtcacaatagatatcaacgaagacaaaaacttaaaaataaaatcatttcattctcaataa

SEQ ID NO: 3983 - DNA, 1254 bp, B.fragilis
gattttagcaaattattaaattttaaagatatgaatttagtagaacgttttttgaagtacgtaagctttgatacacagtcggatgaactgacaagacttacccccagcactccgggccaaatggtatttgcggaatatctaaagtctgagttggagtcgttggggttagaagatataacattggacgagaacggttatctttttgctactttacctgccaatacagagaaagaattgcctgtcatcggctttatagcacatatggatacgagtcccgatatgagtggaaaaaatgtcactccacgtattgtagaaaaatacgatggttcggatattgtgctttgtgtcgaagagaatatcgtactttcaccgagtcagtttcctgagttgctcgatcataagggtgaggatctgattgttaccaatggtaaaactctgttaggggcagatgataaggcaggtattgccgaaatagtatcagctgttgtctatctgcaggagcatcctgaaattaagcatggtaaaattcggatcggtttcaatccggatgaagaaataggtgagggtgctcataagtttgatgttcagaagttcggttgtgagtgggcttatacgatggacggaggagaagttggagagttggaatttgaaaatttcaatgctgccgctgccaagatcacttttaaaggacgtaatgtgcatccgggatatgctaaacataaaatgatcaattcgatccgtatagccaatcagtttattactatgcttccccggcacgagactccggaacatacttccggatatgagggtttctaccacttaatcggtatccaaggagatgtggaacagagcactgtatcctacattattcgtgaccatgaccgtaataaatttgaggatcgtaaaaaagagatagaacatttggtgaataagatcaatgcagagtttggtgaaggcactgctacgctcgaattgcgtgaccagtactataacatgcgtgaaaagatagaacccgtaatgcatattatcgacactgcttttgctgcaatggaagccgtaggggtgaaaccgaatgtgaaacctattcgtggaggaacggatggcgcacaattatcattcaaggggttaccttgtcccaacatctttgccggtggcttgaattttcacggtcgctatgaatttgttcccatccagaatatggaaaaggcaatgaaggtcattgtgaagatcgctgaactggtagcttcgaagtaa

SEQ ID NO: 3984 - DNA, 1020 bp, B.fragilis
ataaagttaaattatagtgttgcggaattaaggataatgtttaaaaatcgtagtatgaaaaaaagtagaagaaaacgccttgtaattttgtgtatagctttagtttgtatcatagttttagtttttttattgttctctaaatcaacttctaataatagtacaaatccacctttgacagatgttttgactgatagcatttctcggatagtatcagcttgtcctggtgaaattggagtggcaattattattaataacacagatacagttaaagttaatgataagagtgtatatcctatgatgagtgtatttaaggttcatcaggcattagctctttgcaatgattttgataacaaagggatttcacttgataccttagtaaagatagataggaatagacttgattcaaagacttggagtcctatgatgaaagattattccgagttggttatatcattaaccgtgagagatttacttcgttatactattgctcaaagtgataataatgcaagcaatctgatgtttaaagatatggtcaatgttgctcaaactgacagttttatagccacacttattcctcgttcaagttttcagatagcttatacagaagaggaaatgtcggctgaccacgatagggcttactttaattatacatctcctcttggtgccgcaatgttgatgaaccgtttgtttaccgaaagtattgtcagtggtgagaagcaaagtttcattaagaatacattaaaagaatgtgtgacaggtacagatagaatagtcgctccgcttcttgataaagaaagggtttctattgcacataagacgggttctggttatgtcaatgaaaatggtattcttgcagctcacaatgatgttgcctatatatgcctgcctaataatgtctgctatactttagcgatatttgttaaggatttcaagggtaatgaatcacaagcatcacaatatgttgcgcatatatcagaggtcgtatattctttattaatacaaaattcggcaattccttaa

SEQ ID NO: 3985 - DNA, 561 bp, B.fragilis
aaaatacaaaaagaacccttctctttatttattcccaaatctttcccgtttctatctcgttatttgcagtgtgaaatagttccgaaacttattattgacactaaaaaaataacgattatgaagaagattttgtctattcttgtattggccattgcagccgtccaatttgcatttgcaggtgatatcatcacgaaagatgcgatgaaattgcctcttccggcacgtaattttattaatcggcacttttccaatccgcagatttcgcatattaagatagaaaatgagattctgcaaacaaagaagtacgatgtgttgttgactaatgcaaccgagatcgactttgataaccggggcaactggattgaagtggattgtaaaaaagcggctgttcctgcaacaattgttcctgacttcgtgaaggaatatatgaaagccaatgggtatcactctgagtttgtgactcagatagagcgcgaccgcaaggggtatgaagtcgagttgaatacggatttgagcctgaagtttaccaaagacggtaagtttcgtaaagcggagcattga

SEQ ID NO: 3986 - DNA, 495 bp, B.fragilis
ctcaaaaaaaacaatatcattatgaagactttaaattatacacatttggaagaaaaaggagctaacaccatcgtactgtcattacagcaactgcttgccgattttcagattcattatgcaaacctgagaggatttcactggaacatcaaaggacacggtttcttcgtactgcacagcaagtttgaagatttatataacggagccgccgaaaaggtggacgaaatagccgaacgtatactgatgctgggaggaactcccgccaataaatacagtgactatctgaagatggcgcagatcaaggaagtggacggagtgaataaggccgacgacgctctgaatcatattctcgaaacttacgggcatctgattgcggaagaacgtaaaatcctgtctctcgcctcttcacacaacgacgaagtaacagtggccatgatgagcgactacctgaaagaacaggaaaagatggtttggatgctgactgcatacaacggataa

SEQ ID NO: 3987 - DNA, 2310 bp, B.fragilis
ttaacagaaaacactaattttgcattcgatttaaattctattcgaatgtcacaacttccaacattaatagccgacctcgccctgattctgatttgtgccggtataatgactctgttattcaagaagttgaagcaaccgcttgtgctgggctatgtggttgccggatttcttgccagtccacatatgccctatacaccttcggtgatggatgtagccaatattaaaacctgggctgatattggagtcatcttcttgctttttgctcttggattggaatttagttttaagaagatagtcaaggtgggaggtacggctgttattgccgcctgtaccattatcttctgtatgattcttcttgggattgccgtcgggatggggttcggctggcaacgtatggatagcctgttcttgggaggtatgatcgccatgtcttctactacaattatttataaggcatttgatgacttaggattgcggaagaaacagtttaccggtttagtactcagtattcttattcttgaagatatacttgccattgttttaatggtcatgctttcgacgatggcagtcagcaataactttgaagggacagaaatgctgggcagtatcggtaagttactttttttccttattctttggtttgtcgttggcatttatgccatacccgagttcctgaagcgctgtcggaaactgatgagtgaagaaacgctgttaatcgtatctttggctctttgtttcggtatggtggctattgctgccaataccggtttctcggctgcttttggtgctttcattatggggtctatcctggccgagacaattgaggcggaatctatcgatcgattggtaaagcctgtgaaagacttatttggtgctatcttttttgtatcggtcgggatgatggtagatcctgcgatgattattgaatatgcggttcctatcatagtcattacgttggcagtgattctgggacaggcctttttcggaacaatgggggttatgttggcaggacagcctttaaagaccgccatgcagtgtggctttagcctgacgcagataggggagtttgcttttattattgcttctctgggcttatcactgcatgtgacaagtgatttcctatatccgattgtagtagctgtttccgtgatcacgacatttctgaccccttatatgattcgtgttgccgagcctgcctcaaacttcgtcgatcgtaagttacccgaatcctggagacgtttcctgatgcgatatactaccggtacgcggactgtcaatcacgaaagtttgtggcggaagctattgtttgccttagcacgtattctggtggtgtattccattgtcagtatttcggtaattaccctttcgttccgttttgtagtacctttgctacgcgaacatttgccgggtatctggggcccattggcaggagctgtttttactatcttgtgcatatccccttttttgcgggccattatggtgaagaagaatcactcggtcgaatttataactttgtggaatgataatcgtgtcaatcgcggaccgctggtttccacggttgtatttcgtgtcgcagtgtcagttctgtttgttatgtttgtcattacccgtttgtttaaagcttcggtaggactgatgttcggagtggctttgttactggtgattctgatgatactttcgaggcagttaaaaaaacaatccattttgatagaacgtaaattttttcagaatcttcgttcacgtgatatgcgcgctgagtatttgggagagaaaaaaccggcttatgccggacgtttgctttcaagagatctgcatctgactgattttgaaataccgggagagtcggcttgggccggaaaaaccttgcttgaactgaatctgggtaagaagtatggagtgcatgtagtctccattcttcggggaaaacgtaggattaacattccgggtggttctatccgtctgtttccgatggacaaaatacaagtgatcggtactgatgaccagctgaataccttcgcagaagagatgtcgcatgttgctgtgatcgattcgggagtgtttgaaaagagtgaaatgactttgaagcaattgttgatcgatacagactctgcttttctgggcaaaacgctgcgtgaatcgggcattcgtgataaataccattgcctgattgccggcgtggagcggggaggagaagctttgatgacgcctgacgtgaatgttccttttgaagaaggagatgtagtgtgggtggtaggtgagaatgaagatgtgtaccggttaataggacaaaattgtgatagaaaacgttaa

SEQ ID NO: 3988 - DNA, 906 bp, B.fragilis
aataccatgaaaaagttatttgttttagtatgtttgcttgcgatcggattctgcaatgtggcttgggcggctaaacggcaggcaaaacatgtagtattgattgcgttggacggctggggtgcgtatagtgtgcccaaggcagacatacccaacattaaaagcctgatggacgaaggatgctacacacttcataaacgtagcgtatttccatcatcgagcgctattaactgggcttccatgtttatgggagtgggtactgaacttcacggatatacagaatggggttcgcgtacgcccgagataccatcgcgggttgtcaatgaacatggtatttctcctactatcttttcggttatgcgtcaacagtatccggaggctgagaccggttgcctgtacgagtgggaaggaattaaatacctggtcgatacactggcactgagttaccatgcacaagcttctgattatgataaatacccgactgctctctgcgagatggctgagaagtatatcaaagataaaaagcctgccatgcttgcagtttgcttcgatcagttggatcataccggtcatgctgtcgggcacgacactccgggctattatgaaaagctgaaagaactggacggttatgtgggacgtatcattgctgccattaaagaggccggaatatatgatgatacgattatcatgatgacagccgatcacggtggcattaaaaaagggcatggggggattacactccaggaggtagagataccttttatcattgccggtaagaatgtcagaaaagggggagagttccaggaaagcatgatgcagtttgatactgctgccaccatgggatacgtttttggagtgaagcaacctcaagtctggataggacgtcccatgatacaggttttcaaataa

SEQ ID NO: 3989 - DNA, 1188 bp, B.fragilis
agcaatcagaataatgaatcctgctgtaaaatgactttaaagaatttgattatgaaaagaataacaataaaacaatatttgcttgcctgtttcgttctgccgatgatcctggcaggatgcaacgatgccgattaccaggttatcgacaatgcgatttatttgaatgaagcatccgagaatggttcggcaaaggttaccgttgatcctgaaaatgtaacaacaactactctgaccgtacgtgtgggacagcctgtaaccgaaaatgtgactgctgtcctgacggtagatccttctattcttaaagagtacaatgaagctaatgaaacttcgtacgaagtccttcccgagcagtattttacttatgacaaagagataaagatagcggcaggcgatgttagcgcaatccccagtgagtttagagtgaaaccttattcaaacgaaaacggagaattgtatgctattccggtatctctcacagaaattcagggaccggtgtccacaatcgggctttcgtcgaagtttatcattttgctggataagccgctgatacagtctgtaccgtttatgaatacgaccaatgccgtgaagcccgccaaggacgaattgtggggagtgacaaccaatgaatggtcactcgaggcttgggtacagatggacggattcgatattaataatcaggctatatttaattcgggcagcagcgaccacgaggtttatatccgtttcggtgacgctatgatcccttataattcattacaggtgaagacacttggaagtcaggtcaatacggtgactttgtttgagaagaataagtggtatcatctggccttcgtttataattcttccgggttattgtcgatttatatcaacggagtgctcgacgtgactctgcagacaaagggtggcccggttagattcgacaagatgaacatggtttcgagcggtagttacttccgcaacaattgtcagatggcccaggtgcgtctttggaagagcgcaatcagccagacgcaaattcagtccaacatgtattttgccgtgaagcccgccgatccgaacctgataggctattggaaaatggatgaaggtaagggaaatgcctttgtcgactgtaccggacacggatacgatttggtggcaggaggaactcttgtctggaaagagcatgttcgttttgataagcaataa

SEQ ID NO: 3990 - DNA, 741 bp, B.fragilis
agagaaaagaaaatgaaaaagagatatttaaatatagtagtttttgcattgttcgtcagcatgctttggggttgcagtgactggaccaaacctgaagcggaagacttttttgaaatgccgggaaatgattattacgagaatctgagagcatataaacgttcggagcattcggttgcattcggttggtttggaggctggacgggtgtcggggcttcgatggtgggcagtctgatggggcttcccgatagtgtggacttcgtttcgatttggggtaactggaaaaatcttgatgaggcccggatgttggataaaaagaaggtgaaagaacagaaaggtacacgcgccttaatgtgttttatcgtggctaatgtaggcgatcagttgactccggaagagcataaagagaattataaggagtactggggctggaaggatggtgatcaggaagctatcgacggtgctatcagaaaatatgcgaatgctatttgtgactccattgataagtatggatacgatggtttcgacatcgattatgaacctaattatggttctcccggaaacttggcaagttatcccgagaatatgctcactttcgtgaaagcactgggagaaagaatcggacctaaatcgggtacgggacggttacttgtgattgatggcgagcctcaaagtattcatccggaaaccgggccttactttgactatttcattgtgcaggcatactctaacccttgcgggtaa

SEQ ID NO: 3991 - DNA, 1074 bp, B.fragilis
aaaaagaagaatatgaagaataacctgttaagtgaaagattagtttataacggtgagagccagactcccacccacctgcatttatgtacttacaacgctcttgtgatgcaggaggtttcaggtgtcaatttccagactgtcgccaattctctcaaccgcgagcagatcaactggctgcaggtgcacggacttcagaacaccgaagtcatccgggaaatatgcagtcactttgaaatagactttcttatccttcaggatattctgaatgccgagcatcccactaaaatagaggagcatgacaagtacacggtgcttatcatgaagctattccgcttcaacaacaaagaagagaaaagcccggaagatgaactggatgaactggaacagcaacaagtatgcatcatccaaggaagcaactttgtactcaccttcctggaaaacgaaaccgacttctttgacgatgtcacctccgcccttcacaatgatgtactaaaaatacggggcagacaaagcgactacctgctcagtgtcttactaaacagcataatgggtaattacatcgccaccgtatctaccatcgacgactccctggaagacctggaagaagaattgctcaccatcagtgacggtaacgatatcggcatccagatacaggcactccgccggcagtacatgctgatgaagaaagccattcttccattaaaggaacaatacgtgaaactcctgagggcggaaaactccctgatgcacaaagtgaaccgtgctttcttcaatgatgtcaacgaccatctgcaattcgtattgcaaaccatcgaaatatgccgggaaaccctatcgtccctggttgatctttacatatccaacaatgacttgcggatgaatgatatcatgaagcgcctcaccattgtttccaccatctttattccgttgacttttcttgtcggagtgtggggaatgaacttcaagattatgcccgaattagactggcgatatggatatgtatatgcctggatattgatgctcctggtgggcggagccgtatactggtttttccgaaagaagaaatggtattaa

SEQ ID NO: 3992 - DNA, 573 bp, B.fragilis
agtatggagaacgggattaaaaaaatattaagagataaatatggactttttgaaaaagatatagaaatattgcttgaaaagttcacaaaattttctgtgcccaagagagagattatccttcaagaagggcaaacagatcactatatctattttgttgagaaagggattgtaaaaagtacgattctaagagagggcagagaatttatcatattttttgcattagaaaatgatgtcccactcagttcacccaacctgacagagagcagacaatcactatatactttagaggcagtagatacttgtattttatggagaatctcccgtaaagacttagccacctcattcaaagactctcttaatttatccaattggggaagaatgattcttcaggaatggcttacttcatctgctttctatttttcatctatccactggatgagcaagaaagaacaatatcaatatctacttaaagaaatgcccaaactgatacaaagattatcaatgagagacctctccgcatggctggacataactccacaatccttaagtagaatcagggccgatatgcattaa

SEQ ID NO: 3993 - DNA, 201 bp, B.fragilis
gtacgctggaatccccggactcggcttctggaaatattcgaatccaccgatcattctatccatgcgcgtgggtccacctcattagatcactctttcttgtactatccgcactacctagtctcttatacacgcattctatttccgacggccttcaatctaggctgctcacgtggagttcacccgctctctgtgccttgctag

SEQ ID NO: 3994 - DNA, 1125 bp, B.fragilis
actggctggaaagaaaaccggaggacgaaaataacgggaggtgtacttatggattatatgaaagatataaaagaaatatcggcggaagaagccgtaatcctttggcaagcctcacgcctgagcctgtcgaaaatctatgagaaagcacctgagattctaaaagtgcaaggttcggtcattggtacactgggtaatttcagtgcatcaatcggcaaagccaaaagcaaaaagactttcaatgtgtcggctatcgtggcggcagcattgaagaatggtacagtgctaagatatgtggcggaactacccgaagagaaacggaaaatcctgtatgtggacacggaacaaagtccttatcattgtctgaaagtcatgaaacgtattttacggatggctgggcttccagatgacagggacaatgagcatctggaatttcttgctttgaggaaatacacgcccgaacagcgtatcaggattgtagagcaggctatttacaatacgcctgacatagggcttgtaatcatagacggcatccgtgacatggtatatgacatcaacagccccggtgaatcgacacgcatcatatcaaagctgatgcagtggacggacgacaggcagatacatatccacacgatactccaccaaaacaagggcgatgagaacgcaagggggcatatcggtacggaactgaacaacaaggctgaaactgtccttcttgtggaaaaggacaagagcaatggagatataagcaatgtttcagccatgcacatacgggcaatggacttcgagcctttttcatttcgcatcaatgacaatgccatacctgaactgttggagggttacaagcccgaaaccaagaaaccgggaagaccggaagaggaaaagttcgacccttacaggcatatcaccgaacagcagcaccgcatcgcattggaagcagttttcgggctgaaagaggaatatggctacaaggaactggaggacaccttaattaagacttatgtgtctgtgggggtaaagttgaaccacaaaaaggcggtatcgctcatcaccatgcttcggaacaaacgaatgatagtgcaggagaacggcagaaagtacacgttcatgcccgacttccactattag

SEQ ID NO: 3995 - DNA, 1272 bp, B.fragilis
atattttacctttgtaatctaaacaaaaaactcgaggtcatgaagtataaactgttagtccttgatgtagacgggacattgctcaatgatgagaaggagattactcctcgtacccttgccactttgttaaaagtacagcagatgggagtacatattgttttggcctccggtcggcccacttatgggattttgcctttggcaaagaaactggagctgggtaactatggcggatacatcctgtcctataacggcgcacaggttattaatgccaaaaatggggaagtattgctcgaacggcgtattaaccccgaaatgttgccttatctggagaagaaagcccgtaaaaacggatttgcaatctttacttacaccgaagaccgaatgattgctgatcaggcagataatgaacacattcttcaggaagcattcctcaatcggatggagttgattgaagaacccgaattttcggttgccgttgattttgctccttccaaatgtatgttggtcagtgatgacgaagaggcgcttatcggattggaagaacattggaaaaaacgtttgaacggagcgctcgatgtattccggtcggaaccctatttcctggaagtcctgccatgtggcattgacaaatcaacttcgttgggagccttgctttcccatttggatatcactccggaagaaatcattgttatcggtgatggcgtttgcgatgtttccatgatccagtttgccggattgggtatcgccatgggcaatgctcaggattcggtaaaggtatgtgccgatgtggtgacggcttcgaatgaagaagacggagttgctcttgccgtagaaaaagcgattctttctgagattcgtccggcagagattcctctcgatcaattgaacgagcgtgcacgtcatgccttgatgggaaatctgggcattcaatatacctatgcttccgaagaccgggtagaggctactatgccggtagacgagcggacccgtcagcctttcggcattctgcacggaggtgccacgttggcactggccgagactgttgccggactgggttcgatgattctctgccagcccgacgagattgtggttggtatgcaggtcagcggtaaccacatgtcatctgcccacgagggagataccgtacgtgccgtcggtaccattatccacaaaggacgttcatcacatgtctggaatgtagacgtatttacgtcgacggacaagttggtgtcttccatacgggtagtgaatagtatattaaagaagagatga

SEQ ID NO: 3996 - DNA, 1041 bp, B.fragilis
tataaatttgataaaatgaaaaagattatttttatgacgcttttcctgcttgtcgccatgacgggacaaagtaaaggaaagggtgagtttacggttctgcaatggaatgtatggcaggaaggtacaatggttccgggaggatatgatgcaatcgttaatgagatagtgcgcttgcaacccgactttgtgacattcagcgaagtgcgtaattatcataacactcgttttaacgagcgtattgtggcttctctgaaagagaaaggactggattattattctttctatacgtatgacacaggtttgctgagtaagcatccgatcacagactcgctcactgtattccccgaaaacggagaccacggaagtatctacaggctgacgagttccgtaaacggacacaaggtggcagtctacaccagccatttggattacttggattgtgcttactacaacgtacggggttatgacggttccagctggaaagagatacctattccgactactgtagaagaagttttgaaggtgaatgtggcttctcagcgtgacgatgccatcaagatgttcattgcacaggctcaaaaggatattgcaaatggttatagcgtgattataggcggtgacttcaatgaaccgtcacatctggattggattgaggctaataagaatctgtacgatcacaatggcctggtaattccctggacagtaactacattgctagagcaaaacgggtttgtggatacatatcgtcacatttatccgaatccactgactcatccgggatttacatatccggcagataatccgttgaaagaacccggtaaactgacatgggcaccgaaagcggacgaacgtgaccgtatcgactttattttctacaaaggaaagaatcttgaagcaaagaaagcgattgtctttggcccgaaaggctctatcgtacgtaataagagagtgcaggagacatcaaaagataatttcctgttaccgttggatgtatggccaaccgaccataaaggactgctggtgacatttaagattaagtaa

SEQ ID NO: 3997 - DNA, 837 bp, B.fragilis
aacattattgatatgaataaacttctatactgtttctttttatcattttctgtcatagctacctcggcatgtaccgatgataaggaagaacgggaatttcctccggcccccgatttcagcctgatgatcctgaaagagaatctgcacagtaacggaggcgacgtattacgcaccgatacttatgtatacgataacaataaactaacgacccataccacattacaggagttctacgggcagagcctgacccacgaaacgactctctcctactccggtaacgaagtgacattggcagatgaaaacggaaataccgccatttatatcttaggaagtgcgggatatgccaccgaatgtacttacaaattgtccgaccaagtcagaaagtacaccttcacctattccggtgaatatcttacccggatcgatgaagaaataaacagtacgccttattcttccgtagagttggcatacgacgacaacgggaatttaagccatatcattgccaatggcttgcaaaccaattatcaggcgggaaatacggagaacctgtatcagctcccttgcctgcaagtttgcgaaacttaccccctgtctttccacaacgacgctatttatgccggactgttgggccgtcagtccaaacacctgattatcggcaacactccgaaagaaaacaaagaggagtatacaaaatacacttatgaactggatgaaaacgaaaagccaaccggaatcatcgctaagaccacttctacaggtactgtgatcgacataaccggtaatgcatacgatgaaacaaaaacagacacgagaaccatcggcatcaccatagaataa

SEQ ID NO: 3998 - DNA, 231 bp, B.fragilis
aagcgtaatgaaaagtcattagaaggaaagagagggtatctgattagcatatctctgtcgccttccagcaccttcctgtattcagcgatacaatatacctatgggggacaaacgagaaaagtccgatcatgcgcacatgacgagggtcaggagaccgatccgcaagtagccgattctgataatcatgaatatcgtgaaaatcatcgtcacaataacggtcattctttctaa

SEQ ID NO: 3999 - DNA, 336 bp, B.fragilis
aaacataccgatatggaagagaaaaaagaagcccgtcaaaaacggaacagggaaaaattagcaactgctgattgggtaatggcagaattttatgctacgtggtgtcctcattgcaaacgtatgcagcccgttgtagaagaattcaagaaacttatggaagggactctcgaggtagtacagatcgatatcgatcaggaagatgctttggctaatttctatacgatcgaatcggttccgacatttattttaatgagaaagggagaacagctttggaggcaatccggagaactggatttagaaaggctgaagaaagcagtgaaagaccttaaatcctga

SEQ ID NO: 4000 - DNA, 876 bp, B.fragilis
aaaaataccgaaatgaatatattggtcaccggagccaacgggcaacttggcaatgaaatgcaggtacttgccagagaaaatctgcagcatacgtatttttttacggatgtacaggagttggacatttgtgatgaacaggctgtttatgcctatgtgagtgaacataagattaacatcatcgtgaactgcgctgcttatacagcggtagacaaggctgaggataatgtcgaactttgcgacaaactgaataatatagcaccgggatatctggcacgggcggctcaggctaatggcgctgcaatgattcaagtttctaccgattatgtgtttgacggtacagcgcatatcccttatacggaagaggaacctacttgcccggcttcggtttatggctctaccaagctggcgggcgaacagaacgtgatggatcattgcgagaaagctatggtaattcgtacggcatggttgtactccatctatggcaataattttgtaaagacaatgattcgtctcgggcaggagcgtgattctttgggagtcattttcgatcagatcggtacaccgacttacgctaatgatttggcccaggctatttttgcagcgatcaataaaggcgttgtccgcggcatttaccatttcagtgacgaaggtgtttgttcctggtatgactttaccgtagccatccatcgcctggcgggcattgcttcgtgtaaggtaaaaccgttgcataccgccgattatccggcaaaggcaccccgtccgcactattccgtactcgataaaacaaagataaaagatacatttggcattgagatcccgcattgggaggagagcctgaaacgttgcattaatcaattaagaatggagacactttga

SEQ ID NO: 4001 - DNA, 1122 bp, B.fragilis
tatattaaagaagagatgacgttagaagaaacaaataattgtgagattatagatgaattgatccgtcagggaaggagcttcgcaatgtatcgtaatccgggcgaagaggaacctcactttctgatgcagacttgcggagaagtacaccttatccggaaaatggaagatttgaatggtcggacaggctttgtcatcgcccctttccgggtcactccgcaatgtcctatcatattgatccggccggattgtcacgagattccttcctgcgccggaaacttgcatacccctgcacagggggacgatgcggcatcgtacgggcaacagctccgaagcgaccggtcactcggggcgaagaaagcctatgaggcttgtttcgatgtctttatcagggctttgagggaacgtacttttgataagttggtactatcccgcagaatgatggtgaggagagagccgggattctctcccgcagcggctttctaccgggcttgcaggcgttacatctattcgtatgtctatctttgttatactccgcaaaccggggtgtggatgggcagtactccggaaatcattttatcgggtgagaaaggagaatggaatacggtagcgttggcaggaacccagtctttacagaatggtgagcttccgcaacaatgggatgaaaagaaccgggaggagcaggagtatgtggcggcatatattcgtaaacaactccgctcgttggggatttctccgacagagaaaggaccttatccggcttttgccggggcattgtctcacctgaaaacggatttccacttctcgctgaacgacagtcagaggttgggagatttattgaagctgttgcatcccactcccgccgtatgcggattgccaaaagaagaagcttaccggtttatccttgacaatgaaggctatgaccgcagctattattccggatttataggctggttgaggccggaagggagaacggacctgtatgtcaacttacgctgtatgaatgtgaaagaagattcgttgacattgtatgccggaggcggcctgctggcctcttccgaattggatgatgagtttcaggagacggaaaagaagatgcagaccatgcagaacttgaactcctaa

SEQ ID NO: 4002 - DNA, 1740 bp, B.fragilis
gtttcaggagacggaaaagaagatgcagaccatgcagaacttgaactcctaaataaaataatatataaagcgatgtattcagataagaaaaacatattgcagttggtagcgttgctccgtgcacatggggtgacgaaagtcgttttatgtcccggaagccggaatgcaccgattgtacatacacttgccggacatcccgacttcacttgttactcggtaacagacgagcggagtgccggcttttttgctatcgggcttgctttgcagggcggaactcctgccgctgtttgttgcacatcgggcacggctttgttgaatttgcatcctgccatagcagaggcctactaccagaaagtatctttagtagttatttccgccgatcgtcctgccgcctggatcaaccagatggacggacagactttacctcagccgggtgttttccggtcattggtgaagaagtctgtcgatctgcccgaaatacatacggacgaggatgaatggtactgcaaccgcttgctgaacgaagcattgcttgaactgaatcatcatggtaaaggccctgtgcacatcaacgtgccggtttccgaacccctgttccagtttacggcagagtcacttcccgaagtacgtgtcatcacacgttatcaaggactgaatgtttatgatcgcgactatgacggcttgatcgaccgcctcaataaatacaaccgccgtatgatgatcgtcggccagatgaacctgatttatctgttcgaaaagaaatattcaaagatgctctacaagcagtttgcctggttcacggagcatttaggcaatcagaccgttccgggcatcccgatccggaacttcgatgcagccctctatgccatgtcacccgagatgcaagagaagatgattcccgaattggtgatcacttacggggggcatatcgtctctaaacgaatgaaaaagtatcttcgccagcatccgcccaaagagcattggcatgtgtcgccggatggtgaagtgatcgatctgttccaaggggcattgactacgattatcgagatggacccatttgaatttatggagaagatagcttttctgctggataaccgtacaccggaatatccccggcaatgggagaacttttgcaaggagcttccccgaccggagttgccttattccgaaatgtctgctatcggatcactcattcaggcgttgcctgcttcgtgtgctttgcatctggccaatagttccgccgtgcgttatgcccagctttattcgcttcccgatacggtagaggtttgttgcaaccggggtacgagcggcattgaaggttccctttccacagcgatcggttatgctgccgcttcgaagaagttgaactttgtggtcattggtgatctgagctttttctatgatatgaatgccctgtggaacaatcattttggaagtaacctccgtattctgcttttgaataatgggggaggggagatttttcatactttgccgggacttgaaatgtccggtacttcccatcgctttgtgactgccgtgcataagacgtctgccaagggatgggccgaagaacggggattcctctatcaggaagtgcaggatgaaaaacagttggacgaagccatgaaaactttcactcaacccgagttactgactcaacctgtcattatggaggttttcaccaataaaaataaagatgcacggatattgaaagactactatcaccaactaaaaaactaa

SEQ ID NO: 4003 - DNA, 1056 bp, B.fragilis
tcaggaggagatataatgcttgcatatacatatgtcgaacatgggaagtttgaacttttggagaagttgaggccacaaataaaagatgcccgggatgcaatcgtacgtgtaacacttggcagtatctgcaccagtgatcttcatattaaacatggcagtgttccgcgtgcagttcctggtattacagtcggccacgagatggtgggcattgtggaggaagtaggctccggcgtcatttccgtcagacccggtgatagagtgacagtcaatgtcgaaaccttttgtggagaatgtttcttttgtcggcacggatatgtgaacaactgtactgaccccgacggaggatgggcattaggttgccgtattgatggcggacaggcggaatatgtcagggttccgtatgccgagcagggattgaatcgtattcccgataatgtcagtgatgaacaagctctgtttgtaggtgatgtgcttgcgacggggttctgggctacccgcatttcggagatatccgaagatgatacggttttgattataggtgccggccctaccggaatctgtactttgctctgtgtgatgttaaagaagccacggcgcattattgtttgtgaacggtctgctgagagaatccggtttgttcgtgaacattatcctgacgtgctggtgacagaacctgaaaactgtagggattttgtactctgcaacagcgatcatggtggagcggatgtcgtgttggaagtggcgggttccgaagaaactttccgtctggcgtgggagtgtgcccgccccaatgccatcgttaccatcgtagccctttatgacaaacctcagtttttacctttgcccgatatgtatggcaagaacttgatcttcaaaacaggtggggtagatggttgcgattgtgccgagattctcagtctgattgagcaaggcaggatagacactactcctcttattacgcataggtttccgttgaacgaaatagaggaagcttatcgtatctttgaaaacaagctggagggagttatcaagatagctataacgggaggcaggtag

SEQ ID NO: 4004 - DNA, 438 bp, B.fragilis
atgataatggaagatttgtgtttgaagatattggagcagagaggcataaaacctacagccatacggatgttggttttaaaggccatgatggagacggagcaggctgtttcacttcttgatttggaaaataagctggatacagttgataagtcgaccatatttcgtacgattactttgtttgtctctcatcatttggcacatagtgtagatgatggtacagggtctttgaaatatgcggtttgtgatagtgaatgtacttgtgcggtaaaggatctacatacacatttttattgtgaatattgtcataagactttttgccttgagaatatccacgttcctgtggtcgatttacccgagggatttgctgtacgaagtataaattatgtcttgaaaggctgttgtgctgaatgtgcggcagagctgaaaaaagatcattaa

SEQ ID NO: 4005 - DNA, 831 bp, B.fragilis
atagaaatggaaactaaaagagaatggactcctattaaagaatacgaagatattctgtttgattactataacggcattgcccgtattacgatcaatcgcgaacgttaccggaatgctttcacccctactacaacaggcgaaatgagcgatgcgatgcgcatctgtcgtgaagagcccgatatcaatgttgtggtattgaccggtgcaggcgataaggccttctgttcgggaggcgaccagaacgtaaagggccgtggcggatacatcggtaaagacggagtgccccgcctgagtgtactggatgtgcaaaaacaaatccgttcgattccgaaaccggttattgctgccgttaacggatttgccatcggaggcggacacgtgttgcatgtcgtatgcgatctctctattgcttccgaaaatgcgatcttcggacagacaggtcctcgtgtaggtagtttcgatgccggcttcggatcatcttatcttgcccgcgttgtgggacagaagaaggcccgtgagatctggttcctttgtcgcaagtataatgcgcaggaggctctggatatggggctggtcaataaagtggtaccgctggataaactggaagacgagtatgttcagtgggcggaggagatgatgcagcttagtccgttggcactccgcatgattaaagccggtctgaatgccgaactcgacggtcaagccggtattcaggaactggcaggtgatgccactctgctttattaccttaccgatgaagcacaggaaggcaagaatgcttttctggagaagcgtaaaccggactttaaacaatatcctaaatttccataa

SEQ ID NO: 4006 - DNA, 405 bp, B.fragilis
aaaaagatggaacaaacatttaaagcgcgaaatccccaattaggagtttggttgttcgccataggtataatagcatgcattgcgatcagtttcataactatacaagcaatctggataggtaccgcatgtataggtcccagtgtaaccatctatttttcacaaacatcctgcaaatacattgtcaagaaaaacggagatttacaaatagtaaatgacttcttccgccaaaaacgaacattcagtcatatcaccgatgttacgtatactcgccatgccttgggcatgcagaaaataaagatcagacacgccaccgggtttgtcatgatagatccccaatcaccccgggaactgataaaagccctgcaaaagacgaatcccgatgtaagagtaaagaactttatttaa

SEQ ID NO: 4007 - DNA, 486 bp, B.fragilis
agaaagatggaaagagcaacttttagcctcctattctacattcgtaggacaaagttaaatcggcatggtgaggcgccgattctgatgcggattactgtaaacggtgttcgtgcggatgcatcaataaagaaaacgattttaccccaactttgggatgccgataaaggcagagccctagacaaaaaacgtgaggggaaggaattgaacctataccttgatgcaatccatatgcggattctgaaaattcaacgtgatttggaaattgaaggagcgaatgtgatcgcttcgaaagtacttgatcgttatcttagaaagggaggttttgttgatcgtagtttattcgatgtctttcgtgaacataatgataagtgcaagaagcttgttggaattagtatggctgctgcaacagcacaacgttatgagacaactctgcaacatacacaggactttgtttgggacacttaccgaaaaaagttttttttctga

SEQ ID NO: 4008 - DNA, 996 bp, B.fragilis
cggaaacgggaaaaatcaatcgtgccgcttgccggcaacttgccctcacttatcggacagatcgctaagtgttttttcttctttagttgtatcatatacgaaatagctttaaatttaataaccaacacatataaactaatgaataagatttgcttttttatcggagtttttattaccctgcttttggcgggttgcagttctaatccgattacccatgttcgtgtggcgacctttaatatccgttatgataatccgggcgacagtttgaattcctggaagtatcgtaaagagaaggtctgtgaatatatccgtgagaaacatccagatgtgctgggaatgcacgaagtactgaatcatcagtcgaaagacctgatgtccggcctgcctgattatgcctatgtaggtgtgggacgcgaggatggaaagactcagggggaatatgctcctgtattctatcggaaagataaatatgatttgttagacagtaatacattctggctttccgaacatccggatagtatcggcaaacttggttgggatgccgcgtgtacccgcgtggctacttgggctaaattaaaggataaaactaccggaaaagagtttctgatgttaaacacccattttgaccacgttggtacggaagctcgtcgtaacagtgccctgcttattattgataagataaaagaaatagccggtacacatcctgctatgatgaccggagactttaatgtttctgaagagtgggaagcttacaaaacgatcacatccaatgagtttgtcttgaaagatgcatggaagatagccgggaaacagtccggtgagaactatactttccatgatttcggaagagtacctgtagccgaacgggaaaagatcgattttattttcgtaactccgcaaatcaaggtggcagatgcagagattatttcttctgcgattacagattccacctatttgtccgatcataatgcacatctggctgatttggaattctaa

SEQ ID NO: 4009 - DNA, 195 bp, B.fragilis
tgccaaccttgggtatcacatttgaatattaaatctcgaaacaactatattattaactataaaaactcacaaaatgaaaaaaagaattgtttttattgcggcacttttatgcggaatgtgcttcacgacagcatccgcacagttcaaaatcggtggaaagaaaatcaatgtaggcaaagtggtacaagccggtag

SEQ ID NO: 4010 - DNA, 2418 bp, B.fragilis
ttaaatttatgttacttttgcctggatagagaattaactatggaattcataaatcctaaatttaagtatatttttgcctccattcttttgttggggggctttttatgtgggtataatttcaaacaatggtatgtaaccaaccatcgaaacgaaaaacatatttctcttatctattcttgttcaaaaaaagaggctgaccggggacaatttgaagaactgctgaagaaagaatttaggtcgaagggtgtagaacctatatttgataaattctatcttgattgtaaccgtttcggccaaaaagtcgaaatagaacacatcagtaattatcttgaagctctgaaaagtaagccgatagaccttgttatggcaatgggagatcaggctacccattctttattatcgactcgacatcctttgctctattctgttccggtggtagcttgtaatgtgcattttcctgatgaagaccttttgaaaaaatatgagtccaggaaagtatatgctctaagagatacccccgactttaagcataatatggaatttataaggtctttgcagccacatgttggtctggaaatcgtttataacattgacttgacgcctctcggtcataaatcttttgacttattaaatcaggtggttgatagaaaagatgtacagattctgggacataaatcagcattctccatggagtatgaatataaagaaatgagagaaatgattgagttttataatctgatgcctgccgtagcaaataaccggataaaaaagaaggagttgacaataagcctttgccccttccggtatattaaaggtgcttctttgcttgtaatgatggaaaattcaaaaagtgagcaggggaagaaagcatttttgcttgataaattcgatatggtatcgtttccgatagtgaatgccttaagcataccttcatttagttgtgtacatgccggattcggagaaggaaataaaattgttggcggctatatggccaccaaagagatttctgtgcaggctgcagccgatctgtctacccggttgatgaataaagaaaaaataggtatgcctaaaataagggatttgagaaaagaatatgttctcgattggagcgttttttctacttataatggttatgatattaaaaacgtgggcaagaatgtgcgtattattaattatcctatttatgatcattatcgtgaggaattttatttattgggtgtattatttgtctttgcattcatttttatttctgtcagtttgctgcacactcggcggcgttcgctgattgaacgcaaaaacttgaaaatactggaagaggcacacaagcgtttgactctttctgcggatggaggacagatttcgctttggaatatgcagagaagtgatattgagtttgatgataattatgcgcgtctgacaggagtagaaaaaaggaagtttaagagaactgattttttggagtatgtacatcctgatgactcgcagttattaagttctttttatgaagcgttgtgcaaatctccgggtgtagaaatacaacgggtacgtttccgttttgatgaaaagaaaggttatcaatggtatgaattacgatgccgcagtctgaaggatattaaaggagagatgatgctggcggggatcatgcagaatattcaagagtcggtagaacgtgagcatcagttgattgtggcgaaacaaatggctgagaaagctgaattgaaacaatctttccttaataatatgagtcatgaaatccgtactccactcaatgccattgtggggtttacaaatgtattgttgggtgagggctccgaggagattgatccggatgaaaaggcgagtatgcttgagattatcaatcataataatgaattgctcttgaagctcattaatgatgtactggaaatttcccgcctggattccggaagtctggattttgacatgaaggaatggaatatgacagatattgtcaaagagatttataagacgtaccaacccttaatccggtcttctttacagtttcgtctcgaattggatgatactgtttctgtgcctgttcatacagatcgtctccgttttgctcaggttatttcaaactttttgaataatgctaacaagtttacccaaaatggatatatcgctttggggtgtaaagtagacaagaagcatagggaggttcgtatatatgtggaagatagtggtaagggaattgatgaaaaggaacttatgatgatttttgagcgtttctataaaactgacgagtttgaacagggaagcggtcttggtcttgccatctctaaagttattatcgagcggttgtcgggacgtataaaagtacactctgaaaaaggtaaaggaagttgttttacagtgattttatcattggcggatgcaccggagaatcacatgttgatttga

SEQ ID NO: 4011 - DNA, 2775 bp, B.fragilis
agtcaaacatgccgcagggataaaaatattataatatacaaaatgagaatagaaagatatgttattaaggtgcgggaccaaataaggaaagctttggtttctattgccgagccattggaatatatcaaagcacagaaagaaacattttataaggctgctattttatttctgattttattgctcttatggcgcgcttatgaaggtttttggatatcactttttgataaatacgtgctgtcgtgcctaaatgtatcttgggactgggtcagtttcactctttatacacttatcatttgcagtattgtttatcagttggttcaatgctttaagcataagcacattttatctatgtatcacttatcaatatatagtgttttgataattgtttataccttctatagattcagtgcttttcataaaggttatcaagactttagtagtttatattatttggatttacttgttttggggttactggttttggttgtttctgctatttctaattttattattgttttgatgagtgagcaacgtgataagccgaatactaatttttttatgatacctgaccaacctattacaactgatgatgatgatcggcttgattatgcaccggaagcgcgtatgctagcagaaacaataagtggtttaaagttgaataaatcgttgagtattggtgtaacatcgcaatggggtagtgggaaaacctcttacttgaacttggtagaacaatgccttgatagaaacctatttattataattaaattcaatcctaggtattcaaagaacgtagcatgtattcaagaggattttttctcgattatcagctctgcattaaagccgtacaactcatgcttttcgaagatgtttaaaaactatatggaaacgttgcagttgtttgatgataaaaatatagtaaccgcaatattaaatttgaagggcattgtcgatagggattctgaaaaagagaaattagatatggctttaaagattctaccaaagaaagtcgttgtgtttcttgaagattttgatagattatttaaagaagaaattatagaggtttttaaattgatagatggtaatgcggcttttccaaatctggtttttctaactgcatatgataaggcatacattgttaaaacgattgggagtaatttagaagatggagcatctttgttttctgataaattcttcgatatggaagttgtcgttcctcttagaccttatcagcagatatttgattttctttctaagcatttattggaggggcttaattgtgaggttggagatgagcataggtatcaaactgccttagaaaaacatttttatgttataaaaagatacttgattacacttcgagatgtaaagagatttttgaatctgtttattaacgattataaatttgtaaaaggggaagtaaattttgaggattattttttgctgacaattattaaattcaaagattctgaagaatacaaagaattaggtcacaatcataagaatataagtaatgaatttgggcgttattgtttcgataataatggtggggatgaaataaagtttgcggatatattaaatatattattccctccgaatttttcaagtttggaaactgactctgaactgagagataatttccgtaggatcaatagtactgcatcttttaataactatttctttaatcgtatttacaatcaactccgattaagcgatatggaggaatgtttgcgtaaagattttatgatggctaagttagatatagacaattggattgagaataatctaataggtggttttgttgaattcttacagcaaaaaaatctgctttgctttgataataaagagcgttttatagtatttatgcaaattgtattttatctttcattgaggctatttgatacagaagtgtatatattaattttgagattggtaacagttgagcatataaaacagtttgagcaaagatataccttttctcaaatggagtataaaatccttatatctgaaatactgaatgaaggctatccctgctttcattataggattatccaaaagttaatactgaatctctgtaatggtgagttggtatttgagataatttatactaaagaagaactaataaacattgctagaaaacttcttaagggatatataagtgaaaatgagaccatgtgtgatgtgcatatggatattctttattcttgtgtgaaagatgtaaatcaggaaacaagaaaagtaactctggacgaagacagttgtttggcggtgagaaatctgatttttttaagccctggatattatatttcaacatttgttcggttaggaatgttctcatctaatcctgatatgaattcgatagcttgtgagccttattggaaacagatatttggagaagcacaaacttttgagacttttattcttggtgaaacgttaaatagtattccagaaattcagagggttcggaacttttggaaattatatagtaataatgattatgagccgattccaatggagcgtatgggtaatgttcagaaaatgataaatgataatctagtcattttgatgcctttattcgagaatattcaagcaattgaacgtaaatttaaagagatacaacgtgactatgatgtggcaaaccctcaggagtcaattgataaatgccagcttcttaaacaaaaaataggggctgacggattatttatagctaaaaatggccagttgatcagacaaatagaccaatggatttccgggatttccggcagcaataacgcgtag

SEQ ID NO: 4012 - DNA, 1035 bp, B.fragilis
tctggtatgtgggcgtggggcatattcggaaccatcaactatgcaactaccgatgaacgattcactgcctcactcggcgtacggaccgatgccaacaacttttcttccggcatgaaagggatgggcgaccaactctcaccccgcctgtcactatcataccggctgacagacggattatatttaagtggaaatgcaggactatattatcagctcccgccttataccggattgggatttaaagataacaatggagcatgggtcaacaaatacctccgttacatgagcgtcagtcaagaaagtctcggcctgagttggcatccgggaaatacattcgaactgtctgccgaaggtttttacaaacaatatgataaaataccgttctccatcgcagacggcatccccctggcttgcaaaggcaatgactacggagtcatcggaaacgaagccttgtcctctaccgcccaaggacgtgcatacggcatagaaatattaatgaaatggctgatagctaaaaaactgaatctggcatcctcgttcaccctgttcaaaagcgaataccgcaacaacaaacaatcggagtacatcgcttccgcttgggacaaccggtacattttcaatatgagtggaacttataactttccacacaactggagcctgggcatgaaaatcagctgtataggaggagcaccctataccccttatgatgtggaaaaatcatctcttgttacggcatggaatgcacagggacgtccatactatgactacacaaagtacaataccggacgcttgcccgccttcggccaactggatgtacgagtggacaaaacattttatctgaaacgctgtatgttgggattctacatcgatttgcagaatgtgacaaacagcaaattcaagcaaccggatatcctgatgagtacaggcgttatcgaaaatccatccgcccccatggcagaacagcgctacaaaatgaaatacataacccagaaaagcggaacattaatgccaaccttgggtatcacatttgaatattaa

SEQ ID NO: 4013 - DNA, 348 bp, B.fragilis
ccggtgccgtgggagcgcaattcaatgcgacagatcatgtcggcctatatgtggaaccgggagtttcgtatttctttgatgatggctccaaagtacaaaccatccgaaaagaaaggccttgtaactttaacttgcaggcaggattgcgattcacttattaaagtagggtggcaaaaaatatgccggttacattatctccctgttcttgccttgtattgtaatgaattaaggcaagaacagggagacttttatatcgtgacttacaaaattataaataagtgcagtcgtcataattcaccgcagagtgaacttaatctattgatggccaatgaatctttatctgtgtaa

SEQ ID NO: 4014 - DNA, 333 bp, B.fragilis
gtatcggtgcgtaatacgtcgcctccgttactgtgcagattctctttcaggatcatcaggctgaaatcgggggccggaggaaattcccgttcttccttatcatcggtacatgccgaggtagctatgacagaaaatgataaaaagaaacagtatagaagtttattcatatcaataatgttttatttgcctgcaaatgtagttaataacctgctctatctaccacgattgtggtataaaaatgccttcaatgtgcgatttctttccataccggattcctctatctttgccacatataaagattggacactgacaatgaactctaaatatagatag

SEQ ID NO: 4015 - DNA, 186 bp, B.fragilis
ctggaaccgcgcagtagtggtagagctgatcaagtaataacaattatattaccttcaaaaaagcgcattgatattctcaatcaatgcgcttttattttaatgatcttttttcagctctgccgcacattcagcacaacagcctttcaagacataatttatacttcgtacagcaaatccctcgggtaa

SEQ ID NO: 4016 - DNA, 522 bp, B.fragilis
aaatcaaagcttttgtctatctttgtaaatagacttaattctaaaataaatagtatggcaaaagagttgaattttacattggaaggtgtacaaggtgatttaaagttgaaatacggtccttttaatcaacgtttataccaagacggaagagagatcaagaaacaaggacgattcaatccgaaatattatgtgattaacaccaatggggaaaaagaagaaataaaggttgtctatggttttgattttgtccatgtcgctgtgttccgcggacagaaaatcgatctggaggaacggctatctatccgcgaatacatagtgggtggtctgcctgtgttacttgtctttctaggtggattgattggagccttgttcggcatcatgggtgctacgttcaattataatcatatgcggcaggaaaagtcttttatgaaacaactgcttgtttccctgggcgtttccatactctgctatgtagcttattttatatttgctattggtgtccagttgatagtggctagatag

SEQ ID NO: 4017 - DNA, 645 bp, B.fragilis
caaaaatttagctacgtttgttcgctaataacaatggagagaagaatggcacagactctgactaacctaaacataaatgataataatgccgttatatcagccctgcgagaaggggatgaagaggtgtttgatcatatctaccgttactattttcgtggattatgcgccttttgctctcaatatgtcactctgagcgaatcggaagaaatcgtgcaggatactatgatgtggctatgggaaaacagaaaaacccttataccggaacttactttaaagactcttctctttactatcgtcaagaacaaagcgcttaataaaatctctcattttgaaataaaacgcaaggtgcatcaggaaattgcggaaaaatatgaaacggagttctcttcacctgacttttacctggaaaacgaactattcagattgtacgaagaggctttaagaaaactaccggccgaatttcgccaggcatacgaaatgaatcgaagtcttcaaatgactcataaagaaattgcggagaaactgaacgtctctccgcaaacaatcaattatcgcatagggcaagccctgaaaatattacggtccgaactaaaggattatctcccgctgatcatgttgtttttatttctgcaagggcataaatga

SEQ ID NO: 4018 - DNA, 1017 bp, B.fragilis
gatatgaatagacatttgaattttgtgaccttaatctgcctgataacaggctttgtatcgttggcttcgtgcagcaacgatgatgatgaaatggacaaatatcaaaagatatatatcagaacgggagttgcaccgggggccgaaatgggtgctgcggtagtggtggattgtgtgagcaattcctctactgccgaccgttctgattttgaaatacaattgtgtgccgtacagccggttacgcgggatgtcactgccgctttgggagtagatacgctgaaagtggatacttacaattctgccaataagacgaaatgtaagttgttgccccaagataattataccattgaaacaagtgaagttgtcttaaaaacgggacagacagtggccgattcatcttttcaggtcgttttgaagaatatagaaaagttgactaatcctgacggatatgtgcttcccgtggcgcttaaaggagttacgggcatggacgaacaggctgtcagtacatctatgaagacggtttatatccggatttataccagcgtgctttataccagttatacgaaacccgggaattggtccgctgtagatcgaagtgcgtggagtgtaagttgcagcaatgtttatgccgatgatgatgccaaatatggtgcacatctggctattgacggtgagataaatactacttggtttacatggggagtggctaatgccggagagtgttggtggaatacggtactggaccgacctgttaccttaaccggattttcggtcactaaacagagtgcctacggatcgggttataatctgagaagtgctgagattaaggttcggaaagagggtgaaaccgagtgggttacttacccgagagtcttgactttcagaaattttaaaggggctgatccgcaatatgcggccatcgaaccacctatcccgaatgtaaaggaattcagaataaactgtctgactccggataattataccgggtttgctgagataaatttatatgtgaagcaatag

SEQ ID NO: 4019 - DNA, 1452 bp, B.fragilis
gcggacaacagaagatttcatcaacaatccaaatcaaattttaagaatatggcaacaaaatcaagcatacatatcaaaccctgcagagtgacatcaagcggggctcataaccggagaactgccgagtacatgcgcaatatcggcgagtccagaatctacattgtacccgaactgacttccaataacgagcagtggataaacccgggcttcggcagtcctgacctgcaggcgcactatgacagcatcaaacggatggtcaaggaaaagaccggacgagcgatgcaggaaaaggagcgtgagcgcaagggaaagaatggaaagattataaaagtggctggatgttctccaatccgtgagggagtattgctcatcagaccagatacaacactggcagatgtacgaaagtttggtgaggagtgccagagacgctggggtattacaccgctccaaatcttcctgcataaggacgagggacactggcttagtggacaacccaaaaccggggatagggagagtttccaagtcggtgaaaagtggtttaagccgaattatcatgcccatatcgtattcgactggatgaaccacgacacgggcaagagccaaaagctcaatgatgacgatatgatggaaatgcagactttggcatctgacatcctctccatgcaacgtgggcaatctaaatccgagaccggaaaggaacatttggaacgaaatgatttcatcattgaaaagcagagagccgaactgcaacgcatggatgctgcaaaacggcacaaagaagaacagataggtcttgctgaacaggaactgaaacaggtgaaatcagaaatacgcactgacaagctaaagaaaacagccaccaatgcagccaccgccatagcaagcggagttggttctcttttcggaagtggaaagatgaaagagctggagcgaactaatgaagatttgcaccaagagattgccaaacgagacaaaggtattgacaccctcaaaatccaaatgcaggaaatgcaagagcgacatggcaaacagatacgcaatcttcagagcatacacaaccaagaacttgaagccaaagacagggaaatatcacgattgaacactctgcttgaaaaggcattcaagtggtttccgatgcttagagaaatgttgagaatggaaaaactctgcgctgtcattggatttaccaaagatatgatagattgtcttttgacaaggaaagaagctatccaatgtaatggcaagatttattccgaggaacatagaagaaagtttgaaatcaaaaacaacatcttcaaggtggagaagaatccgaccgatgatagcaaacttgtactgaccataaacaggcaaccgataagcgaatggttcaaagagcaatgggagaaacttcggcaaggtttgcgacaaccaacggaagaaccaagaaaaagtagaggattcaagttataa

SEQ ID NO: 4020 - DNA, 198 bp, B.fragilis
gcaaagataagggatattaaaaacataacccaagattacgacaagaagttgctttcattatttaataatacaactcacccgggaaaactactaacctctatcaccctttttttattaaactttatcaatacaacacacgcaaagaagcaccgaagactttcatccccgatgcctctcgcccccttatctacaatctaa

SEQ ID NO: 4021 - DNA, 414 bp, B.fragilis
ttgatggcgagcctcaaagtattcatccggaaaccgggccttactttgactatttcattgtgcaggcatactctaacccttgcgggtaattccgacgctaatcttgacagacgtctggctggtacgattgccaactttaaaggaatacttcctccggagaaagtggctaatatgtacatcgttacggagaatttcgaatcttatgctccgacaggaggaggtgattatgtagatcgttacggaaacaaaatgagagcacttgccggcatggcacgctggactccgactattgacggaaaacaggtacggaagggtggagtaggcacctatcacatggaatatgactatccgggcgacatcgaatataagtacctgcgtgaagcaatcagaataatgaatcctgctgtaaaatga

SEQ ID NO: 4022 - DNA, 984 bp, B.fragilis
ttaccttttggtaacttttcattcttccctgtaacctacctttgcgctcaaattttaattctgtatgatatgaaaagtttaaaaggtattatttatgcaatgatttcatcaggtacatttgggctcattccattatttacaattccattaatgggaaatatggaaatgaatgaatccaacattcttttttatcgatttctattttctacccttatgatgggagcagtatgtcttttgcacaaaagtactttaaaaataaatatgaaacatctgatctctatcatcggtttaggtgccttgtatgctcttacagcgctatttcttatttattcctaccattatataactagtggagtggctacaaccattcactttctctatccaatctgtgtcagcttcttaatggtagtattctttaaagaacaaaaatccaaatctctattcttagcagcctcactctcactaatcggtgttgcacttatgtgttggtcgggaggaggcagtatccgattgatgggtatcggactcgcagctcttacgatattaacctatgggatatatattgttgctctgaatcaattggatataggtaaattacctgctgaagtgcttacgttctatgtgcttttaggcggttgcgtaatctttttcatctacagtctatttacagcaggtatatcctccatccccagcacaaaagccggattttatattttggcattggcatttctatctaccgtcatctccgaccttacgttgattttagcggtaaaatatgccggttcgacaacaacagccatccttggttcaatggaacctttggtcgcagtggttgtaggcgtattggtattttcggaacatttcacattacaatcattaatcggtttattactgatactaatgtctgttatcattgtaatattagccgatcaacaaaaaaagtcgaagagaatcacagaacagaaaatcattaagccacattga

SEQ ID NO: 4023 - DNA, 636 bp, B.fragilis
atatgctttgggaagtcatccgctcttttttccaaaaaaaacatattgctttctaccatgcctttatcatttggtacccggtggcccaaggaatttgccatcaagatggtaccgttgttcctgaaaacgtcggttgccggatggggattgggactcagcactcaggatatcggactggtatatggtacgttcggagcgggagcttttattctcggttcgcttttggccggttattacatttcggctttcggacttcggaagactttgttttctttatgttgcgcttttaatattccgttcttggtatatttcctgttagccctttaccagccttccgatctatggattattggtatggccattgtgtctgaatacttgggttacgggtttggttttgtcggattgatgctctttatgatgcagcaagtggctcccggcaaacatcagatggcacattatgcttttgctaccggtattatgaatctgggggtgatgcttcccggaatgatgagcggatacctgagcgattggctgggttatcgcgatttctttatctgggtacttatcgctaccataccggcttttatcgtgacttggctggtacctttcacatatccggacggaaagaagaaataa

SEQ ID NO: 4024 - DNA, 906 bp, B.fragilis
cgggaggcaggtaggggagtgtttgtattgacactttctgcacatattacaattgaaaaaggaaaaatcatagagttaatcaaatcaaagagaatacctatcatagaaatatcatccttgtctcatcccggagtagagatattcagtacccttactgaagcccagttgcgtaatcgcatcgattccgaccggggaatttttatagcagaaagccccaaggttattcaagttgctttagacgccggttatgaacctttggctattttatgtgagcaaaaacatatcatcggtgacgctgccgttatcattgagcgttgtggtgatattcctgtctatacaggcaagcgtgatatacttgctttactcaccggatatacacttacccgcggagtgctttgtgccatgcggcgtcctgaattaagaagtgtggaggaagtatgccgcgaagccaaacgtatcgtggtaatagatggagttgttgacaccactaacatcggagctatttttcgttcggctgctgccctcggcatagatgctgttttgctgacgcggaactcttgtgatccgctcaatcgccgtgcggtcagggtatctatggggtcaatatttcttgtatcatggacttggatagatggttctctcagcaggcttggcgatttgggatttcgtacggctgctatggcacttactgatgattccatctctatcgatgatccggttttgaagactgagcccaagttggctatcataatgggtaccgaaggagacggactgccgtacgagacaatttccgaagccgattatgtggttcgcatccctatgtcgcatagtgtagattcacttaatgtggcggctgctgcttctgtggctttttgggaacttcgtgctccaactttcaaggagtga

SEQ ID NO: 4025 - DNA, 1068 bp, B.fragilis
gcagacagaggccttcttgatgggagaccttttctttatatcatttttatgtatacaataaatattattccacgcgttcttcatttcaagcaacctgcgggaacttcgcgtggttcttatactacccggaatgtctggtatatccatctttcttccatagagtgtccgggacgtgtcggagtaggagagtgtgctccgttacccaaactgagttgtgatgacttgccggattatgaacaggtgcttcggagtgcctgtcagcgactggaacaaacgggagaactggatatagaatctttacgtgggtatccttctattctgttcggactcgagacagcactgcgccattacgaaacacagagctgggcattatgggatactcctttttcgcgcggagaagccggtatacctattaacggacttatctggatgggaagttttgacagaatgctgcaacagatcgaagtcaagatgcaggcgggatatcgctgtatcaaactaaaaatcggtgcgataaactttgaagaagaattagccctgttgagacatatccgtgctcactattccgccagagaaatagagttgagagtggatgccaatggagctttctcacctgccgatgctatggataaactgaatcggttggccgaattggacctacattccatagagcagcctatccggaccgggcagtgggaggaaatggcccgtctggcggctgagtccccgcttcctattgctttggacgaagaactgataggttgcaatgcccttgaaagaaaacgggaattgctggcggctatccacccccggtatatcatactgaaaccatctctgcatggcgggatcagtggtggcaacgaatggattgcagaagcggaaaagcaacatatcggttggtggatcacatctgcgctggagtcgaatatcggtctgaatgccatagcccaatggtgtgcgactttccggaatccgttgccacaaggattaggtaccgggctactgtttacggacaatgtcgagatgcccctcgagattcgaaaagattgtttatggttttgcaaataa

SEQ ID NO: 4026 - DNA, 510 bp, B.fragilis
attgatatgggtaaagaaaaaaataaaatagcagtactaaataatccgatagaacatgcgattaagattatagtcgctttaaaatgtgcaatgactccattgacacgtgacagactagtggcatatgaatatttcgctctgcatctaactgaccttaataaaaatgcagaaagtctatttcctcaaattccctatcgagcatgtacatacgtatgtaaccataccgatataaccatggctttagagattttactatcaagagatttaatcaagtatgcgataaagaatgataggctatgttatacattgactgaagccggtatcttatttgaagaatatttgcagaatgaatataaacagcgactcacgattatgatggttgaagttgtatcactactgaaaaacaaaagtgatgcagacatccaagaatatgtggagcaaaatatagggaaatggggtagtgaatttgagcgagagtatatattaattaaagatgtcaatcatggataa

SEQ ID NO: 4027 - DNA, 576 bp, B.fragilis
gaaacaattatggaaccaattatcaactcacagatgcctgaattcaaagtacaggcttttcagaacggaagttttaaaacagtaagcagcgaagacgtaaagggaaaatgggctattttcttcttctacccggcggacttcacctttgtgtgcccgaccgaactggtagacgttgccgagaaatacgaacagtttcaggctatgggtgtagaagtatactcagtaagcaccgactcacacttcgtacacaaagcatggcacgatgcttcggaaagcatccgtaagatcaaatatccgatgttggcagacccgacaggtgtattgagccgtggattcggtgtgatgatcgaagaagacggaatggcttaccgtggaacgttcctcgtcaatccggaaggaaaaatcaagattgccgagatacaggataacaacatcggacgtaatgccgacgagttgctccgcaaagtagaggccgcacagtttgtagctactcacgacggagaagtttgccccgctaaatggaaaaaaggcgaagcaaccctgaagccgagcatcgacctggtcggtaagatctaa

SEQ ID NO: 4028 - DNA, 1203 bp, B.fragilis
aaatcgattattatgagacaaacattttcccttttattctttttgaagaaaagacaaaaccatatggatggtttgcatccaattatggttcgtatcactatcaatggtaaaagtgtagaaatttgtaccgggcaaaaagcgttacttgctaattggagtatccgactacatcagtgtgtgggcagttgtgcgaaacaaacaaatttatttctaaaaagtatcaggtttaggctgaatcagattttttatcaacagtctttatacggagagacaactactccccaaaaaatcaaagatacttttacaggagcagacaaaaagaatcattatttactttctttatttgaattacacaatgagagtataaggaagcaggtgggtataagcaaatctcctacgacttttcgaaaatatgaaactacacgcaagtatcttcaaggttatcttcgaagtaagtgtctggaggatataattctagaaaatatcaatcatacatttatttgtgattttgaagtctatttgcgtgtaaccgctcattgtgctcataatacaacagctaaatttatgcagtttttcaaacgaattatcatccttgctttaaataatgggtatataaccaaaaatcctttttcagaatatcagataaaactgcaaaaagtagatcgtggatatttgacgagagaagaactacagagaataaaagaaaaaaagatcgaaataaaacgtttggttttagtcagagatctttttctttttgcatgctacacaggtttatcttatattgatctcaagaatttgtcaaaacatcatttgtatattgctcatgatgggaatttgtggttacgaatgaaccgcaataaaagtggtgagacagcaaatgtatacctatttaatcttcctaagacattgattgcaaaatatgaaaatccagattctatctacttatttcctgttccaagtaatcaaaaagtaaatgcttacctgaaagagattgctgatatttgtggtattcataaaaatctaacctttcatgttgcccgccatacgatggcaacgactgtttgtttggcaaacggtgtgcctattgagagcctatctaaggttttaggacacactaatataaaaactactcaactatatgccaagattaccgatgaaaaattgagtaatgatttggctatactcatgtcaaagatagattag

SEQ ID NO: 4029 - DNA, 1338 bp, B.fragilis
gaacctaatattgactttattatggaattatatcgtagtatcatagagaatttaaagaactggaaagcaagtccagatcgaaaacctttgattttaaaaggtgctagacaaactggtaagacatggattttggaacatttcggacgtacagagtttgagcatgttgccagtttcaattttgacaaggatgaatcgttaaacgaaatattcgaaaagactaaagtacccgagcgtattatatctcagttgaagttgcatacggacagtccgattttgcctgggaaaactctgataatcttcgatgagattcaggaatgcaacaaagcactgaatgctttgaagtatttttgcgaagatgcacctgaatatatagtggttgcggcaggttcgctattgggggtaactttatccaaaggggattcgtttcctgtggggaaagtagaatttatggatttgtatcctttgacattcagggagtttttgaaagttaatgatgagaaaatatatcagtatattgaagaaatttcaatgattgaacctcttccacagattgtgacaaacaagctgactgaatattatcgtcaatatcttgtagtaggtgggatgcctgccgctgtgaaagcttttatggaaaataagggcatggaagcagtaaaacgtgaacagcgttttattttggatgcatatgcgcttgatttttccaaacatgccgaaagtaaggatattcctcgtattatgaatatatggaattcaatccctggacaattagctaaagagaaccgtaaattcatctacaaaatggttaaaccaggtgccagggcacgggattatgaagatgcgctgctctggttggagagtgccggactgattcaccgcgtattttgttgctcaaaaccttttctgccgttgaaaagttatgatgatctttcagcctttaaaatatatctttccgatatcggattattaagggaactggccggattgccacctgaagcgatactaagtgggaatgtagtatatactgaatttaaaggtgcattagccgagaattatgtccttcagtcattggtatgtcaaattgaagtattgccacgttactggacctcgctggggaaagcggaagtcgattttatcattcaattaaacatggatatcattcctgctgaagtcaaatctgaaacccgtttgggaggtaaaagtttatctgtttatgatgataactatcgtccggcctataaaatcagatattcattgaataatttgaaaatggatggtaatctgattaatataccgttatatttggctgattggacagtaaaattagtgtctatacagtaa

SEQ ID NO: 4030 - DNA, 1014 bp, B.fragilis
aaaactaatatgatgactaagcacaagatgaacctattttgtgggatgctacttttgtcagcttccctgtttgtggagaaagctcaagccatgtttcccgagagatacgtatcggaggaatcggcagccagggcagatacaatcaattttcggttggcttctgccggagaagcaaaacgcctgatagcggccaaagattcttatacggctaattggagtccgtttgacatcgctgcccgacttgaaaatcctgaaggcaaaagagaagacctcgtcagcctggccgttcgtgaagtgcgtgaatggacagcggaagaagcgcagcagatcgagcagatcaggaagaacctgaatgatacgattcgtaaatacggctatcggattccatttccgaaagagattgtgctggtaaagacaacaatgaaagacgaaggaggggcgggaggatacacacgcagtaactggatcgcattgacggacgctacttttcagcgggggaccgaagcttctcacacacgcctgctggtgcatgaaactttccacatcctgacacgtctcaatcccggattcaaaaagaaactgtacagagctatcgacttcaacatcctgcccaaagagattgagttccccgaagatatacggaaaagccgtatctccaatcccgatgtcagtcgttgcgatagttatgcgacttttaccattgacggtaagccacagaactgcactatgattatctataccaacagaccctataccacgggtaagttctatcagtatatcaatgtggggctgattccgttggacgagtcgttcaagcctctccgggagagtgggaagacagtgatttatccattacagaaagcgaccgacttctttgataaagtagggcggaacaccggatatgtcatagatccggaagaggtgctggcggataattttgcaattgctttattgaacacgcccaatgtacatacacccgaactgcaaaagaaagtacaggaattactgaaataa

SEQ ID NO: 4031 - DNA, 1218 bp, B.fragilis
ttagctaatatgaaatcaataaaagaactctatcgcattggaaccggaccttcgagcagtcacaccatgggacctcgcaaggcagcagaaatgttcctcacacgacatcctgaagcagcatcgttcaaagtgaccctctacggaagcctggcggcgacaggaaaaggacacatgacggatgtagccatcattgacacactgaaacctactgcaccggtagatattatatggcaacccaaaatctttcttcctttccatccgaacggaatgaactttgtggcacttgatgccggcggcaatgaactggaaaactggactgtctacagtgtagggggaggtgcattggccgaagacaacaaacagccgtctattgaaagcccggaagtatactccatgaacagcatgaccgaaattctggattggtgcgaacataccggaaaaagttactgggaatacgtgaaagaatgcgaagatcctgatatatgggactatctgaaagaagtatgggatacgatgaaggagtctgtccagcgtggtctcgaacaagaaggagtgctgcccggcccattgaacctgagacgtaaagcttccacatattatatccgcgctaccggatacaaggcttctttgcagtcacgcggattggtatttgcctacgcgcttgccgtaagtgaagagaatgcctcgggaggcaaaatcgtaacagcacccacatgcggatcgtgcggagtgatgcctgccgttctttatcatcttgccaaaagccgtgagttcagtgagatgcgtatccttcgcgcattggcaacagccggattgataggtaacatcgtcaagcaaaatgcttccatctccggagcagaagtaggctgccagggagaagtaggcgtggcatgtgccatggcatcggctgccgccaaccagctattcggaggaagtccggctcaaattgaatatgctgccgaaatgggactggaacatcacttgggcatgacttgtgatccggtatgcggattggtacagattccttgtatcgagcgtaatgcttatgcggccgcccgcgcattggacgccaatctatactcttcatttaccgatggaatgcaccgtgtctctttcgacaaagtaatacaagtgatgaaacaaaccggccacgacctaccctcactttataaagaaacaagtgaaggcggactggcaaaggattataagccgatgtaa

SEQ ID NO: 4032 - DNA, 753 bp, B.fragilis
acaaacgacatggacaatttcaaagtgatttattcgattccatttttgttttttattatcgtgtcctgcagcaactcatcaactgagatggttgctaaaagtaagtatgatgctaagattgccgagtataaggagttgaacgaacagcaagcggctgttattgaagataatttagagaaaagtaaaattattaataatgtggtgacggaattaaatcagatagccggcaatacacattctttgcgtgtgaatgtagagcatggagtgggggaattgagtcaagcagaagagatcaatcagaaacttcagactctgaaaaagcgcttaagtgcagttgaaggtaagcgtagtgacggcagtaagaacctgttggcaacgatggataaattgaaaagtattattgagcaaaaagagattgaaatcaacaatctcaaacaggagattgcgaaccaacaacaaacaatagctaatcagaaaaatacaattgcgagccaacaggtgacgatcgatgctcagagccaggagttaatgaataaacaacaggaaatgtggtataaattaggtactgaactacactctgtcgtagaagaattaccaaaagtaaaaggaagaaaagataagcggaatattaaaaataccagatactatattctgaacaaagcaaaagaatgttttgaacatgctgcgcaactgggacattcacttgccggttcgaaagcccgacaggtggaaggggagatgagtagattataa

SEQ ID NO: 4033 - DNA, 1779 bp, B.fragilis
cttactataatttacattgttaatcttacgggcttttatatgaaaaagacatctttgtttttgtcgttttttattgctctctttttgttttcggcttgtactgacgatactgagcaatgtctatattcccctaaagtttttgatacgggtaatctattgagcaatagagtgaaagaagaatttcttaattttgattatcctgccgggattgttccaattctttttgccgtagatagtatcgaggccatccaaatgggggcttatgctgatgaatgttttaatgatcttgtagattcgatatccgagtcaagagattttaagcatagagggatgttggtgcttgtttcgaaaaatccgaaactcattcaaatacgtttgggtaatcgatatagggtttattgcaatatgacaggagcaacttccggactggattatttagatttgcaaaagcaaatacaggagagaggtgtagaagaaactcttccattgtttctgcaaaacacttcagttcgtattcaggagttgaatgaattaccttcatataaaaaatatcgaatcaactctgcaatatcagtaatttctacctgtttggaatacataggaactccttcggagaacttttacggaaagtgtgttttaacccccattttaaaaataacatcatttgggtattatatttttaaatcatggttgttgaccttcatgtttgtatgtttgataatgcttttatgccgttggatgatatttctgctagtgaagcgtttattgggagagaatgttatagcccttatgtggactcaaaagatcattaattggggacttggtttattattttcaatttctgcagcagcttcggctattattttgtccagtggacgaatggaagatgcgatagcgttgcaggctattggaattccttttatggagaattttcagattgccgctgcagattatgttttgaaaacatcgtttgttgccgctttcttttttgttttaatgtatgcattgaaacgaaatatcgtatcagatatctttttaatgagtcttttggaaccagccaagcagcaggaagtttatcgtagtttgagcgatgctcaaaagactgctttggttataggacacgaagcggatctcaatgaagttgaaacaagttccgaaccatattccgaattgttcacttcgcgtgtatctaaacaggaaaccgtgactattgtttcattggcaatagcggctttatttttgattccgcggcctttgattataatgggtattgctttaaccatttacccgctggtcgggcaatgtgtgaagatttatcatgtggtgagtaatcatacgcttccggcacaaataaagggagatagaagaagggcattaataaccaatttacttatcatttttgcaatagcttttataactgttctgataggactgttttttaatcccatgccggataaaaaagaaattgatcggaatgaaataaagatggaattgattgctccggatagactggaaggaaattatactgttagtaaatctattgtggggcagatccaagtatccagtggtattataaaaaaggtgaaagatggaacgtttcaacttttgataaccggtaaatcttctcctaaagtgtataagttggattttaattctgataaaatgatatttgtttcaggagaactgggtaatggagcaatccactatgataaagatttggataaaattaaaatagtatttaatataaatgaacaaacgacatggacaatttcaaagtga

SEQ ID NO: 4034 - DNA, 1539 bp, B.fragilis
ctaaccacaatgagcaatagaatagttagccgaagtttgatgggagccctctgtagcgcatgtttcacaacagcaagtgcacaagaacgacccaatatcattgtttttttagtcgacgacatgggattaatggacacctccgttccctttgttacggacgaaaatggaaatgcacagagacaaccgttaaacgattggtatcgtactcccaatatggagcgcctggcaaaccagggaatccgcttttccactttttatgcacaaagcgtgagttccccttccagagcatccatcatgaccggacaaaatgcggcccgtcaccgcactacgaactggatcaatgcggaaagcaacaaccgcactccatacggaccattcgattggaattggaaagggctcactcatcaggatatgatctatccctatttattacaacaagccggataccaaacgatccatgtgggtaaagcacacttcggatgtctgaaaagcgaaggagaaaaccctgcgaatctaggctttgatgtcaacatagccggttcggcaatcggccatccgggtagttatcatggagaaaacgggtacggctggatcaagggtcaaagagcaagagccgtgcccgacttggaacaatatcacaaaactcacaccttcttaagtgatgcactcacattagaagccgataaagagatagaaaaagccgttgcagaaaaaaaacctttctatctaaacatggcacactatgccgttcactctccattcgaaaccgatgaacgcttcatcagccactataccgatccaaacaaatctcaacaagcacgcgcttttgccaccctgatcgaaggtatggataaatcgctgggagacattctggataaactcgaagatatggggatagcggaaaatactctgatcatctttttgggagataatggtggtgatgcaccactcggggatgctgccgattatggttcatccgccccattcaagggaaaaaaaggatcggaatatgaggggggagtccgtgttcctttcattgtcagctgggcacatcccaacccaaacaataaattccaaaaggcgtatcctatagcccggaatgccatacaaacccaaatgggaacggttatggatatatatccaaccgtactttctgttgcgggtgtcaaacctgctcccaaccatatcttagacggagccgatttaagaaaactgttaaagggaaagagagataaaaagcatcgtgatgatttcttaatgcatttcccacatgagcatcgcggcagctatttcacctcttatcgtaagggagactggaaattcatctattattataacccacagactccggaggcgcctacctataaactgtttaacctctcagaagatccttacgaaaaaaatgatctgtcaaaaacaaaccaacaaaaagcgaaagaactcttccgtctaatggttcaaagactggaaaaagaacaagccctctatccggtagatgccgataaaaacgtattgagtccaatatttgttgccgaataa

SEQ ID NO: 4035 - DNA, 1011 bp, B.fragilis
tttaatcgaatcatggaagaaattaaaattgcaggtgctgctttgccggctatgccttgggaagaacgtccggcaggatgtaaagatgtagtgtggcgttgttcggccaatccgattattccgcgcgacttgctccctacttcaaacagtatattcaacagtgccgtagttccgtttaaggatggctatgcaggggtgttccgttgtgatgatactaatcgtcgcatgcgtttgcatgtgggattcagcaaggatgctgttcattgggatatcaacgaagaaccgttaaagtttcaatgtgatgacgctgaggttggaacctgggtctatggatatgacccacgggtttgctttatcgaagaccgctactatgtgacctggtgtaatggctatcatggtcctactatcggtgtggcctacacctatgattttgttacttttcaccagttggagaatgcctttattcctttcaatcggaatggagtcttgttccctcgtaagataaacggtcgttttgcgatgttgagccgcccgagtgataatgggcatactccttttggagatattttctatagcgagtctcccgatatggagttctggggacgtcatcgtcatgttatgtcgccggctccgttcgaagacagtgcctggcagtgtaccaagatcggtgcagggcctatcccgattgaaacctcggaaggctggttactgatctatcatggtgtattggcttcctgcaacggttttgtgtatagttttggttcggcactgcttgacatcgatcagccctggaaagtaaaattccgttcggggccttatctgatttcacctcagaaggattacgaatgtatgggtgatgtgcctaatgtctgtttcccatgcgcagcgcttcatgattcggagaccggacggattgccatctattatgggtgtgcggatacagtgaccgggctcgcattcggatacattccggaaattattgaatttaccaaacgtacaagtatcatctga

SEQ ID NO: 4036 - DNA, 2040 bp, B.fragilis
atatccttgattcttttcccgatagagttttgcaactttgttgcacttgaaaactactacctttgcatcataaacctaatagtagattggattatgggacattgtaaatgtgaaatgaatgcaaatgtgcgagtagaaagctgtcaggaagcgaatggcttcataaaggaatattggaaggtaatactttcattattaatgttgatagcgggtgcaataatgaatcagttggatgttgcttttttcagagataatacgatatctttggtttggtatatattggcttatctgcctgtaggtttacctgtgataaaagaagcatgggagagtattcttcagaaagacttctttagtgagtttacgttgatgtcggttgcaacgttaggtgctttttatattggtgaatatccggagggagttgccgttatgttattttattcggttggtgaattatttcaggataaagcgatagacaaggctaagcgtaatatcagcgctttgctggatgttcgacctgaaaaggctgtggttgtgagaagtaatgagattgttacggtggatccgagatcggttcttataaatgaaattattgagataaaagccggtgagcgtgtaccgttggatggagtaatgttggatgaagtggcggcattcaatacggcggctcttactggagagagtgtgccccgggatattagtaggggagaagaggtacttgcaggtatgattgtcacagacaaagtaattcggatgaaagtgacaaagccttttgataaaagtgcattggctcgtattctggaacttgtagaggatgcttccgaacgtaaggcacctgcagaattgtttattagaaaatttgcacgtgtttatactcctattgttatcggctttgcatttctgattgtgttgattccatatatttattcatttataaatccgttgtttgggtttgtttttaatgattggctgtataaagcattggtttttctggtgatttcttgcccgtgtgcattggttatcagtattccattagggtattttgggggaattggggcagcatcccgattgggtattctgtttaaaggtggaaattatctggatgccataactcgtgtgaatacagtcgtattcgataaaacaggtactctgactaaaggagttttcgaagtagaatcttgtcgggttgttcccgggacttcagaagaagatttattgcgtgtagtggcttccattgagaaaaacagtaaccatccgatagccagggctattgtagcttatgcccaagataaagggattgatctgattgtcactaagaatatagaagagattgcaggttatgggttgatgactgagattgatggaaaaagggtgctggtaggtaataccagattgttatcgaaatattccattgagtttccgaaggctgtgttttcaataacagaaacaacggttgtatgtgctgtcggggataaatatataggttgtatcatcttatcggatgtgttaaaagacgatgcgtcagatactgtcaaggcacttaaagagttaaatattaagaatattcagatattgtcgggcgataaacagagtattgttaccatttttgcaaataagttgggaataactcaagcttatggtgatctcctgccggagggaaaggtggagcatattgagagattgaaggaggagaagggcaatcagattgcttttgttggtgatgggatgaatgatgctccggtacttgctctaagtgatgtgggtattgctatgggaggactgggtagcgatgccgccattgaaacggcggatgtagtcatccagaccgatcagccttcgaaagtggcaacagctattaaggttgggcgttgtacgcgtcggattatctggcaaaatgtattgttggcatttggtgtgaagttgttggtgctgattttaggggcaagcggtatagctactttgtgggaagctgtctttgcggatgttggtgttacattgattgcaattatgaatgctgttcgtatacagaaaatgattaaatga

SEQ ID NO: 4037 - DNA, 516 bp, B.fragilis
aaaaagaccttgattatgaaatttttgaaatttagtttgttgacagccgtgttgctgtcggtcgtgtttgctttcagttcgtgtggcgatgatgacgatacgggatatcttccgccgagccaggccattcaggatgcactgaagaagctttatcccaatgccactgccattaaatgggagcaaaagggcgtctattacgtagccgactgtcaggcggacggcagagagaaggaagtttggttcgatgccaatgccaactggctgatgacggaaacagagttgaacagtatcaataacctgccgccggcagtgttgacggcttttatggagtcgagttacaacaattgggtagtggatgatgtggtgatattggaatatccgaatgaaccttctacggaatttgtggtaactgtggaacagggtaaaaaggtagacttgtatttttcggaaggcggtggtttgctgcacgaaaaagatgttaccaacggtgacgacacacattggcccaggatttaa

SEQ ID NO: 4038 - DNA, 1269 bp, B.fragilis
aatagaatgatgaaagaagacgaaaaatggattaaagcattcaaggataagctcgaagattattcggagccgatgcctgcttccggttgggaacgactggaaagggaactgatgcctgtaaccgaaaaacgaatatatccgtatcgccggtgggcggttgctgcggcagctgtggtattggtgctaacgactgctgtcagtttgtattttctgaatagtccggtagctgatgaaatccgttatgcaacggctccttcactggctgtcaacccggatgtattgccggaacctgccttgccggatgtacaggtagctgtatccgaaccagttaagccggtaggaacgacgagtattaaccctgtttcgggctatttggcaaagaatactgatccggtgattgttccggaggtatcctccctggtagagaagcgaccggaggcagtgacggaggaaaagagatctgagccgcaacaggaagcaattgctgcaatcgagaaaaaagaaagtgcgacggcgcagcctccaaagaggaaagaagcgcggcgaccgtccggtaaagacaagtatcagttgcctatcggagactcttctgctaaacgtggtggtaaatggtcgatgggagtgggtatcggtaatggaggtggacttccgacaaatggttccgaaaattttgcgccccgtccgatgactaacagggtcgacttgatgacgatcatgaatggagctgtgagtattcctgccgatcaggaagttatatttgaagaaggagtcccttacctgaagtccaatacaactgccgtggtggattatgaacatcatcagccggttagcttcggactgtctgtacgtaagtctcttcccaaaggtttctctgtagagacgggattgacttatacgttgttgtcttctgacatcaaacggcagggggataccaagatgcagagtcagaaattgcattatataggtattcctgtacgtggaaactggaattttctggaaaagaaatattttacactctatgtatctgccggaggaatggttgaaaagtgtgtttatggaaagttggcggatgataaggtgaatgtgaagcctttgcaattttctgtagccggtgccgtgggagcgcaattcaatgcgacagatcatgtcggcctatatgtggaaccgggagtttcgtatttctttgatgatggctccaaagtacaaaccatccgaaaagaaaggccttgtaactttaacttgcaggcaggattgcgattcacttattaa

SEQ ID NO: 4039 - DNA, 1557 bp, B.fragilis
aaccagtcgatcatgaaaaagaaaatattaaatatagttttggccgcagctgtcacacctttcctgtgctgctgtaccgataattttgaggagtataataccaatccctatgaaccccattcactcaatccgcccatgctgtttgcaaccatgattactaccggaatcaatgtacagcagaatgacaatcagatgatcgatcaaatggtagccggacctttcagtggttatcttacgatggccaactcatggggtgggtccaacttcaatacttttaatcagacggaatcctggaatcagattcctttcaacacaccctttgaaaaattctattgcaattacttcaagttggagactgcgacaggtggaaaaggccactattgggcgatggcaaaactccttcgtgtgaatacaatgttgcgtgtaaccgattgttacggtcccattccctacagccaggtggccaatggtaaaacggctgttgcctacgatagccaggaagatgtgtataaacatatgtttgaagatctggattatgcaatacagatgttgggtgaatttgtagatgaagtggggggactgaaaccgttggagggttatgatccggtctataatggtgattataataaatggatgcgttttgctaattcacttaaactgcgtttggctgtccgcatcagtaatgtgtcccccgaacttgcccgtacgaaagccgaagaagcggtaaagagcacccgcggactgatagatacgaacgataataacgcgtatgtcggtgtaggtgccgagcctaatcctctttggctggtggcctccagttggggagagatccgtatcaatgccactatagccagttatatgaaaggatattccgatcctcgcagtgcagtctatttcaccacctccaagttgggaggcgatagcccgtatatgggtatgcggtcagggttggaaggagtgaagccggcaacttattcgggatattccatgcccaattacgaacagaaagacgacatgttgatgttttgtgcggctgaaaccgcctttttgcgtgctgaaggcgccctgcgtggttgggatatgggaggtagtgcccgtgacttctacgagcaaggcgttaagctatcattcgaccaacggaaagtgagcggggcagacgaatatctggccaatgcagtggctgtgcctgaaccttttgtcgatccggtaaacccggctaaatgtaattatacaccgaaaaccaagatcacgattgcctggaacgaaggtgcttcgacggaagagaaactggagcggatcattactcagaaatggattgctaacttccctctgggctttgagggttgggccgactatcggcgcacaggttatccggaagtgtttccatctgtcagcaatttgagtaatggagtgatcgacaccaatcggcaattgcggcgtttaccttttcccttgtccgaaaaacagggaaattcagccaatgtttcggctgccgtttcaatgttgggtggtccggataccggagctaccgatctttggtgggctaaaaagaattga

SEQ ID NO: 4040 - DNA, 447 bp, B.fragilis
atagaaaagatgaaaaccgtaaaactgattacttgcgatgatgcctttcaagctcatattatacagggagcacttgctaatgaaggtattgattctctattacataatgaaaatatgtcgaccttgttgcggggttttgtccatgacatctcaagagtggatgtcttggtggcggattgcgattatgaagcagccatacagttgctgaagcagaatcagatgatacccgaagaacagaagttttgtcctttctgcggttcggaccggattaagtttgttcttaaaaaggagcatcgtgtgagggctgtcagcgctgccattgtttctatgctggctactgtcccgcccggaggcaatcattgggaatatatctgcgaccattgtgggaaagctttcgaaaagccggttacggaattcaacccttctgctttggaagagaaagattga

SEQ ID NO: 4041 - DNA, 1143 bp, B.fragilis
cgatacgggatttacaggaaggagttattaataagaaaatctattgatttgccgacactgccctgccctaaaaaaagatatacaatgaaagtaaaattattgtttttggtcttcgttctgtatgcgtgtggaactaaaacggtttcggaagagaaatcttatgatcgaataaccatgacgacttatgaaaacaagtatgatgaaaataatcgtttgtcagaggtacaattgaccagaacatctcatcataggtatgaagaagattctgaaacaattgatttaattgatgataaaagcacgtattattatacgtatatcaacaacgaagagtttacggtaagaagaaagtcaaagaggtcgggaaatatcaagattatgagatatgctccccaaagggaggaggtgttaacattaaatgcccaaggggataccattgattatttattgcagaaatattacgataaaagtaaactcaaattagtgtatgttagaaatataaacaatgactatgtactgcatgaagacaacgactatgaggaaaaaaatgaatacgacgggaatggtaatctaacaaaaagagtgcaatactattttgacatagggaaaaaaagaaccacttacttctttcggggactatcttatgaggaagctaaaaaaaggattccccgtacagacgaggactatgacatcgtgtgcgatatagagaaaatggcaggagatacccttatcaggaaatgtataaagaatggtattgtcagttctattaacaagacgattgttgacgaaaaagggaaaaaggaatttatattcgacgctgacatgaagttcacaggtagtttcacggaatttaagtcggatggttttgatattcacgttgatcgtattgtactggacgattgcacggatattgatagcacttattataagaatgggaaagaggtaagatgcgtttatctttcggatacgtctaaacgtattgtactttctaaatatgataaatggggaaatatggttgagagggtggaaaagacaaagtatttttattcgcaagacggagaggcattgatcaatgaaatgctgcaagtagtgagagagaatgagaagaagaaagaaagtagaaagcgattgaaaatatcaaaataa

SEQ ID NO: 4042 - DNA, 273 bp, B.fragilis
ttgataaactttgataatgtgtgttgctccttaaaaagtaacgttcaagccaacggtctatataagaggcctcaactattgcatttacaactagacaccggcggtgtggtaatgacatctgctcaagtagcggaacaaataaaatcgattttcccactattctacatacaaggtaggtcctcaagggttatcattgatctacgttgctcctcgttctttattatgcagactgatatgttatatactaaaaaaagaaagtccttgaattattga

SEQ ID NO: 4043 - DNA, 570 bp, B.fragilis
ggtaaacacgtgtttaggagaatgaatgaattagagctgtcggaacgttgcaggcagggagataatcgtgcccgcaaagaactttatgagcagtacgcagggcgcatgcttggtgtctgtcttcgttatgccggagacagggacatggcacaagacttggtacacgacggtttcctgaagattttcgactccttcgacaagtttacctggcggggtgaaggctctctgagagcatggatggagcgtgtaatggtgaatacggctttacagttcttaagaaagaacgacgtgatgaaccagaccacggcactggatgaagttcccgaaacgtatgaagaaccggatgcttcggctgttgaagcaataccacagaaagtgctgatgcaatttattaatgaactccccgccggatatcgtaccgtattcaatttatacacctttgaagataagtcgcacaaggaaatcgcacagatgttggggattaatgaaaaatcttctgcctcacagctttttcgcgcaaaaagtgtattggcaaagaaagtgaaagaatggttggtgaccaatggttga

SEQ ID NO: 4044 - DNA, 726 bp, B.fragilis
atgataaacgtacactcatacgagtcaatgggaacattcgacgggccgggtctccggctcgtcgttttccttcaagggtgtaacttccgttgcctctattgtgccaatccggacacaattgaagccaaaggagggacagcaaccgaccctgaggaaatagttcgcatggccgtcagtcagaaagctttcttcggtaaaaagggaggtatcaccttttccggtggagagcctacttttcaagcaaaatcgcttatcccactttttaaaagactaaaggaagcaggaatccatatttgccttgataccaatggcgggctatggaacaatgatgtagaggaactattggaattgactgatctggttttattagatatcaaagaatttaatccggaacatcatcagtctttaaccggaagaagcaacgagcagaccctgaaaaccgcagcctggcttgaaaccaatcataaaccattctggttgcgatacgtattagtgcccggctacagtgacttcgaagacgatatccggcagctgggagagcatcttggaacgtaccagatgattcagcgtgtagaaatattgccttaccacaccttgggtgttcacaaatatgaagcaatgaacaaagaatatatgctgaaaggagtgaaagagaatactccggagcagatagaaaaggctgaaaaactattcaggcaatatttccggaccgtacaagtgaattga

SEQ ID NO: 4045 - DNA, 1164 bp, B.fragilis
ttaatagtggttaataccaaagttatattactaaatcaatttactatgcatacagacttgaagcccataaataaggatgcaagcaatcatgttcttacaaacctagagaagttagagaaaaagacagctgaagaacgtctaaaatttatggatgaagataggtatgaagaaatgatcacaaagtgggcatatttttgtttgaaggaagattcaaataagaaatatgaggatgtctttcgatatggtggtagtggcgatggtggtattgatgttattgctttctatgatttcaaaaatcaaatttgcgacatttatcaatgtaaacattataaagattcaataggttattccgatattaataaagaattatgcaaattcttgtataatacattcatcgattatataccattccctaaaacatactatcttgttgcaccccaaaatataacgggtcctttaggaagtttgtttaatgatcatgaaaaactaaggaatagattatgggaagattgggaaaaaagtataaagaaaaaattggcagtaaatattactaatgatgagaacgataaatttaagaagcatgtagatacatttgatctttcaataataaagcccctatctccagacaaaattattgaagggttaagaaaagaatattggttatatttccaatatctaggaattgatagaactttgataccaaggatccacgctgcccccccttcaactgtagcagattatgaatctacttatatcaaccatcttgtggatgcctattcagatgcgaataaatcgtcaattacacaaattaatctcaatgatgaaaatatggctatgtataaagcacatttcacagcatcaagagaacaattctatttggctgaatcagctgcaatgataggaaaagagatatgctctggaggaaatgatgaatacagtgaaattaaggataacattgaagagcatgttattgatgaatactactcacaataccatactgatggttttgaaaaagtaaaagctgtaacaaagagtgcatctcaatatcaggtagaagagatgaattccgttaaaccaattattagctcaagagtattaaaaggtatgtgttttcaattatcaaatgagaataaattgatatgggtaaagaaaaaaataaaatag

SEQ ID NO: 4046 - DNA, 408 bp, B.fragilis
accttttcggtttttatgggttattttattaaaataggattaggtatgactgaaataaaaataaaacgtgtatatgaggatccttctgatacagatgggtatcgtgttttagtagatcgcctttggccgcgcggaatgaaaaaagaacatttaaagtatgactattgggcaaaggaactgactccttcatctgatttaagaaaatggtttcatgacgatgttccgggacactggaaagagtttgcagagatgtatcgaaaagaacttgaaacttctgataaaacgtccgagtttttatcccggatacgatcctgtgaatcagtgactcttttgtatgcttcgaaggagccggtttataatcatgcccgtattttacaagcttttctggaggaacgtttgaaaaagtga

SEQ ID NO: 4047 - DNA, 1047 bp, B.fragilis
ataaattcatttatgttgagcgagaaaagaaacagtatgcttcacggggttttgttgatagccctgttttcatgtgcggccttttatataggtgacatggagttcataaagaaactctctttcagtccgatgattgtcggaatcattttgggcatgttgtatgctaacagtctccgaaacaatcttcctgagacgtgggtaccgggtatacagttctgttcaaaacgtattttacggataggcattatcctctatgggtttaagttgacttttcaggatgtattggcggtggggctgcccgcgatattgattgatactattgtagtaaccataacgattcttggaggtatcttaatcggtcgtatgcttaaaatggatcgtggagtggcgttacttacttctatcggtagtggaatttgtggtgcagcggctattttaggggccgaatcgaccattcagacaaaaccatataaaacggcggttgctgtttctactgtagttattttcggaactttgtccatgtttatctatcctatattatatagaaatggaacttttgtgctttcacccaacgagatggggatatttaccggtgctacgttgcatgaagtggcgcacactgttggtgcgggaaatgcgatggggaaggaggtttcggatgttgctattatcgtgaagatgattcgtgtgatgatgttggtacctgttttgttgataaccagttttatggtatccagggctgccgtgaaagctggtgggcaaggaggtagtatgaaggacatatctattccgtggtttgctatcggttttttagcggttatcggttttaattcctttgatctattgccacaaagtttaatagcttttatcaataatctggatactttcttgctgactatggcaatgactgcattaggtgcggaaaccagtatcgacaaatttaagaaagctggtgccaagccatttgtacttgcttctttgctgtatttatggctaattgtcggaggatattttttggtaaaactccttgctcctgtcttaatgtaa

SEQ ID NO: 4048 - DNA, 1056 bp, B.fragilis
tccccaaaattgaagtctatggcaggagaaataaacaaactgattccccaatatggagaactcaatagaatatataatgattgggtaaccaattatgctttttcttttgacaagcagaaattcatcaccgacttttacagacagcacaatgatacaaaggcttttgaagccgctatccttgaactggtacttgacaagcagaaagaacaatacacattgattctcaatagtctgaaaatcgaaatagaaaaaaatatacgggcttatgaaacaaaaccgctgaatgatgacgtcataaagcgtgtgtgttttcactacgcagacaggcataattctgcaattaaagaccagttggagattaccaccaagttgcacgagcctttgaatgacgcataccacagatatgatttcattggttttcgggagcatacggacgaagaagaaatacaggcagaaaaggaatatgaacgctgcaaggctgaatacgacaaggaaaagaaagaattggataaactttatgaactgcaaaagcaagacaggaaagaggcttttcaatatatagaaaacctttccggcaatgtttaccgcctaagtcttctttttatggaagtcctaaaaaagtaccttcctaatgatagggaagaaaaacagcaggatgaaccagtcaagcaaaacgaacaagaagaagtacagaatagcccggagggacaacatgaatattttgacatgaagcagctttcgcccattcatgaaacctgtgtcggggaacagttcgaagccattaccatagcggatttctatgccaatataaacctgtacccctgcaagaataaactaaaaatcaaggcaagggaaaagatacgggtgtgttacctgatattcctgatgagcgagaaactatccaagcaatacagggatgaatggagaagccaaatattaaaattgttggatattgacgagagctattacaggtcgaaatacaaagaacctgtttccgattttccgagtgacagcaaccagaaattcgcaaaggaaatggaaagcatattcggataa

SEQ ID NO: 4049 - DNA, 192 bp, B.fragilis
tcgggctattcctttatttcagtgttttgctatcctctaattcattatactacattcttttttacttttttctatatatcagtaattgacctgaggtcgacattatttaaaagattttcagttgtcgtcatttgtgaaatttacaccaatggctggttgttttttaaagagacaataaacggtaatggctga

SEQ ID NO: 4050 - DNA, 570 bp, B.fragilis
actgataattcgaatatgaaaaagcttatttatctgcttgggttggcaatgcttatggctgtcgcagcttgttccggttcggctgaaaagaaaaagagcgatatccgtgttttgatgcaggatagcaccgatgcacatggagtgcagcgcatgacggcccgtaagagcgaggtagatattaaatataaaggcaaagagtaccattcgtttatttcccgtacgcccaatgattcgcttccccgggtggtaagccagatggggaatacgtatgtcgacaatcagatagtgcttaggctgacgcgtggaaacgaacgtgttttcagccgtacttttaccaaaaagcagttcgagtctctgataggcgatgattttatggcgaaatctatcctggaagggattgtttatgataaaacgactcctgagggaatagtctatgctgccagtatctgctatccgcagacagacctgtatgtacctatctccatcacgatctcacccgatggaaaaataagtatgaagaaagaagagcttctggaagaggtgtacgatgaagatacatccgcccgttaa

SEQ ID NO: 4051 - DNA, 1104 bp, B.fragilis
ttcttaaattctcatttcatgaaaaccactccatttaccgagaaacatattgcacttggtgctaagatgcacgagtttgcaggatataacatgcctattgagtattcgggtatcatcgacgaacaccttacagtttgtaacagtgtcggtgtttttgatgtgtcacacatgggcgaattttgggtgaaaggtcctcatgcgttggattttttgcagaaagtgacttcaaataatgtggcagctttggtgccgggtaaaattcaatatacttgttttccaaatgaagacgggggtatcgttgatgacttactggtctatcaatatgaactggaaaaatatcttttggttgttaatgcttcgaatatagagaaggactggaactggtgcatttctcacaatacggaaggtgctgagttggaaaactcttcagataatatggcacaacttgctgtacaaggtccgaaagccattcaagctctgcaaaaattgacggatattaatcttgccgatattccttattatacatttaaagtcggtgagtttgccggtgagaagaatgtgattatttccaatacgggatataccggagcaggtggatttgaactatatttttatccggatgctgccatgaagatttgggatgcagtttttgaagccggagctgagtttggcataaaaccgatagggcttggtgcgcgtgatactcttcgtcttgaaatgggattctgtctgtacggtaatgacttggacgatactacgtctcctattgaagccggactgggatggatcactaaatttgtggacggcaagaactttacaaatcgttcgatgcttgaaaaacaaaaggctgaaggcaccgttcgcaaattagtgggctttgaaatgattgaccgggggattcctcgtcatggttacgagttgacaacagcggaaggtgataaaatcggggtagtaacatcaggtacaatgtctcctattcgtaagattggtattggtatgggatacgtgaaacctgaatatagtaagatcggtacagaaatatgtattgatatgcgtggacgtaagttgaaagctgtagtagtaaaaccgcctttccgtaaatag

SEQ ID NO: 4052 - DNA, 222 bp, B.fragilis
  unsure (198),(199),(200),(201),(203),(204),(205),(206),(208),(213),(216): Identity of nucleotide sequences at the above locations are unknown.
atgtctcaacaacaagaatattggttcgctgcccgtacccgtaaggatcaggagcttactactcgtgacgcattagagaaaataggtgtcgagtattttttgccgacccaatttgtcattcgtcaattgaaatatcgccggcgtcgtgtagaagttcctgccattcgtcttcaccaggggtgcaaaggccctcagggnnnngnnnntncaaanggngttcta

SEQ ID NO: 4053 - DNA, 1905 bp, B.fragilis
agatcgttatcgtatagattattaatcattaatcacttaaaaaagagaatggataaaaacaccatcacaggcctcgttttaataggtatattactggtaggattcagttttctgagccgtcccagcgaggagcaaatagccgctcaaaagcggtattatgactctatagccgtggtacagcagcaagaagaagcactgagagccaaaaccgaagctgcgctggctaacgaaaaagaagaaacagcagccgactcagcatcgctcttcttcagtgccaccaaaggtaaagaggcgtttactactatccagaataatttggtagaaatcactctggataacaaaggcggccgtgtttactctgccctgttgaaaaactacatgggacaggataagaaaccggttgtgttgttcaacggcagcgatgcttccatgaacttcaacttctataacaagaagggggccctccagacaaaagacttctattttgaagcagtcaataaaacagatagcagtgtaacgatgcgtctagctgccgacagtgccagctatatcgatttcatttatacactgaaacctgataactacctgatgagctttgtgatcaaagctacgggaatggacggaaaattggctgccagcacaaactatgtggacatctcatggtcacaacgtgcccgccagatcgaaaagggatatacttacgaaaaccgtttggcagacctcacctacaaatacaccggtgatgatgtggataacctttcggcaagtaaagacgacgaaaagtccgtttcggaacgtctggactggatcgctttcaagaatcagttcttctcttccgtattcatcgcagaacaggatttcgaaaagactacggttaaatcgaaaatggagaaacagggaagcggttacataaaagactattccgccgagatgagtacgttctttgatccgaccggcaaacaacctaccgatatgtatttctacttcggcccgaaccactacaaaacgttgactgcgttggataagggacgtgaagagaaatgggaacttaacaacctggtatatctgggctggccgctgattcgttggattaacaaatggatcaccatcaacgtattcgactggttgtccggctggggattaagtatgggtatcgttctgttgttactcaccatcatggtgaaaatagtcgttttcccggcaacatggaagacctatatgtcatcagccaaaatgcgggtgctgaaaccgaaaatcgatgaaatcaacaagaaataccccaaacaggaagatgcgatgaagaaacagcaggaggtgatgggattgtacagccagtacggtgtaagcccgatgggtggctgtctgccgatgttgttgcaattccctatcctgatggcattgttcatgttcgtaccgagtgctatcgaacttcgtcagcagagtttcctttgggcggatgacttgtcgacttatgacgcattcatcactttcccgttccatattccattcttgggtaatcacctcagtttgttctgcttgctgatgactgttaccaacatcctgaatacgaagtacacaatgcaacagcaggatacgggtgcccagccgcaaatggctgcgatgaagtggatgatgtacctgatgccgatcatgttcctcttcgtcttgaacgactatccttcgggattgaactattactactttatttcgactctgatcagtgtagtaaccatgatcatattgcgccggacaactgacgaaaacaaattgcttaccgaactggaagctaagaagaaagatccgaaacagatgaagaagaccggatttgccgcacgcctggaagctatgcaaaaacaacaggaacaattggcaaaagaacgggctaataagcagaataagaaataa

SEQ ID NO: 4054 - DNA, 576 bp, B.fragilis
cgcattaagtccctttcaccttattataaatgcaaattatcactatatttgccgtataaattgaaaaatacaacaaacatgtttactatccgaaaagcaacctcagatgattgcaaactgattaacgaactggcaaaccaggtatttcccgccacttacaaagaaatactttcgaccgagcaacttgactacatgatggagtggatgtatgcacccgaaaacatccgtaaacaaatggaagaagaagggcatgtatactttatcgcctatcagggagacgaaccttgcggctacgtctctgtccagccccaggatgccgatgtgtttcatctccagaaaatatatgttctccccggctttcagggggcacatttaggcagcaaactatttgatcacgcagtgcaatatatcaaagagatacacccgtctccctgcctgatggaactaaatgtaaaccgaaacaacaaagcgctgcacttttacgaacataaagggatgaagaaattgcgggaaggagacttccctatcggaaacggatattatatgaatgactatattatgggattggaactttga

SEQ ID NO: 4055 - DNA, 432 bp, B.fragilis
attatgatgcctgttagaagatctcagaattggttaccaagtatctttaatgatttctttgataacgaattaatggctaaagcaaatgctaccgcacctgctattaatgtaattgaaaccgataaggcctataaattagagttggccgcaccagggatgactaaggaggatttcagcgtacggattgatgaagaaaacaacctggtaatttcaatggaaaagaaagctgaaaacaaggaagaaaagaaagacggtcgctatttacgccgtgaattttcatattctaaattccagcagacaatgattctgccggagaacgtagataaagatcacatctccgcgcaagtggaaaacggtgtcctgaacatcgaactacccaagttgagtgaagaagaagtgaagaaacctgacagaaccattgaagttaaataa

SEQ ID NO: 4056 - DNA, 342 bp, B.fragilis
ttttataataccatgaaaagatattgccaaacactcgaattatataatgattcggaattgattcgtgcttatgtcgcagaacatcagcatgtgtggccagaaattaaagccggtatccgtgaagtcgggatactcgatatgcagatttatatccacgaacatacactctttatgattgtcgatacggtagatgaattcgattggataaaagataacgagcgcttggctaaacttccccggcaggcagaatgggaggcttatatgtctcgctttcagcgttcattgcccggacaagcgtcacatgagaagtggaaaatgatggaacgtatatttaaactctga

SEQ ID NO: 4057 - DNA, 1317 bp, B.fragilis
caaaatacaacgaaagacatgatttggaatgagagcatcgaatgcatggaacgcgacaatttgcataaaatccagagcattagactgaagaaaatagtagaatacgtttatcataatacgccgttctatcgtaaaaaaatgcaagagttgggcatcacacccgatgatattaacgggatagaagatatatccaaattaccatttaccactaaattagatttacgcgacaattatccgtttggcttatgcgctgtacccatgagccagatcgttcgtatccatgcgtcctccggtactaccgggaaaccgactgtagtgggatatacccgtaaggacttatcgacttgggcagaatgtctgtcgcgtgccttcacagcttatggtgccggccgttctgatatatttcaggtatcttacggttacggtttgtttacgggcggactgggtgcacatgccggtgccgagaatatcggagcgtcggttatccccatgtcaagtggtaatacggaaaagcagattacattgatgcatgattttggctcgactgtgttatgttgtacaccctcttatgctctttatctggctgatgcgattaatgactcaggttttccacgcgaagaatttaaactgaaggcgggtgctttcggtgcggaaccctggacggaaagtatgcgtaaagacatcgaaaccaaattgggcattaaggcttatgatatatatggattgagtgaaattgcaggtcccggtgttggatatgaatgtgaatgccagaatggtacgcacttgaatgaagatcacttcttccctgaaataatagacccgcatacattgcagcctgtagaacccggacagaccggggaacttgtttttacccctctgacgaaagaaggtatgcctttattgcgtacaagacaaaaagttttgccagttttgcattatgaaaaatgttctgcggaacgtatttgggtgcgtatgggccgcatcttggacgtaagtgccgatatgcttattatccgtggagtcaatgtattcccgacacagatagaatctgttattctggaaatggcggaattcgagccacattatctgttgaccattgaccgcaagaacaatacggatactatggaactgaaggttgaggttcgtcctgactattattcggatgaaattaacaagatgctggctttaaagaagaaattgacaggtcgcttacaaagtgtattaggtctgggagtagacgtgaagctggtagagccgcgcagcattgaacgcagtgtgggcaaagcgaagcgtgtgattgataatagaaaactataa

SEQ ID NO: 4058 - DNA, 3102 bp, B.fragilis
aaggaaaaaacagatatactaagttattacataatgaacaaacaaacatcaaccccttctcagattcatcgacttcagcagaccatttatgaaaatcttcctgtaggaatggaattgtacgatggcgatggatatctgatagagattaatagtgtgggactaaagatgatgggagtgaaggataaacaagatatgttgggaatcaatatctttgagaatccgaatattccggtggagatgaagaggcgtctacgtgcgggagagaatatccgttttacggtcaaatatgattttgacctggcaaaagcccattatccgactgttttatcaggaatcagttattttgaaattgctgtatcggtcgttctggatgaaaataaggagattgataagtttcttttcatagcacaggatgtgactgaagctgtgcatactcaagagatattgcggcaaagcaagcaaaaaacggcattggccatgcaggctgctgaggtgatgttgtgggaatttgatgtttgtacccggttgttttatgcggagaatgaacctcttaatggttatgatcctacccaagcactcactatcgaagactataagaaacagattcatccggaggattggaaaaaagcggagattatcctattggatatgctcagtggttgcgattgtctgtatgaaatagatttccggatcaggttgtccgatacatccgaatggcaatattgtaaactgaactgtaccccgtatgaaagagggacggatggaaaggtaattaaatatgtgggttttcgtaaaaacaatacggagctgcaaaggcgcaagctgctacaagagaatattttgaacagcataccgcttcccattcatataaaagatgtggaagatgattttcgttatgtcttctgcaatgaagaaagcatgcggatgttcggcacccatgagggtgaaaccgtatgtagcgttctggatagcgaacaggcggaacgtatgcagaaaacagatctggaagtcttcactaccggaaagccttattttggggtagaaagaatcatattgaaagacggacgcagctatgataccatcgtgcgcaagaatatcatctatgatggcaccaagcgtctgttgcttaatatccgctgggatcagaaattgcagaatgatcttaagcgccgtgctaaagtgctctctatgtcaatggaagtaatgaacgcttatacctggttttacgagccgtcaaaacaaagggtaagctttggtgaaggatttgataagatcgggcggaatgctttggatatcaactcgtttgaaaagtttgcagagtgtgtgcaccctgatgatcggcaacggtttgtcgatacaatggatgcggtgctcaaacaggatagcggcgaatgggatatagaatatcgtgctgatctgagaggaaacggaaactatgaatggtggaaaacccgcggagtacttgaaacctccatactcaatgatcatccttatcagtatgtttccggaatgtcaatcagcatcgaatcctacaaacagacagagttgactctgctgaaaaataaagaaaagctgaataaacttatccgacagaatgaactggtattgaataacactaattcggggttggcctatatcacgacagattatgtagtacaatgggaaaatgtgtctgtctgttcatccagcctctcttttgaggcttataaaagaggagaatgctgttataaaagtgctcataatcggacttctccttgtgacaactgtgtgctaagcaaagtattggtatcaagacagatggaaaagatcaagtttcatctggagaataaccggattgtagaagtgctggctactcctgtatttaatgaaagtgaagagatcgacggtattgtcattcgtgtggatgatattactgacagggagaggatgattgaggagttgagacaggcgaaattgttggccgaacaatcggataagctcaagtcggcctttcttgccaatatgagtcacgaaatccgtactccactaaatgctattgtcggcttctctgacctattgatgaattcggaagaacagggtgataaagaagaatacatgcagattatcaataccaataacgaattgctgctgaaacttattaatgatattctggatttgtcgaagttggagtccggttcggtggagctgaaatatgaggaatttgatctggcagaatatttcgatagtatggcatcttcaatgaagcaacgggtgacaaatcctaaagtgcagttggtcgcggtgaatccttatagtgtgtgccgggtgagacttgacaaaaatcgggttgcacaagtggtgactaattatgtaactaatgccatcaaatatacgccgcagggaactatcgagatgggatacgaggtggtagacgccggaatccgtctttatgtaagggataccggcatcggtataccggaggagaaaaagaggaaagtctttcatcggtttgagaaattggatgaatttgcacaaggcaccggtcttggactctctatatgtaaggctattaccgaatcgatgggaggaagtgtcggttttgaatcggaatatagccggggatctcttttctgggctgttctaccttgcgatccggaggtacaaatgcgtcgggagtccaatatcgccattggacagaatacaggtaaagatgatctgatacgtagcggaaatcagtattcggctttggatagaaaaacagtcttggttgtagaagatatttcaagtaattatctgctgatatcggctatgttgtccaaacattataatttgcttcacgctgtgaatggggagcaggctgtagcgatggtaaaagagtataaaatagatctcttgttgatggatatgaaaatgccggtaatggacggactgacggcaacagctgagattaggaagtttgatacgaatattcctattgtagctcttacagcgcatgctttcgagtccgacaaggtagctgcgctgaaatccggttgcaatgattatctcgtgaagccggtggataaagcaagactaatgtctgtattgcgcaaatactgccacccttcaactcttgttttataa

SEQ ID NO: 4059 - DNA, 2214 bp, B.fragilis
agaaaggaaactggcagaaaaagcagatttgacctgatttttgcttatcttcgcagcactattatggaagagaacacaagtaaattactaattattaaaataactatgagacaagtaaacctatttattatgtcggcagcaatgatgttagcatcttgtggtggaaccaaagatgcaggcaaaacagatcaggcgctgatcggtaaatccgatatcaagatcgaaggaaagcggatgactcccgaagcgctttgggcgatgggacgtatcggcggactggccgtatcgcctgacggaaagcaaatagcctatactgtggcttattacagtgtccccgagaacaagagcaaccgggaagtttttgtgatgaacgcggatggaacggataatcgacagattacccacactccttatcaggaaaatgaagtgacttgggcggcagacggaagcaagctgctcttcctgagcaatgacaacggcagcagccaactgtatgaaatgaatccggacggtagcggacgcaagcagatctccaagtatgacggagacatcgagggatattccatctcaccggacggtaaaaagatactcttcatcgctcaagtgaaaacagtaaagagcacggctgataaataccccgacctggataaagcgaccggaatcatcatcaccgacctgatgtataaacattgggacgaatgggtgaccaccgctccacatcctttcatcgccgactttgatggcaaatcaatctccaacatcatagatgtgctggaaggagaaccttacgaaagcccgatgaaaccttggggaggtatcgaacaattggcttggaatacgacttcggacaaggtggcttatacctgccgcaaaaaaacgggactggcttatgccatatctaccaactcggatatctatgtatatgacctgaataccaagaaaacagtaaacatcaccgaaggtatgatgggttatgatacaaacccgcaatattctccggatggaaaaagcattgcctggcaaagcatggagcgcgacggttacgaagctgaccagaaccgcctcttcgtcatgaacctggaaacgggcgagaaacgttttgtaagtaaagctttcgattcgaatgtagatgcattcgtatggagccgggatgccaagacgatctacttcaccggtgtatggcatggcgagacacaaatttattcactcgatctgtctaacgattccgtacgccccgtcacttcgggtatgtacgactacgaaggtgttgccctctttggagacaaactgattgccaaacgccattcaatgagtatgggtgacgaaatttacgcaatagctttggacggacaaaccacgcaactgacccaagagaacaagcaaatctatgaccagatcgaaatgggtaaagtagaaggccgctggatgaaaacaactgacagcaaagagatgctgacatgggtcatctatccgcctcaattcgatccgaataagaagtacccgacactgctcttctgcgaaggtggtcctcagagtccggtaagccagttctggagttatcgttggaacatgcagattatggccgccaacggttatatcgtcgtagctccgaatcgtcgcggacttccgggcttcggattggaatggaacgaggctatcagcggtgattacggtggtcaatgtatgaaggattatttcacggctatcgacgaaatggccaaagagccgtttgtggatagtgatcgtctgggttgtgtaggtgccagcttcggaggattttctgtgtattggttggccggacatcacgacaagcgcttcaaggcatttattgcccacgacggtatcttcaatatggaaatgcaatatctggagacagaagaaaaatggtttgccaactgggatatgggcggcgcttactgggaaaaacagaacccgacagcccaacgtacatttgccaattctccccatttgtttgtcgaaaaatgggatactccaattctctgtatccacggtgagaaagactaccgcatccttgccaaccaggcaatggctgcattcgatgctgccgtgatgcgtggtgtacctgccgaattactgatttatccggatgaaaaccactgggtactgaaaccacagaacggtgtactgtggcaacggactttcttcgaatggctggatcaatggctgaaaccaaacgaaacggcacagaaataa

SEQ ID NO: 4060 - DNA, 1671 bp, B.fragilis
tattctaattttatgtttgaaggacaacctaagggtttgtatgctctggcacttgccaacacaggcgagcgattcggttactacaccatgcttgcgatttttactttgtttttacaagcaaagtttggttacactgctgctgaaacttctactattttcggatgttttttggctgctgtttattttatccccttctttggcggtattcttgccgataagtttggttatggtaagatggtgacaatgggtattgtggtcatgtttattggctatgcgctactcgccatcccgacttccgataactccggcaaaataatgatgttcggtgcgttggccctgattgcttgcggtaccggtctttttaaaggtaatttacaggtgatggtgggtaatttgtatgatgcccccgaatatagttccaaacgcgacactgcattcagtattttctatatggctatcaatattggcgcaatgtatgctccgacagccgcaacgaaagtaaccaattatatgttgggcaaggcaggtctgtcgtatgtccctcagattccttcattggcacatcaatatctcgatggaacaatcactcctgccaaccaggctactctggaatccttgcaggctgcacaaaactttaccggtgacattgccactttctgtactacttatatcgataagctctccgaagcttacaactatggatttggtgtggcatgtgtgtccttgattatttcaatgcttatttatgtagctttccgttctacattcaaacatgcggactataactctaaacaggctaagccggccaacgtggtagaagagaagttgactccggaacagactaaacaacgtatcgtagctctgttgcttgtgtttgccgtagttattttcttctggatggctttccatcagaacgggttgacattgacattcttcgctcgtgactatacggcacaagaggtgaccggtctcgaccgtctgggcttcaatatcgtgaacctgaccttcttgctgatcgttatctacggactgttttcactgttccagggtaaaaccggaaagtcgaaaacgattgccggtgtagtagttatggtggcactcctctgcttgggatggagttatacttctatggatcctacaatcaacatcctgccacagatcttccagcagtttaatccgttcttcgtgatcgctttgactccggtttcgctggcagtgttcggctatctggccagaaaaggaaaagaaccttctgcaccgcgtaaaatcggtatcggtatgatgattgccgtatgtggtttcttgatcatggctatcggctctatcggtctgcctactccggacgctttggctgccagtggcattgagaaggatgcgttggtttctccgaactggttgatctccacttatctggttcttacttttgccgagcttttcttgtcgccgatgggtatctctttcgtttcgaaagtagctcctcccaagtacaaaggtatgatgatgggtggttggtttgctgcaactgccattggtaactacctggttgccatcatcggttatctgtggggaggcatgcaattgtggatggtatggagtgtgcttatcgtatgctgtttgctggccgccctgtttatcttctctatcatgaagaaacttgaaaaggtagcataa

SEQ ID NO: 4061 - DNA, 621 bp, B.fragilis
acaatacattatatgagtaagaaagaaacactcaagcaacaaattctcgatttaacccgggaatactacaaagaggttcacgggtcctcccgttccttcgaacccggtaagagttttgtcaactacggcggccgttattttgatgaccgcgaactggtgaacctggttgactcatcccttgatttctggctgaccgccggtccgtgggcccggaagtttgaaatccgttttgccgaatggttgggtgttaaatattgctccctgaccaattcgggctcttcggccaaccttcttgcctttatggccctgacctcgccgcagttgggtgagcgcagaatcaggcggggtgatgaagtgatcacggtagcctgcggctttcccacaaccgtgaccccctgcatccagtatggtgcggtccctgtttttgtggatgtcaccatccccgagtacaatatcgacgtgactcaactggaagccgcattatctcccaaaactaaagcggtaatgattgcccactctttgggtaacccgtttgatttgcaggctgtcaaagatttctgtgataaacataacctctggttggtagaggataattgtgatgcccttggctctactgtcttc

SEQ ID NO: 4062 - DNA, 570 bp, B.fragilis
aggaaagattattgcagaaatattttgagcgtacatgtacgtgtattatctttgcaccatcaattaagcaagaagtatttaactaaaaaaagaaaaatgaaaaagaaagctatttttttattgaccattttattaatggcaagtttcgtaacaagctgttcaagcgatgatgataatgaaaaaacagagttcacatcaacactaacagcgaatggaagtgcagttaaaattacaaatctcgaaggtaaagcaatagcaggctctatatacgagttttggataaatgatgcaacatctgatttttatattcaagggaatatcacatctcatgaagtacatacttcgggaaaggacgttaccaaagactgtaaaatgatgattgctttagtgaataatgaagaatggtatacctccgaaaaagagtacgtttctggtactgttacaatagaaaaatgggatttggaaaatttcaaagttacacttgtatttaaggattataaatgcaaatcgggttcaaagagtattgttttgaacggcagtgttacctttccaacatccataaatatttaa

SEQ ID NO: 4063 - DNA, 1431 bp, B.fragilis
cgaaaccgttacggggaggtagaagccctgaaaagtgctaccttttctgtaaatcccggcgaattattcggtattatcggcccggacggagcaggtaagagcactctcttccggatattgaccacattgttgctggccgatagcgggacagctacagtgaacggactcgatgtcgtgaaagactacaaacaaatccggcaacaagtgggatatatgcccggacgcttttcgctctatcaggatctgacagtggaggagaatcttgactttttcgctaccgtgtttcatacgaccattcgtgaaaactacgatctggtgaaagatatctatcagcaaatagagcctttccgtaaacgcagggcaggagctttatccgggggaatgaagcaaaaacttgctctgagttgtgcgttgattcataagccggagattctttttctggacgagccgactaccggtgtggatcctgtttcgcgcaaggagttctgggaaatgctgaggcatcttaaggatcaaggtatcacaattcttgtttccactccgatcatggacgaagcccgtcaatgcgaccgtatcgcttttatcaatgagggcgagatacaaggtatcgatgtgccggaacgtatcctgcaacgtttcagccatattctttgcccgcccggtctggaacgtacggaagtgcacgccggaaacgattttgccatcgaggtggatcaattgaccaagtgtttcggtcattttaccgcagtcgatcatatctcctttcgggtaaaccgtggagagatcttcggatttctcggagcaaacggtgcagggaagaccactgctatgcgcatgctttgcggactgagtaagcctacttcgggcatggcgcgggtagcaggttttgatgtagcggctcaccccgaagaggtaaagaagaatatcggttatatgagccagaagttttcgttgtatgaggaccttaaagtgtgggagaacatccgcctctttgccggaatttacggaatgcaggatcgggaaatagccgaaaagacagatgctcttcttgatcgcctgggcttcagcggagagcgtgacacacttgtgaaaagcctgcctttgggatggaaacagaaactggccttttccgtttcaatcttccacaatccccggatcgtgtttcttgatgaaccgacgggaggagtcgatccggctacccgccgtcagttctgggaactgatttatcaggctgccgaccgggggataacggtctttgtgactacccattacatggatgaagcagaatattgtaaccgtgtatctatcatggtggacggacgtatcgaagcacttgacaccccccgtgggttgaaggcgcattttcatgccgatacgatggatgatgtattccaacaactggcccgtaaggcagtgcgtaaagctgattag

SEQ ID NO: 4064 - DNA, 339 bp, B.fragilis
acaaaaattctatggatgtcatgcctgggccgaatgctacctcaaacaatacggatggatggcagtagacccccaatccggaaaaagctggttaccaacaactataatccgactttttgccggaacagattatacagactgtggattaaactcttttatggacctagtacccaagtctatagaaatagtaaaagaataaatgtacatcaaaaatataaaaaggaaaataatgctcagataatcatggaacaacaacctcaactcaacgaccacaataaacaagaatatcccccgatgcacacggcagagataaacacacccttaattaatcagctataa

SEQ ID NO: 4065 - DNA, 1359 bp, B.fragilis
ataaaaagctattacgcacataataaaatgtttaaaaacagcaaaaagaaaatcacacttggcgttagtgtgcaaaaatttgagaacaaacctaataattggaaaatactaacctataaacgccatacaataaccatagaggaacttgtaaaccttatttgcaaaggacactgcatttgtcaaaacttcaaaacaacaagcgaaatatttggacttagagaaaaaacgattgccaattttgactttgcagattgcgtaatattggatattgacgatacatttctatccatgaacgacttttacttatcattaaaagatgaacacaagccgaccatcatttatactacgtatagcaatattgataatataaataatagatttagaccgatttatgtttttaatgagccgataagaagcaatgaatattatagggggatagctaatactattgtttataatatccaaaaagagattgaaggttttgacttaaaagacaaaacatgtttaaatgcttcgcaacaattcgctggtaatggtaatgacaacattgtgtattactataatgataacatattttgtcctacggattttggatttgatgaaaacagtttttccaattcagatagtatattaaaaagagagaggaagaacaacatacaaattgacttggaaagtctgattggtaattctgaatttatgaaggacttttggagcatgggctataaaaaaaatgaagaaattttcatacgtaagtatgcccaaatatacccatttattgaagccaccccattacctgaaacagattcagatacaccttatatattactgcccgacaattatgtaaagattgcccgatattggtacaaagagccactaactaaaggtgacggaacaattgtctataaaagccatgcagttaaattaaagtcaggacacagaaggaagttactatatgacggttgtctgcttcgcaagattatgttacctaaaattacaatggaacatttgttgtattgtcttgtatgtgaacgcagatactacgtagataaccaagataaggttattaccaacaagatactgtaccaaattgcaaaagacgcttggaatgataccaaacgaagtattaaccccaaaaaagaagaaagacagtttgttgttaatcctaagtattgtgagaaatacggaataagcaaacaagcagctcgaaatatagctgccaaaatattattggacttacaactcaaacaattatacgatacgaatttatcggttaaagaaaatttggaatcgctaaaaaatcagggtatcaaaatcggcaaaagcagtctctataattgggtaaaatcacaaaaaatatag

SEQ ID NO: 4066 - DNA, 186 bp, B.fragilis
tgtggattatatccttctccaccgatgacattactgtacataaacggaataccatcattaaaaataaatcttccgtatattgtcggtataataaatgtatttagtgcgattggaaatatcttagtgatttgggtagcaagtgatgagtatgcagtgttggtatgcaaatcggtatgtattgtataa

SEQ ID NO: 4067 - DNA, 2877 bp, B.fragilis
tggaacgtatatttaaactctgacaatatgcaaaaactactatctttaccgcccaatctggttcagtcttttcatgaactggagagggtgaaccgtaccgattggttttgtacttccgacccggtaggtaagaaacttggttccggtggtggaacatcctggttgcttgaagaatgttataatgaatattcagatggtgctacttttggagagtggcttgaaaaagaaaaaagaattcttcttcatgcgggtgggcaaagccgtcgtttacccggctatgcaccttctggaaagattctcactccggttcctgtgttccggtgggagagagggcaacatctgggacaaaatctgctttctctgcaacttcccctatatgaaaaaatcatgtctttggctccggataaactccatacactgattgcgagtggtgatgtctatattcgttcggagaaacctttgcagagtattcccgaagcggatgtggtttgttatggactgtgggtagatccgtctctggctacccatcatggcgtgtttgcttccgatcgcaaacatcccgaacaactcgactttatgcttcagaagccttcgttggcagaattggaatctttatcgaagacccatttgttcctgatggacatcggtatatggcttttgagtgaccgtgccgtagaaatcttgatgaaacgttctcataaagaaagctctgaagaactaaagtattatgatctttattccgattttggattagctttgggaactcatccccgtattgaagacgaagaggtcaatacgctatccgttgctattctgcctttgccgggaggagagttctatcattacgggaccagtaaagaactgatttcttcaactctttccgtacagaataaggtttacgatcagcgtcgtatcatgcaccgtaaagtaaagcccaatccggctatgtttgtccaaaatgctgtcgtgcggatacctctttgtgccgagaatgctgatttatggatcgagaacagtcatatcggaccaaagtggaagattgcttcacgacatattattaccggggttccggaaaatgactggtcgttggctgtgcctgccggagtgtgtgtagatgtggttccgatgggtgataagggctttgttgcccgtccatacggcctggacgatgttttcaaaggagatttgagagattccaaaacaaccctgacgggtattccttttggtgaatggatgtccaaacgcggtttgtcatatacagatttgaaaggacgtacggacgatttacaggcagcttccgtattccctatggttaattctgtagaagagttgggattggtgttgaggtggatgttgtccgaacccgaactggaggaaggaaagaatatctggttacgttccgaacatttttctgcggacgaaatttcggcaggtgccaatctgaagcgtttgtatgcacaacgtgaagagttcagaaaaggaaactggaaagcattggccgttaatcatgaaaaaagtgttttttatcaacttgatttggccgatgcagctgaagattttgtacgtcttggtttggatatgcctgaattattgcctgaggatgctctgcagatgtcacgcatccataaccggatgttgcgtgcgcgtattttgaaattagacgggaaagattatcgtccggaagaacaggctgcttttgatttgcttcgtgacggcttgctggacgggatcagtaatcgtaagagtaccccaaaattggatgtatattccgatcagattgtttggggacgtagccccgtgcgcatcgatatggcaggtggatggaccgatactcctccttattcactttattcgggaggaaatgtggtgaatctggccattgagttgaacggacaacctcccttacaggtctatgtgaagccgtgcaaagacttccatatcgtcctgcgttctatcgatatgggtgctatggaaatagtatctacgtttgatgaattgcaagattataagaagatcggttcacctttctctattccgaaagccgctctgtcattggcaggctttgcacctgcgttttctgctgtatcttatgcttcattagaggaacagcttaaagatttcggtgcaggtattgaagtgactttattggctgctattcctgccggttccggtttgggcaccagttccattctggcttctaccgtacttggtgccattaacgatttctgtggtttagcctgggataaaaatgagatttgtcaacgtactcttgtccttgaacaattgctgactaccggcggtggatggcaggatcagtatggaggtgtgttgcagggtgtgaagcttcttcagaccgaggccggctttgctcaaagtccattggtgcgttggctacccgatcatttatttacgcatcctgaatacaaagactgtcacttgctttattataccggtataactcgtacggcaaaagggatcttggcagaaatagtcagttccatgttcctcaattcatcgttgcatctcaatttactctcggaaatgaaggcgcatgcattggatatgaatgaagctatacagcgtggaagttttgttgagtttggccgtttggtaggaaaaacctgggaacaaaacaaagcattggatagcggaacaaatcctccggctgtggaggcaattatcgatctgataaaagattataccttgggatataaattgccgggagccggtggtggcgggtacttatatatggtagcgaaagatccgcaagctgctgttcgtattcgtaagatactgacagaaaacgctccgaatccgcgggcacgttttgtcgaaatgacgttatctgataagggattccaagtatcacgatcataa

SEQ ID NO: 4068 - DNA, 1230 bp, B.fragilis
ttatatggatactggctgtcgttatttttgtcatcaacctctcttacctgggatggccttatcctttcctttgggtcggatgacgtgaaatgccaattagttgatgatcatagaaatgcttcccgtagtgtgtccgggaggcattttttttctcataaaaatacggttttgtgcaacgaaccgcaaatcttttgttatttttgtttgttactcatcgaaaagaatacgtatcatatgggcgagcatatatgtttcagaagaaatgaaagactggcaacggtcaatcctcactggcggggcaatcctgtagtaagaggaaagtttgtcaatcgccagcatcgatttcgtcccggaatggggagtgtgttgaagtggcgtctttcgcccaatccgcagcggaaagagaaaaagagtgtgaagtggagccccaagttgaattatctgcgttcgctggatggcgtggtaggcaattcactgatttggctcgggcataattctttcttcctgcagttgggtaggaagcggatcatgttcgaccccgttttcggcgatattcctttcgttaagcggcaaagtgattttccggccaatcccgatatatttaccgatatcgattatctgctgatcagtcacgatcattttgatcacctcgataagcaaagtgtggcacggttggtaaaaaacaatccggggatgaaactcttttgtggcctgggcaccggggagctgatcaaaggatggtttcctgagtttgaggtgacagaggctggctggtatcagcagatagaagatgacgggctgaaaataacgtttcttcctgcacaacactggagcaaacgttccgttcgcgatggagggcgcaggctgtggggggcatttatggtacaggccgatggtatttccctctactacagtggtgataccggttactccaggcatttccgcgaaatacccgatcttttcggagctcccgattatgctttggtgggtatcggggcctataaaccgcgctggtttatgcaacccaatcatatatcgccttatgatgctctgactgcatcgaccgatatgaaggctgctctcacaattccgatgcattacggaactttcgatttgtccgatgaacctctgcatgaccctcctctggtttttgctgccgaagccaagaagcgaaagatagatgtatatatccccgtactgggagaggtggtgaagttgaagcggatgtag

SEQ ID NO: 4069 - DNA, 429 bp, B.fragilis
gttctaattcaaaaagaggatattatgattaaacaagactatctgatacggatgattcaggaaatcatttcgttaattgtaaatgcgatattgaataaaaagaagttccgtaaggatgaatggactgaatatgattgcctgacgagacagattttaggagtttctcaagaggaattgttaagtatgagcctggatgaaatgattgactgttatgaaggagatcctaatagaatggggaagatagaattggcggccgtgactttgttgaaagtttcggacgaggcggaatctgatattttgcaaaagtccaaattacgtcaggatgggctttccttgctaaaatatgttcagaaagaaagcagtaccttttcaattcagcggacgaatttgattcggatgattgagattaatgaatctcttaaaatgtag

SEQ ID NO: 4070 - DNA, 519 bp, B.fragilis
atgtctcaacaacaagaatattggttcgctgcccgtacccgtaaggatcaggagcttactactcgtgacgcattagagaaaataggtgtcgagtattttttgccgacccaatttgtcattcgtcaattgaaatatcgccggcgtcgtgtagaagttcctgccattcgtaatcttatttttgtacatgctaccaaagagtttgcttgtgctattgccaatgaatacggggtgcgtcttttctatatgcgtgattttgacactaagagtatgcttattgttcccgataagcagatgaaagattttatgtttgtcatgaatctcgatcctgctgctgttatcctcaacgatgattgtttcgcagttggcaccaaagtacaagtcatcaagggagatttttgtggagttgaaggtgaactggccagtctttctaatcgtacttatgtcactatccgaattcgtggcgttttatctgccagtgtcaaggttcctaaaagctaccttcgcattctcgcaccgtaa

SEQ ID NO: 4071 - DNA, 1104 bp, B.fragilis
tatatgaaacaatttatagcatttgtaaaaaaggaattcttccacatattccgtgaccggcggactatgttgattttgttgggaatgcctgtcgtgcagattatcctctttggctttgccatcactacagaagtgaaaaatgtacgagtgggcgtactcgatccgtcaaatgacatcgtcacacgcaaaattatcgatcgtctggatgccagcgaatacttttccgtgaagtgccttttacattctccgcaagagatggaaagggcgtttcaggaaaacgagatagatatggcactcgttttcagtgagcagtttgccgaccgcctttatacaggtgatgcccgtgtgcaagtggtttccgatgcaacggatccgaatatggctaccacacaagccggctatgccacaggagtgattgctgctgtccggcaggaaatgcttcctcccggaatgtcagtgccttctgtcgtacccaatgtgaaattgctttataaccctcagatgaagagtgcttacaattttgtacccggtgtgatggggcttatcttgatgttgatttgtgccatgatgacctctatctctattgtccgggagaaggaaaccggcacgatggagatcctgttggtgtctccggtgaaaccgctgtttattattctggccaaggcagttccctattttgtattgtcatttgtcaatcttacgacgattctgttgctttctgtttatgtactcgatgtgcctgtggcaggcagcctgttctggctgattatggtgtcgttgcttctcatttttgtatcgttgtcgctgggattacttatctctacggtgacacggacacaggtagctgccatgctggcctcgggtttggtactgatgatgcctaccatgttgctttcgggtatgatattttcgatagaaagtatgcctttggtgctgcaattaatatctgatatactgcctgcccgctggtatattcaggctgcacgtaagttgatgatcgagggagtggacatctcgcttgtatggactgaagtcagtattctggctttgatggcagttctgttgataacaataagcttcaagaaattcaaaaacaggttatga

SEQ ID NO: 4072 - DNA, 540 bp, B.fragilis
  unsure (90),(130),(276),(291),(343): Identity of nucleotide sequences at the above locations are unknown.
ttgggaaggcacagatcgcaatggctcgaaacggcaagcttactgcccaaaatgtggtctttacaagaccagtacgaccagtttgccggnaacaggggatcatccagtcgcatatccaggttggccacangtagagggacaattggcgaaagtgtcacgtcgtttcgcctatcagtggtactgtatttgcaaaatatgccgaaaccggggaagctggctgctgtgggtaaccctcttttaaaggtggcagatatcgatcagatgtatcttcgtgcntatatcacttccgancagctttcactagtcaagcttggcaatcgggtgacggtcttttccgatatgnggggagaagagcgtaaggaatatccgggtgtcgtgacatggatttcagatcgttcggagtttactcctaaaacgattctgacaaaagaagaacgtgccaatctggtgtatgccgttaagatagcggtaaagaacgaatggacttctgaagataggtatgtacggaggagtgaagttataaatgatgcctgcttatga

SEQ ID NO: 4073 - DNA, 354 bp, B.fragilis
catatacttaatacatgcaatttatttacgctagaaatagttaaaaacatgacatttattcattttatgcaatataattcctatttttgcaataaagctattttaattatgactgaaaaagagaaaaaagaacgaacagttattcatctttatataaaagagaatgacactcaccactattttggctcaattgccaatgtatttgaatacttttcacccgaagaacttggaataacttacggctcgttaagaaattatggactttctaatgaaaattcataccaaaatagcaaatgtatcattaggaaaggaatacttctatcaaagtcgggaaataggggtaaaaatagatag

SEQ ID NO: 4074 - DNA, 282 bp, B.fragilis
tttgtttctaaatcctttgatttgaatcttaaaaaccgcaaaattacaaaaaaatggggaagaacggatgctttctacaaaacaaatttattaaaaaatgcaattccgggtaccgaaatgtttgaacgacaaacagtcacatgtttgccggcatataagcacgcctttattcaacttgcactatcgagccgggggaaggcggttctcagttcgatctgtattgttctgagagataatgcacgttccaataaaacagctgaattgttgtatagattcatttga

SEQ ID NO: 4075 - DNA, 351 bp, B.fragilis
tcaatttataataacgatatgcaggctattattttgagttcaaatactgcgattagagcagaagttattactatccgtaccaatgcgcgcaaaattgatgggatttccaaagctgttttgattgaacagttaaaagagaaattaaagagtggaaaaattgtcaaatttacctatttgaaaagtaacggtgaagttcgtgtggcatttggcactacccatcccgattttgtgaaggataaggtttgtgggtggggcgcaagtcgtgaaagttatgctactactgcgtatttcgacttagaaaaatgtgattggcgttccttccgatgggagaacctaatagcggtattttaa

SEQ ID NO: 4076 - DNA, 1275 bp, B.fragilis
ttaaatgataaaaacatgaagagacaaattgtatcatgcggcatttttgctatgctattgttagcctcctgcaatggagcgcagcaaacctctgaagtcgatctgatagatattgccggaggaatggagaaactgacagaactaaaagtatctgatctcgggaaaacaatccgatacattcctttagaaacaacggactcctgcctgatcggagattttcctaatatcaaacttctggatgataaaattatggtctataacggcaaacagtgtttgctgtttgacaaagaaaccggaaagtttatttgttctgtagggcacagaggagacgatcctgaagcttatagcagtacttgcggatatctgaattccaaaaaccaattattgtattttaatcgcgatcccaaccaattggtaaaatatgaccaaaaaggaaatttcgcaggagtcatcaccatcccttcgccggaaacttcaacgggcaatatacaaataaaccgtcccggaatgaatgggtttgtattctctgattccattattatagggcattatgtaggaggattagggcaaagatgtcccagttcggtattatatttctctgataaaggtaattacatagatacgatcccgaatatcattcccgaattaggaacaggacaggttggagacatcaacaacatttcggtacgcaagggattcggactgttagaaggcattattcaaatacagtataacaacggaaaacaaagtatctgtgtacccggatatacggcactgtggaagtgtaatgacgaaatccgattcaaagaattatttaccgacaccatctacacattgaaacacaatcagctggaaaagtacataatattcaataccggtaaatattactggccggcttccgaacgtacgcttacagacaataacagtgaccgaattatgatcagctatgcaatcgagaatgacaagttactctatttccagttcatcagagggctttacacagacaaacacatcttgtacaatggaatttatgacaaaaatacaaaagtgactaatatagctttagctgaaaaaaatttcgttgatgacttgacccattttatgccttttactcccagctttcttaatgaaaaaggtgaatgtgcctctttggttcaagctgctgacattcttacttggctagaggaacatccggaagtcaaaatagaaaaagaactaggcgtcctgaagaatttgaatgaagaatcaaacccggtagtagtattggtaaaataa

SEQ ID NO: 4077 - DNA, 1458 bp, B.fragilis
atttgccccaaatttgttataaaaatgaagactagtcacatctcaacattagcatttgcgatcctgttttcttcgtcagtgatggcgcagaagacgaacaaaccggtttctgaaacagtgcagagtgaagtgaaagcagatacactttccgagacgcttcaacagtaccttgtcctgaaactgaatctggatggtccgaagcctaagatagatacggtgtccatcttatataataagtatataggagagttggaatatcttaatgatccttctgtacccatgcgttatattaagacagatccggattactaccgactgtttgtaccgctgacttattataactctcccatcgcggaatattctaccatgcactggaagtttaaggaaccttttgttactccctctctttcttcgcaattattgccgccgtatgacacattgcagttttctaaagctgagagagcttcccggctggtgaatgttgctttgatggatctatatctgaatcatcctaatttagtcgttaataccgaagatcatatcatgagccgtaagttgtatcatggcgataagaagattgaagtcccgaaaacagaagtgaaaagcctgttccgtgcggataaggtggaagacaatgtgggtgaagcggaaatggtgatctccaagcccaattggtgggtgacaggaggtaacggttcgcttcagattacccagaactatatttcggacaactggtacaagggaggtgagagcaataatgccgtaatggccaatctgcagttgtttgctaactacaatgaccgtgagaaagtacagtttgaaaatctgttcgaagctaaattaggattcaattcttctccgtcagacgaatatcataaatacctggttaataccgaccagttgcgtttgtattctaaattaggtattcaggctgccaataattggtactatactattacaggagagtttaaaacccagttcgtaaagggatataaggctaacagtgaagagttggtagctgctttccttgctcctgcagatgtgatagtcagtgtcggtatggactataagttgaaaaagaaaaaattcaatctttctgtattcatgtctccgttgacttataaccttcgttatataggtaacaaaaacgtggacgaaaccaagtttggattggataaaggcaaatgctcgaagaatgacttcggtgcacaggttcaacctactatttcatggactattattccgtctattgtagtcgattcccgtttgaactatctgacgaactataaatgggtgcgtgtagagtgggagaatactttcaacttcgtattgaaccgttatctttctactaaactatttgtacatgcacgctttgacgacagtgcgaagccgactactggcagcagttatttccagctgaaggagttgctaagttttggtctgaattataaatggtaa

SEQ ID NO: 4078 - DNA, 1344 bp, B.fragilis
acagattacaacatgactactaaatacacatacaaagaaatatggattatcgcctaccccatcctgatcagcctgatcatggaacagctgataggcatgaccgacactgcttttctgggacgtgtgggcgaagtcgaactgggagcctcggccattgccggtgtatactatctggctatttttatgatggcattcggattcagtataggtgcacaaatcctgattgcccgtcgtaacggtgaacagcaataccaggctatcgggcccatcttttatcagggtgtctactttctgctttcactcgcagtggtagcattcactctttcgctgtgcttctcaccgcacatactgaaaaaggtcattagctcggagcatatatacgatgcgtccatcagctacatcaactggagggtcttcggctttttcttctcctttgtcggagtaatgtttcgtgcattcttcgtgggtacaactcagaccaaaaccctgacactgaactctgtggtcatggtattatccaatgtggtgttcaactacatactgattttcggtaagttcggtgctccacagttaggtatcgccggagccgccatcggttcgtcactggccgaaatggtttcggtcatcttcttcgtcatctacacctggaaacggatagactgtaaaaagtatgccttgaatcatctgcccggattccggccggagatgctgaaacggatcctgaacgtatccttttggacaatgattcagaactttttctcactgtccacttggttcatgttcttcctatttgtcgaacacttaggcgaacgtgcactggccataaccaatatcatccgtaacgtatcgggcatcccgtttatggtcaccatggcatttgcagctacttgcggctccctggtgagtaacctgatcggtgcgggcgaaatcaagtgtgttcccggaacgatccgccagcacatccgtatcggttatattttcgtgctgccgctggttatactcttcgcactgtttcctaacctgatattgagtatctatacggatattcccgatttgcgggaggcctccatcccttctttatgggtactatgctccgcttatctgatactcgtacctgccaacgtctattttcaggcagtatccggaacgggcaacacacgtacggcgttgggattggaactctgtgtactggccatttatctgatctatatcacctatatgattctctatctgagagtggatgtagccgtctgctggactacggaacatctgtacggaatctgtatcctgttcctttcatacctttatataaagaaaggaaactggcagaaaaagcagatttga

SEQ ID NO: 4079 - DNA, 453 bp, B.fragilis
cgaatattaaatataaagtcatttattatggtagcaaaacaactttccatttttttggaaaataaatcaggccgactgacagaggtgactgaagtattggcaaaggaaggtattaatctttctgctctttgcattgctgaaaatgccgactttggtattctccgggggattgtttccgatccggataaagcttataaagctttaaaagataatcattttgcagtgaatgtgacagaagtggtaggcatcaactgtcctaacgtgcccggtgcgttagccaaagtattgcaatacctttccaatgaaggagtttttattgaatatatgtattcatttgccaataataactctgcaaatgtgattatccgtcctaatgatatggaaaactgtatccgtgtgttgacggaaaagaaagttgacttgttggcggcaagcgacttgtataaactgtaa

SEQ ID NO: 4080 - DNA, 1092 bp, B.fragilis
aaagaaataaagatgaaaaaaacattaaccgtaaatttaggcggaaccgtttttcatattgacgaagatgcctatcggttgcttgataattatctgtgcaacctgagacttcactttcgcaaacaagaaggagcagaggagattgtaaatgatatagagaaccgcatttccgagctttttgccgaaaagctgtcagccggttcgcaggttattacgattgcggatgtggaagaggtgattgcacgtatgggtaaaccggaagacttcggcgaggataccgaagaagaggagcccaaaaagacaaccggacaaacgggggcacagcaaggtgcgaccattcggcgcagattatatcgtaatcctgacgataagatactgggtggtgtaatcagcgggttggcagcttatcttaattgggatgtcacggtgctccggcttatcatgtttgtggtacttatctgcggatatggcgtgttgattcctatctatattatttgtggggtagttattcccgaagctcgtacggcagccgataagctgaacatgccgggagaggatatcactatcgagaacattggcacgacggtgaccgatggctttgacaggatggccaacggtgtaaacaactacgtaaactcaggtaaaccccgtagctttctgcagaaagtaagagacgcattggtgtccattgccggattcttactgaaagcttgcctggtggttcttgccattatttgcagccctgttctttttgttcttgccatcgatgtcgttgctctggtgattgctgccattgcagtagccatcggaggtggagccgctctttatcagatgttgccttcggtcgactggtcaccattgatctctacttctccgatgatgactatcgccgggagcattgcaggagttgtcttggcaggtattcctttaaccgccatcattttcgtgattctccggcaaatcttcaattggtctcctatgtcatccggactgaaatggtcactgttgattatatggatactggctgtcgttatttttgtcatcaacctctcttacctgggatggccttatcctttcctttgggtcggatga

SEQ ID NO: 4081 - DNA, 780 bp, B.fragilis
tacatgcaaaagttactatttctttttttactgccactgataccattttcgttcccgtgccatgctcaaacgacttatcgaatggtgacaagaaattactctccggttacagattcttatccccaagaggtttctaattttaaaaaggcagacagtgtctactatttcaccgtaaaagtatccaaagcttatgacgataccttaaaaagaaaagtagcagaaaaggttctttatagccccaatgacatctatgacggagaggtcgcttcttatctaaaccccacccgactcattgactattcttctcctactatcgaacttataacagactctttattcaaaggcgaagacagtataatgacaattataagaaagggcttggagtttgtatcccattatataagttttgatgattctctagccatggctatttcaagaggtgattgtaaaacattggatgtaaatcatatccttcaaagaaagaaaggtacttgcagcgaatatactaatttattcacggcacttatgagaaagaaaggaattccttgccggtttgttgccggttttatttttatacctgaacaaaaattctatggatgtcatgcctgggccgaatgctacctcaaacaatacggatggatggcagtagacccccaatccggaaaaagctggttaccaacaactataatccgactttttgccggaacagattatacagactgtggattaaactcttttatggacctagtacccaagtctatagaaatagtaaaagaataa

SEQ ID NO: 4082 - DNA, 714 bp, B.fragilis
cttcgaatgaaaagggatcaactgaaatcactcttactgggagccattttgctggcaggcattaccctgccggcaaaagcccagataggcgaacaacgacataattttgcaatcggaatcaatggcggtgctaattacagcactgtttctttccagcccaccatcaagcaaaacggtcttttgggaattaccggaggtgtcacagcacgctacatttccgaaaaatacttcgctatgatctgtggtgcacaattggaacttaacttttctcaacgcggatgggacgaaaaattcgatccggaacagggattctcttccgaagactcttatgtccgtaccatgaactatcttgagattcctttccttgcccatctggcctttggcaaagacaaaggggtacaatttttcgtgaacctagggccacaaatcggcctcttgttaaacgagagcgaaaaaagaaaaggtacttgggaaaccgcgaatcgggcacccaatgaacaatatggtaaatgggttgaaaataagtttgattacggaattgtaggaggaggaggcattgaagtcaggactaaagccggtaatttccttttggaaggcagatattattttgggctggccgacttctacaacagtaccaaaaaagattatttctcgcgctctgccaatagtaccattacagccaaaatcacttatctgtttgatataaagaagtag

SEQ ID NO: 4083 - DNA, 603 bp, B.fragilis
ttaaaagagaatattatgagcctaaagaacagttatgtaacaagtgattatattgaatgggatacaatgctttcattagttcgaaaattgtatcgtgacaaggaataccgtatgtctttacttattggctgtggcagtttctttgggctgcgcatatcggatattcttactcttacatggtctatgttgctggatgatgaaaagttcgttattatagaaaagaaaacgggtaaaagaagagaaataaaaatcaattcaaattttcaaaaacatattgcagactgttatatggctttaggtgtgacagataaaaatgagaagtgtttcctcagtcgtaaaaaaacagtgtatagtacgcaaagaattaatgtgttgttcaagtcaataaaaagcaaatatggattgaaggtggaacatttttctactcacagtatgcgaaaaacatttggcagaaaagttgttgaagctgctggggaaaactcggaatttgctcttatcaaactatcggaattgtttaatcacgctgatgtaatgactacacggagatatttagggttacggacacaagaattgttagaaacctatgatatgctcagtttttaa

SEQ ID NO: 4084 - DNA, 1641 bp, B.fragilis
tggaaaattgataatagagaattatctttgcctacattttgtggatgtgcgcagccatccactattcattttctatatttcaataaaatacagatggccgaacaaagaagaaatacccgcagtactgccaagtctaaggtgcaacccgtaaatgattacgggcgcatccaaccgcaagcgccggaactggaagaagccgtgctcggggccttgatgattgaaaaagatgcctattcgctggtgagtgagattctccgtccggaatcgttttacgaacataggcatcaattgatttatgcagctattaccgatcttgccgttaatcaaaaaccggtagatattcttactgtgaaggagcagctcagtaagcgtggcgagctggaagaagtcggaggaccgttttatattactcaattgagcagtaaagtggcatcttccgcccatattgaatatcatgcccgtattattgcacaaaaatatttggcaagagagctcattacttttacaagtaacatacagagtaaggcttttgacgaaactctcgatgtggacgatcttatgcaagaggccgaagggaaactctttgagatttcacagcggaacatgaagaaggactatacgcagatcaatccgattattgccgaggcttatgaacagattcagaaagccgccgcacgtaccgatggtctgagcggattggagagtggatataccaaactggataagatgacttccggatggcagaaatccgacttgataattattgctgcccgtccggccatgggtaaaacggcttttgtactttcaatggctaagaatattgccgtgaatttcaggaatccggtagccttgttttctcttgaaatgagtaacgttcagttggtcaatcgtctgatctcgaacgtttgtgaaattccgagtgaaaaaatcaagagcggacaattggcagcttatgaatggcaacagctcgattataaattgaaggatttgctggatgcaccgctttatgttgatgatactccctctctgtccgtatttgagcttcgaaccaaggcacgtcgattggttcgtgagcatggagtaagaattatcatcattgactacttgcagttgatgaacgccagcggtatggcatttggcagccgtcaggaagaggttagtaccatttcacgttcgctgaaggggcttgccaaagagttgaatattccgattatagctctgtctcagttgaatcgtggtgtcgagagtcgtgaagggcttgaaggaaaacgtcctcagttgagtgaccttcgtgaatccggtgcaatcgagcaggatgccgatatggtgtgtttcattcaccgccccgaatattacaagatatttcaggatgataaaggaaacgatctccgtggaatggccgaaattattatcgctaagcatcgtaatggtgcggttggcgatgttctgctacgatttaaaggtgagtatacccgtttccagaatccggatgacgatatggtaattccgttgcctgatgccggggccatgcttggatcacgaatgaataataccggaacagtacctccgcctcctgctgaatttgcccctcagaatagtaatccgttcggaggtgaaaatgacggacctctgcctttttaa

SEQ ID NO: 4085 - DNA, 318 bp, B.fragilis
aacgaagatgatatgaaacggtataataaacaacaagtgatgaaagacgctcacagactttataagaatgatttccaacgtagaggacgttcttggggtgaatgcttgaaagcggcttggagttgggaaaaagatgctgttcgggttcgtgaagagaaagcggcaaggcttgatgctatgatagctgcaagttgggctgcgcacaatgcacacaagaatgaaaagtccaataaaaaagagtttgaagacttatcttctgatgcagtttcttatgcgatgggttatggtcgtggcaatggtttctactgtggtgactaa

SEQ ID NO: 4086 - DNA, 735 bp, B.fragilis
caaaggttggagcaaggcgttgctcctttttttatgctttcaaatcaactttcacaccaaatccttatctttgcacagcatcctgaatatagaaaaatgaaaaagatcgtccttatgggaatacctttattgttgatagtccttgtgatcaccatctatgtttgcaaccggactatacagaaaaatagcgaaacatatatctattcgactgtttccgatattccatataataaggtaggactgttactgggaacttcacctaaactgaaaagtggaaaagccaacctatatttcgactataggattaaagctgccacagaactctacaatgccggaaaagtcaaatatatactggttagcggtgataaccggagaaatagttataacgaaccggaagaaatgaaaaaagcacttatagcagcaggaatacctgaccaacggattatactggactatgcaggtttaagaacattggattctgtggtaagagcacatttaatttttggtttggagcgttttactctgatttcacaacagtttcataacgaacgggcaatttatctggctcagcaaagtcacctccaggctatcggatacaacgctcaggatgtgagtgcgtatgccggctttaaaacgaatcttcgagaattattggcaagagtaaaagtctttgtggatatagttaccaataaagctcccaaacatcttggagaaaaggtaaagatacccgaataa

SEQ ID NO: 4087 - DNA, 579 bp, B.fragilis
acgattatggaatatatattgatatttatctcggcaatctttgttaataacattgtgttgtcgcaatttctgggaatctgtcctttcttgggtgtttccaagaaagtggatactgcattgggtatgagtgcagcggtagctttcgtgcttaccattgctacgatcgtaacgttcctgatccagaagtttgtactcgatgctttcgggttgcagtacttgcagactatcacgtttatcttggttatcgctgcattggtgcagatggtagaaattattctgaagaaagtttctcccgcactttatcaggcattgggcgtattccttcccttgattacaacgaattgttgtatcttgggtgtggcaattcttgttatccaaaaagattatgacctactgacgggtgttgtatatgcattctctactgctattggtttcggtctggccctcgtactttttgccggactccgtgagcagatgagtcttgtgaaaattcccgaaggaatgaaaggtactccgattgctttaattacagccggattgctggctatggcatttatgggattctccggagttgtataa

SEQ ID NO: 4088 - DNA, 2832 bp, B.fragilis
aatatgcaggaaacagaatatataaatgtgtatggtgcgcgcgtacacaatctgaaagacattgatgcggaaataccacgtaatagcctgactgtaattaccggacttagtggaagcgggaagtcatctcttgctttcgatacgatatttgcagaaggacagcgccgctatattgaaactttttcggcttatgcccgcaactttttgggcaatctggagcgtccggatgtagataagataacaggattgagtccggttatttccattgaacagaaaactacgaacaaaaatccccgttctacggtcggaaccactacggagatttacgactatctacgtttgctttatgcccgtgccggaatagcttattcttatctttcgggagaaaagatggtgaaatacaccgaagaacagatattggaacttattctgaaagattataaagggaagaaaatctatatgctggcccctctggtgcgttcgcgtaagggacattataaagaactctttgaacaaatccggaaaaaaggatacctgtatgtccgtatcgacggggaggttcgtgagattacacatggtctgaaactggatcgttataagaatcatgatattgaagtagtcgttgacaaactgatcgtagaagataaggatgataaacggttgaaacagagtgttgccaccgccatgcgtcagggagacggattgctgatgattctcgatgcgcagacagagagtatccgacactatagcaaacgcttgatgtgtcctgttacgggattgtcgtaccgggagccggctccgcataatttttcgttcaactccccgcaaggtgcttgtccgcgttgtaaaggattgggagtagttagccagattgatgtggataaagtgattcccaataaagagatgtcgatctatgaaggggcaatagctcctttgggtaaatataagaatgcgatgattttctggcagatcggtgctctgctggagaagtacgatgcgtcactgaagactccggtaaaagacctgcccaatgatgctattgatgaaattctgtatggttcggatgaacgtatcaaaataaaaagctcattgataggtacttcttccgactattttgtaacgtatgaaggagttgtgaagtatatccagatgttgcaagagaaagacgcttcggccactgctcagaaatgggcggaacagttcgctaaaactacggtttgtcctgaatgtaagggggcgaagttgaataaggaggcgcttcacttccgtatccatgacaaaaacatcaatgaactctctaatatggacatcaacgagctgtatgactggttgatgaaagtagataagttcctgacagataaacagaaaacgattgctgccgagattctgaaggagatacgtacccgcttgaaattcctgttggatgtggggttggattatctttcgttaaatcgcagctcggtcagtctgtccggaggtgaaagtcagcgtatccgtctggccacacaaattgggtctcagttggtcaatgtgctttatattcttgacgagccgagtatcggattgcatcaacgtgataacttgcggctgattaattctctgaaagaactgcgtgatatgggtaactccgtgatcgtggtagagcatgacaaagacatgatgcttgctgccgactacgtgatcgatatgggacctaaggccggacgattgggaggagaagtcgtttttgccggtactcctgaagagatgttgaagaccagtacactgacttcgcagtatcttaacggacaaacggctatcgaagtaccttctaagagacgtcccggaaacggcaagtctttatggttacggggtgcgaaagggaataacctgaaaaatgtggatgtggaatttccgttgggtaaattaatttgtgtaaccggagtttccggtagtggcaaatcgactctgattaatgaaactttgcaaccgatactttcgcaaaaattctatcgttctttgcaggatcctttggaatatgattcgatcgaaggacttgagaatatagataaggtggttaatgtggaccagtcccctttggggcgtaccccacgttccaatccggctacttatactggggtcttttctgatatccggagcctgtttgtcggactgccggaagctaagatccgcggttataagcccggccggttctctttcaatgtgtccggtggccgctgcgaggcatgttccggtaacggctacaaaacgattgaaatgaatttcttacccgatgtatacgttccgtgcgaagtctgtcatggtaaacgctataaccgtgaaacgctggaagtacgttttaagggaaaatctattgccgatgtgctggatatgactattaatcgtgcagtagagttctttgagaatgttcctcagatcctgaataagatcaagactatccaagatgtaggattggggtatatcaaactgggacaatcgtcaacaactctttcgggaggtgagagccagcgtgtgaaattggctactgaactttcaaaacgagataccggaaagactttgtatattcttgatgaaccgactaccggcctgcattttgaagacatacgtgtgttgatgggagtcctgaataaattggtagataaaggcaataccgtgatcgttattgaacacaacctggatgtgattaagatggcggattacataatagatatggggcccgaaggtggtaagggaggaggagaacttctcagtttcggaacaccggaagaagttgcgaagagcaacaaaggatatactccgaagtttcttcgcgaggaattaaaaatcaattaa

SEQ ID NO: 4089 - DNA, 609 bp, B.fragilis
ataagaaaggagtataaagatatgaataactttaaagtattaatgaatgggattgttaaagagaatccgacatttgtgctcctgcttggtatgtgtcctacactcggtacgacttcctcggccattaatggtatgggcatggggcttgccactatgtttgtattgatctgttccaatgtagtgatttcattgataaagaacctgattccggacatggtgcgtattccgtcattcattgtagtcattgcatcttttgtgactttgcttcagatggtaatgcaagcatatgtacccggactgtacgctacattgggactttttattccattgattgttgtgaactgcattgtgttgggacgtgcagaagcatttgcagccaagaataatgcactttcttctatgttcgacggaatcggtatgggattgggctttacaattgcccttacattgctgggagctgttcgtgagttcctgggtacaggcaaggtattcaacttgtcaatcattccggaagaatacggtatgcttgtctttgtgcttgctccgggtgcgtttatcgcattgggatatctgattgcgttgattaacagccttaagaaagcgaattaa

SEQ ID NO: 4090 - DNA, 348 bp, B.fragilis
aagatagaacttatgaatgtagataatgtaaagtcgcaaatgcgaaagggtatgctggagtattgcatcatgttattgttgcataaagagccggcttatgcttcggatatcattcagaaactgaaagaggcgaggctgattgtggtggaggggactttatatccattgctgacccggctgaaaaatgatgatttgctcagttacgagtgggttgagtcaacacaaggaccgccacgcaaatattacaaactaaccgggaaaggggagtcttttcttggtgaactggaggcttcctggaaagaactgaatgaaaccgtgaatcatatagctaatagagaatccatttaa

SEQ ID NO: 4091 - DNA, 2118 bp, B.fragilis
aacttgggacttggcttatttatttctatatttgtttccatattaattgatattgatgtaattaacagcgcaaagataatgaataatatggataagaagatactaatctattgtcgtgttagtacgcaacaacagacaactgatagacaaaaagaggaattgttgaagtttgcagaagacaaccattggaacgttgcagaagaggatattttcatagatgttattagtggttttaaaaagggagagtttcgtcctgaatatgccaagatgcttgaaagagttgaatatggggatattgacataattttattttctgaattttctcgtcttgcaagaaatgctacggagttattagaacaaatcaaattgtttatagataaaggtattaacttgtattttgataaacaaaagttgtgggtaaaagatactaataaagatgtaggtagtcttattttattgcatgtgcttgctgttatgtcaagctatgagatagaattgtttgttgaacgttcattaagcggcaagataacaaaagttcaagctggtcatggaggaggggatgaacgtgcgtatgggtatatgcacaatgaaaataaacagattgttataaatcctatcgaaagcaagattgttgcccgtatttttgaaatgtatgttggaggatattcttcaattcaaatatcagagatattgaatgctgagaaagtacctgctccatacgtaaggaaattgaatgagtacaagaagaatagagaagcaaaaggattagaggtgaaagagtacaaatttgatacagataatttaaaatggcgtatttctacaataaacagacttatgcacaatgagttatataaaggaaatcgtagaataacattttataaaccagaccctaccaatccacttccgttatccgaaaggcaagatagagagattgtttatgaatattcggaacatgtggaaagtctgcgaattgtatcagacgagttgtttcagcaagcccaagataaactttccaaagcgcattataataagaataatgcagtcaggcatgagaatttattgaaacatttaatggtatgtggcgaatgcggtgctaatttttctgtagggaaatcaaatgaaacatctaaaaattatatcagtggtggacgtacttacaaatgttatggtagagtgaatcgtaaagataaaccacgaacatgtacgaatggggcagaacttcgacaatggaaattggatggacttgttctacagttgtcaattcaaatgtttgctgagattaatattcagcagaccaatattttaaagatagaaaatttagggaaagaaatcgaagagttggttcaaataaaatcatcaaagaatacagaattggttgaagcggagaatctttataaaaagacacttaaacgtcttattgcgattgaagacgatgaggtcgcaaagaatttgatttcagatgcaaaacataaatatgatgaaactaaaaacatgttgaacaaaactatagataaattgtcacgagaaatcacaacaaagagaattactattgataatttgaagcgtttgaatgccaatcctttgttgattaataaaatggatgagattaggaaggataggaatttggtaaagactatggttgatgaatatattgataaaattactatctttcgtttacatgaactttggttgttggtcgtagtatcttataaaggaggtgaggaaatgtgggggacaattaaatgcgctcgttataaaaaagaggagatgttttatgatgaattgcattgtcattatggtgttgaatttcagggatggttacttaataatacggaacgttgtttttcgtatgataaaaacacacatattattacttataatggtgaaagtaaaatatatgtggaatttaaatcaggtgagtataattacgatacatttaatcaaatgatacaagaaacagggtggatgggatgtttccctttttatgcttatgaagatagtggtaaggatttaagtgtaccttctaatgaagattttggaaaatctttacaagagaatagaattgattggaaagcacacaatgaaaaggtcttggaacgtttattatccaagtcatag

SEQ ID NO: 4092 - DNA, 351 bp, B.fragilis
attataaatagatttatggattacaaaaaaacaaatgctccgacgaataccattacccgtgatatgatggacttgtgtgccgataccggtaatgtttacgaaacagtggctatcattggtaagcgtgccaatcagattagtgtggaaataaaaaatgacctttccaagaaacttgcggagtttgcttcttacaacgacaatctggaggaagtgtttgaaaacagagagcagatcgaaatttcacgttattacgagaaattgccgaaacccaatctgattgctgcgcaggaatatgtagaaggaaagatctattatagaaacccggcgaaggagaaagaaaaattacagtaa

SEQ ID NO: 4093 - DNA, 1005 bp, B.fragilis
aaaataataagtatggaaaataaattaattgtatcattatcgcctcacgttcatggtggagacagcgtacaaaagaatatgtacggtgtgctgattgcgctgattcctgcctttatcgtttcgctcgtatatttcggactgggtgcactgattgtcacagctacttctgtgatagcctgtttgttttttgaatgggcaatcggtaagttcttgctgaagaaagaaaccactactatttgtgacggttctgctgtcatcacgggagtgttgctggcgttcaatctaccgtctaacttacctgtatggattattattttaggtgctttgtttgctattggtgtcggtaagatgtcatttggcggcttggggaacaatccgtttaacccggcactggcagggcgtgtgtttctgttattgtcattcccggtacagatgacttcctggccggtggtcggtcagttgactgcttataccgatgctactactgccgccactcctttggcattgatgaaacaggctattcatggggatgtctcggcttttggtcaactgcccgatgcctggagtctgtttattggtaacaatggtggatgtctgggtgaagtgagtgctgctgccctgattttgggtcttctttatatgttatggaagagaatcattacatggcatatccctgtatccattctggttactgtatttgtattttccggtatcatgcatctggcaaatcccgaagcttatgtttctccggtgatccagttgctttcgggaggtctgatgctgggtgctatctttatggcaacagactatgtcacttctccgatgagtaaaaaaggtatgttgatttatggtgtctgcatcggtttgctgacggttgttatccgtctgtttggtgcatatccggaaggtatgtcgtttgctattctgattatgaatgcattcactccgctaatcaatacgtattgcaaaccaaaacgctttggggaggtagcgaagaagaaatga

SEQ ID NO: 4094 - DNA, 2049 bp, B.fragilis
aagaaaaaaagaagcatgaattttgaattaacatccgcatacaagccgaccggagatcagccggaagcaattgcgcaactgaccgaaggggttcttgaaggcgtaccggcacaaacgttactgggagtaaccggttccggaaagacatttaccatagccaacgttattgccaatatcaataaaccaacattgatcttaagccataacaaaacactggcagcccagctttacagcgaatttaaaggattttttcccaataatgctgtcgaatattatgtatcttattatgattattaccagccggaggcctatctgccaagttcggatacatatatagaaaaagacctcgctatcaatgacgaaatagataagctcagattggctgcgacttcggctcttctatccggcagaaaagatgtagtggttgtatcctccgtatcttgtatttatggtatgggaaacccatccgatttttataacaatgtaattgaaatagagcgaggccggaccatcaaccgcaatgtatttcttcgccggttggtagacagcctgtatatgcgcaacgatattgaactgaatcgtggaaatttccgggtcaaaggagatacggtggatatatatctggcctatttggacaatctgctccgggtaaccttttggggagacgaaattgacggtatcgaagaagtagatccggtatccggagtcaccatcgcaccttttgaagcttataaaatatacccggctaacctgtttatgactactaaagaagcaactttacgggccatccatgaaatagaagatgatcttaccaaacaagttgcctatttcgagtctatcggcaaagagtacgaagccaaacgtctatacgaacgagtgacatatgatatggagatgattcgggaactcggtcattgctcaggtattgaaaactattcacgatattttgacggccgtgctgcaggtacacgtccatactgtttgctggattttttccctgacgattttttgattgtaatagatgaaagccacgtcagcgtaccgcaaatacgagctatgtacggaggtgaccgtgcccgtaaaataaacttagtggaatatggttttcgtttaccggcagctatggacaaccgccccctgaaattcgaagaattcgagtcgatggctaaacaggtgatttatgtcagcgctactcctgccgattatgaattagtacagtccgagggtattgttgtcgagcaggtgatccgtcctaccggtctgctcgatccggtgatcgaggtacgtcccagcctgaatcagatcgatgatctgatggaagaaatacagatacgcattgagaaagaagaacgcatacttgtcaccacactgaccaaacgtatggccgaagaattgacagaatatctattaaacaacaacgtacgttgcaactacattcacagcgatgtggatacattggaacgggtcaagatcatggatgatctccgtcaaggagtttacgatgtgttgatcggggtgaatttattgcgcgaaggtctcgaccttccggaagtgtcactggttgccatcctcgatgcggacaaagaaggatttctccgttcccaccgttcattgacacaaactgccggacgagcagcccgaaatgtaaatggaatggtgatcatgtatgcagacaaaatcacagatagcatgcgactgactattgatgaaaccaatcgtcgccgtgagaagcaacttgcatacaacgaagaacatggtattactccgcaacaaattaaaaaggcccgtaatctgtctgttttcggaaacggagcagaaacagaagatactcaaaaaggtacccgtgcatacgtggagccttcttcacccaatattgcagctgatccggtcgtacaatatatgagcaaagcccaactggaaaaaagtatggagcgtactcgcaagttaatgcaggaagcagctaagaaacttgaattcattgaagcagctcaatacagagacgaattacttaagatggaggacttaatgaaagagaaatggcccggataa

SEQ ID NO: 4095 - DNA, 531 bp, B.fragilis
cttactaatgggcagctcctctctgtggctgccgaaatacacatattgtctatgaaaatcaataagaccaatgccgcccgtctactggataaggccaagattgcctatgaacttattccttacgaggtagacgaaagcgatctgagtgccgtgcatgtagcggcaagtttgggagagaatattaatcaggtttttaaaaccctcgtacttcacggtgataaaacgggatattttgtttgtgtaattccaggagatcaggaagtgaacctgaagcttgctgctaaagtgtccggcaataaaagttgcgatatgatccctatgaaagagcttctgtccgtcaccggatatatccggggtgcctgttcgcccatcggaatgaaaaagcattttcctacctatattcatgaaacctgtctgggctttccgtatatttatgtaagtgcagggcagagaggattgcagataaaaatagaccctaaagagctaataaacgaggttcgggcggaagtttgtgtattatatactgtttaa

SEQ ID NO: 4096 - DNA, 828 bp, B.fragilis
aataccaaaggcttcgagaagaattgggtgaatggcagtgctgccaacgtacttttggctgtcaatgccgtgaatggtaccaagggtggcttgggaagttcctatttgtctgccattgtcaatgactatggagaagaattacggactgaaagcggtaccacctctttctctgccgatggaaatctgccccggattgatattctcacccagaatctttttaatgcccgtttggattataagctgtttatggttccggccctgatggtgatgttgcttacgatgctttgcggctttctgcctgcattaaatatagtaggggagaaagaagccggtacgattgaacagatcaatgtaactcctgtcggaaagtttacctttattcttgccaaattgattccctattggctgatcggttttgttgtcctgactctttgctttgttttggcatggacactttatggtatctttcctgtggggcattttggggtcatctattgtttcttcattatatttgtcctggctgtatccggcctcgggctggtcatttccaaccattcggctacgatgcagcaagctatgtttgtcatgtggttctgtatgttgatcctgattctgatgagtgggctgtttacccctattcgtagtatgcccgaatgggcgcaatggataacaatgcttaatcctctgaaatattttatgcaagtgatgcgtatggtttatctcaaagggagtggctttattgatttgttgccacagctgggggcgttgctggcctttgcactgcttttcaatgtttgggcagtgaagagctatcggaaaagcggttga

SEQ ID NO: 4097 - DNA, 189 bp, B.fragilis
aaaccactgggtactgaaaccacagaacggtgtactgtggcaacggactttcttcgaatggctggatcaatggctgaaaccaaacgaaacggcacagaaataaaggctgtgttgtcaacaaataaaggctctgtccctaccggacagagcctttatttgttgacaacagaagctctatttggaaggtaa

SEQ ID NO: 4098 - DNA, 1974 bp, B.fragilis
ggcttcattattcctatgaataaaattgcacttgcacttattttattaatattaccattctctttagcctatacatcaccacgaaaaaaggtaggcatcgttttaagtggtggtggagctaaaggggttgcgcatattggggtaataaaagctcttgaagaattaaatatacctattgattatatcgcaggaacaagcatcggagctattattggcggattgtattctataggttacacatccgaacaattagaaacaatagtaaaacaaacagattggataaatttgcttactgataaagtttcacgcgaaaaaattccttttccctttaaatccaatgatagcaaataccttgtatcattcccattcaacaatagtgagaagaatggaggcataataaaaggaaagaatatatcacagttattacatcaacttacagaaggttatcaaaatgtaactaattttgatagccttccaattccttttgcatgtattgccacagatatggcaagaaaccaaaaagaggtcattcgctttggcaaactttcagaggcaatgcgagctagtatggctgttcccattgttttttcaccaatatattcaggacagaaagttttaattgacggaggatttaaagataatctgccaattgatgttgttaaatctatgggagcagatattattatcggtattgatgtacaatctgaattatcagatgcagacaacttgcattcgattgcaggaatagccaaccagcttatgctaatgatttgccaatcatcgcttgatgaaagcactaaggatatagatgcttatataaaagttgatgtagaaaactataatgctgcaagttttacaaaagccgcaatagacactcttattataagaggagaaaatgccgcaaaagccaattacaatacattattatcaatcaagaataggataggcatagtaaataataaaagaaataataaagcccaattacccttgttttatccgcaatatgttccaagcaatgataatcaactaagaattggattaagattcgatagcgaggatattgcagcagtgatgcttaatatcaatttgaataaacataaattcgggaaagccgaaatagcggtaagaggaggaaaacaatctttcctcagaacccaatatcatttccctatatcaaaaccacaatggataacactttcaaatcaaattggttataatgatatatttttatacagtcatggatacaaaatatctaatccaacctttatacggaatactagcagtctaatttactctattataccttcaagaaatcttcaaatagaagttggaacttcattagattatcatcagtattataggacattagtaaatgaagatgcaacaccaataaaacgaaaaaatttatttcttaattatcacacaaaattgaaatatgaaactttaaacaaaagatattttcctactaaaggtctgaaaactaatatttcttatacaatacataccgatttgcataccaacactgcatactcatcacttgctacccaaatcactaagatatttccaatcgcactaaatacatttattataccgacaatatacggaagatttatttttaatgatggtattccgtttatgtacagtaatgtcatcggtggagaaggatataatccacattacgagcaacaaatacctttttcagggctgccccatacagaatccaccctaaaattattgggaaatgcacgaatccaaataagacataaattccatggaaagcaataccttaccttatcaggaaattatgctatccatcaaaatcagttttctaattttcttcaaggcaaaaaaatatatggaacaagcatcggatatggttacgatagtccattgggacctatagaaggatttatatgttactccaataggactaacaaactgggattttatctcaatatcggatttggattttaa

SEQ ID NO: 4099 - DNA, 1629 bp, B.fragilis
aaacaaattattaaaacagttatagctgtgggagaaacaaagtatattttcgtcaccggtggtgttgcctcttctttaggaaaaggtatcatttcatcttccatcggtaaattgctgcaagcaagaggttataaagtaactatccagaagtttgacccgtacatcaacattgacccgggaacattgaacccttatgaacacggagaatgctacgtgactgtagacggccatgaagccgatcttgacttaggacactacgaacgtttcctgggcatccagacaacgaaggccaacaacatcacgacaggccgtatctataagagcgtcatcgataaagaacgccgtggagattatttggggaaaaccattcaggtgattcctcatatcaccgatgaaatcaaacgtaacgtcaagttactgggtaacaagtataagttcgactttgtaatcacagaaattggcggaacagtaggtgatatcgaatctttgccttatctggaaagtattcgtcagttgaaatgggaactgggtcagaatgccttgtgtgtacacctgacttatgtacctttcctgtccgccgcccaagagttaaaaaccaaaccgactcaacattccgtaaaagagttgcaatcactcggtgtacagccggatatcctggtgctacgtaccgaacatgacctgaataccaacttgcgcaagaaggtcgctctgttctgtaatgtagccgaaaacgcagttgttcagtcaatcgacgcttcaactatttatgaagtacctctgttgatgcaagagcaaggcctggacgaaaccatactccaaaagatgggtctgcctgtaggcgaacgtccgccgttgggtccttggaaagacttcctgaaccgtcgtgccaatgcaactgaaacagtaaccattgcaatggtaggtaaatatgttgaattgcaggatgcctacaaatctattctggaatccttgtcacaagctgctacctacaatgaccgtaaagtaaaaatagaatatgtatcatccgaacatctgactccggacaatgtagacgaacaattgggacatgtaaacggagtagttatctgtccgggattcggttcacgcggtatcgaaggtaagttcgtagctgccaaatacacccgcgaacacaacattccgacattcggtatctgtctgggtatgcaatgtatggctatcgagtttgcccgtaatgtgttgggttatgccgatgccaactccattgaaatggatgaaaagaccaagcacaacgtgatcgacatcatggaagagcagaaagccatcaccaatatgggaggtaccatgcgtctgggagcttacgaatgtgtattgaagaaagactctaaggtatacgaagcctacaaagaagaacacattcaggagcgtcatcgccaccgctacgaattcaacaacgactatcgcaaacaattcgaagaggccggcatgaagtgtgtaggtatcaaccccgagtccgacttggtagaaattgtagagattcctacattgaaatggtacatcggaacacagttccatccggaatacagcagtaccgtactacacccgcatccgttgttcgtgtcgttcatcaaggctgcaatcgataagtaa

SEQ ID NO: 4100 - DNA, 882 bp, B.fragilis
ctaaaaattatgaatttgattctgattgcagtgatttctttgggagctattgcgcttgtattggctgcagtattgtatgttgcttctaagaaatttgccgtgtacgaagacccacgaattgcccaggtatccgaagtgttgcctcaggctaactgcggtggatgtggttatccgggttgcagcggatttgccgatgcttgcgtcaaagccggttcgctggaaggtaagttttgtccggtgggtggacagcctgtgatgtctcaggttgcctctattctcggattggacgccggaactgcagaaccgatggttgcagtggttagatgtaacggaacctgcacgaaccgtccgcgtacaaatatgtatgacggtgcaaagagctgtgctattgctgcttcgctttatggcggagagaccggctgtagctatggatgtttgggatgtggcgactgtgtggctgcctgccagttcgatgctattcacatgaatccggaaacaggacttcctgaggtggatgaagaaaagtgtacggcttgcggagcttgtgtaaaagcctgtccgaaagcgataatcgaacttcgtgccaaaggtaagaaatcgcgtcgtgtatatgtatcttgtgtcaacaaagacaaaggggctgtcgcacgcaaagcctgtacggtaagttgcatcggttgtggtaagtgtgtcaaaacttgtccgttcgaggcaattacacttgaaaacaatctcgcttacatcgattacaataaatgtaagtcttgtcgcaagtgcgttgaagtttgtccgcagcacactatcatcgagttgaatttccctcctcgtaaacctaaagaggaaatgcctgttgccgaagctgccaaaactgccgaagcttaa

SEQ ID NO: 4101 - DNA, 591 bp, B.fragilis; identical to SEQ ID NO: 620

SEQ ID NO: 4102 - DNA, 246 bp, B.fragilis
ttagcatatatgactaatatagaagattttgtaatacaaaaggtaaaggctatgaggatggaaagaaagtggtcacaagtagaattggcagactatatgaatctttctccaagtttcattgcagatattgagaatcctaaacggagagcgaaatataatctcaatcatttaaatgagttggctaaagtttttagttgctctcctaaagacttcttgcctgatacaccattaaaaaatgaaaagtag

SEQ ID NO: 4103 - DNA, 543 bp, B.fragilis
attagtatcttcttatccatattattcattatctttgcgctgttaattacatcaatatcaattaatatggaaacaaatatagaaataaataagccaagtcccaagtttcaggatgtgtcaattgcacctatgcatacagcagagcatttgctcaatgccactatggtaaaaacattcggatgtcctcgttcacgaaatgcacatatcgaaaagaaaaaaagcaaatgtgattacgaacttccgacttgcccaacggaggagcaaattcatgccattgaagaaaaagtaaatgaagctatcgatcgccatttacctgtaacctgtgagttcatgacacacgaagaagccaaaagcattgtggacctgagtaagcttccggaaaatgcaagcgaaatattacgtattgtcagaataggagattacgatgcttgcgcttgcatcgggcaacacgtagaaaacacatcagaaataggtctttttaaaattatcagttacgattatgccgacggaaaattacgcctcagattcaaactgataaaatag

SEQ ID NO: 4104 - DNA, 897 bp, B.fragilis
tctattatcatgaaaggcattgttttggccggtggttcgggcactcgcttatatccgatcaccaaaggagtcagtaagcagttgcttccgatatttgataagccgatgatctattatcctatctctgtactcatgttggcggggattcgtgaaatattgattatttccactccatacgatttacccggctttcaacgtttgctgggtgatggctctgactttggagtacgttttgagtacgccgaacaaccttctcccgacggtttggcacaggcatttatcattggtgagaagtttataggtggtgattctgtatgtctggttcttggcgataatatcttttatggacaaagttttacccgtatgctgcgtgaagcagtccatacagccgaatcagagaacaaagcaactgtttttggttattgggtcagcgatcccgaacgttatggggtagctgagtttgacaaggctgggaatgttctcagcatcgaagagaaacctactgttcctaagtccaattatgccgttgtgggtctttatttctatcctaataaagtggtggaagtagccaagagtattcagccttcccctcgtggagaattggaaatcacgacggtcaatcaacggttcctgtccgatcgggaactgaaggtccagcttttggggcgcggctttgcctggttggatacaggtactcatgattctttgtccgaagcaagtacatttatcgaggttattgaaaaacgtcagggtttgaaagtggcctgtttggaaggcatagccctgaggcaaggctggatttctcctgaagagatgaaagcattggcaggtccgatgctgaagaatcaatatggacaatatctgttgaaagttatcgatgaattatccataaagtag

SEQ ID NO: 4105 - DNA, 1095 bp, B.fragilis
ttttgttacatttgcaaacactttacaagtaaaccgaaaaaactaaccattatacacgttatgaaagaaagaattttagtaacaggcggaaccggatatatcggctctcatactgtggtagagctgcaaaacagtggatacgaagtaatcatcattgataatttatctaattcaaatgctgatgtcgtagataatatcgaaaaggtatcaggtattcgtcctgttttcgagaaactggattgcttggattttgacggtttagatgccgtgttcaataaatataaaggtattaaagcgattatccactttgcggccagcaaggcagtaggtgagtctgtagaaaaaccattgctttattatcgcaacaacctcgtttctttaattaacttgcttgaattaatgcctaaacatggcattgagggcattgtattctcttcttcatgtactgtatatggtgaaccggatgaattgcctgtaacagagaatgctccgataaagaaagctacttctccttatggaaataccaaacagattaatgaagagattgttagagatacagtagcttccggtgctccgattaatgcaattttactgcgttattttaatccgattggtgctcatccgacagcattgttaggagaacttcctaatggcgtacctcaaaatcttattccgtatttaactcagactgctatcgggattcgcgaaaaattgagtgtcttcggtgatgattatgatacacctgacggttcatgtatccgtgactttatcaatgtagtcgatcttgctaaagcacacgtaattgctattgcacgtattcttgaaaagaaacaaaaagataaagttgaaactttcaatatcggtacaggacgtggagtttcagttcttgaactgatcaacggatttgagaaagctaccggcgtaaaactgaactatcagattgttggacgtcgtgccggtgatattgaaaaggtatgggctaaccctgattatgcgaacaatgaattgggttggaaagctcaggaaactctggaagatacactgcgttctgcttgggcatggcagttgaaacttcgtgaaagaggtatccaataa

SEQ ID NO: 4106 - DNA, 834 bp, B.fragilis
cccaaagacatgattacatttccgaatgccaaaataaatctgggactgaacattaccgagaaacgtccggacggataccacaatctggaaactgtattttatcccatacctctggaggatgcccttgaaatcacaatattaaatgactcgaaacaaaaatttgtcctgcaccaatccggcctggaaatcagcggggagccggaaaccaacctggtagtaaaggcatacctgctgctggaacaggaatttcaattacctccggtagacatttatctatataaacatattccttcgggtgccggtttgggaggtggctcggcagatgctgctttcatgctaaaattgttgaacgaaaaattcaatttacatctggcagatgaaaaattggaagagtatgctgccatattaggagctgactgcgctttttttattaaaaacaaaccaacctttgcagagggtatcggcaacattttttccccagtcgatttatcattgaaaggatatcagttggtacttgtaaaaccggatgtctttgtctcgacccgagacgccttttcacaaatacaacctcactacccggatcattcattgaaagaaattataagacgtccggtaagcgaatggaaaaactgcatgttcaatgactttgagaaaagcgtctttccacaataccctgtcattgaagaaataaaaaaagaattgtacagcaaaggagccatatatgccgccatgtcgggttccggttcatctgttttcggattattctctcccgaagaaaaaataacgaaaatggattttgaagcagcattctgtttccaaaccgaattgaaataa

SEQ ID NO: 4107 - DNA, 1797 bp, B.fragilis
aaattacaaattaagattaataaattgatgaaatcaatcaaacgaatcttctttctcctgtcctttataagtgtttcctatttaagcacctttgcacaagagaaccaatcctacttcctgcacaccattgaaaagggccaaagtttatactccatctcaagcatgtatggagtcagcaaagcagatattatccgactgaatcccggttgtgaggacaaaatctacgcaggacaagccattaaaatcccacagaacaaaactgctcaaaaaggtgaaacctttcatacgatccagccgggcgagacactctatcggctgacaacgacctataaagtttctgccaaggctatctgtgacgctaaccccggattaagcgcggagaacttccgcatcggacaagttatccgtattccttcggctgccgaggctatcgattcgaccgtagaagctgtagtggcagctccctcagagcctgctatgcaaccggccgtcaagccacgctgtaaagatatgcataaggtgaaacgcagagaaaccattttcagcgtcagccgtgaatatggcatttccgaacaagaactgattgctgccaatccagaattaaagaatggcatgaaaaaagggcaatttctctgtatcccctacccgtctgaaaaaccgacagtcactgtccccaaaacagatgccaacatcataccgccaagtgacagcgaattgttccgtgaaaacaaagaagttcctaagagcatttctactatcaaagcggccctcctgttaccatttgacgacaaacggatggtagaatattacgaaggtttcctgatggcagttgacagtctgaaacgtaccggaacttcaatcgacctgtatgtatacgattgcaataaagaaagttcgtcgctgaacagcattctggccaaaagcgagatgaaaaatatgaatgtgatcttcggtccggcgcaacaacaacacatcaaaccattggcagcctttgccaagaaaaacgatatacgcctggtcattcctttttcctcaaaagagggagaagtattcaacaacccgtttatctaccagatcaatactccgcaatcttatctgtattcggaagtatacgagcactttacacgccaatttccaaacgccaacgtgattcttctggaatcagcggttgtagataaagataaagtagagtttatcaaaggtctgaaacaagaattgggaagcaaaggtatacccgtaaagacattgaaagaaaatgccccggtagaagctctaaaagcagctctgcacaatgacaaggagaatttcttcattccgacttcgggcaatgatctgacgcttctgagaatcattcctcaattgacattactcgttagagacaatccggaagcacgtattcatttattcggttatccggaatggcagacatatacaaaagaccatttggaaagtttctttgaattggatacctatttttactcgtcattctacacgaacaatctattaccggccgccatcaacttcactcaggcatatcgcaaatggtacagtaaagagatggaggaacggtatccgaagtacggtatgctgggctttgacactggatacttcttccttaaaggactgtctaaatacggttccgaactggaaaagaaccttccgcaaatggatttgactcctatccagaccggatttaaattccaacgtgtcaacaactggggaggatttgtgaacaagaaagtattctttgttcatttcacaaagaactttgaattgattaaacttgacttcgaatga

SEQ ID NO: 4108 - DNA, 1359 bp, B.fragilis
acagataaaatacagaattgtatgttgaagacattttcaattggtggtgttcatccacacgaaaataaactctcagcacatcaacctattgttacggcagaggttccggcaaaagctgtgatactgctggggcagcatatcggtgcgcctgctaagcctattgtggcaaaaggtgatgtggtgaaggtgggcactaaaatagccgaagctaatggctttgtttcggcagccattcactcttctgtcagtggtaaagtcgctaagattgactctattgtcgatgcgagcggttatgctaaacctgctatttttattgatgtagacggggatgaatgggaagagtctatcgatcgtagtcctgaattggtaaaagagtgcgaattgacttcggaagagattgtgaagaagatagcagatgcaggcattgttggtttgggaggagcttgtttcccaactcaagtcaaactttgtccgcctccttcatttaaagcagaatgcgtgattatcaacgctgtagagtgtgaaccttacttgacagccgaccatcaactgatgttggagcatgccgaggaggtaatggtaggggtggctattctgatgaaggcggtgaaagtcaataaggcttttataggtatcgaaaacaataaacccgatgctatccaactgatgacgaaagtcgcatccagttatgccggtattgaagttgttcctttgaaagtgaaatatcctcaagggggtgagaagcagttaatcgatgctattacgaagcgccaggttgcaagcggcgcattacctatctctacaggagcagttgtgcagaatgtaggtactgcatttgccgtatatcaagctgtacagaaaaataagcctttgtttgagcgtgtcattacggtgaccggtaagtctgttgcccagccttctaactttttggcgcgtattggtactccgatgcagcagttgatcgatgcctgtggcggtttgccggaggataccggaaaaataattggcggtggtccgatgatgggtaaagcattggttaatactgatgtgcccactgctaaaggaagttctggaattttgattatgaaccggaaagaggcaaaacgcggagaagtacagaactgcattcgttgtgcaaagtgtgtgagtgcctgcccgatgggactggagccgtatctgctttccgctttggctgagaacacagaatttgaaagaatggaatcagaaagaatcatggattgtatcgagtgtggctcttgccagttcacttgtcctgccaatcgtccgttactcgactactgtcgtctgggtaaggggaaagtaggagctatgattcgtgcacgtcaagctaaaaaataa

SEQ ID NO: 4109 - DNA, 1272 bp, B.fragilis
aataatctgatcataaaatataataccatgaaaaactacttaataacgtatagttgtgccatgtttctattagcctcttgcggatctccatcccaacagccaaaagcaccgggacagatagatattgccggaaaaatagagagcctgacggaacttaaagcatctgattttatcaaagagatcaactatgtggcattggagactacagacagttgtttagtaaacgagaatcctaatatacaggttttcaaaaataacattattgtaaatacaaacaaacaatgtttggttttcgataaagacagtggtaaatttctgcgttctatcggtcatataggtaatgacccgggaggatacagcgaagcaaccttctggattgacgatataacaggagaactgtatttcataggatggaacggtactcttatgcgatacgacctgcaaggcaactacttgggtgacgtcaaggttgcctcaaacctgggagtaagaaatcccgcttgttttgttttcacagattcattaattgtcagtcatcaattgagtctcctgccaatacaaggaaatgaaaagaaatctcctttcctacttctagacaaacaaggaaatgtgatagatagtatcccttctttactcccggttatacctgtcaccactaatgtagtacgattaaacatattaaaaagtgaaaaagcacgggagctttacggtaatataggagttcatggtatgatgacagcatactttaataatgatgacgccattgaatcaccacgagtgctttcaacactatggaaacataacggaaaagtacgatttaaagaggcatatctggatacaatctatactttatccgaaaataaattatctccttatctgattttcaatacaggcaagtatcattatccggcagaagaaagatatcagcaaaaagaaaatgacgaaagagtcaagatcgactatgtgatggaaagtaccactctgatcatcttccagttcagacaacgaggagaagtgtataccggtatatataataaagatactcaaataactcaaatagccaaaggacagaattttgtaaacgatatcgatcattttatgccattaaatccccggaattgtaatactgacaatgaatatgtagatctcgttcaggcaaacactatactggaatggatggaagaacatccggaagtaaatccagatggcaagttctctttcatcaaaggaataaatgaagaatccaatccggtcgttatcttaatgaaatag

SEQ ID NO: 4110 - DNA, 840 bp, B.fragilis
aaaaggtatgttgatttatggtgtctgcatcggtttgctgacggttgttatccgtctgtttggtgcatatccggaaggtatgtcgtttgctattctgattatgaatgcattcactccgctaatcaatacgtattgcaaaccaaaacgctttggggaggtagcgaagaagaaatgaaaaagttagaatcatcattgaaaaatatgttgctggtactcaccggagtaacagctatctcggtagctttgctggcttatgtgaatgagttgactaaaggtcctattgcagaggcgaatgcgaagacattgaatgaagctttaaaagaagttttgcccgaatttacaaataatccggtcgcagagtgtgataccgtgtttagtgagaaagatggcaagaagattgttgactttatcatttatccggctaaaaacggagatcaatgggtaggaacagcagtagaagccaagtcgatgggatttggcggagaattgaaagtacttgttggttttgatgctgaaggtaaaatctacaactattctttgttgtcacatgccgaaactccgggacttggttccaaggcggctgactggttcaaagaaggaaacaaaggtagcattaagggaatgaatccgggtgagcaaccgctgactgtaagtaaagacggcggacaggtagatgccattactgcttctactatcacctcacgtgcatttttgaatgctgtgaatgctgcctatggtgcttataaaggcaatggtggtgctaatggtacgaccggtgcttcgcagaaagttgtgcagaagtccgaaactgggattgtcgattcagtagtcattaaataa

SEQ ID NO: 4111 - DNA, 1647 bp, B.fragilis
ttttcattattgataaaactctatagaattatgtcacatattgatagaatgaggcagttaggaaatattgcactaccaaatgaggatagtccacttcatgatataatagtgaaaaagttaaaaaaacatgattcacccgatattcaaaaacgagttggagaagcttttaataaagcttttgctattgtcgatgcacaaagaaagaatggtgcaaatttacctattgatatagaattgcgttattatttagaagagtttaattcaagagcatggaaatatggattaagaacgatgccatcctctttcaatgtaatggaggctttctttacatataatcctcaattaaattcttttttcttattagacgaagaggattttctaattgattttattgactttatcgattatgctacttccaaagattgcccaaataaaatcgaagaatcattaaaattatttgatgaagatagaatttacaatttcacagtaactaataacccaccagacatagatttttcattattggataataaaataaaatatgcaataggtggagtttctatgataaaacgaggagatgaggtttctatgattcttttagctggggagaaaaattcggacttaagtttacctcctcttaaagaaaccaaaagaattcctggtaaaagtcgcttggaatatagcccagacagagtgcaagaaaaagtacgtttttgggatgacgaaggttattggaagacaataatccttttaagatttgatgttttaaccatggagctagacgcaaaattcataaataaagatatgggtaactctttttctgtattgacagattatattgagtcgtttttatcagaaaaaggggagttcctgtttccagaagctgaaaattatctaaatgaacaaaaggtaaaaatacaaaattattatcctttgtttgagattgctagaacgtgtttacatctattgtcttatgtggaaaagtacacagactcattatcgtcggaggagcatataacagtattaggacatgaaccgataaaacctagatttttcaaaaaagataaaatggttccaccaaaatatgagttgcgaaaaagagatgtatggaatttaaagaggcaaagggataattattcctctagcataataacatttaatgatgacttcaaattggaaactagtggctattggaaatcattgaaacctaacgaaataggtcagaataaaaatggtgatgaaatacatggaaaaacatgggtaagcataacaaaaacttggcatgaaacagaaaataaacctataaaaataacgaataatataaagactctcgtaaacagtgttaatagtggatttatttatataatgagaaatgcatctcacgaaaaaaatatatttaaagtaggcttaactagaagagattgtgaaactagggcaaaggaactttcatctgcaacaggtgttccagataaatatttaatcgtagaagaatttgcaaccgctgattgcgttctagctgaaaaattgatacatgaaaaactagatgattatcgattaaataataaacgagaattttttaaagcgaattactctttcattagagcaacaattaatgagattgtcaatgaaataaatagtaatacttaa

SEQ ID NO: 4112 - DNA, 828 bp, B.fragilis
ctttgcgcattatttaaatacagaatgaagaagaacatcattataacgctgcttgcagctactgttttatcctcgtgtggagagtacaataagttgctaaaaagcactgattacgaatacaagtatgaggccgctaagaactacttcgccaagggtcagtataatcggtcggctacattgctgaacgagttgataactatcttgaaaggtggtgataaggcagaagaatcattatacatgttggctatgagttattataatcagaaagactattctactgccgcacagtcgtttatcacttattttaatacatatccacgtggtcagttctctgaattggctcgttttcatgcaggcaaagctttgttcttggatactccggaaccccgattggatcagtcaagtacttatcaggctatccagcagttgcagatgttcttggaatattatcctcaaagcagcagaaaacaagaggcacagaatatgatttttgctttgcaggataagttggttttgaaagaactttattcagcgagattatattataatctgggtaattatatgggcaacaactatctgtcttgtgtaatcacagcacagaatgctttaaaagattatccttatactgattatcgtgaggatttatctattttgattctccgtgccaaatatgagatggcagtgaatagtgtagaagataaaaagatggatcgttatcgcgaaacggtagacgaatattatgctttcaaaaatgaatttccggaaagtaaatatctgaaggaagccgaaaggattttcaaagattctcaaaaagtaattaaagactaa

SEQ ID NO: 4113 - DNA, 216 bp, B.fragilis
tcaatgttttttaagataaaaaagaatggaagaatagagtttagttacgaatggcgaataagcattgatggatggttaatttataaacaatatagcagctattcattaaccatccaccacttagtcacagattttacagtttatacaagtcgcttgccgccaacaagtcaactttcttttccgtcaacacacggatacagttttccatatcattag

SEQ ID NO: 4114 - DNA, 534 bp, B.fragilis
aagctaccttcgcattctcgcaccgtaatcagtaatattttatcatataaaatgaatactcttatgacccagattcatgagctgcaacatgtggctcacgaattattgtatttgggtgctgacggttctcctatctataccgacagtttccgtcaattaaacactgaagtgcttcaaaaatctgatgctttgtttgctttgaaaggagaaaatccggaagaagaagcacgactttgcctggctctcttgatgggctacaatgcaacaatctatgattatggcgacaaggagtctaagaaacaggttattctggatcgttccttgcttgtgttagagtctctcccgtcttctttgctcaagtgtcagcttttgacatattgttatggagaagtttttgaagaagagttggcaaaggaagctcatgcaattatagattactgggataataaaactttatcgatagatgaacaggagactgtagatatgctgaagatgatagaggaaaatcagtatccgaatagttatattgattaa

SEQ ID NO: 4115 - DNA, 486 bp, B.fragilis
cttttttattccggattaaacacaactttaaaaactatgattcaacgaattcaaacgatttatcttttacttgttactgcattattgataacaagtatgtgtctgcctgtgggcagctttataggtgctgatgctgcaatgtatgtttttaaaccattgggggtagagatgaacggtacactttattctacatggggggtatttggtatcttgttgctcagtgcaatcattgcattcgctacgatctttctgttcaagaaccgtatgttgcaaattcgtatgacgatattcaatagtattctgctgattggttattatcttacttttcttgccttcatgtttgtcctgaagaaagatctgagtgctactttccagatatcatgggcattatgcctgccgttaatttcgattattctgaattggctggcggtccgtgcgataggacgagatgaagtgatggtaaaggctgccgatcgtctccgataa

SEQ ID NO: 4116 - DNA, 321 bp, B.fragilis
agtcagtattctggctttgatggcagttctgttgataacaataagcttcaagaaattcaaaaacaggttatgattaaatatcttatagagaaagaattcaagcagttgctccgcaactccttcctgccgaggttgatatttatcttcccttgcatgattatgcttcttatgccttgggcggccaatcttgatataaaaaatatccggatgaatataatcgataatgaccattcggttagttcccgcaggctggtggataaaataacagattcaacttactttcagaccaatgcttggcggattcttacgaaaaaggtatga

SEQ ID NO: 4117 - DNA, 183 bp, B.fragilis
gtcataaagtcattattcatgttggggatatctatcttggtggtattatatgtatatgatgcggggatatcccccaatgccgcagttgtattgaatgagtatccgatgacccggatcgttcctgagcgtgtgagtaattttcctttcttcagcacaggtgaagaagcaccatttgaggtatag

SEQ ID NO: 4118 - DNA, 3507 bp, B.fragilis
aaaagaaagtccattattctcaaaaaaagagaatcggaaagtacccccatactttccgattcgaaacagtcaaaaatcgaccttaatcaatttattaacttaacacgttacaaagatatgagaaaaatttctttgccgaggcatttatgcccaaaaaattttgtttcaaaacaaatattgttagccatgaagatcactttattccttctctttttcgtagcattccaagcttacagtgagaatggatactctcaaagcactaaaataagcataccgcgttctagtctgaaagtaagcgaattactatcaaaaatagaatctcagacaaagtacctgttcgtctacaataaaaaaaacgtagacaccagacgctgggtgaacgtgcaagccgataacaaagctgtatccgaagttctcgaccaagcattcaaaggtaccaacattaaatatgtgatggaaggtaacaacattgttctgaccagaaacaatgataatgccataactgcacaacaggacagagtaaccgtaaaaggagttgttactgatcagaatggtgaccccatcataggtgccaatgtacttgagaaaggtactaccaatggctgtatcaccgatatggagggcaatttcaccctcaatgtacccagtaacgccactcttgcaatcacctatatcggttatcagccacaaaatatccaggtgaacggacggcagagtttcaacgttaaactgcaagaggaagccatggcactggaacaggtagtggtaaccgctatgggtatcaagaagaaagaagcttccttgacttactcaacccaacaagtgggcggtgacgaattgacccgtgccaaagatccgaatatgattaatgcccttgccggtaaaacagcaggtgtacaaatcactaaaagttcatccggactgggtggttcggccaaagtttccattcgcggtagccgttcgatcagtggaaacaaccagcctctgtatgttatcgacggtgtaccgatgctgaacagtagcaatgaacaagcttccacagctattggtggtacagccgatgcaggtaaccgtgatggcggtgacggtatctcaaacttaaacccggacgatattgaaagtatgagtatcctgaaaggagcctctgcagcagctctctatggctcacaggctgccaacggtgtgatcttaattaccacaaagaaaggcaaagccggtattcaaaaaatcactttctcttctaatctgactgtagaccacgccatttgtttgcccgaattccagaacaattacgccatggaccctgaagccaaaaacagttggggaaagaatcaaacactgaaagattataataacgccgataatttctttcagaatggtgtaacagccatcaactccgtatcttttatgaacggcagcgaaaagatgcaaacttacttctcttatgccaatactacagccaaaggtatcgttgagaaaaataagatgcaaaaacacaacctcaacttccgcgaaacggctaacttctttaatgattacctgaagctggatgccaacgtgaacctgatgacacaaactatcaaaaaccgtcccacctccggtggctattatatgaatccgttggtaggtctctacggtttcccgagaggtgaagatttatccgaatacaagaataatttcgaagtcttcgatcctgcccgtaacatgaacgtacagaattggtatacttcttatcaggacatggaacaaaatccctactggattaccaaccgcatcaacagtaatgataaacgcacacgtgcgatcgcttcactaacagccaacgtaaaaattaccgactggctgaatatccaggcacgcggtacagccgactacacacacgaccagtatcaacagcgcatgtatgcctctaccgctcctgccttagcggggcaaaacggacgttacatcgacctgaatcatactgaaacattgtattacggcgacgtcatggctatggtaaacaaaaaatggaatgacttttcattgaacggagccatcggcggcagtatcaacagtacaaatgtaaactccctgagactggattctaaaacagcttccctgtactatccgaatgtatttacggtagccaacattaaaatgacacaggctgcctacatcgacgaacaaatgaatcagaagcgagtgttgcagtctttgttcggaaccgctcagttgggttggaaagaaagtctgtacctggatgttaccgcacgtaacgattggtcgtcgacactggcctataccaagcacagcagtttcttctatccctcggtaggtctgtcatgggtactgaacaatacagtgaaacttcccgaatggatttctttcgggaagatcagaggttcttggtctaaagttggcaatgaccttccattgttcatcagcaacagtatccctggcagcaatgatatcatcggagcaggtggtgccatcgtgacttactccaaagcccccttcaacgatctgaaaccggaaatgagtacttcttatgaaataggcaccgaatggatattcttcaattaccggctcgatctcgatattagttattaccgcaccaataccaaaaatcagttattcacattgccttcatcggcaggtgccgactataaatactatatggtaaatgccggtaatatacaaaacgaaggtgttgaaatcactcttggagctactccggtaatgaacgatgctttccgttggaaaacccaatttaacttctccaccaacaaaaacaagattatcaagcttcatccggatctcaagacattcgtttatggtgacgaaagcttctcttcttcttactccatgcgtttggtagaaggaggttcattcggcgacatttacggtaaagcattcgaacgtgacgaaaatggcaaagtggcatttactacagataaagacggagacaagatcccgaacgttatcggtggcggcaatacagaaaaagtaggcaactgtaatccggactttatgttaggatggagcaatacattcacttataaaggtttctcactctacttcttgatcgacggacgttttggcggcgatgtactctcacagactcaggccgaactcgaccaaagaggtgtcagcctgaacagcggtaaagcccgagatgcaggatatatcaatattgacggaacacaagtgaagcctagaaaattctacaccgcagtcagtggacgtgacggatgtacggagtactatatgtacgacgctaccaatattcgcctccgcgaactctctttgggctactcactccctcaaagctggttggctaaagccggcggtgcatttaaagatgtccagttgtcatttgtagcccgcaacctgttcttcatctcaaagaaagctccgttcgatccggatgccgttctttcgacaggtaacgataatcagggtattgacgtattcggcatgccgactacccgtagcttaggtttcaatattaagttcacattctaa

SEQ ID NO: 4119 - DNA, 2433 bp, B.fragilis
agcatttttccatctgctcccgaaacatctccttttacattaaatttagggtcagaattacaagaacttaaagcaagagccacaagagctactaacgttacttttttcataatattcgtgttatttttcaagctgcaaatatacttcttttcaagattagtcaaagcattttgccgcgttcttcgttccaaaattgaaaaaaatcaaattcctgctaactttttatctcattttcacgatattagtgcaataaatgtatatctttgcgggaattttgaaagaaagatattagataaaacaatttttatgattaacccaattgttaagacgatcgagttgggagatggcagaaccatcacactcgaaacgggaaagctggcaaaacaggcagatggttctgtgatgcttcgcatgggaaacaccatgttgttagctactgtttgtgccgctaaagatgcagttcccggaacagatttcatgccgcttcaggtagagtataaagaaaaattcgcagcattcggccgctttcctggtggttttacaaaaagagaaggaagagcatctgattatgagatccttacttgccgtttagtagaccgtgctctccgtcctttattccccgataactatcacgcagaagtttacgtaaacatcatccttttctcagcagacggtgtagatatgcctgatgcattggccggattggctgcttccgcagcactggctgtttcagatattcctttcaacggaccaatttcagaagtacgtgttgcgcgtattgatggtaaattcgttatcaacccgactttcgatcagcttgaacaagctgatatggatatcatggttgccgctacttatgaaaacatcatgatggtagaaggtgaaatgagcgaagtgtcggaagccgaactactggaagcaatgaaagtagctcacgaagccatcaaagtacattgcaaagcacagatggaactgactgaaatggttggtaagactgttaaacgcgaatattgtcacgaagaaaacgacgaagaactccgtaaagccgttcatgatgcctgctatgataaatcatatgctatcgcagcttccggcaacagaaacaaacatgaacgccaggatgctttcgatgcaatccgcgacgaattcaaagcacagttctcggaagaagaactggaagaaaaaggcgctctgatcgatcgttattatcatgacgtagagaaagaagcgatgcgccgttgtattcttgatgaaggaaagcgtctggacggacgtaaaacaactgaaatccgcccgatttggtgcgaagtaggttacctacccggacctcacggatcggctatctttactcgtggtgaaactcaatcattgacttcagtgactctgggtactaaactggatgagaaaatcatcgacgatgttctcgctcacggaaaagaacgcttcctattacactataactttcctcctttctctacaggagaggctaaggctcaacgcggtgtaggacgtcgtgaaatcggacatggaaatctggctcacagagcattgaaaagaatgattccggaagactatccttatgtagtacgtgtcgtttcagatatccttgaatcaaacggttcttcatcgatggctaccgtatgtgccggaactttggccctgatggatgccggtgtgaaaattaaaaaacctgtatcgggtatcgctatgggattgattaaaaacgcaggtgaagaaaaatatgcagtgttatctgacatccttggagacgaagaccacttgggcgatatggacttcaaagtgacaggtactaaagacggtatcacagctacccagatggatattaaggtagacggtctgtcttacgaaatcctggaacgcgccttaaatcaggcaaaagaaggacgtatgcacatactcggtaaaatagaagaaacaatttccgaaccacgtactgagctgaaagatcacgctcctcgtatcgaaacaatgactattccgaaagaattcatcggtgctgtaatcggcccgggcggaaaaatcattcagggaatgcaggaagaaacaggtgcaacaatcactatcgaagaaatcgacaacgtgggtcgcatcgagatctcaggaactaacaagaaatcgattgatgacgcaatccgcttgattaaaggtatcgttgctgttcccgaagtaggtgaggtatacaaaggtaaagttcgctctatcatgccttacggtgcatttgttgaattccttccgggaaaagacggtttactccatatctctgagattgactggaaacgtcttgaaactgtagaagaagccggcattaaagagggtgacgagatcgaagtgaaattgatcgatattgacccgaagacaggtaaattcaaactttcaagaaaagttttattgccacgtccggaaaagaaataa

SEQ ID NO: 4120 - DNA, 1617 bp, B.fragilis
gttatgaatacgaagacaaaacttctgtatgtaggctttcgtgcgttaaacacatgctgtctgtacgcggcttttttaatgataacatcgtgtggcgacaatgttgtgaaccccgacagtccggaaccggacggagaggatatgattcctgttacggtcagccgggttgaggatggcagctatatggaaagccatattgatactcccgacacaaccgggggaagaacgcttgtagacgaatgggtgccggtgaaagagccacccgccagcagggccataccggctgccgtgccttacgaggggccttcagcggtacggatgacgctccgcgaagagccacaagtccctacccgtgccgctacattgggcaacggcatttatttccggttgatcgctttccgtaaagtaggcagcaattacgtgttccagtcggcagcggattttacgacgaacggggcttccgctcccacactcaggctaggaaatctgctcaccagagcaggaactgtccgtgtgatcggatactcgttcaatagtacggcagcgatgggaacgatcccttcatcctatacttataacagtacttccgtcactatcccgaatatgaacagtgactttatggtctatgactcgggggaaatagcgaatgtgagcacaatcagccacaacctgtcggttagtttcacgcaaaaactctgcaagctgacggttaagctatccttgtcgcagtttgtaagcaacacatttaccaactgtacgggcgtatacgtttctcaaggcggcaatacgtccgcctggacgataggtccttctacaaataatgtaagtgccaataccggaaatacacctacattcaatatagccaataattcgactgccactatacggttagttcctttttcgggttcccgggcaatcacggtgcatatcggtacgctgactctcagtaattacttcaacgcaaataaccggaatatcacctcgagtcagaatgtccagttgctgccgggacggagctataccataacactacagatcggacttgggatacaagtggcggcaagtgacattaacctgacacaaaatggatgtacagcgagtgataaaaatgacttggcaaagttgagatgggctacaggaaatttgaagagtacaggaagtgcaaattatgtatgggcttcttcaacagatagaggttattattacacatggtacagtacctatacaggaaacacaaatattaataatacagatccatgttccaaattgaatacagcatattacggtacaggttggcgaacaccttcaaagaatgaacttacgaaattagcaagatgcacaaacaaaatattaactaatagtggaatgtggtttatgaataacagcataggactttttttacctgctgcaggttgtcggcaagacggaaatggtagtaatacttcgccaacaacagattccggaactgatggctactactggagtagcgatataggtaatggaaataatacagggaaaagactatattttggtaaacgttataataccgcagatgtagcggaccatgccaaaaacgccggactgactgttcgttgcgtaaaaggcactaaacaataa

SEQ ID NO: 4121 - DNA, 762 bp, B.fragilis
atcatgaaaacagaactcaaaggctggcttgcggacaataccgtaaccaccgacaacaaagaagacaaaatcctggtattggaaagcgccggaaacctgacactatccgatgtactggatgaaatgaagaaagaagataccggcttgcgggcagagactttaaagcatgccgtcgacctctttcagcgtacagtatcggaattggtactgaacggatactctgtcaatacggggttattccgtgctgttccccagtttcgcggtgtaatagacggtggagtatggaatcctgagaaaaattctatctatgtttccttcaatcaggataaggatttacgtgaagctatcgcacgaaccggcgtgaaaattctgggagtcaaaggcgattcagcctattttatcggtggtgaagacgccgccacccgtgctacggacggtagtgcaactgcaggacgtaactatcgcttacaaggcaagaacatcaaagtagcaggtacagatcctgctgtaggtatcgtcttgattgatgaaaaaggcacggaaacgaagctaccgatggatatgatagcagtaaacaacccttcggaagtactggtactcctaccggcagacctgacagacggaatatacaaactgcgactgactacgcaatataccagtggcaaccggcaactgaagacaccacatgtcatcagccaaaccatcgtaataggcaatacaaccgagggcgacggagatattgtggacgacccgacagcataa

SEQ ID NO: 4122 - DNA, 261 bp, B.fragilis
tgcaacaaagataagatgctttttttacttgtgcaaatcttttcgcatcgttttaattatcagtcatttatctattccctttgcattttgtacagagagcaagaatcctgtttcaaaagacgaacgtcttttgaaacaccacctgtgtattcaagacagttatatctgattggaatacacaaacttacgcataataaaagttgtatcaaacagtctttaccgacttatacccttatgtataagtcgggcaagagattttga

SEQ ID NO: 4123 - DNA, 942 bp, B.fragilis
aaacattttatggaacaggaactgctatacaagtattttaaaggaaccacttctgaagaagaagaaaggctgattctggattgggtggatgcctcccccgagaatcggaaagcatttcaaaaagaacgcatgctatatgacatagccttattcacagacgaaaaacagatgaaccggaaagatagaaaagcccggatcatccctatgctgaggtggagtgcacgtattgccgccgtagtcattgtagccatcagtttcggattcttgtttaagaactatcagtatgaaaaatcagcttgccaacaaaccataacagtacctgccggacaacgcgcacaaatcacactggcggatggaaccaaagtatggttgaactccaaatcgaccttaacctatgcatccaacttcggtcgtaaagaaagaaatgtagagctggatggagaagcctattttgaagtagccaagaataaaaaaataccattcttcgtcaatacggagattaatcgggtgaaagtggtaggaacccatttcaatgtctgcgcctacaaaggcagcaacgaatttgaaacgactttaattgagggaattgtcgacatctatccgatagggagtgatcaggtaattacccggttgacaaaagacgaatttttcggatcgtacaatggaaaatataaaaagaccactttgccttcgtacgaatatctgagatggaaagagggattatactgttttgatgatgcaccctttaacagcctgctcaacaaactggaaaaatattataatgtgaacatcagcgtgagaaacctgaacatactcaactaccgttgtaccggtaagtttaaagaacaggatggcatagaacatatcctgaaagttattcagaaagatcataagttcacctatagtatcaacgaagagaaagacagcatcatcattgaatag

SEQ ID NO: 4124 - DNA, 1125 bp, B.fragilis
actaagaatatggataaactgaatataaactctactccgtcttctgtgaagaatggacggggggaaaggctccttgttatcaatcccggttccacttcaacaaagatcgctgtttatgaaaatgaaactcctttgttggtacgcaacattcgccatacggtggaagagttgtctgccttcccccgggtgatcgatcagttcgaatttcgtaaatcgcttgttctccgagagttggaggtaaacgatattcctttccggttcgatgctgtcattggacgcggaggcttggtgaagcctattcccggtggagtttatgaggttaacgaagccatgaagcgggatacccttcacgctatgcgtacacatgcctgcaatctgggaggtttgatagccgatgaattggccgcagctttacccggatgccgggcgtttattgcagatccgggtgtggtggacgaactggaagaggttgcccgtattaccggttcgcctttgatgccgcgtatcactatctggcatgcactgaatcagaaagctattgcccgtcgttatgctgccgaacatggcactcgttatgaagatcttgatttgatcgtctgccatttgggaggaggtatttctgttgcagtccatcgtcatgggcgtgcagtcgatgccaataatgcattggatggcgaagggcctttctcacccgaaagagccggaactcttcccgccggacaactgatagacctttgtttcagcgggaaattcaccaaagatgaattgaagaaacgaatttcgggtcgtgccgggcttaccgcccatttgggaactactgatattcctgccattattcagtccattgaggcaggtgatgaccatgcccggttggtgctcgatgccatgatctacaatgtggccaaaagtatcggtgctgcctctactgttttatgtggaaaggtagacgccattctgctgaccggaggcattgcctattccgattatgtaatttcccgtttaagggaacgtatctctttccttgctcccgttttcgtgtatccgggagaagatgagatggaggctttggcattgaatgctttgggggctttaaggggagaacttccggtacaggtctatcagtga

SEQ ID NO: 4125 - DNA, 570 bp, B.fragilis
aatctattcatgccaagcaacaacagccttcacaccatggacttattcagccagttctttcaagaaaaccagaagaagtttctgtcgtttgcttattcatacacccgaaataaagccgcagccgaagatattctgatggaagcaatggccagcctgtgggagaatcgcaaaaaatgggaaaaagattccaacctgcatgcattgctgcttactatcatcaaaaacaaatcactcaattatcttgaacacgaacaagtgcgtatgaaagctgaagaggtgatcaatacacataagcaacgtgaactcgatctccgtatctccaccttggaagcatgcgaacctgcgacaattttcgatactgagatacaacgcatcgtatataaaacacttgaacagctgccggaacaaagccgccacattttcatattaagccgttatcacaatactcccaataagaagatagccgaacaactcggcatttctatcaaaagtgtagaatttcatatcaccaaagcattgaaactgttgcgtctcgaactcaaagattatcttatatccctacttttttaa

SEQ ID NO: 4126 - DNA, 1629 bp, B.fragilis
aagagattcatcatgaaaaacaatatcaaatatatagcaggcatactcttaggaggattgatcggattttcagcttgtactgattcttttgagtcgttcaacaccaacgaagcaggattcgataatgatagtaaaaaacaggatttcaattattatggcatccctttgggaatcattcagcaaggaatctacttcaactacgactggggaagcggcaagaactggccttttcagaccatgcaaaacctgggggcagatctattctcgggatatgtgcatgacttcaatcccttcaacgaaggaaagaacaacagcacttactacatgatggacggctggaacggttctacatgggataatacctatggatacattatgccggaagtacagaaatcagagactattaatgaaaaagacaatatagggttcttcggtattaccaagatactgaaagtggaattaatgcaccgcttatccgacctgtatggaccgatcgtctatactcagttcggatcaaaaacgggttctacacccgatacgcaacaagaagcatacaaagctttcttcaatgacctggatacaggtattgccaagatacgtgaatatcagaaagccaatccggacattgagagttttgcaaaattcgatatcctgatgccgcagggaaaacgcacattcagcgaatggatacggttcgcaaattctctccgtctgcgcctggctgtccgtattgccatggcggactctaagctggctgtggcagaagcccaaaaagcacttacggatgaagaaggattgctggaaggcaatgatgaagtcgtagccgtttctacctcatcaggttatactaatcctttcggagaaatcaataaagcatggggcgaagtgtttatgaacgccaacatggagtctctattagtgggttacgaagatccccgcatggaaaagtattttgataaagcaaccggctctgatgcaacaagccttatcgactataaaggtacttacaaaggtatccgccaaggaacaggctttagtcataaaaactacaacggacattcaaaaagtaccattacccaacagacagacgccgtactgatgactcctgccgaagtatggttcctgcgtgccgaagcagctctgcgaggctggagcagcgaatcggtgaaggattgctatgaaaaaggcgtaaaagcatcatttgcacaatggggtgctgccggtgccgaagcatatctggagagtgacagaaagccatccgactatgtagacgctttcaaagcagccaataatgtgaaagcagtcaacacactgacccccaaatgggacgatgccgccggcaatgaagacaagctgggacgcatcattacacagaaatggcttgccatgttccctgaaggaggagaagcttgggcagaacaacgtcgtacaggctatccgagactgttccctgtattggtcaaccaaagtgaaggtacggtagataccaacctcggaccacgtcgactgaacttcttcgtaggtatcaaaacgaccaatcccgagcaatatacccaattggtaaatgcattgggcggaatcgacaactgcggcactcgcctgtggtgggacaccggaagaaatttctga

SEQ ID NO: 4127 - DNA, 750 bp, B.fragilis
tttttttcaattttggaacgaagaacgcggcaaaatgctttgactaatcttgaaaagaagtatatttgcagcttgaaaaataacacgaatattatgaaaaaagtaacgttagtagctcttgtggctcttgctttaagttcttgtaattctgaccctaaatttaatgtaaaaggagatgtttcgggagcagatggaaaaatgctttatctggaagcttccggacttgaaggaattgtgcctttggattctataaaattgaaaggagacggttcattcagttttaaacaattgcgtcccgaatctcctgagttttatcgtttacgggttgaagataaagtaattaatttctcggttgactcaacagaaactgttagcattcaagcaccttatacagatttctctactgcttatacagtggaaggatcggagaactctgcaaaaattaaagagctgactctgaaacaggttcgtctgcaaaaagatgtagatgcgttggtaaaggctgcacaggctcatcaattgggtaacgatgtttttgaagacagcttggccgtactactgaaaaattataaagatgatgtgaaaatcaattatatctttgcggcacccaatactgcttctgcttattttgcactatttcagaaattaaacaattatatgatctttgatccgttgaataataaggatgatattaaatgttttggtgcagtggctaccagtctgaacaatacttatccgcaagtcttcacc

SEQ ID NO: 4128 - DNA, 324 bp, B.fragilis
gttgaagcaatatcgatattatccgcattattagcaattagatttcctactgtcagtttgttgaagtgtactgttattgtccgggaacttgcgaaaggaaccatgcgtatcgtagtagtctggttagtgtttgggttgaatgaagctgtgttgctggtattagcagccactgccgaactgccaattacccacgaggttgaattacctccctgctttacgtatacccctgtacacccgctgatggtattacttgtgaagccggttacactaatgcttattgtcagtttacacagtttctgtttgaatgttaccggaagattgtaa

SEQ ID NO: 4129 - DNA, 954 bp, B.fragilis
aaatctaacgttatggaacctattagaaactttgaccaactgacagcccatctcaaaaccttaaaccggcggaaacggattgccgttgtctgtgccaacgatccgaatacagaatatgccattgcccgtgcactcgacgaagagattgcggaattcctgatgattggtgactcggccatcctgcaaaagtatcccagtctgcagaagtacccggaatatgtgaagaccctccacattgaagatcccgatgaggcagcgcgtgaagctgttcgtattgttcgggaagggggagccgatattctgatgaaaggtattatcaatactgacaatttgcttcatgccattctcgacaaggagaaaggcttgctgcctaaggggaagattctgactcatttggccgtaatgcagattccgacgtatgataaattattgttcttctcagatgccgctgttattcctcgtcccactttgcaacaacgcattgagatgatatggtatgccatctgtacttgccggcggtttgggatagaacaaccccgtatctctttgatccattgtacggagaaggtaagtgccaagtttccccattcgctcgattatgttaatattgtggagttggccgaagccggagagtttggtaatgtgattatcgatggtccgttggatgtacgcacctcttgcgagcaggccagcggggatattaaaggaattgtatcgcccatcaacggacaggccgatgtattgatattccccaatatcgagtcaggcaatgctttctataaatctgtttcgttgtttgccaaagccgatatggcagggttgctgcaaggccccatttgcccggtggtgttaccgtcacgcagtgattccggactttccaagtattatagtattgcgatggcgtgtctgacagcttctacccggtcggcagagagaggaagatgctccgaatga

SEQ ID NO: 4130 - DNA, 1647 bp, B.fragilis
  unsure (354): Identity of nucleotide sequences at the above locations are unknown.
tctgattattcattaaataaatttagaatgaacaaacttttgattatgcggacacacctcctatggatcggagtaatgacggcatccagcctttggttgagcggatgcacgcaagaagaaaagtatccattttttccggaaaaaggttatgattccggtactgtaatccctattaaaatcagtatggctgaaaatggagagtacgattcctatactccggaaaacgacatggctcctcgttacaatgctcctctgattgccgaatgggcaggagtacaaactctaagccgtacccgtacaaaagaatctccggaatataatggccccagaatcgcatctatggaactgacaganaatactccttccaccctaactacccgtgcaaacactctgtctacaggtgtttactttcgtctgatcgtgttccgaaagtcagggaataactatgtgttccaatcggctgcagactatacctcaaatggtgcttcttcacctgtgctgaagaaaggaaaattactcacacgctcaggaacgatccgggtcatcggatactcattcaatacaactgcggcattgggggatatccccgcatcatatacatataataccaccaagatagatatccccaacatgaataatgactttatgacttatgattcaggagacatagccaatgtgaacagtcttaattacaatcttccggtaacattcaaacagaaactgtgtaaactgacaataagcattagtgtaaccggcttcacaagtaataccatcagcgggtgtacaggggtatacgtaaagcagggaggtaattcaacctcgtgggtaattggcagttcggcagtggctgctaataccagcaacacagcttcattcaacccaaacactaaccagactactacgatacgcatggttcctttcgcaagttcccggacaataacagtacacttcaacaaactgacagtaggaaatctaattgctaataatgcggataatatcgatattgcttcaactcagagtgtccaattgaaagagggaatgagctatacaatgaaaatccagtttaagagaagccccggaataaatgttccggcaggtagcatcaatctgagcaatccgaaaaaagcatgtaccaatgatgataagcaaaagttatcaaaattggtatttgccgacggcaatttaaaaagtaccggtgcaagcaacaattatgtatgggcaaccaacaaagaatatggctactattaccaatggaaaaaagactataatggaaacaacatcgatccatgtgccagactaaatcccacaacttatggtagtggttggcggctacctacacgcaatgaattagaaagattgggaagatgcaataatgtaaaaaaggtctctaatggagtgaatggtttgtggttcctaaatgccacaaccggtatttttttaccgttaggtggctggcgtaataataactcgggaacaacggcagaagactggcctggaacgtttggtcaatattttacagatgaatcaattaatactaatgattgttatagattggatatatctcccggtgaaggtaaaactgatgtcaatagcacacaaaagaaaatggcatacacaactcgttgtgtcaaaggacctaaactataa

SEQ ID NO: 4131 - DNA, 267 bp, B.fragilis
acactagatgccaattcttattctgcttggcgtattggaggacggttgagctttaaaaatgaaacattagccatgatcttgcctcggttagagaaatggtacggacaaaagatcgattgcccgcagaaaactgctgatcattatcgctttacatttacgttgcggaatgaacctttggatctgatattaaatataatgtcgcatagtgcgccattaaattataaattaataagtaatgactactatgttctcgaagaacttaagtag

SEQ ID NO: 4132 - DNA, 1164 bp, B.fragilis
ttaatcgtatttatgagaaaatgcaacatgcggtggtttagtccgcaaagaatgaaaaagcatctggcttttgctttagcagttagcctggtggctatggtacctgtgagtgccttcgctcaagtactaaagatttcaatgacaaagaccaatgtatctattgaaaatgtacttcgtgaacttgaaaaacaaagcgattacactttcttctacaatgacattcaggtaaaactgaacaagaaagtatccatcaacgtatccgacgctccgatcgaaaccgtattgaacgaagttttcaaaaactcgggatatacctacaagattgtagacaatcagatcgtagtgtctacagcagctgcagcagcgaaagaggtacaggctacccagcaacagaaacaaagaaaaatttcgggagttgtgaaagatgcaatgggagaagccatcatcggagcatcggttatagaaaaaggaaatccgactaacggtactatcactaatattgatggtgagtttactcttaacactgccggtaaggaacttcaggtgacttatattggttatatacctcaagcgattgttcttaaaccgggagttaatagttatacagttaccatgaaagaggatactaaaactctggacgaagtggtggtagtaggttatggtactcagaagaaggtaaatttgacaggtgctgtgtcttctgttggagcggacgaattgaaagaacgtgtgaatacagatgtattggcatcagtacaaggacaggttccgggagtaactattatatcaggtccgggatctactccatcaattaatatgcgtggtcgcggtaacttgggaacatcttctcctctgtttgttattgacggtgcaattgctgatgcttctttcttttcaagtcttgatccgaattcgatagagagcatttcattcttgaaagatgcggcatcttctgctatttacggttctcgtgcagcttatggtgttgtattggtaaaaactaaaggtggtaaagaaggtgatttgaagatcagttatgatggttcggtcgcagtgaaaatggcgacttatacacctgatgtattgggctctgaatggtatgcacgtttgagtaatgaggctgctgtcttcaccgcggagtgccaaactaccctctattgcccc

SEQ ID NO: 4133 - DNA, 216 bp, B.fragilis
attttatttcttgtctgttttcctaagttccgtatgaacttagctttctattttattcattactttcaaaaatatcgtgttctacttaagttcttcgagaactatggcgttttttcccttttattatttctgtttctggattctacttacattttgattatattatactttttatcattttgtattttctatcccatctgtattgcctgcttttaa

SEQ ID NO: 4134 - DNA, 189 bp, B.fragilis
catcgtgcgaaaatgaaatttaaaagtccgcctcttaaaagctatttactacctcttattgattacaattcaactatcataaatataataaactcatattataagcatcatatagcatcccgttttaggatttatgtagcaaacaaatcgtatacaacacggtttgtctgtcataagttattctactaa

SEQ ID NO: 4135 - DNA, 240 bp, B.fragilis
  unsure (119): Identity of nucleotide sequences at the above locations are unknown.
ggtacacacactatgcgattgtccgaattaaagacaggtgagaaaggagtcattgtaaaagttttggtacacggtggcttccgtgatcgaatcgtggagatgggctttatcaaaggtanacccgtaggagtattgcttaatgctccattgacagaccggatctcatacgcaataatgggttatgtaatctctctgcgacgacaggaggctgatatgattgagattatcagcgagcagtag

SEQ ID NO: 4136 - DNA, 2373 bp, B.fragilis
agttgtcagacaaagcatcgaataagaaaactgatgaatcagattcttaagccacacaatcttcccccctcctttcaagggagggggtggaagataagtatcaaaagttggtggaaacctgcccttttcctccttcttgtcctgtatatattttgccttcccagccaattattcacctccccttactctaccgtcgtaacagaccggaacggtgaacttctcggtgcccgtatcgccacggatggacaatggcgttttcccccgcgcgagaatattcccgagaaagttgccacttgcctgattgaattcgaggatcgccagttctaccatcattggggagtcaatcctttggcaataggcagagccgtagttcaaaacctcaagcacaaacgtatcgtcagcggaggaagtacccttaccatgcagaccattcggttggctcggaacaagccgcgtacattcaaggaaaagctgattgaaatggtgtgggccacccgtttggaatttcgtaaatctaagaaagagatactgtcactttacatttcacatgcccccttcggaggaaacgtagtaggactggatgcggccgcctggcgatacttcggacactcggctgaagaactatcatgggcagaatcggccatgttggctgtactccccaactcacccgccatgatccatctttcgaaaagtcggcaagcactcctcgataaacggaaccgactattgacacacctgcataaaaaaggaattctggatacttcaacatatgaactggccatcagtgaaccacttccgcaggaacctttacctcttccacacatagcgcctcacctgacagactatttttatcaaacccgaaatggaaaatactccgtatcgaccatcgacagaggtatacagactcaaattgaaagtttggtagaacgatggaacagtgaattcaaacggagtgacatccgtaatctggcgattcttgtgattgacatccggacgaatcaggcgatagcctattgtggcaatgtacatttcgacaaagagcagagcggcaaccaagtagatgtcatccggtcgccacggagcaccggcagcattctcaagccttttctttattatgccatgctacaagaaggagaaattctcccaaatactttgttgccggacattcccgtcaacatcaatgggttcactccacaaaattttaatctgcaatttgaaggagccgtaccggcctcggaagccattgcacgctctcttaacataccttcggtaacaatgctgcaacgttacggggtacctaagttccacagtttcctgaaacaaatcggactgactaccctgaaccgtccctcaagccattacggactttctctgattctgggaggtgcagaagccacgttatgggatatcacttcggcctatgccaacatgggacgcagcctcaaccggttacctcaattcccgtgtacactcctcctgtcggattccatctccgttcatcgcccatcgtttcaatccggagccgtctggcagacttttgatgcaataaaagaagtgaaccgaccggaagaaatagactggcgtaccattccttccatgcaaaccattgcctggaaaaccggtaccagttatggtttccgggatgcctgggcagtgggtgtaactcctaaatatgcagtgggtgtatgggtagggaatgctacgggtgagggaaaacccgggttggttggtgcccgtacggcaggccctgtcctgttcgatgtattcaacctgctcccttcttctccctggttcgaacgtcctcagggcgaactggttgaagcagaaatttgtcggcagtccggccatctgaaaggacgattctgtgaagaaacagatactttgctgatccttccggcaggtctcaaaacagaagcttgcccttatcatcacccggtcaccttatcggcaaatgaacggttccgaatatacgagaattgtgccaatagcgaaccggttgtccgccgtaactggtttacccttcctcccgtatgggaatggtattataagcaacatcacccggaatatcgtcctctccctccctttaaatcaggatgtggagaagaccgattccaaccgatgcaatttatttatccgccaatgggagcccgtatccatctgcccaaacagatggatggcagcaaagggcagttgactgtcgaactggttcacagtcatccgaatacaaccatctactggcatctggacgagacatacctgacgcaaacgcaggacttccacaaactttctctccgtccgtcccccggcaaacactccctgacggcagtggatgacgagggaaatacaatttcgacaacgttctttgtggaatag

SEQ ID NO: 4137 - DNA, 1329 bp, B.fragilis
caaaactattatctttgcaatatgatacaaaatagagtagcacaatacatcgaaaaagagaagctgttttgtctgaatgacaaggtattggtgacattaagcggaggggccgactctgtggcattgctacgtctcctgctatcaatggggtatacctgcgaagctgctcactgcaatttccatttgcgggataaagaatcggacagagacgaagcttttgtgcgccgattatgccatgaatcaggggttcttttacacatagaacatttcgatacaacccaatacgccgcaaagaaacatatttctattgagatggctgcccgggaattacgttatgaatggttcgaaacgcttagaaaacaacgtgaagccagtgttatcgcaacagcgcatcataaagatgacagtgtagaaaccgtattgttgaacctgattcgcggtacgggtatcaacggattactcggaattcgtccacgaaacggtaacattgttcgccctttactttgcctgagtcgcgaagaaataatagcctatctgcaatatatcgaccaagattacgtaacggacagcaccaatcttttggatgaatatacccggaataagattcgtttaaacttattgcccctgatgaaagagatcaatccgtcggtgaaagagagtatcatccgcactaccaactatctgaatgacgcagcaactttatacaatcaaagtataggggaggcgcgtaaacgtatattgacccccgaaggcatccggatagaagccttgctgcaagaaccggtacccgaagccattttattcgaagtattacacccgctaggattcaacacgacccaaatagataatataaggcaaacgctcgacggacaaccaggaaaagtcttccttggtaaaggatggagagtcataaaagaccgtgacctgttattaatcgaagaagatacaactgcagaagagtcccagccacctttccggttagttatggaagagtacgattatacttctgaatttataattccaaaagataaaaacacggcttgcttcgatgctgacaaaataaataaaacatgggagatacgcaagtggaaaccaggagatgtttttatacctttcggaatgaccggtaaaaaacatgtcagtgactacctgacggataaaaaattctctttgagtgaaaaagaaaagcaatgggtattatgctttggagaacaaatagcctggctgataggagaacgtacggataaccgatttaaggtaaacgagaacacaaagcgggtaataatagtccgaattgtttccgaacattcagattttattgaggaataa

SEQ ID NO: 4138 - DNA, 549 bp, B.fragilis
ctccgctgcaaatcgcacaaaaagtgtacatttgcaacggagtttttttatggacagattatgagagaatatatcatcgcagataatcaggacatcacgaaagcaggaatgatgtttctgttaagcaagcaaaaagaggtaagcttgttgctggaagccgacaataagatggagttggtccagttgttgcgcattcatccgcaagcggtggttattttagactatacactatttgatttttccggtgcagatgaattgatcatccttcaggaacgattcaaagaatcagactggttattgttttcggatgaattgagcatcggatttctgaggcaggtattgttcagcagcaatgctttcggagtcgtgctgaaagacaactccaataaagagataatgacggccctgcattgcgcatcacgaaaagagcgctctatctgcaatgatgtaagcaatcctgcattatgcggaagtggaaaattaaccacttgtttaggccgtgcacacgtcttgtaccggatgaatacccgtctgctccatacgcgatga

SEQ ID NO: 4139 - DNA, 1053 bp, B.fragilis
actccataccgccaattaccacgtatttctgaacggctgaaatcaacaggctctcagaaaaaaggagcattgcctattcttaatgtggctaaagaacttttaaatatcccgactcaacttcatgaaataaatgacatttgcgccatttattgtatctttgcaaaattaaaagtgatgaagatggacttgaagaaagaagtgaaggaagagtttatccgtttccaacgaaatgagaaaaccgaaagtatcgtatacgaacgcgtgccttttattgaaaaagacgaatcgacccgcaaagtattacgtctgatctcagcagaagaaaaagcgcattatgccacactgaagaaatatacggaaaccgacgttgcaccagacaagttgggtatagccaaatattactggctggcaagaatcctgggtattacatttgccattaaactgatggagtcaagtgaagagaatgcacatcatgattatgccaaatatacagattatccggacctccggcaattggccaatgaagaagaagttcatgaacagaaattaatcgggctaatcaatgaagcacgacttgaatatatgggttcggtagtgctcggtctgaatgatgctttggtggaatttaccggggcattggcgggattcactctggccttgagtgactccaggctgatagccctgacgggaagcatcacggggattgccgcagctttatcaatggcttcttccgaatatctctcgaccaaatcggaaggaggagaaacgaaacatcccataaaggccgccatctatacgggtattgcttatatcatcacggtagtggcgctggttgctcccttcatattgatcgaaaacgtattgatagctttgggagtaatgctggccatggctttggtaatcattgcattatttaattattactattcggtagcacgcggagaaagtttccgcaaaagattcaccgagatggcagtacttagtttcagcgtagccggcattagctttctgataggctatgcactgaaaacatttacaggaatagacgcttaa

SEQ ID NO: 4140 - DNA, 282 bp, B.fragilis
tacatctcacgccaaccaaacagttctcctataaacccgctgactacacgtgaggccaaaatgccggtcagtagtcccgatacgacgattcctacatttctccctttgttttccggacgtgagaactgggaagctatcgggatgaatatctgtggcatcaccgaacagatgccggtgaggagcgaggcacacaggatgacgtggatgttgggggccatcgcgatcaccagcaacgaaacgattaatatggagaagctggtgagaatgatccgctttcgctga

SEQ ID NO: 4141 - DNA, 897 bp, B.fragilis
gacttgaaacgggttgctcttggaaagcgacgcacgattaatgtggcgttggtcggtaacccgtattgcggtaaaacgtctctcttcaatctggcttcaggtgctcacgaacatgtgggtaattatagtggtgtgacggtagatgctaaagaagggtattttgatttccagggttatcacttcaaaatagttgatttgccgggtacttattctttgtctgcctatactcccgaagaaatttatgtgcgccgtcatattatcgacgagacacctgatgtgattatcaatgtggttgattcttcaaatctggagcgtaacctctatctcactacccagcttattgatatgaatgtacgtatggtagtggctcttaacatgtatgatgaactggaagccagtggtaatacgcttgactatctcctgttaggaaagttgttcggagttccgatggtgcctactgtctgtaaaaggaatatcggtgtggaccgtctttttcatgtagtcatcaacctttatgaaggtgccgactttattgataaaaaagggcatatacatccggaggtggcaaaggaaattatggattggcaccagtccttacccaattttaaagaccatggtgaacatccggctgattatacccatggcaaagaaccggtgggtaaagtgttccgccatattcatatcaatcatggacccgatttggagaaagccattgatgcagtgaaagaggagatttcgaagaacgagtttatccgtcacaagtattctactcgttatcttgctatcaagttattggagaatgatccggaaatagaacgttttattcatactctgcccaatgctgtggaagtagaaaagagtcttcaccacggggctggaaggatcagcgcggtgcaa

SEQ ID NO: 4142 - DNA, 627 bp, B.fragilis
acgaacaacagttttaaacctaaacaaaaaaaagttatgaaaaagtttattgcattagtagcattagtattagtaagtgcatcgactttaatgtatgcacaagagtcacagagagacatacgccgcgctgaccgtaaagcacaaagagacgcagaaagagccagactgaaagctgaggaacaagctgccgaccaagtggcctatcagcaagccgtacaggctatcaaagacaaacagtttgtactggaagccgatcaggtaatcttcaaacgcggccagacagctttcgtatcgtccaacactaactttgtaatgttgaacggacagagagcaaccgtacaggtagcgttcaatactccgtatcccggccctaacggaattggcggtgtaacagtggacggaaccacttcggatgtaaaagtgactaccgacaaacgaggcaatgtgaactgcaacttcagcgtacaaggtatcggtatctcggcacaagtctttatcacattgacaaacggaggcaacaacgccactgtgaccattaatccgaacttcaactccaatacattaacgttgagcggcaaccttgttccgctgaaccagtcggatgtatttaaaggccgttcatggtaa

SEQ ID NO: 4143 - DNA, 1449 bp, B.fragilis
aaaaggaaaagaagaatcatgaaaaaagccccctcacctcttgtctctctgatccctctggtcgtattggttatcatgctgtttgccaccatacgtacctttggcagcgatgcactcagcggaggtagccaagtgtccctgctgactacaacagccgtttgcatactgatcggtatgggattctacaaaataggctggaaagactttgaactggctatcacaaacaacattacaggagtatctaccgccctaatcattctgctgattatcggcgcattgagcggtgcatggatgataagcggtgtggtccccacattgatttattacggagtgcaaatcatacatcccagttttttcctgacctctacctgcattatctgtgccttggtatcggttatgaccggaagctcctggactacgattgctaccatcggaatcgctttaatgggcattggcaaagcacagggattcgaagaaggttggatagccggagccattatttcgggcgcatacttcggagataaaatctctccattatcggatacgacaatattagcagcctcagttaccgatactcccctcttcagacatatccgctatatgttgataactaccgtaccttcactaatcattaccttggttatctttacagtagccggattgtcacacaatgccggaagcacagaacatatagccgaattctcggccgcactggcaggaaagttccacattacaccatggctgctgattgtaccggtagttacaggtgtactgattgctcggcgggtaccttccgtcatcaccttatttctgtcggcggcattggcaggggcattcgccgtattcttccaacccgacctgttacaggaaatatccggtttgcaaaattccgaaggcacacagtccatcttcaaaggactgatgatgactctttatggagggaccagtctacagacaagcaatgaagcactcaccgaactggtggctacccggggtatggcaggcatgatgaatacggtatggcttattatctgtgcgatgtgtttcggcggggctatgactgccggcggcatgttaggaagtatcacttccgtatttgtccgcttcatgaaaaatacagtcagcatggtggcctctacggtttgctctggtattttcctgaacctcgccacagccgatcagtatattagcattatcctgaccggaaacatgttccgggatatttatgaaaagaaaggttatgaaagctgtttgctcagtcgaaccacggaagattctgttacagtgacctccgtattaataccatggaacacttgcggaatgacgcaagccacgatactgagtgttcctacactggtttatcttccctattgcttcttcaacattatcagtccgttaatgagcattacgattgctgccatcggatataaaattgtgagacgcaagtga

SEQ ID NO: 4144 - DNA, 192 bp, B.fragilis
ccagcttccatctgtcagtcaaatcgcagatattattacatctgtatctctatcggaagtttacaggccagatcaatcatatattttcaaggtttatattcacaaagatacaatttatcctataaagagtttactatttgcaccctcaaatttatgcttcgtatctttaggttattcctcaataaaatctga

SEQ ID NO: 4145 - DNA, 1185 bp, B.fragilis
ctttgtgccatgaaacagattttgaaagaaaacggcggactaccggcttcgattctttggacacttgctattgttgcaggtatatcggtagccaatctgtactataaccagcctttactgaacatgatccgccatgaattgggtgtttcggagttcgaaacaaacctgattgccatggtaacgcagatcggatatgccctcggactattgtttatcgtccccttaggcgatttatatcagcgaaagcggatcattctcaccagcttctccatattaatcgtttcgttgctggtgatcgcgatggcccccaacatccacgtcatcctgtgtgcctcgctcctcaccggcatctgttcggtgatgccacagatattcatcccgatagcttcccagttctcacgtccggaaaacaaagggagaaatgtaggaatcgtcgtatcgggactactgaccggcattttggcctcacgtgtagtcagcgggtttataggagaactgtttggttggcgtgagatgtattacatcgctgccggcatgatgttgatatgtggtatggtagtcatgcgggtattaccggacatacgcccgaactttcagggcaaatacagcgacttaatgaagtctttgctttcactgctgaagcagtatcccgagctccgcatcttttcagtccgcgccgcacttgctttcggttcatttctagccatgtggtcatgtctggcatttaaaatgggaagtgcccccttctacgctgacagccacatcatcggtatgttaggattgtgcggcattgccggcgccttatcagcctctcttgtaggtaagtatgtacggaaagtgggagtcagacgattcaatttcatcggatgcggactgatcttatcagcttggttgcttctctttatcggagagaactcctattggggaatcgttgccggtatcatcatcatcgatatcggcatgcaatgtatccaattgagcaatcagacccgtatcttcgaactctgtccgagtgcttcgaaccgcattaatactatttttatgacaacttacttcataggagcctccaccgggacatttctggcaggaactttctggcaggcattcggttggcatggagtcataggcacaggagtggccttgactaccggctcactgctgattacttttttttcaaaacgataa

SEQ ID NO: 4146 - DNA, 5613 bp, B.fragilis
actaaacgcttatttgctatgaaaggaaaaaagaatcttttaattctattctcctgtgttcttacagtaattatcgcaggactgttcgcttgcacacgcagcgcaaaagaaattattccgtcatcggaatatgctccttatgtcaatgcttatacaggtggagtcatttctcaatcttctcccatacgaatcgaactgactcaagatcaaccaatggtagaccttaacaatgaactgaaagactgtccgttcagttttactccatcgttaaaaggcaaagcttattgggtgagtaataacaccatcgaatttcttccggaagaaggagaactaaagccgggcaagttatatcaaggctcgttccaactaggcgattttgtcgaagtggatagcaaattgaaagttttcgatttctctttccgggtacaagaaagtaatttcacactgcataccgctccattggaaatagcctcttcttcacccgataaggtaaccgtaaagggagaaatccgttttagtgataaaatgactaaagaacaagttgaaaaaatactttccactaacggtacctctacaatcaccataggatccacatctaatccattagaatatagtttcattatcagtaatatccaaagaaaagaacaggattacgatcttaaaattacagcagacggggaacctgtcgaaatggacaggaaacaaagtgagtccattacgattcctgccaaagacagcttccgtttcctttccgccgaacgtatcagtcagcctgagaacgggatacaaatcgtcttctctgatccggtttctgatactcaggatttaaaaggtctaatcgaaatacccgagattccatcctatattttccagattacggataataaggtaaatgtttattttgaagccggtcaactcagtaaactgaccctgaaaatacatgaaggagtgaaaaacaatcaaggcaaagcattgggcagttcccattctatctctttcggcgaactgaacctgaaacctcaagtcgaaatatcttctgcaggtgccatcattcccgattcaaaaaatcttgtaattcctttccgggctgtcagtctgtatgctgtagacctacgggttatccgcatttttgagaacaatgtgctaatgtttatgcaaaataactcactgtcctcggccaacgaactaagacgatcgggaagactggtttataaaaagacactgtttttgggtaaagatccttcaaaagatatccataaatgggaaaactattccatcgacctggcaggcctgattcatcaggaaccgggtgctatttatcgcgttatcctatccttcaagcaggaatattcggcttatccttgcggcagtggtgagaatccgaaaatgcaattttccgaagaaaccgaatctctgaccaaggtcaaatctgatatcctttcggaagaagatgaagccgtctgggacaaaccggaaacatattattacttcagcgggaatgaaaatgccgactggagccaatatcgatgggatgaacgggataatccctgccatccgtcctattatatgacgtccgaccggatagcagcttgtaacgtactggcttccaacataggtatgatcgtaaaacgtaattcgatgaacaaactttggatagccgtaagcaatattctggacaccaaaccggtagaaaaagctaaagtcattgtctacaacttccagttacagcctatcggagaagcattgacagatgcggaaggttttgcaataatagaaacgaaaggaacaccttttattgtagtggcagaatcggaaaaacagaaagcttatgtaaaagtagccgatggagaagagcagtctaccactcgttttgatgtaggcggcaaagacatccaaaaaggcttgaaaggatttgtatacggtgaaagaggtgtatggcgaccaggagacaccttgcatatctcgtttgttctggaggaccgtaacaaacgtattccggataaacatcccgtaactttggagctttacaatccaagaggacaattttacagcaaacaaatttcaaccaatgggctgaatggtttctatacattcaaggtcccgacacaaccggaagatcccaccggattatggaacgcttatgtaaaagtaggaggtaccgctttccacaaatcactccgtgtggagaccataaagccgaaccgtctgaaaataaacctgaaactgcccggagagattctgaaagctgcggataaagaagtacaagcacatctttcatcagcttggctgaccggagcaacggcatcgcgtctgaaagcaaaagtcgaaatgtctctgtcgaaagtcaatacacaattcaagaactacgagacatacatctttaataatccggcaacagaattcacatcaataagaaccgatattttcaacggtaccctggatgaaaatggtaataccgggttcatgctgaaacttccgacctctgagaatgctccgggaatgcttcgtgccaatatcacgactcaggtattcgaaccgggcggagatgccagtatccagactctgtcagttccctactctcctttcccgtcatacgtgggtatcaatctgaaccagccacaaggcagatatatcgaaacagacaaagagcatatttttgatatcgtaacggtcaactccgacggaaagccggtaaatcgttccggtctggaatacaaaatataccgcatcagttggagttggtggtgggaaaacgacaacgaatcattcgaaacatacatcaacagcagttccatcacccccgtagctacgggaagactcaacacaacaggcggcaaaggacaattcagtttcaaagtgaattatccggattggggacgctatttggtttacgtcaaagaccgtgaaagcggacatgctacaggaggtaccatctacgtggactggcctgactggcgagggcgttctaataagagtgacccgagtggcatcaaaatgttatctttttccattgacaaagactcttacgaaccgggagaaaccgtaacagccatattaccggcatctgccggtggaagggccctggttacgctcgaaaacggttcgtctgtaattcaacgggaatggatcgaggtatcagggaaagaagacactaaatatcaatttaaggtaacccctgaaatggctccgaatgtttatctccatatcagcttgctacagccccatgcacagacggtgaacgatcttcctatccggatgtacggcattatgccggtattcgtgaccgacaagcaaaccgttcttgaaccgcaaatcaagatgccggaagtacttcgtcccgaacaggtattcaaccttaccataaacgagaagcatggcaggccgatgacatatacacttgccattgtagatgacggtctattagacttgaccaatttcaagacaccggatccctggaataatttttatgcccgcgaagcattgggaatccgtacgtgggatatgtacgacgatgtattaggagccacggcaggaagctatggatcaatgttcagcacaggtggtgacgagacactgaagccatcggaccaaaaagcgaatcgcttcaaacctgttgtgaaatttatcggtcctttcagtatcggtaaggggaaaagccgtacgcaccaaatcactttacccatgtatgtaggttctgtccgtgctatgatagtagcaggtcaggacggagcatacggaaatgccgaaaagacagttccggtacgtacccctttgatgattctttcaacattgccacgagttttgagcaccaatgaagagattgaagtaccagtcaacgtatttgcattggaaaacaatgtaaagaacgtcaacgtatccatacaagcttccggtgcaggaatacaagtgacaggtaacaagcaacaaacgcttaccttcactcaaacgggtgaccgcctgatctttttcaagttaaagacaggtacgaaaaccggaaaagccaccattcatcttactgccaacggaaacggacaaaacaccaaagagaccattgagatagaggttcgtaatccgaatccggtggtcaccctgcgtgaaagccaatgggtggaaaccggaaagagcgaagaactcaattatcagttaagcagtggctcggaaggaaacagtatacagctcgaagtctcacgtattccgtctgtcgacatcagccgccgttttgactttctctacaattatcagcacaactgtacggaacaattaacctctaaagctcttcctttgctatttatcagccagttcaaaacagtagacaacgaagaattggaaaagataaaagtcaatgtacaggaagctatccgtcagctatacggacgccagctaccgaacggaggtttcgtttattggcccggaaatgcctcggcagacgagtggatcacctcctatgccggtatgttcctgatactggcacaagaaaagggttatgcagtaaacagtaatgtactgaacaaatggaaacgtttccaacgggcagcagcccaaaactggcaacccgttgcccaagaacagagctggtggtattggcaggcagatttccagcaggccttccgcctctatacattggccatggccggagcaccagaacatggagcaatgaaccgcatgaaagaactgcctacactttcgcaacaagccaaatggcgtttggcagccgcttatgcactcaacggtaaagaaaaagcagccggcgaactggtattcagtgcaaaaacgactgtagaaccctattcatcgaataattatgtatatggttcatccgaccgggacgaagcaatgatacttgaaacgctattgctaatgaatcgtcagcgcgaagccatggaacaagctaaaatcgtttcacataatctgacaagagagacgtggttcagtacacagtccaccgctttctcactgatggcaatgggacgtctggcagaaaagttgtccggcacattggatttcagttggacactgaacggaaaacagcaaccggcagtaaaatcagcaaaagcagtatacgagacacctatttccacttcatcacgtgaaggaaaggtaattctgaaaaacaatggaaaaggagctttgaatgcagacctgatcacacggacccaattactgaacgacacactgcctccgatagccaataacctgcggataagtgtaaagtacgttgataataacggttcaccgatagatacgcattctctgcatcaagggacagattttatggcagtggtaactgttgccaataccagcggtacaaccgattatacaaatctggcattaacacacatcatccctgccggatgggagattttcaatgaacgaatgacaggacagattagcacttctgctccttatagctatcaggatatccgcgatgaccggatactgacttactttaatttgcaacagggacaagccaaaacatttaccgtccggttgcaggcaacgtattccggtgactttgtcatgccggccatccagtgtgaagcgatgtatgatgccaatgtacaggcaaggacacaggcaggcagaactaaagttgtcagacaaagcatcgaataa

SEQ ID NO: 4147 - DNA, 486 bp, B.fragilis
tatttggtatcagaagaatgttcgtcctttttttatttacataattcagattttaatatgtttggaaaaaagaagaatgaagattattctgtaaagactgtgaaagtcggtgttgataaactgactacaatagcattgggaacaatggtgaaaggaacaatcacggtagaaggggatttacgtttagatggaataatagagggaaatgtttcctgtagagggaaagtggtgattggtcctcaaggaaggatcaaaggaaatgtgacgtgcaccggtgctgtgttacacgggatgttacagggagatattcaggtggcagaagatttgataatgaaatcgggatgtacaatgaatggtgatgtttatacatgtaaacttgaaatagaatcgaaagccaggtttaatggtacttgtaatactactgagaaagatacacttgtgacaagtcaggttgtgaagcctgagactgtggatactgagaaatga

SEQ ID NO: 4148 - DNA, 1266 bp, B.fragilis
agtgaattgtttatgagaaaaaaatctatgtttttatggtctttgcttgctgcaatgactatgagtgcttgttcggagcacaatgaactgccttcaggagaagttcccggagggaactcgaaggctaactttatagtcaagttgaactttgaaggaacaagtatggaacagggcggtaagacgagagccgcacaatctactgcagtaccggaaacttcgtggagtaatatccgccaggtacagattttgctatatgacgcaagcaatatcgtgcggttttccgatgtagttactccaacagctgggaatacaacctttacttatacagatgtgcctgctggaacttatacaatggtagccatagcaaatgcgaaaagttcagcggatgctatcaatacctatttggatggaggcacgactcctgtagagtgggggatgtggaacgtacgtcagaaacaggtacagaacatggtgatgaagtataaaacgggtacattccctgctttttgttctgctgccttggctggcaatacagcctatacggaaccggccgaaatctttatgggagctgtttcgaatgtggttatttcttcggatgcgactgcaactccatctccgattgctttgaagcgtgaagtttctttgatgcgtgtccgtctgaacgtaaaggataaagaaggaaatacgaataatgagaatactgccaaaggagttgattttacacaagacgcttctattatgatttatcgcttgccggactatctgaaagtgatggcagggaatgacggaggagtaagtgctacctcgactgctactaatatattgtctatctcggatggtgaagtctttaaaacggctgagcccggagccggttataatccaggaggaatgattttgaacggaaacttcacgatgtggagagatgtggttgtattccccaataacggtgggcgcgttaatgattctgcaactaccggtacggctgacagacagcgtcagtattttatagtggtatcaggacgtggtaaagccggacatattttgggagatggtactgcacttcctagtgatgctactgtttattggtccggagtggttaaagagaattttgtgccgaacgtgattcgtgaagtaaacctgactttacgtaccggcggaagcacgactgtgcctgtaactcctacggaatatggtggcctgacaattactgtaggagctcctacaccttgggatagcaatattgtaaattcagatattataatgtaa

SEQ ID NO: 4149 - DNA, 1161 bp, B.fragilis
gaatattcgttttatttgttacttctgccgattctgactatctttgcccttcgattaaaaacaaaagtaatgggaaaagaaaaaatcatattaacaggcgaccgtcctaccggaaagctccacatcggacactacgtaggctcgctgaaacggagagtcgaactgcaaaactccggctcgtttgacaaaactttcatcttcattgccgacgcacaggcactgaccgataatatcgacaaccccgaaaaagtacgtcagaacgtaattgaagtagctctcgattatctggcttgcggactcgacccggaaaaatcaaccatcttcatccagtcccagattccggaactgtgcgaactgactttctattatatggatctcgtcaccgtatcgcgcctgcaacgtaatcccactgtgaaaacagaaatccagatgcgtaactttgaaaccagtattccggtaggtttcttcacttaccccatcagtcaggctgccgacatcactgccttccgtgccacaaccgtaccggttggtgaagaccaggagcccatgatcgagcaagccagagagattgtccgccgtttcaattatatctatggagaaaccctggtagaaccggagatccttttaccggataatgcagcctgcctgcgcctgcccggtaccgatggaaaagccaagatgagtaaatcgttaggcaactgcatttatctggccgaagaagctgatgaaatccaaaagaaagtgatgagcatgttcaccgaccccgatcatctgcgtgtgcaagatccgggtaaaatcgaaggtaacaccgtatttacatacctggatgcattctgccgtcccgaacacttcgaacgttacctgcccgactatccgaatctgaacgagttgaaagctcactatcagcgcggcggtttgggtgatgtaaaggtaaaacgtttcctcaactccattatgcaagaagagttggagcctatccgcaaccgtcggaaagaattcgaaaaagatattcccgccatctatgaaatgctgagaaaaggctgtgaagtagcaagagctgccgctgccgataccttgtcggatgttcgcaaagccatgaagataaactacttcgatgatgccgaactgatcaacgaacaagtgaagcgattcaacaaatag

SEQ ID NO: 4150 - DNA, 1200 bp, B.fragilis
ctattaaggtatatgaaaaagattctaatgctgctggccttagccggcgttacatctgttgcttctgcgcagcagactacaattacgggatacgaagttatccaggtacaagacaaatatcaagtgatcactaaccctttctgggataattggtttttctctatcggcggaggtgctgaagcactgtttggcgataatgaccatgtcgggaaattcagggaccgtatcagtccgacattgaatgtggctgtcggtaaatggtttactccgggattggggttgcgattgcagtacagtggcttacagggacgcggctttgccggttcggaaacagctgattttgtgaagagtggtaaactggctaatgggtattataaacagaaattcaactatatgaatcttcacggggacgtgatgttcaacttgaatgcactgtttggcggatacaactctcaccgtgtatatgaaattatcccttatttgggagccggttttactcattcatattcgaaacctcatcgtgaggcgtttgctatgaacgcaggtattatcaaccgtttccgcgtttcgagtgcggtagatatcaatatcgaaatcggtggtatgctggccgaagataagtttgacggagaaattggcggaaaacatggatatgacggtgttgccagcctgactgccggtttgacttatcgtttcccggctcgcggatttgcccgtccgatgccacagattatttctgaaatcgaactggctaatatgcgtcgtcaaatgaatgacatggctgctgctaaccagtcactgcaacagcagttggttgacgcacagaatcagccggtggcagaagttgccgaacaggtagtcgttacggatgctaacattgctccgcgtaccgtattcttcacaatcggatcttctgaactgtcaccacgtgaagagatgaacttgtcttatcttgctgccaagatgaaagaattcccggatacacaatataccgtatacggatatgctgactcagcaaccggtactcctgcattcaataaggagttgagccaaaaacgtgctcaggctgttgtcaatgcattggttaagaaatacggagtagattccagccgcttgaaggttgatgccggtggtggtgtggataaattcggtaaacctatttacctaaaccgagttgtattagtagagtctgttaaataa

SEQ ID NO: 4151 - DNA, 189 bp, B.fragilis
gttaattataagacaggcagaaaaaaagacgggaaaatgatcgtatataatcataaaaaaggggaaaaaccgtttatcggtttctcccctctctcctattatttaattgttgcaaacagaattatttatattcctgccagctctttatctgaatatcttccagtttcagatcgcagaatgcctcgataa

SEQ ID NO: 4152 - DNA, 915 bp, B.fragilis
aacatgagaaaaaacagacttctcatagtattatttactggtgtagcagtcttactttcgcttgcgtcgtgtacatatgattattttgaagatgaaacgaattatcaggtttttgtacccgaagttctgaacaagactgtcagtgattgtcgagtgctggtctataacgatgccggaacattggtcggtgcacgttatgcaacctctccatgggataaagatccgcgcatggaggcgggcttgtttagttttaggttaactcccggcgaatataaagtatactgttataccaatacggacagtcttacgtttgtggacgggcaacatctggatgcttctgcttttattctgaaaagcagctctaccggaccgaacagatatgtacagctttcggatatattattccagaagttcgtacccgcaattgtacatccgggcattttacagaccgataccgcagcactggaacgctataccggacgtataacggttcggtttaagaaatttcctggtgatgtatcgcatataaagaaggtacaattgcttgcggaaggagcacctgtgatgcaatacctcaaaaatgatactctgaccggccgattgactcctgaggacaaaatgtttcatttcggaacattacccgtacaggagaaagccgatgtattagaggtagatcatcgttttattccttctgtggagaatgaaccgatgaggttgaattatacatttctcgatgaaaatggagcagttgtcaaccatctgcccgtggaagttacggaaagggagacaggactgccgttacggttattgcatggtaaacgtataattattgagatcgaatcttataccgttattaagatatcggttgtaggatggaacgaagatatcgagagtggagatacggacatggaatga

SEQ ID NO: 4153 - DNA, 1587 bp, B.fragilis
aaagttgctgaaatgagaaagaagaagatacagattctcctgtcggctgccgcattcctttttctgatgggagggactatgccttccgttgcgcaggagcggaagatagggcgggtagaacggcgggcagaccgtaattttatcaggcagaaatttgataaagcgatggctcagtatgaaacggctatcaggcgtgaaaaagatgaggccggtcaggctgcgcttcatctcaaaacagcgcgtttgtatttcatggtaagggaatatggtcgcgcctcggagcattatgataaagcaatgagcttgcgtccggatttgctcggggtagatgatgtctgtgattatgtggatgctctgcgttttcagggacaagcccgcaaagcagaagccatttgcctggataatgcctataaagacatatatagccgctatcagcgctatcagaatacattgcaggcacttgccatgcgccattcggttcaggaagatcccgggttttcggcaaaacgcttattactgaatacatcgaacgctgaattttgggttggtaattatggggaacaaccgttttatgccattagttacagtaaattcaatgatccggggaaattattcttccatcgtactcactattatgcacttgacgaacccggtgaaaccggtgttgagactcagaaacctccaagatattatggttatttccggaaaatacctgctgacttacagaatggtccggtgaccttttcaccggatatgaagtcgatggtagctacggttatcgagtatgataaagagaagacaaccgtagagatggcaaaccggaagctacgtcctttccgtacaaagttgttttactctgtgctaaagaacaagaagaaacgatttacgaagtatgttccggcttttccacaggaagagatgtcttcgtatgcccacccttacctgtttaatgaaggcaaatcattgttgttcacctctgacatgcccggaggatacggtgggttcgacctgtatgttgtccattgggatgaagaggctcaggcatgggggactcctgttaatctgggaccggatgtcaacacggaaggcgatgagatctttcctgtaatctataaaggacgtcttatcttttcgtctaacggattgccgggattcggtggttatgatctgttcagtgcttattatgataaagatggagtgattccgggcagtatcagccattttccttatccggtaaattccgtcttcaacgattattatatgtgtccgcttgacttgcgaacagcctattttgtatccgatcgtgaaatggcttcaagagacgatatctattacctccgtacagtagaggatctgggaacccagcaagggatgcctttttacgggatgagtgaggaaaatgcaattttaggtggcgctttgttgttgaacggcactacggaaactgtttctccggagtctgtcacattgaagcagtatgcgccggaaggattgctgatgactctctattttgatttcgattcggatgagttgaccgatgaatgtcttcaccacggggctggaaggatcgacgggtgctcagccatc

SEQ ID NO: 4154 - DNA, 999 bp, B.fragilis
gcaaaagcatgcgataatttaatttgtaatctaaacagacttaaaatgaaaaaagaacttttgactcgatttatggagaagcgaatagtcgaactgaaaaaagaacaacgcaatggtactgcccatgtatatcagagtactttgaatcgactgaaaaattttatgaatggacgtgaaatcacctttagccaactgactccggaatggctggctttgtttgagcagaaactattggctgaccagcttaagtggaataccatttctacttacatgcgtatgttgagatctgtatataatcaggctttggaacggggcgtggcaacttacgtgccacgtcttttcaataaagtacataccggtattgattgcccggtgaaaagagctgtttcgccggaagttatatgcagactgatgacagaccgaaaaccgttgcctggaaaattggctttcagccgtgatctgtttgtgcttttgttcctgcttcgagggatgccgtttgtggatcttgctttcttgcgcaggtgtgatttgcagggaaatgtgatcacgtatcaccggcgcaagaccagtcgtaaactgactgtggtggtgggtaaggaagccatggaaattatacagaaatatatgtatgcaattccggactcaccttatcttttccctattatacagaatcccggtaaagatgaatatggacaatatgcccgaatgttacgccttcagaactatcggttgacacaagtggcaaacatattgggaatcagagaccgactcagtacttataccgcccgtcatacctgggcgacaacggccctccggcagaattataattcaagcttgatttgtgacgctatgggacattcttcggttaaagtaaccgaaacctattttcaaccctacagagacgatgaggtaaaccggatgaatagctctcttattacatatattttatcgaagaagaaaagggggacagataaaaaaaataagaagctaatagcttga

SEQ ID NO: 4155 - DNA, 609 bp, B.fragilis
aagagaattagaatgaaatcagttatacgacatattttgagtgtcgccgttttattttgcttaatcagcggagtacaggcacaaagtgtcaaagtgaatattcctttttggctgaccggttcgcctaacgtcggctttgagtatacattgacgaggcaactcacggtgaacggtgaagtgctatggatgccgtatttattcaagaaacatgaagaagtgtttcgggcactccagagcagtgttgaattgcgctattatgtgaatcctcgtaacttttatactaacgactcatgggatggattttatattggcccctatgctatgtacggtaattttaatatcggtttattaaagcataacgatccgttgcagagctatcgtcgtaaaggttggggagtatcgggaggtatctcgaccgggtataaatttgctttcaactctcgttgggggctggatctgaatattggcctgggatatgcgcacctccaatacaataaatattatttgggtggagaatatgtgaatttccctttggaacgtaaaaagacgaagaggtggataggtccgactaagttcggtataaatctcacctataatatattccgataa

SEQ ID NO: 4156 - DNA, 3246 bp, B.fragilis
caacttataatgacaataaaagaaatggaaaaggaaatgaaaaaagttcttgttttgggttcaggcgcactcaaaatcggacaagccggagagtttgattattccggttcacaggcattgaaggccttgaaagaagaaggtatcaattcggtattggttaacccgaatatcgcaaccattcagacttccgagggaattgctgataaggtgtatttcctgcccgtgactacttatttcgtagaagagattattaagaaagaacgccccgacggtattctgctcgcattcggcggacagactgccctgaattgtggtgcggaactttatacaaaggggattctggataaatatggcgtgaaagtattaggtacttcggttgaggctattatgtatacggaagaccgtgacttgtttgtgaagaaactcgatgaaatcgagatgaaaactccgatcagccaggcggtggagagcatggaagatgctatcgctgctgcgcgacgcattggctatccggtgatggttcgttcggcttatgcattgggaggactcggcagcggtatttgtgccaatgaagaagagttcctgaaactggccgaaagttcgtttgctttctctaaacagattttggtagaagagtcgctgaagggctggaaagagattgagtttgaggtgatccgcgatgcgaacgatcactgctttacagtggcaagcatggagaattttgatccgctgggcattcataccggtgaatcgatcgtagtagctccgacttgttcattggacgacaaagagttgaaaatgttgcaggaactgtcaaccaaatgtatccgtcacttgggtattgtcggtgagtgtaacattcagtatgcgttcaattcggatacggatgattatcgtgtgatcgaggtgaatgcacgtttgagccgttcgtcggcattggcttcgaaggctaccggttatccgttggcatttgtggctgcaaaagtggcattgggttacacactcgaccagatcggtgagatgggaactccgaattccgcttatgtggctccacagcttgattattatatttgcaagattcctcgttgggacctgaccaagtttgccggtgtatcccgtgagatcggatcgagcatgaagtcggtaggtgagattatgtcaatcggacgttcgtttgaagagattatccagaaagggcttcgtatgatcggacaaggcatgcatgggtttgtcggtaacgatgacgtacactttgaggatctggataaggaactttctcacccgacagatctgcgtatcttcgcattggctcaggctatggaggaaggttataccatagagcgtattcacgaactgacaaagatcgatccgtggttcttgggtaaacttaaaaatattgttgactataaggctaagctgtctgcctatgataaagtagaggatatcccggccgatgtgttgcgtgaggctaaagttctgggcttctccgacttccagattgcacgatttgtgctgaatccggtgggaaatatggagaaagagaatctgatggtacgtgcacgccgtaaagaactgggtattcttccggcagtgaaacgcattaatacaatcgcttccgaacatcctgaattgacaaactatctgtatatgacttatgcggttcagggctatgatgtgaactattataagaatgaaaaatcagtagttgttctgggttcaggcgcttatcgtataggtagttcggttgagttcgactggtgttcggtaaatgctgtgcagactgcccgtaagctgggatataaatcgattatgattaattataaccccgaaacggtgtctactgactatgatatgtgtgaccgtctgtactttgatgaactttcgttcgaacgtgtactcgatgtcattgacctggagcaacctcgcggtgtgattgtatctgtaggtggacaaattccgaataacctggctatgaaactctatcgtcagtctgttccggtattgggtacttctcctatttctatcgaccgcgccgagaatcgtaataagttctctgcaatgctcgatcaactggggatagaccaaccggcatggcaggagctgaccagtctggaagatgtgaagggatttgtggagaaagtaggttatccggtgctggttcgcccgtcttatgtgttgtcgggtgctgcaatgaacgtttgctatgacgacgaagaattggagaacttcttgaagatggctgctgaggtatccaaagagtatccggtggttgtttctcaattccttgagaataccaaggaaatcgagtttgatgcagtagctcagaacggagaagtagtagaatatgccatctctgaacatattgaatttgccggtgtgcactccggtgatgctactttggtattccctgcacagaaaatctattttgcaacagcacgccgtattaagaaaatcagtcgtcagattgcaaaagagctcaatatttcgggtccgtttaatattcagttcctggctcgtaacaacgaagtcaaagtgattgaatgtaacttgcgtgcttcacgcagtttcccgtttgtttcgaaggtgttgaaacgcaactttatcgaaacagctacccgcattatgcttgatgccccatacagtcgtcctgataagtccgcatttgacattgattggatcggagtaaaagcgtctcagttctccttctcgcgtctgcataaggccgatccggttctgggcgtagatatgtcgtctaccggtgaagtgggttgtatcggtgatgatttttcggaagcattgctgaatgcaatgatcgctacaggctttaagattccaggaaagggagttatgttctcttcaggtgcaatgaagtcgaaagtcgatttgttggaggcaagccgcatgttgttcaaccaagggtataagatttatgcaacagccggtactgctgctttcctgaatgcacatggggtagatactactccggtttactggccggatgagaaaccgggagctgagaataatgtgatgaagatgattgccgatcataaatttgatttgatcgtaaatattccgaagaatcattcgaagcgtgaattgacaaatggttaccgtatccgtcgcggtgcgatagatcacaatattccgttgatcactaatgctcgtctggcaagtgcatttatcgaggcattctgcgatctgaaactggaagatattcagataaagagctggcaggaatataaataa

SEQ ID NO: 4157 - DNA, 339 bp, B.fragilis
atctttacggtcttaaaaaagacaataaaatcctttcccatctttcaacctgaaaaatggaaatatcttttgttgccttttccgaaagacaacccgctaaaaatgttcagctatttaatatctattgcaaaaataattgttttattatgcgtaattcaaaaaatatatttaaatttgccgccgatatcatctcccgttacctacgaagtaacggatattttttcaattagcaatcaagctattagcttcttattttttttatctgtcccccttttcttcttcgataaaatatatgtaataagagagctattcatccggtttacctcatcgtctctgtag

SEQ ID NO: 4158 - DNA, 576 bp, B.fragilis
ttatcaaaatctttttttgagcgatctaaccaccgtcgacaacgccatacatcgctgatcatgactctcgctgatcaatgcgggtgcacagatcacgggatttatgcctctgcctctaatagctttcactgtaccttagactatgacgaccctgatgaccctactcaggcattataccaaaaagagactgataactcccggattaaaacctgcactctggaaccgaaactggactacagactctgtgtgttctcttgtcggaacactctattgcgcaatagacgcacctactacttgtatctctactggaccatattccataaaggcatccctgaggtcacttacctaccaccaaatattgactttgccactcggcaaaccaaccatttttttactacgagctacgaatcccgcatgccgtttgaaaccatcttaaacagtacgcacctgcactctacatataacgtgtcccaacgcattctggtagaaattaatagtgggccattttattggattggcaaaccagagttactagaaacctcaccttccatttcacaagatttttctcggaattag

SEQ ID NO: 4159 - DNA, 1170 bp, B.fragilis
tacaaaatgttacaacccgaattaaagatgcgccgcgataaaattcgtgtgcttatggctcagcaaaatattgaagccgcacttatcacttgtaatgtaaatttgctctatacttacggccgtatcgtcagcggatacctctacttacctctccactcaccggctttattattcatcaaacgccccaacaatatcaccggcgaacatgtatttcccatccgtaaaccggaacagattccagacttgatcaaagaaaacaatctgccgatgccacaaaagttgatgttggaaggcgacgaactttcgtttacagaatacaatcgccttgctgctattttccctgaatcggaaattgtaaacggtactcctctgatccgtgaagcgcgcagcgttaagactcctgtagagatagaattattccgtcgttcgggtgtagctcatgccaaagcctacgaccagattccttcggtatatcgcccggggatgactgatctggaattctccattgaaatagagaggctgatgcgtctgcaaggtaacttaggtatcttccgcgtattcggtcaaagtatggagatttttatgggtagcgtactgacgggtgacaatgcagcttatccttcaccttacgatttcgctttggggggcgaagggttggatccggctttgccaggcggactgaataagactcctttaaaagaaggacaaagtgttatggtagatttaggcggaaatttcaatggatatatgggagatatgagtcgtgtattctctgtcggaaagctaagtgacgaggcttatacagctcatcaggtctgtcttgacattcaggaagccgtttcatcgatggctcaacccggcgttgtatgcgaagacttatataatgcagcgatcaacatagtaaccaaagccggttttgccgacaaatttatgggtatcagtcaacaagccaaattcattggccacggtatcggcctggaaatcaacgaggcccctgtacttgctccccgtatgaaacaagaattggaaccgggaatggttttcgctctcgaaccgaaaatcgtcattccgggtgtaggtcccgtaggtatcgaaaactcttgggcagtaactcccgaaggtgttgagaaactgactatctgcaacgaagagattattgagttgcaataa

SEQ ID NO: 4160 - DNA, 210 bp, B.fragilis
ttatcggcttttttatattccgcttcgttgacggaacgggttttcgtggaaaaagaaggattggcagagagcccgaggctcaatgttcctacaccgtatgaaacagcatcactgccggaatcacacgaggcaacacatgaaattagcatcgccatactaaccataaaagagagtcttttcataatgataactactaattattactcataa

SEQ ID NO: 4161 - DNA, 1416 bp, B.fragilis
catcagaaaacttttcttatatttgcatatgaaacaagttacattttatcagaatcaacctttttaaaacatactattatgaacatcgaaaaaatcatgtcctctcttgaggcaaaacatcccggtgaatctgaatatcttcaggctgtaaaagaagtattactctctatcgaagatatctacaaccaacacccagaatttgaaaaggccaaaatcatcgaaagactggtagagcccgaccgtattttcacattccgtgtaacatgggtggatgataaaggtgaagttcagaccaatctgggatatcgtgttcagttcaacaacgctatcggcccatacaaaggcggtatccgtttccacgcttctgtcaacctctcgatcctgaaattcctgggattcgaacagactttcaaaaatgcactgacaactttacctatgggcggtggcaaaggaggttccgacttctctccacgaggaaaaagtgatgcggaaatcatgcgtttttgtcaggcattcatgcttgaattgtggcgtcatctagggccggatatggatgtgcctgccggtgatatcggtgtaggaggacgtgaagtcggctatatgttcggtatgtacaagaaactgacccgtgagtttacaggaactttcacgggtaaaggacttgaatttggcggttcactgattcgcccggaagccaccggattcggcggattgtatttcgtcaaccaaatgttgcagaccaagggtatcgacataaaaggtaaaactgtggctatctccggattcggaaacgttgcctggggagctgctaccaaagctaccgaactgggagccaaagtagttaccatctccggaccggacggatatatctatgatccgaatggaatcagtggagagaagatcgattatatgcttgagttgcgtgcttcgggcaacgatattgtggctccgtatgcagatgaatttccgggttctacattcgtagccggtaaacgcccatgggaagtaaaagcagacatagcgcttccttgcgccactcaaaacgaattgaatggcgaagatgccaagaacctgatcgacaacaacgttctttgtgtcggagagatctccaatatgggttgtacacccgaagctatcgatctctttatcgaacacaaaacaatgtacgctcccggtaaagctgtcaatgcaggcggtgtggcaacatccggactcgaaatgtcacaaaatgcaatgcacttgagctggagtgcagccgaggtagacgagaaactgcattctatcatgcacggcattcatgcacaatgtgtgaagtatggtacagagcccgacggatatatcaattatgtaaaaggtgccaatattgcaggtttcatgaaagtagcccatgcaatgatgggacaaggaatcatctga

SEQ ID NO: 4162 - DNA, 747 bp, B.fragilis
  unsure (593): Identity of nucleotide sequences at the above locations are unknown.
gtaaatataaaaagattggtatatatgaatgcgataaaaaacatatatgcggtgctggcattgatagcactttgtttgagttcctgcgagatgaagaatgaattggaaggcaaatataatttgaagaatgacgaggggcttctgacattggatctggtgaacaagactcaggctacgcctactacaaaggctgaaagtacatcacttactgatgaactggatgtgaatacctataaggtggagattgttgataatgccactgaagccgtggtccgttcatttgccagctatgcaaagttgaaagaagctttgccgttggtcgttccggtaggaaactataagattgtggctaaaagcggtgttttgcaagatgcttcgcgtactccctattttgaaggaagttcttctatcgaagtgaagcaaggaatggagtctaaggcagaagttctttgtaaatcggcaactgtgaaggttagtttgaatatatcagaagagtttctcaatatgtttgccgatgattacgtgttcactgtttcaaacggaatcggcggagtcatttatgtaaagaaggaagatttaagttcgatttatcncagcattcaagcgggctgtacttcgatcaatattgtatctaaagaacgtcagaagaacagtggtagagacattgagactgttgatacagtgacgagtcacatgcagaaggtctgcaagcgcgtgattcttttaatgtcacgctgcaaccggtag

SEQ ID NO: 4163 - DNA, 606 bp, B.fragilis
aagagcgtgaagatccgcacaatccagaacgtaactcgttctgatcagaagtgggggatacagttgcatattgacttgaccatggatgaaactggcattccagtgaaagtaccgactgaactgattgaacaatctaacccggaagatccggatcaaccatcagatccagatcagccgacagtagacgaaccggatattatcgggccgtataaagtggtaaaagtgtataccaataatcctccaacagttcaggttacaatgacagctccggctggaattcagaatttacttgtgacgataacttcagattccaccgagtttataggtttaatttctcaaatggggttgggcgaaacgttcgacttagctaatcccggtgatctggaggataaacttgaaggtagtttagaagtcggatccggtataggcgtgattgacccgaatgatccgattaaagataaaaaagagtttatctttcatgtatccggttttatgcctatgttatcgccgtttgggcttcagcaacactattttactattaaactgattgataataatggtaccgagttagccaagaaattgacagtaaaagtggtgaaaaactaa

SEQ ID NO: 4164 - DNA, 2985 bp, B.fragilis
aactacgggaagcccatgctcagcaaatttaaattaaaccagctctactttaaagatacccagtttgctaacctgatgacaaggcgaatttttaacgtcttactgatagctaatccttatgatgcttttatgctggaggatgacgggcgtatcgatgaaaagattttcaatgaatatacctcactttctctccgttatcccccccgtttttcacaagtttccaccgaagaagaggcgttgaggcagcttgaaagtgtatcgttcgatctggtgatttgcatgccgggtacgggagataacgatagttttgatatcgggcgtcatattaaggagaagtacgaacagataccgattgtcatcctgacaccgttcagtcatggtattaccaaacggattgcaaacgaagatctgagtgcattcgactatgtgttctgttggttgggaaataccgatttgctggtgtctatcattaagctgatcgaagacaagatgaatctggagcatgacgtaaaagaggtgggcgtgcagttgattctgttggtggaagacagtatccgcttctattcttccgtacttcccaatctttataaatttgtattgaagcagagtcaggagttttctaccgaggccttgaatgcccatcaacgtacactccgtatgcgtggtcgtcccaaaattgtattggctcgtacttacgaggaagcgatggatatatataataagtatactaacaatatattgggagttattaccgatgtccgttttcctcgtgtggataagggagagaaggacggtatggcaggtatcaagttgtgtgccgaggtaagaaagaaagatccgtttgttcctttaatcatccagtcgtccgagacggagaatgcggcctatgcggcaaaatacggggccacgtttatcgataagaattccaagaagatggatgtcgatcttcgccggattgtttccgataatttcggttttggtgactttgtgttccgtaatcccgaaacgggagtcgagatagcccgcgtacggaatctgaaagagttgcaaaatatcctttttgccgttcctgccgaatctttcctttatcatatcagccgtaaccatgtctcacgttggttgtattcacgcgccatgtttccggtagctgaatttcttcgtcccatcacctggcatagtctgcaggatgtcgatgcacaccgcaaaatcatctttgaggccatcgtgaaatatcgaaagatgaaaaaccagggagtggtagccgtattcaagcgcgaccgtttcgaccgttattcgaactttgcccgtatcggagacggttcgttgggaggaaaagggcgcggactggcgtttattgacaatatggtgaagcgccatccggaatttgaagaatttgagaatgcccgtgtagctatcccgaaaacagtagtgctctgtaccgatgtattcgacgagtttatggatacgaataatctgtatcaggttgccctttccgatgctgatgacgatacgattctgagatatttcctgaaagcaaagttacccgaccgcttggttgaggacttttttactttcttcgatgtagtgaagtcccctattgccatccgttcttcttctctgcttgaagattcccattatcagccttttgcaggcatctataacacttatatgattccttatctggacgataaatatgagatgcttcgcatgttgtccgatgctattaagggagtatatgcatcagtctattttcgtgacagtaaggcatatatgcaagccacttcgaatgtgatcgatcaggaaaagatggccgttatcctgcaacaggtagtcggcaatcagtatggtgaccgttattatccttccatgtccggtgtagcccgctctctcaattattatcccattggtgacgaaaaggctgaagaaggtacggtaaatctggctctcggtttgggcaagtatatcgtagatggaggcatgactttgcgtttctcgcctgcccatccttcgaaagtgctacagaccagtgaattggatattgccttgaaagagacgcagacccgtttttatgccctcgacctgaagaatgccggtgataacttctcgattgacgatggcttcaatcttttgaagttacatgtgaaggaagctgaaaaagacggttcgttgcgttatattgcctctacttacgatccttacgatcaggtgattcgggacggtttgtatcccggagggcgcaaagtgatcacgtttgccaacatcctgcagcacgatgtatttccgttggcacgcatcctgcgctgggtgcttcgttatggtcagcaggagatgcgccgtccggtagagatcgaatttgccgtgacgctcaatcacgaccgtgataagaccggtacattctatctgcttcaggtgcgtcctattgtggacagtaaagatatgttggacgaggatcttacgactattcctgacgaagacgtgttgcttcgttccaacaactctttggggcatggcattatgaacgagatacacgatattgtgtatgtcaaaaccgatcattacagtgcatcgaacaatcagaatatagcttgggaaatagagaaaatcaaccagcaatttctgaatgaaggcaagaactatgtgcttgtcggccccggacgatggggaagcagtgatacttggttgggtattccggtgaagtggccacatatttctgccgcgcgtgtcattgtggaggccggacttactaactatcgggtagatcccagtcagggaacacatttcttccagaacctgacttcttttggtgtgggatatttcacgattaacgcgtttatgaatgatggagtatacaatcaggaattcctgaatacacaacctgccgtatttgaaaccgaatatctccgtcatgtacgctttgaaaggccgattgttgtgaaaatggatggcaaaaagaaacttggagtagtccttatgcccgataaataa

SEQ ID NO: 4165 - DNA, 246 bp, B.fragilis
aattcaacagacaaaagtcgctgtttttattgggaaaaacaagaaaaaacaattcactttattgctgactatccatatatgcacagattgctttctcgttttcggcttaaaatctctcctactctcatacgtatcgaccacaaggccggacatggttccaacaaagccacaacaaagttagtaaaggagcaagcagacatctatgcatttatcatgtataacctggggatgaaaatgaaatactga

SEQ ID NO: 4166 - DNA, 825 bp, B.fragilis
ttagtagttatcattatgaaaagactctcttttatggttagtatggcgatgctaatttcatgtgttgcctcgtgtgattccggcagtgatgctgtttcatacggtgtaggaacattgagcctcgggctctctgccaatccttctttttccacgaaaacccgttccgtcaacgaagcggaatataaaaaagccgataattatcaagtgacggtcaaggatgccgacggtgcctctttatacaatggcttgtacaaagacatgcccttgtccattgatctgactgccggtaaggggtataccgtaaaagctttctatggcgagaatgtgaacgcaggcttcgacaagctatatgtggaaggtagtcaggagttcacggtcagtgaaggcgaacaaaagaatgttattttgtactgcaaaccggctaatgtcaaagtatcggttatctataccgaagattttctgaaatattattcggattgtaccgtatccctctctacttcacacctgactgctccttttgaagtgaatatgaaaaaagatttcggtaaggatgcttatctgaaagcaaatgccgatggcgagaaggtatcgatcactgtaggaggtttcagagataaagaaggcaatgaggtggtgatggaagctttggttgctgagaaaaaagtggctcccaaaacacaccttactattacagtcgatccggaagttattactatttccacgggtacggcgtcgttggacgtaacagtggataccggtacagaagataaggatgtgaatatcgagattccggaagagtattggccgggtaatgcaagtaagtaa

SEQ ID NO: 4167 - DNA, 315 bp, B.fragilis
cgtttgtcagcattcgttcttccttatcgacatcggtatacatatcagaagcctgttcccattgactataaattgcttgattcacaaatttatagttatttagcttctctcgctcttctggcgataggctatcagtcagtagcttctttattatatccttatttcctgttgtcgcttgtttcatctttattaccttcttattacctatctatttataaatacacgcaactccataacatcccccaaagaaaatttaaattctttaaaataaaagggaagttattaaataatctcctctataccttattattatag

SEQ ID NO: 4168 - DNA, 192 bp, B.fragilis
atatcgaaatattctcctttatgtcaacgcaaaacgcaattaactatcttttttgtatttctgcaatcattattatttaaacacacatttttatattcaaatgttttcgtttactataaattctctatttttcttttaaaatttgtattgtttctccctgaaaaattgtatgtttgcacatcacaccgatag

SEQ ID NO: 4169 - DNA, 1011 bp, B.fragilis
ataggtaataagaaggtaataaagatgaaacaagcgacaacaggaaataaggatataataaagaagctactgactgatagcctatcgccagaagagcgagagaagctaaataactataaatttgtgaatcaagcaatttatagtcaatgggaacaggcttctgatatgtataccgatgtcgataaggaagaacgaatgctgacaaacgtcatgcaccaaataaagaaaggaaaaaccggacgttttaggcaaaacctacatcggtatggctgggtggcatctatagctttattgctgatttgtggaacactatctttaatgttattatccagaaaagcagagccggaggtttggtatgtactgaactccggacgccagtcaatggattcggtaagattagcggatggtacgcttgtgatgctgaacgcagggagtcgcttgacatatcctaaagagttttccggaaacaagcgggaagtaactctttccggacaagctttttttagtgttcatccggataaggcacacccttttgttgtgaaaacaaagaatatggatgttacagctttaggaacagcatttgaagtctttagtttcgatggcgatgaaagtgtagaaacggtgttacttaacggaaaggttaaggtagaacctaaggatcacaaagagcaaataaaaggagaatacatccttcaaccgaacgaaaaactaacgtgccaagtaaatggtgatatacgtatagatcgcgtagatgccaattcttattctgcttggcgtattggaggacggttgagctttaaaaatgaaacattagccatgatcttgcctcggttagagaaatggtacggacaaaagatcgattgcccgcagaaaactgctgatcattatcgctttacatttacgttgcggaatgaacctttggatctgatattaaatataatgtcgcatagtgcgccattaaattataaattaataagtaatgactactatgttctcgaagaacttaagtag

SEQ ID NO: 4170 - DNA, 1548 bp, B.fragilis
aaacaggcaaatgcagaggctgaaagcggagtttggaaacacctactggtattacctgaacttcatcagtccgtatggagacaaaatcataaggaactaatatgtaaagacatgaaaacaatctatatccttcttatcacggttcttagctggagcctgcaggcatgcaccgcccaatgcggcaaaccggatgcctgcacggacagtattccccgtatatatcccgattatgcgggagtcacattcccgctgaatattgcacctcccaatttcaggatcggggagaacgcggatgccttccaaacggaaattggcacaggggagacggcggacatcctctacacaagcaagagtcccgaagtgattataccgacaaagaaatggaagaaacttctccaaaaagccgcgggaaaagaaatattcatccgcatcaccctgctgaggggagggaaatggacacgctatgcggatatcaaggataccatatcgaacgaaccgatagatgagtacctggtctaccggttgctgtacccgggatatgaactatggaacgagatggggatttaccagagagacctgacaggctatgaagagactccgatagcggagaaccgaaatttcggcaaacagtgcatcaactgccatacgttcaatcaaaactctccggaaaccatgatggtacatgtgcggggaaagtcgggagggacactgatatgcaaaaacgggaaagtggaaaaggtaaacaccaaaccggagggattcaagaacgggggaacctatgcggcctggcatccttcaggaagatacatcgcattctcaatgaatgagatacagcagttcttccattcatcgggacaaaaacccatagaggtatccgacctggctgccgacctgatggtttatgatactgaaaagaaaacattcctcactgactccctgatatgcggggagcggtatatggaaacattccccaactggacaccggacgggaaaacactgtatttctgccggggaaacgcttataaagagaagatgccgctggacagtatccgttatgacctgtgcaggataggattcgatccggaatccggtaaattcggtacgccggagtgtgtgtacagagcctccgaacagggaaaaagtgtctctttcccaagggtttctcccgatggtaaatacctgatgttcaccctgtcggattatggaaacttctccatctggcatccggaaagcgaactttgtctgttgacaatggatacaggagaaatacggtttttaaatgaagtgaacagcaacgacgtggagagtttccatacatggtcatcatccggacgctggtttgttttcagcagcaaacggttggacggactatgggctcgccctttctttgccagtttcgatccggaaaccggaaaagcggggaaaccttttctgatgccccaaaaagatccggacttttatgacacgttcactaaaacttataatctgccggaactgattaaacaacccgtaagaaacggaaatgaaatgataaaagctatacattaa

SEQ ID NO: 4171 - DNA, 1638 bp, B.fragilis
caaaatatgaaaaataaaattttatatattatagcgtccgttatgctaacaggatttacctcttgtagcgattttctggatcgttatccaacagaagaactttcagacggaagtttctggaaaacaaaaacagatgcggaaatggccgtttctgatatttatagatgtcttcccaattgggatatagatgaagatatcaattcagacaatgcagtacatggtatcaagtgggctaatggaaacgtgtccaaaggcgtatacgaccctgctgaccaaggatggtcagaggattacggatatattcgtagatgtaatctggtattacagaaattagaagaaatggaattatctcagtcggataaggaaccaatagccggacaagcttacttcttcagaggttatatttattttgaattgattcgtaaattcggagacgtcccatacatcgaccagcctttaaaattaactgatgtagaggacattacccgtacatctaaagatgagatctacaccaaaataatggccgacttcgataaagctttcagctacttaccagaagaatggccggctacacagtggggacgcataaccaaaggtgccgctatggcgatgaaagcaagagcagctttgtattttggcaattgggaaacagcggctacagctgcaaaatctgttatggatctaaataaatatgatctgtacgacaaagaaaacactggaaagtaccaagaattattctgggaaaagacagacggttgtgaagaaattattcttgcagtacagtacaacgcacctgataaaacaaactacctaattggatgggaatgctttccgacaaaaggttggggtggtttgaatccgactcaaagtctggtagatgcattcgaagacagtgaaggagctcctatcagcaaatctaaaatttattcggaaaaaaatccatttgctaaccgtgaccctcgtttagaggttaacgttttacacgatggtgaggaaatgtatggcgtgacaattaaagtagctccactaaaatcaagtggaagcactggtattgcacagcatggtgatgctacagcaacaggatattatcaacagaaatggcttgacccaagtattgaccctcaatcagcaggttgggaaatgggaaaagattgggtaactatccgttatgcagaagttctgttaacctatgctgaggccaaaaatgaagtttcaccactggacgattctgcttttgaagctgttaatcaggtccgtcgccgcgtaggtatgccggaattacaaaagacagatgcaaccaagccgacttactgcgcgactcaagatgatcttcgtcagcgtatacgtaatgaatggcgcgttgagtttgctctcgaaggaggaaagcgtcaatgggatattcgccgttggggtattgctaaagatgtgttgaacgcaccattccttggcattaaatacaaaatggtagacgatgcggttaatgcagatcccaaagatggcggaaaggtatgtgttctgtacgagggtgacaatgttaaactggccggtagtagatatgaagaccataattatatctacccgattcctcaatctgaaattgatttaaatcccaagttaactcaaaatccgggatattaa

SEQ ID NO: 4172 - DNA, 189 bp, B.fragilis; identical to SEQ ID NO: 4134

SEQ ID NO: 4173 - DNA, 1359 bp, B.fragilis
aaaaatgaagacggtggatatgaaatgtctcgtctatcctacttcggacgtgtccagtatgactttatgaataagtacttgtttgaagccaatttacgtgcggatgcctcttcacgttttccaaaagataatcgctggggtgttttcccagcaatctctgccggatggagaatttcggaagaaacatttatcaaagacaatgtatcatggattagcaacttgaaactgcgtcttggatggggaaaaaccggtaacgaagaattagatccggatgatatttatccggcaataccgacatatgcttacgaaaaatatatgtttggtaatagcctgtattctaccgcttacgaaagccgttacgtaaacaacaacttacaatgggcaaccgttacaaattatgagttaggactagaggccggttttctaaacaatatgtttggattcgaattatctgtttataaaaagaaaacaaatgatatgttgttgtacatgcctatacaaggtgtgatcggtatgggcgctcctgcacaaaatgcaggtagtgtagaaaacactggttttgatttgaatttattgcacaacaatcgtatcaacaaagattggagttatgctgtaaaccttaatattgcatatgtaaaaaatgaaatcatcgatatgaatggtacggaaggtgctaattcaaaaaatgataaattatggtacatcgaaggcaatccaattggttcatattatggttacgtagccaacggatactttaacactgacgatgaattagccaattatccgaaacgcaccggcaaagaacaattgggagacatcaaataccttgatttgaatggagatggcaaaattaccgctgacggagaccgccaaatcattggtaagaatttccccagttggactacaggcttaaatctgactttatactataaagattttgatttctctgccatgttccagggagcttttgatgtggatggctattacatggccgaagcagcttatgcattctacaacggagctaatgcactaaagagacatttggatcgttggactccggagcatcacaacgcttcttacccaagaatcaccaaagacagtcaaacgaatttcacaacttcttcattctggctacaaaatgcctcatatgtacgtttaaaaactatttccctgggatacaatctgcctaacagtttcttaagcaaactgggtgttcaaaaagcaaagctttatgttgccggagagaatctattgacgttcagtgatttggaaggtatcgatccagaagaaggcaatgaacgtggttggtcttatggaaacgtaaaaaaagtttcaatcggattaaaagtttcattctaa

SEQ ID NO: 4174 - DNA, 606 bp, B.fragilis
aatttgtattgtttctccctgaaaaattgtatgtttgcacatcacaccgatagatttatgaccgagaaagagcttattgtatcattaaaacagggggacgaagctgcatttactgctctatacagaatgtattggcctaaagttcacaacttttcccgtttatacctatcttctatagccgaagtagaagaagtggtacaggaagttttcgtaaaattgtgggaggcacgtatctttctgaaagagaatgaaagtttcaaaggattcttgtttattataacccgaaatatcatttttaatcaattccgtaaaagttttaatgaaaatgcctataaaacgactgtacttagtagtgcagaggtagagtatgacattgaaaacgagatggatgcagccgatcttcaaggctatatcaaaaaattaatttcagaactgacaccacgacaacaagaagtatttcatttaagtcgtgaggaacatctcagttataaagaaatagctattcgattatctatcagtgaaaaaacagtagagcgtcatattaatgaagccttaaaatttttacgtaagaacatctatttattttttatatttctttctctataa

SEQ ID NO: 4175 - DNA, 1752 bp, B.fragilis
cattttaaaagtaacgattatatgaaaaagataataactctactatgtgcggttactactttaactgcttgtgacatagacagacttccttatggttcaatgtcagccgaacaaataactcaggatcctacctcttcattagagtcacttgtaaatggatgctatgcacaattaaaaagttggtcggatcctatgcatcgtttaggggaatatgcgggtgataatatggcgaaagataaatcatcaacggatgctttttttgattttatttcttattcccgtgatgctgataattatcgtctacaaagcttttgggactctggatacaaagctattgcacaagcttcgaatattattaaaatgattgatgaaggaaaaagcaaaatcattgattatcaactgggtgaatgctactacatccgtggtatgatgtatttttatcttggacgtgctttcggacgtccttattgggacaagccggaaggacatatgggagtccctattgtaaatggtacgccagacgatgtaaataatcttaatcttcctgatcgttcgactgttcaagatacctatgaacaagctattgatgacctgaaagtagcggctcgattgatggaaaatggagaaactaaacgggaaggtcctgcatatgcatctaaagaagcggcatgggccatgttgtctcgtatttatttatttatgagtggaacttatgaagcacccaatagtgaaaatgctcagttggccattgattatgcaactagagttattgaaagtaccactagtgaaggtgggctgaaatatgagttactctcccgtgaaaattttatgcgatataatacattcatgccggaaaataataaagaatctatttttgtagtaaaaatcatggcatcagaaaaaccggattattggaattctatcggtggaatgtattcttatgctggtcagcaaggttggggagaaatgtatgcaagtgccaaatacatggatttattaaatgaacagggacgtaacgattggcgtcctgacaagaaaaaaattgtagatgcacgagcaaatttcatttcaccaagctacatcacggatagtgatggtaaatatgttgaagtattccgtttcataaagaatgtatacaacaaaaacaacatacatacggggtacacatatgtacaattacccatttctaagagaggtaacactgtgacttgtaaagagggggaaactaattacacattgtcattaataaacagtagtgaagaaaaatattcaatcaactattcagatggtcaaacctattctggtgttattgattatgaaatagaactctcaagtgggcaacccaaattctatattctcaaatgttcgaatgaaggaactgcaagcggagaagctgaatctcaattacattctcctgttatctctcgtttaggcgaggtttacttaaatcgtgcagaagcatatgccaaaaaaggtgattattctcatgctcaagcagatctgaatatcattcgtgaacgctctttacccggaagaggctataatgacttaaatgcttctaatgctaaggtgcgaatagaaaaagagagacaattagagctggcctatcaagcagaacgtagttatgatgtatttcgcaattgtgaaacattaactcgcaaatatcccggagtacatgatgccatgcttgaaattccggctacagactatcgggttatttattttattccacaaagtgctattaactcttaa

SEQ ID NO: 4176 - DNA, 3387 bp, B.fragilis
tcaagcacgggattcttaaaggatgacgtctattatttgttaaatttaaattataatctaataattatggtatttatgaaaaaatgcaatcaaaagtggtttaatcctcaaaaagtaaaaaagcaaatagcaattgctgttgctattagtttagtttgtgcaatacctatcagcacatttgcacaagtactcaagttttcaataaaaaagagtaacacttctatccaatcagtattacaagagttagaaaaagaaagtggatatacttttttttataatgacaatcaagtgaagctagataaaaaaatctctataaatatagaagatgcttcgatagaagttgttctaaatcaaatatttgaaaacttaggatattcctatcgaatagtagagaatcaaattgttatatatacaacgcccaccacaactgtgcaacaaacggttcaacagaaaaaacaacaaaaagtgaccggtgtagtaaaagatattgcaggagatcctataataggagcatctataatagaaaaaggatcttcttcaaacgggactatcactaacgtgaatggcgacttttctcttatagtaacaggtaatgaactccaggttagttacattggatatattcctcaaaccattaatctcaaaccgggggtaagctcttataatgtaataatgaaggaagataccaaaacattagatgaagtagtggtagttgggtatagtacacaaaaaaaagagagcttgactggtgcgctacaaacagttaagagtgataaactaaaagatattaccaccccttcagtagaaaatatgttaaacggaaaggtgccgggagtatatgtagctccagggtcgggacaacccgggtcaggaggagctgtcgtgattcgtgggcaagcaactttaagtgggaccactgctccattatgggttattgatggagtgattgttggttcaaatgccggtgctttgaatccaagtgatatagaaacaatgactatcctaaaagatgctgcttctactgctatctatggttcacaaggagctaacggcgttattcttgtaacaaccaaaaatggtaaagcagaaaagatgacggtaaatgtctctgcaaaagttggtatcagtaagttagggagaggaaatatggaaatgatggatggagcggagctatatgattactataaatcattttcaaatcaggaggcgattactttttcacgttacaatgataaactgcgaaattgtaatttcgattggtttgatttggctgcccaaacaggagttacccaagattacaatgtttctttatctggaggcaatgagaaaatcagatctttcctttccatcggtgtctatgatgaagaaggagcagtgaaaggttacgattacacacgatataacttccgattaaaaacaacctataaaccctttgaatggctaagtataaaacctgcactggcaggatcgcgacgggatattgaagataaacagtatgatgtaacttccatgttccaaagattgccatgggatagtccttttgatgaagaagggaatttggttcccaatagatatacgggatgggtgaacagttctaatagtaattatctatacgatctgcagtggaataaatcgaactctaccaattatgagtttatgggtaatttagattttgatattagaattactgactggctgagtttttcatccgtcaataactataaatacataggttataattacagtgaatatacagatccacgctcaagtagtggagagggggtagatgggcgtatgcgtgaatatcaaactaccactgtacgtcgttattctaatcatatcatacgttttaacaagatgtttggtaaacattcaataaatgcgttagctgcttatgaattcaacgattattgggccaaagcaacagatatgtatggaataggatttattcccggtttcgaagtattggacgtggtagctaaaccggagaaagttggtggtagtattagtgagtgggcagtacagtctcttttatttaatgcaaactatgcttttgataataaatatctggcacaactatctttccgtcgcgatggagcctctaatttcggagataatgcaaaatatggaaatttcttttctattagtgccggatggaacattaatcgtgaaaaatggtttcatgcctcttgggttgatatattgaaattacgtatatcttatggttcagtaggtaacagaccaagttcactttatccccaatacgatctctattcagtatcttctaaatataacgaagaatccggagccttgatatcacaattgggcaataaagatcttacttgggaaaagacttatactacaggcaccggaattgacgtagctttttttgataatcggttgagagcaagttttgactggtataataagtacacaagtaacattctatatgcagtacccatttccggattagtaggagtgacaagtatgtggaagaatattggtgaaatgcaaaatcaaggatttgaattgtccattggcggtgatattatccgtacgaaagactgggattggaatatagaaattaacttgggacataataagaacaaattaaagaaactctataagacaaagaacgctgagggacaatttgtagaaaagccaattattatttcagatggaacatcgattgcaggtacagccaaaagagtattacagccaggttatccatgtgatacttattatctgaaagaatgggcaggtgtaaacccggaaaatggggcacctcagtggtataaaaccgtagaaaatgaagatggaactttatcacgtcagaaaacaagtaattattctgaggccgatcaagtgaaatgtggaagttcatctccagacatctttggaggatttagtactgtactccgctggaaagatcttgatctgaatgcagtatttggctactctgtaggagggcaaatctataattattctcgccaggaatatgattcagacggagcatataacgatcgaaatcaaatgaaacttcaaaagggatggaatcgttgggaaaaaccgggagatatagctacacatccggtggcatcttatagtaatacgagtaagtcgaacagttcttcctcgcgctatcttgaaaagaatgactatcttaaattgagatcattatcaatcggttataacttaaaattacctcaatattatattaataatatgagaattttcttcactggagagaacctgttctgtgttacaaattactcaggcgtagatccggaaattccggctagtgatggttctgtaataggtactgcattaccttcggtttatccaactgtacgtaaatttatgtttgggcttaatttaacattttaa

SEQ ID NO: 4177 - DNA, 1491 bp, B.fragilis
gcagcacttatcatgagaaagtacttcccttacatactcttcatttttcttttctttatttattttctctgttatcagagtgtgttatcacatgtgatttattatcaggaacaacatcatctttttctatattccaaaactttttttctacaacatatccagtcacaaggatggatgagttatctgacagcatttattatacaattttttcacatacctactataggcagcattttacttgcaggaattttagccctcatatatttactgactaacgatgccataaaaaaaattacagggcacaatgatctgctactgctatcactaataccttctatatatttgttcctctattcaatgactgtcgaccattcattaacaccaatcatcgctaccttcctgggacttctgattatgggcctttttcatcaaatcacagttcgcccttggtcttttatccgaaaaatttattctccacttccccccaacaataagtaccgtcttttaatatacagcttactaatagcaatttacgcaggcacttcattttacttttttgtccaaacctataacatgagtgaacaccgaatgataatggcggaaaagagtgtaaaagaaaagaattgggaaaatgtactgacacaaaccgaaaaatatatcaactcgggaagaaccaaccagttgatctcctactttcacaacctggctctgtaccatacggaaaaattgccttatcaactattcgattacccacaaaaactgggagtcaaggcgctatacttcccatggaacagcgatagccgtgagagtgaatacggacattttatatatgaagacttaggatacatcaacgaagcacagcggtgggaattcgaagcaatggtggtatggggagaaacggcaccccatttgcttaacctggcacgatacaacatagtaaacaaaagacctgaagtggcacgacggttcatcaatctcctgaagcagtccctcttctatcggaaagatgccgaagaattggaaaaacagctccatgcaggcagtgtaccgggactgcgcatggcacttgaaaacaataaggaacatcccgcacgatttgcaaacgtcatcaatataggaccggaattacaatatctgtgtgagcaggacacgacaaacagaatggcttttgaatacctgatgagtgacctactgctgagcaataacgtagtacgctttgtggataacctgaagttcatcaggcactttaaatatccggaaatgccacccgcataccaagaagcactctatatatacaaattgggagtggacggggaaacgttttccaaatcaggattcaacgtcagcgaaaacaccgaaaagagattccaaaggtattacaacctgtataaaaacaggcaaatgcagaggctgaaagcggagtttggaaacacctactggtattacctgaacttcatcagtccgtatggagacaaaatcataaggaactaa

SEQ ID NO: 4178 - DNA, 1947 bp, B.fragilis
ttaatcgtatttatgagaaaatgcaacatgcggtggtttagtccgcaaagaatgaaaaagcatctggcttttgctttagcagttagcctggtggctatggtacctgtgagtgccttcgctcaagtactaaagatttcaatgacaaagaccaatgtatctattgaaaatgtacttcgtgaacttgaaaaacaaagcgattacactttcttctacaatgacaatcaggtaaaactgaacaagaaagtatccatcaacgtatccgacgctccgatcgaaaccgtattgaacgaagttttcaaaaactcgggatatacctacaagattgtagacaatcagatcgtagtgtctacagcagctgcagcagcgaaagaggtacaggctacccagcaacagaaacaaagaaatatttcgggggttgtgaaagatgcaatgggagaagccatcatcggagcatcggttatagaaaaaggaaatccgactaacggtaccatcacagatatcaacggaaaattcagcctgaatgtaggtggtaatgaattacagattacctatatcggttatatgcctgaaacagtatcgttgaagaccggtgtagcttcttataatatcatcatgaaagaagatactaaaacactggatgaggtcgtagtagtgggatatggtgtacagaagaaagccaatctaacaggttctgtagcatcaatcagtgctgatgccttagagtctcgttccgttgccagtgtgtctgccgcacttgccggacaaattccgggtgtaacttctattcaaacttcgggtgctccgggatcacaaacgggtagtattaccatccgcggtaagaactctattaatgctgccagcccattggttattgtagatggtgttcccggaaccatggatacaatagatccttcggacattgaaacgctaactgtattgaaagatgctgcatcatcggctatctatggtgtacaagcagccaatggtgttattgtaatcactaccaaacaaggtaagaaaggtgagaaaacgcatataaactactcaggtattgtttcatgggcttctcctgttgtgaaacgtcagtatgtcaatgcttatgaacatgctatactatacaatgaagcagttcacaacgaaaatccgaacgcagtacttccttttacggatgaagatatcgagaattatcgtaatggaacttaccccagtacaaattggtacgatgaagcgttcaaaaagagtgcttttgagcaaatgcataatttatctatcagtggcggttctgaaaagaccacttataatgcttccatcgggtataccaaccaaggaggtctgacagatgaaattagctataaacgctataacgcacgtatgagtctgaattcagatattaacaagtatgtctctgtaggtgttaatgcatccggatatcgtggtattaaagaagatggttggatgggatacgtcacagtagcgcagggtgtgagtcgttcatatccgacagacccggtatatgctgaagacggttctttcaattattcaggaaaagataacccggtagcaattcaagatcaatccggttttacccgcagtacagcacagcaattaaatgccactgcctatgcacaaattaatattttaccggaactaagcgttaaaggagtattttctcttcgccatgattacaccaatcaagaaggctttaaaaagcatttcacttatggtaatttcgactccggacttcgcgaaggttacgacgagtattataatcacaaccgatacacaagtcaggtattagccaattataataaaactttcggcaaacattcaatagcagttctgggaggttttgaatcattcgaacacatttataaatttaccaaagcttctcgaaagggcggtggcaacaatgaattaacggaatcattgaataccctgaaaaaatga

SEQ ID NO: 4179 - DNA, 3423 bp, B.fragilis
ttaatcgtatttatgaaaaaatgcaatctgcggtggtttagtccgcaaaaaatcaaaagacaactagcgtttgttttagccatttgtctggtttgtatagtgcccgtcactacctatgctcaaattcttaaaatatccatgaagaggacaaatgtctctatccagaatgttattcgggaattagaacaaaaaagtggatatactttcttttacaatgacaatcaggtgaaacttactaaaaaggtttctgtagatgttacagacgcacctattgaaaatgtattggatcagattttcaacaattccggttacacttataaaataatagataaccagattgttgtctcagccataaaagcagaaatcccgaaaacctcttctcttcagcaacagaaaagtgtacgtatcaccggacaagtaaaagataccaccggagaacctatcattggtgcttctgtggtggaaaaagggtcagcaagtaatggtacaattactgacgtaggaggaaactttaaattaacggtatccggtaatgaaatacaaattacatatatcggttatattccacaaactgtaaaaatccatccgggagtaaccgattatagtattacaatgaaagaggatactaaaactctggacgaagtcgtagttgtaggttacggtacacaaaagaaggtaaacttaacagggtcagtagcttcggttagtaccgatgaaatcaaagatcgtgtacaaacaaatgtattatcagcagtgcaaggtacagtgccgggagttacggttatctcacgccccggacaaacaccgagtataaacttccgtggacgcggtaacttaggaacctcatctcctctctatgtaattgacggtgcaattgcggacgccacattcttttctaaccttgatccgaatagcattgagtccatctctttcttgaaagatgcagcttcatcagctatttatggttcacgtgccgcttacggtgtagtgttagttacgaccaaacagggaaagagcgataaaatgaacgtttcatatagtggttacgtaggtttgagcaatccgacttacaaaccggaatacgtcaactctacccaatatgcagagttgtacaatgaagctctttacaattacaatcctaaaggcgggaaataccaaggctacactgaagaagaaattggttatttcagagatggctccaaacccgatttatatccaaacacagactggaatgatctggtactggataagaacgtattgaccactcaacattcactggacttcagtggaggaacagataaaatacgctattttattggattgggatatgtgtataaagacaatatgattcccggacaagacagccagcgttacaatttgaataccaatttgagttccgatatcactaaatggctgacggtaaaagccggagtgaaatacatacgtaatgattccgaccgcgattgtggtgcgccttcattggccagtttctcaatggtaccggttacattcgttgccaaacagtcaaatggtgattggggtactgtaaatggaggtcagacggctacaagtaattttattacaggcaatccgcttcgtgcactgagcaagaaagattggagtaagtccaagagtgaaaatacaatgtacgatctcggatttgacattaaacccgtgaaaggacttataatcagtggacaaggtgtattcaagggttatgaatataagagcaaaagctacacggctttacaacccaatgctataaactacttttccggagaggaaatagcaggaaccggagttaccaaaaataaaatgagcatggactggcaaagtacaaatacaatgctttatacagcaacagcccgatatgattggtcgaacgataaacatgctgtcggagctttggtcggtacatcttatgaacattataaatacgaaagattggccggatcacgtgaagaatttccatccgacgcattgacggatatggaagcaggttctacctccggagcagggtataccaatggcgcaggttcatcagaatataaaatgttgtcttattttgctcgtgtcaattataccttgatggatcggtacctattcgaggtaaatatgcgtgcagacgcatcctcacgtttccataaagatcatcgctggggatatttcccttcattctcggccggatggagaatgagtgaagaaagcttcatgaaagatattgagtggatcaataatttgaaaatcagagcctcctatggtacacttggtaatataaacaatgtgggtaattatgattacttccaaaattatagtagtggaaatcattatagcttcagtgattcaccagtgattggtatcggtgaatccaaaccggctaatgaaactctcggttgggaaaaagttgctttgacggatattggtttggatttcgacattttcaatggacttctgggggtaactgccgactattatattaaaaatacaagcgatatcttattaggatacaatgtacctacggaaaccggtattacagcagctccatcgcaaaatattggaaaagtgaaaaatacaggtttcgaattggctttgaatcaccggaacaaaattggagctgtgaattatagcatcggtgccaacattgctaccaataaaaacaaaattaccaatttaggtggttcagacaacattatccaaaccagcagttatatcgtgaagtacattctgaaaaagggagaatcaatcggttcattctatggatttaaaacggacggactttatactcaggcagacatcgatgccggacattactacaccttgagtggagtggtacccaatgcgggtgacattaaattcgttcctcagcgtgatatcgaatataagcaagaaatcacagatgaagatcgtactattcttggtaaagatgtacccgattttacatatggcgtaaatttgagtctgcaatataaaggttttgagttcagtatgttcggacaaggaatcagtggaacgaaagtagcatttgatgtttatggcgttcatccattctaccatggacaggacagcccgagaaaatatcatttgaaaagatggacggaagagaatccgaatccacatgcggcatatcctcgcatctattcagcaagtagcgtacatacaacttacaaccgtaattttagtgattatcatttgttcgattccgattatttccgtttcaaaactctgtcactgggatatacagtaccatctgcaacagtgaagaactggggattacagtcattgaaagtatatgtaacaggcgagaatcttttcacggttcgtgctgataaaaagatggaagactttgatccggaaacagccggcggtgtgatttatacgctggggactaaatcggtagcatttggtgtaaacatatcattctaa

SEQ ID NO: 4180 - DNA, 1776 bp, B.fragilis
aaaatagaattcacaatgaaaaacaatataagaaaaattgcattgggattatgtctcacaggagcattgacagcctgcgatttagatgtggttccacctgctgacattgcagcagaaaacttttggcagactgaaaaagatgcatggtatgctttgaacacttgttatgccacattagatggtgtagacatctgggatgaattgtgtaccgacaatgcgcatagccataaaccttgggaaggaaacttcgaaatggtccagcaaaatggtattagtacagccaacggatatgggagctactattttggtaccgttcgtatagtaaacaactttatcgcgaatatagataaatgtgcagtcagtgaagaactgaaaacacgtatgaaagcagaagcacgttttttccgcgctttaagctatctggatttgaccacaaaattcggaaaagttcctgtaattacagaggttttggcttatgacgctcccaatgtaaaacgtgatgaagtagaaactgttcgtaaatttattttagatgaattggctgaaatagctgaaattcttccagacagttataatggtagttatctgtatgaaaccggacgtattactcgtgccggtgctttggccctccgtgcccgtgcagctttatatttcggcaactatgctgaagccgaggcttcagccggaaaaatcatatctgaaggacatcattctttattccgtgtatcatcgcttaccaccgcacagcaaaaagaagctgacgaaatggatgcatatattgactatgcaaccaaaggtatcgataaagataaattcgtaaaaggtatgttcagttatgaatcactgtggcacaaaggtaatgcatctcccgctaatccggagtatattgtaacacgtgagtatatggctgatgcaaacaattacgactggaccagatatacctattttatacctaaatcgttctctcaatatgacgggtattgttcttacgaacccatgcaggatctgattgacgcctattgggatgtggatggtaaaacgatgcgtaatgacatcactatggaacaacgtaaagaacgttatgcggaaatatggaaagatttcaaagatatgagccaatctcaattcatagaaaaagtgccacaaacagatattatgaaatatgactatatgaaagagttccgtaaccgcgacagccgcttgtatgtgtctatgatgttccctttcaaaggatggcatgaaaccattaaaggtacattctacttccgttgggatccggatctgataaataaagacggtaatgaatcatggaccggatatttttatcgtaaaatggtcactcttgatccatacgatacctggactgcagaagaagactatccggtgattcgttatgctgaagtattgttaacttatgcagaggcacgtattcagaattcgggatgggatacagaagtacaaaaagcattgaatgatttgcgtgatcgttgtggtatgccggatgtgccaactaccatgccttcaaaagaagaagctctggcctttgtacgtaatgaacggcgtattgaattggcagcagaaggccatcgctttgatgatatacggcgttatggtaatgattactgtagtaaggctatgaatggtccttcttatgctccaaacggatatgtcgtaattaataaagtttgggataaccgtttgatgctgatgcctatacctcaaggtgccattgacctgaatccattgttgaaagacgatcagaatccgggatattaa

SEQ ID NO: 4181 - DNA, 510 bp, B.fragilis
ttaggcatgtttgacattcattttgtaacacacgatcagcttactgaaataattcttttagaagtgattcgccttaaatcttcggcttggaattattcttatgaggatcaagtatcgtggattaatactcatataaaagattcggatttgcattgttttttatcagaggatggtgttaatgttggttatcttaatttgattgagacaaatatcattgtcgatgatttaagttatagagcatatggtgttggtaatgtttgttctatcgtcagaaaaaaggggtatggcagtatactcctgaattatgttaatgatttcattgtaaataaggaatatattggagtattgttatgtaaaccagaattgtcacatttttataataaatctggttggaaattagtaccatatttaaagttattatgtgagttctcattaactaatatagagatgatgacatataattgtgaatttaattataaacaaattatttataaaggagggcctttttaa

SEQ ID NO: 4182 - DNA, 264 bp, B.fragilis
aacgtggtgccgttaccggacttgcttcgagtacaagaaaatttatatgtagtgccttgtgaacaagtacgcagatgttgtaatttttatgaagactgcctgaatgcgggcggtaccgagcaggagaggggctatggccgtagcatcctaaaggatttttcgaacgacgcccaaatcaaatccttgcaaagtgatggctataatgtctatatgtatcttgatgatgagttgatagaggtgccgccttgcccatgtgcggaataa

SEQ ID NO: 4183 - DNA, 486 bp, B.fragilis
gttatgaatacactcacttctcaaattgaacaattacagagtctcgcgcacgagttactctatttaggtgtggatggtgctcctatttataccgatcatttccgtcagttgaacaaagaagttttagaacaatccgatgcgttgtatcctcagcgcggtgctacttccgaagaggaggcaaacatttgtctggcactattgatgggttacaatgcaaccatctataatcagggtgacaaggaggagaaaaagcaagttgttctcaatcgttgttgggacgtgcttgaccaacttcctgctactttattgaaatgccagttgttgacttattgttatggtgaggtgtttgaagaggagttggcgaaagaggcgcatactatcatagaaagttggaaagataaagaactttctgaagataaaaaagaggcaatcaataatttgagaaatttggaagagaatccatatccttatagtgaaatggaatag

SEQ ID NO: 4184 - DNA, 234 bp, B.fragilis
ctcccgctaacaaaagagatagatgaagtccatcagtacccgaatgtaaagctaatgacagaggattcccaatataagcacgaaacttatcttcaaactgataaactgcttctccctctgcaatatagccactatacaatatcttgtgtaattctggcattaaaatatcagcaggaggaagataaggtttcactaaaggtatcattattatttatcttatttatttatacctaa

SEQ ID NO: 4185 - DNA, 285 bp, B.fragilis
ttatcgcggacgcatattttaagtgtaataggactatatctagggtgtaagaattcaatagaattaacgtttaagagtgagaaagatattatgcgctgtatagatactgtaactattactatctcgaaaatggagattgatttacctaaaatagagattgttaagcaatgtggtatgattgctgctaatactgtctttttaataaatagtttgacttctaatattccatatatgtttttggataggctcaggggcgtaaaagttacttgggataaaataaaatag

SEQ ID NO: 4186 - DNA, 231 bp, B.fragilis
gcgacgaatgccctccgtgcggcaggtgatgtgaattatcctttctatgtaggattggttgtgatgtggagtgtggctgtcggcataggttatttatttggaatttattgggcttggggcatttgcggcatgtgggttgcctttgctctcgatgaaaacattcgcggaattatctttgtccgtcgttggtatgggatgaagtgggtgaataaaagctttgtgaggtcataa

SEQ ID NO: 4187 - DNA, 258 bp, B.fragilis
gctgaaaaagccgggaccaacctgcaaccccaaggcatatacaaagataatgagcccgaaactctcggcgtaattcagcatctgcggatcaatggacaatccgaagtgcccggccagaatgccggcaaaaaagacaaaggtaacgccaagcgaaatgccacaaacatgaattttgcccaatccgagcccaatggcggaaatcagggaaagaacgacaactgcctgcaaagcagaatgttcgataaagagactatataa

SEQ ID NO: 4188 - DNA, 1209 bp, B.fragilis
ataatgaaagcatgttttatggggttaggctatattggcttgcccactgctattattgctgccaaacacggtattcagattaccggagttgacattaatcctaaagtagttgaaatgactaatttgggtaaattgcatattattgaaccaggtatgcaggcactgcttcaagaagtagtttcttcaggatggttaaaggcttctactacaccagatgtgagtgatgcgtattttgtggttgtgcctacacccttcaaaggaaatcatgaacctgatatttcttatgttgagactgctactcgtgctgtaattcctttcttaaaagaaggagatttgtatgtgatagagtcgacttctcccgttggcactaccgataaaatggcagatttgatttttgatttacgtccggaattgaaagataaactttatatagcttattgtccagaacgtgttcttccgggaaatgttatttatgagttagtccataatgatcgtgttattggtggtataaatgaggcttctaccgataaagctattgaattttatagccactttgtacaaggtacgttgcatcgtacaaattgtaaaacagccgaaatgtgtaaattgacagaaaactcttctcgtgatgtacaaatcgcttttgcaaatgaactttccttgatatgcgataaagcaggaattaatgtttgggaattaataagtttagccaataaacatcctcgtgtgaatatccttcaaccaggttgtggtgtaggggggcattgcattgcggttgatccttattttattacgtcaaattttcctatggaatctaaaatcatttctacagcccgtgagataaataattacaaagccttttggtgtgcagaaaaagttcagaattccatgttaaagtttgaacttgaacatcatcgcagaccagctattgctatgatgggtttagctttcaaaccagatattgatgatttacgtgaagcccctgcaaaatatatcacgacgaaggtgatgcaaagttgcaataatgcagatattatggtagtggaacctaatgtacaagaacataatgttttcaaactcactgactataaagaagcttatacaaaggctgatattgtagtatttctcgtagctcatacttcgttcaagtctcttccttatgatgagacaaaagtcattcttgacttttgtggtatctccaaaagataa

SEQ ID NO: 4189 - DNA, 1296 bp, B.fragilis; identical to SEQ ID NO: 845

SEQ ID NO: 4190 - DNA, 246 bp, B.fragilis
ataaattcgtatatgaatgatatatttgatgaattggtatcatccaactactggaatggaaaacttccgaaagtggaatttgcccgtaaaagttacacaaaccgtatattcgggtatgtaggtaaccgccttgtaaaggtcctgaccggacagagaggggtaggtaaaggatgcctgttgcggcagatcatctatcagttgatgcgatggggtgtttcatcacgggaccattctatatataagtaa

SEQ ID NO: 4191 - DNA, 837 bp, B.fragilis
ccaattaatcagcaacataacaacttaacaattatggcaacaacatacgatggaataaattactttccaatagctgtgaattttatggaagagaacgcaatggaggtaatagaagcaaaatatggcatgaaaggactcgcgattgtactgaaactcctatgcaagatatataaagaaggatattatattccgtggggtgaggaacaatgccttattttcgccaacaagacgggaaaagaggcagacgcagaagaggtgcaggggattattgagataatgatcgagaaaggaatgatagacaggggaagctatgcggaacataaagtactgacctctgaagcaatacaaaaagtatggatagaggcaaccaagcgaagaaagaggaactggacagccatgccttatctactgataaagccgaaagagacatgtaatgaagaaaagaccgtctgcacgcaaaatgtagagcaggatgcaggctctgatgcaaaaaatgcatgcaataccgaacaaagtaaagtaaagcaaagtagagaatttcccccctcagctcccccaagggggaaggaagaggaagtcaatgctacgccggtcagtatgcccggatacgcatttaatacaatgacacacaactacgtgggattaatgggaaacctggaacgattcggaataacagacgaaaaagagatcgaagcaatcctgcgactgtcggattacgggagaaaaggaacccctgtatggaaactgatttgcagcacgaactggagtaacatcggagcaaaaggaaaatacatgatcgcagcgttgaaccgggcaaagaaaagaagcggaacctaa

SEQ ID NO: 4192 - DNA, 525 bp, B.fragilis
atgtctgaacaacagaagtattggtttgccgcccgtacccgagataaacaagagtttgctattcgtgactctcttgaaaaattgaagactgaacttgatctcaattactatcttcccactcagtttgtcatccggcagttgaaatatcgtcgaaaacgggtggaagtccctgttattaagaatcttatcttcatccaagctaccaagcaagatgcttgtgatatttctaataaatacaatatccagcttttttttccgaaagacttgcttaccagggctatgctgatagttcctgataaacagatgcaggacttcatatttgtcatggatttagatccgaatggcgtcagtttcgataatgaccatttatctgtcggtagcagggttcaggtagttaaaggtgatttctgtggtgtcgagggcgaacttgccagcgaggccaacaaaacttatgttgttattcgtattgccggtgtattgagcgccagtgtcaaagttcctaaaagttatttacgtgtcatttaa

SEQ ID NO: 4193 - DNA, 1698 bp, B.fragilis
ctatatttgcacaatttatcatcaaatgtgcaaaaaacaatggaacaaagttttatagcttacattgaaaatagtattaagaataattgggatttggacgccctgacagattataaaggtgccaccctacagtataaagacgtagcccgcaaaatagaaaagctccacatcatctttgaagaaagcggaatccgcaaaggagacaaaatagccgtttgcggaagaaatagttcccattggggagttactttcctcgcgactctcacttatggagcggttatcgtccccatcttacacgaattcaaagctgataacgtacacaacatcgtcaatcactcggaagccaaactcctctttgtaggagacgtggtctgggaaaacctcaatgagtctgccatgccgttgcttgaaggtatcctgatgatgaacgattttacgttattggtatcacgtagcgaacgactgactcacgcacgtgaacacctcaacgaaatgttcggcaagaaattccccaaaaatttccgtaaggaacatatcgaatatcataaggatcagcctgaagaattggctgttatcaactatacctcgggaaccaccagctattcaaaaggtgtaatgctcccctatcgcagcctatggtcgaatacggctttcgctttcgaggtccttccactgaaagcaggtgataagatcgtatccatgctgccgatggcacacatgtacggactggctttcgagttcctgtatgaatttgcggtaggttgccagatttacttcctcacccgcatgccgagcccgaagattatcttccaggcgtttgccgatgtgaaacccaatctgatcgtggctgttccgctgattattgaaaagatcatcaagaagagcgtacttccgaagttggagactcctaccatgaagctgctgcttaaagtgccgattatcaatgataagattaaagcaacggtacgcgaagagatgataaaaggctttggcggcaactttgaagctgtcattgtaggtggagccgccttcaaccaggaggtggaacaattcctgagaatgatcgacttcccttatacagtgggctatggtatgaccgagtgcggtcctatcatttgttatgaagactggaaacgcttcaaaccgggatcatgtggaaaagcagcactcaacatggaagtgaaagtcctttcacccgatccggaaaacgtagtaggcgaaattgtctgcaaaggtccgaacgtaatgttaggctactataagaatgaagaggctaccgcccaagtgatcgataaagacggatggttacataccggtgaccttgccctagaagatgctgaaggcaacatcacaattaagggacgcagcaagaatatgttattgagtgccagcggacaaaatatctatccggaagaaatagaagataagctgaacaatctgccgtacgtggccgaaagtattattgtacagcagaatgacaaactggtgggactggtttatccggattttgacgaagcctttgcgcatggtctgaaaaatgaagacatggaacgggtgatggaagaaaaccgggttaccttgaacgaaatgcttcctgcctacagccagatttcgaaaatgaaaatctatccggaagagtttgaaaagactccgaaaaagagtatcaaacgcttcttatatcaagaggcaaaaggataa

SEQ ID NO: 4194 - DNA, 219 bp, B.fragilis
ttgagtttgcaacactgtccggttgtaactgctgaggggcatgtattgatatttgacaatggatatggatgtaatttttctggatctaatagacatagtcggggtgagtataaaatagtaggtcttgatgtagagcaaatttgggagtatggtaaagaacgaggcgaagattttttctctcctattactagtgaggtacaatatatagaggaatcttaa

SEQ ID NO: 4195 - DNA, 312 bp, B.fragilis
cagtgttcgcaggtatattatgacgcatactccaaatgcgtagcggttttgtcactgtcttgctttgccggaggggaaaatagtttcgtatcattagaaggtatgaatgtagccgcccacaagggtggatatggacagtcttcaatatttcgtgatggcggtaggaaaagcggcggcttaatgcgagtggggtcttttagagcgccaaacggatggggcgaatatgcaaatgaaaagaaccaggctcgggctaaattggtcatctttcccactaactatatagacaaagactccaagaaaagcaatcgctaa

SEQ ID NO: 4196 - DNA, 252 bp, B.fragilis; identical to SEQ ID NO: 860

SEQ ID NO: 4197 - DNA, 345 bp, B.fragilis
tttagatggcacatccgcgtcaacctctacggatacaggttggttggacgcttcttccctgtatattccggttctggctgtaaaggtgttacttataagaaagatatcgtggatgatcttattgaacataaatgtgactgttcgaaacttccggccgggacggtaatcctaaaagtgatgaagcgtcagaatttgcccatttgggtggacaagggtacggttcaactcaacaagttgattcctgccttgaagggtatcgctttagagttgggttcgaatgtgcatgtagatgaaacgtggtgccgttaccggacttgcttcgagtacaagaaaatttatatgtag

SEQ ID NO: 4198 - DNA, 390 bp, B.fragilis
aagcccgacaataactcattaataaacttaaaaaaatcaattatgaaaaagaacaggaaagcagtatcgaaaaacgaaatgatgaaaggaaaatggaaaagacaaatcatgctcgaaaaggactacacagaacagtgctccgaatggatggcagaacgactggaagccctcatagaatatatgcaatatggacatgcagccgtagcttatatgaaacaggacggaacattcaaactggtgaaaggaacattggtgggatacgaaaaagatttcggaaagcagtatgatccgatggaaataaaaaacacagtggtctaccgggatgtggaacaacaaaggtggatgaccttcaaaatagagaatttcatggaatggagagcgatcgtatag

SEQ ID NO: 4199 - DNA, 1095 bp, B.fragilis
ttgcgactaaacatgattgacagaatggataaaaacgcaaaaatttatgtagccggacaccacggactggtgggttcggctatatggaaaaacctgcaggaaaaggggtatacgaatctggtgggacgcacacataaggaactggacttattggacggtgcggccgtaaagcagttttttgatgaggaaatgccggagtacgtgtttttggctgccgcttttgtcggagggatcatggccaatagtatctaccgtgcggactttatctataagaacttacagatacagcagaacgtgatcggagaaagtttccgccatcaggtgaaaaaactactctttctgggcagtacctgcatctatccgcgggatgccgaacagccgatgaaagaggacgtcttgctcacttctccactggaatataccaatgaaccttatgccatagccaaaatagccggactgaaaatgtgcgaaagcttcaacctgcaatatggaacgaactacatcgccgtgatgccgaccaacctgtatgggccgaacgataactttgacttggaacgcagtcatgtgctgcctgccatgatccgtaaaattcacttggcacactgcttgaaaaaaggagattgggaggccgtgcgtaaagatatgaacctgcgtccggtagaaggcatcagtggtgccaattccaacgaagaaatcctccggattctccggaaatacggcattactgaaacggaggtgacactttggggaacaggaacgcctctaagggaatttctttggagtgaagaaatggcagatgccagtgtcttcgtaatggaacatgtggacttcaaagatacctacaaagccggtgcaaaagacatccgcaactgccacatcaatataggtaccggcaaagaaattacaatccgcgaactggccggactgattgtaaatacagtcggctatcagggtaaactgacttttgacagcagtaaaccggacggaaccatgcgaaaacttaccgatccgtcgaaattgcacaacctcggatggcatcataagatcgatattgaagagggggtacagagaatgtacgagtggtatctgggataa

SEQ ID NO: 4200 - DNA, 1161 bp, B.fragilis
cttatgaagaaaataattcttgtagcagctcttctttcggctgcagtctgtctgcctgcacagaataaaggcggaaacaaaagtgggggaatcaatctttctttatggaaaaaagcatgtacgcaaccacttgacagtacacagactacatatgtcaacctggggcttttctcggcaatgcataagttgcacggtgtaggcttcaatgccttcggaagtatggtacagaacaatatgaacggtgtgcagatttccggattggccaaccttgcgggaggaagcatgcatggagtgcagattggaggtatcagtaacgtaaacggcaacaatctggcaggattgtctgtttcgggacttgtcaacatcaccggaaacaaagcaaagggtgtactgattacgggtttaagcaacattgccggagacaatatgcgcggactgatgatgagtggtatcatgaatatcacaggcgataaagccgcaggtgtacaattggcaggccttgccaacgtaaccggtgaggaatatgacggacttatgatgtcgggattgctcaacgtggtaggagaagaaatgaacggactgcaactttccggacttgccaatgtaaccggaggacaaatgaacggagtgcaattgggactgttcaattttgcctctaaggcaaaaggtttgcagatcggactgttcaactatcataaggaggatatgaaaggacttcagctgggactggtcaatgccaacccacagaccaaggtacagttaatggtattcggaggaaacagcaccaaaatcaatgtaggtgcacgtttcaagaacaaactcttctacactatcctcggtggaggcacacactatcttgattttgacgataaattttctgcggcattattctatcgggcaggccttgaacttccactctacagaaacttgtttgtaagcggtgatttacgctatcagcacatcgaaacattccggaataaaaaggtggaaggcattccggcacgtctttatgccttgcaggcacgcctcaacctggagtatcggtttacagataaattcggtttgttcgtcacaggcggatacggtggcagccgttactataacaaagccaggacctacgacaaaggtgtgattgcggaagcaggagtggttctgttctaa

SEQ ID NO: 4201 - DNA, 252 bp, B.fragilis
catgttgacctgttttcgattagactttacctttgttgcacatttaaaaataattttatgtacagtagcagtgattttgaaaagtataatttctctactagacagagagtgaaccccaaaggaatttcaattaattctttttgtctgatccaaggtgttctctatcgtaattttaatacttggtttgtgaagactcgcaagagaatcgttccggttcagattgaaggtttcctttttctgatttccttgtga

SEQ ID NO: 4202 - DNA, 210 bp, B.fragilis
aggtgccgccttgcccatgtgcggaataaattcaaggatgcctataatcaaggctataggaaggctcgtttcttcttggaacaggttgcaaaactttataagcatgaggatgactaccgccgggataatctgttagctactgagactaaggaaaaatgtaatgatatttatattaatggaatcgttgatgccttatgtgatggactgtag

SEQ ID NO: 4203 - DNA, 192 bp, B.fragilis
tctagattactggtttctggagctttaaaatatgatctgaattatacggatagtttgaataattcggttttccctaatacaaattttgttagtacacgtattattgaagtagatagtaagaataatgttagttttgagatgctctataaatctcagaaaatggatatgacatttagaatgcaaaagatgtaa

SEQ ID NO: 4204 - DNA, 1173 bp, B.fragilis
attctattctgttttatgaaaaaagtagtattggtttttgggacacgtcccgaagctataaaaatggctcctatagttaaagaatttcaaaaacatccggatgaattcaaaacgatagtatgtgttactggtcagcatcgtgaaatgcttgatcaggtattgaacatcttcgaaatcactcctgattatgatttgaatatcatgaaacaagggcaggatctttatgatataacaagtcgtgttttgacagggatgcgtgatgtgttgagagagtctcagccagatatcgttttggtccatggtgatacaacgacttctatggcatcggccttagcggcattttatcaacaaatacctgtgggtcatattgaggcaggtttacgtacgcataatatttatagtccttggccagaagaaatgaatcggcagataacaagtcgtataactacctgtcatttctcaccaactttattaagtaagcagaacttgttggatgaaggaataagagaatcttctataactgtgactggtaatacggtgattgatgcactttatatggttgttgataagattaaaaataataaagaactcaataaagaattagaaagtattttaaaacaaactggatacgatatcaatcgtttgcagaatggaaggaaattaattttaattactggacatcgtcgtgaaaactttggtaatggttttatttcaatgtgtaaggctattaataccttaaaaaagaaatatccagatgtcgattttgtttatccgatgcacttaaatcccaatgttcgtaagcctatccatgaaattttcggagataatctatccaaccataataatctgttttttatagaaccgttggaatatctttcgttcgtttatttgatggagaaatctacaattgttttgactgatagtggtggaattcaagaggaggctccaggacttggaaagccagtgcttgtaatgagagacaccactgagcgtcccgaagcattggaggccggaactgtaaaattagtgggaacaaattatgataagattgtagatggtatttctactttgttggatgataaagtgtattatgaagaaatgagtaaatcggtgaatccttatggagatggaaaagctagtgagcgaattgtaaataatattaattatgtttaa

SEQ ID NO: 4205 - DNA, 2022 bp, B.fragilis
attgtaaatcgtaaaatcgtaaatcatatgactgctcaaagtaatataacccccgaaagtatcgttgccgatctgcgttatctgcaactgctttcacgtagtttccctaccattgccgctgccagtacagagattatcaatcttgaagccatcctgaatcttccgaaagggaccgaacactttctgaccgatatacatggcgagtatgaagcttttcagcatgtattgaaaaatgcttcgggagcggtgaagcggaaagtgaacgaaatattcggccatactctccgtgagatcgagaagaaagagctctgtacgcttatttattatccggaagagaaactccaattgattaaagcaaccgaaaccgatattgacgattggtacctgatcactctcaatcagctggtaaaggtctgccagaacgtatcatccaaatatacccgttcgaaggttcgcaaatcattgccggccgagttctcctatatcatccaggagttacttcacgaatcgaccatcgagcccaataaacatgcttatatcaatgtgattatcagtaccattatttccactcgccgcgctgacgactttatcattgccatgtgtaatctgatacagcgtcttacgatcgattcactccatatcgtgggcgatatctacgatcgtggtccgggtgcccatatcataatggatactttgtgtgattatcacaatttcgatatccaatggggaaatcacgatatcctctggatgggtgcagcatcgggtaatgaagcttgtatggccaacgtgatccgtctctcgatgcgttacggcaatctggggacattggaagatgggtatggcatcaatcttttgcctcttgccacttttgcgatggatacttatgcggatgatccctgtaccatctttgcacctaagaccaactttgccgattctacttataacgagaagaccttgaggctgataacccagatgcataaagctattaccatcattcagtttaagctggaggcgaacattattaatcgtcgtccggagttcggaatgggtggtcgcaagttgcttgagaaaatcgactttgaacggggagtatttgtctatgaaggcaaagaatatccgttgcgcgataccaacttccctacggtagatcctgcagatccttatcgtctgactgatgaagagcaggaattgatagaaaagatacattactcgtttatgaacagcgagaaactcaaaaaacacatgcgttgcctctttacctatggaggtatgtatctggtgtgcaattccaatttgctttatcatgcctctgtgcctctcaacgaggatggaagtttcaagcacgtgaatatctgcggtaaagagtattgggggaagaacttgctggacaagatagaccaattgattcgtacggcttattttgatgaagatgatgaagaagagaaacgctttgccatggattacatctggtatctgtggtgcggaccggatgccccttcgttcgacaaagacaagatggctacgttcgaacgttatttcattgcggataagagcctgcataaagagacgaaaggatattattatgctttgcgtaacaaagaagaaatctgtgaccggattcttgaagaattcggagtgacagggcagcatactcatatcatcaacggtcatgtgccggtaaagaccattaaaggcgagcagccgatgaaagccggtggaaaattgctggtcatcgacggtggcttttcgaaagcttatcagccggagaccggtattgccggatatacgctggtatatcattcacatggtttgcagttggtgcagcatgaccctttccagtctacacagaaagccatcgaagagggacaggacattaagtcgactaccttcgtcatcgagttcaattcacaacgaatgatggtgaaagataccgataagggaaaagagctcgtaacgcaaattctggatttaaagaagttgttggtagcataccggatcggtttgataaaggagaaggtctga

SEQ ID NO: 4206 - DNA, 402 bp, B.fragilis
gtgaataagctacttaaaaactggtcatatttgttactgtctgatatatctcagtcagtaattaatttttttgtttttatgttgttggctaggaaattaactcctgtcggctatggtgagtttaatgtaatactagctatagtggctatattttcagtagtagcgacgaatttgggagctaaccatgtaataacaagagaggttactttacaccccgataacacgaagggaatttgttataatgtaatacctttcaggttaattgcattagcgattgcttttcttggagtctttgtctatatagttagtgggaaagatgaccaatttagcccgagcctggttcttttcatttgcatattcgccccatccgtttggcgctctaaaagaccccactcgcattaa

SEQ ID NO: 4207 - DNA, 369 bp, B.fragilis
cattatggaagaaaaaaagtagttatctcattgaatgataacttagtaaccatcgaagtaaatggaaaagtaatctttgcgggtaaagccgacttgcaattcagcctcaatcaaaaggttagagaaccactacgcatcacaaaaggcaaaggaaagctaatggaggcacttaccgaaagctttatcaaaggcggaatcaacagcatggaaaacagacccattgaagaactacaggaaacaataaaagaatatctcacctttgaatatcagcgcaaaggcattgctacagagcccaataaacgttcttttctatcagagctgaaaaaatatgccagagcattccggaaaaaacgagatgaaagcgaataa

SEQ ID NO: 4208 - DNA, 270 bp, B.fragilis
aaaccgtttgggcgtgtcaacaatgatcattataatacctcgaagaaccgcaagggcatcgataaggataaacctgtgaaaagcaggaatgatgactgttctgatttagatggcacatccgcgtcaacctctacggatacaggttggttggacgcttcttccctgtatattccggttctggctgtaaaggtgttacttataagaaagatatcgtggatgatcttattgaacataaatgtgactgttcgaaacttccggccgggacggtaa

SEQ ID NO: 4209 - DNA, 186 bp, B.fragilis
gtttttaatggcatattagaagccaaacaactcattggagaagaaataacttcatcccctggcttcaactctaaaaccgttaatgcaacttgtatcgcagaagcatatgagtttgttgtcagtaaattttcaatccctaagaaagtcgataatttttcttctaaaagaagtccccactttccataa

SEQ ID NO: 4210 - DNA, 891 bp, B.fragilis
tttatgaaaggcattgttttagctgggggatctggtacacgtttatatcctattactaaaggaataagcaaacaacttcttccaattttcgataaacccatgatttattatcccatctccgtacttatgttagctggtatacgagaaatactaattatttctactcctcatgacttaccgggttttcaacgtttactgggtgatggttctgattttggagtacattttgagtatgcagagcagccttctcctgatggtttagcacaagcatttattattggagagaagtttataggcagtgattctgtttgtttagttttaggagataatattttttatgggcaaggttttacgtacatgttgcatgaagcggttcgtactgctgaatcagaaaataaagcgaccgtttttggctattgggtaagtgatcctgaacgctatggcgttgcagagtttgatcaggagggaaatgtgctcagtattgaagaaaagcctcaaatacctaaatcacattatgctgttgtaggactttatttttatccgaataaagtggtggagatagcccaaaatatcaaaccttcccctcgtggagaattagaaataactactgttaatcaacagtttctattagataagaagctgaaggtcaaattattagggcgtggctttgcttggttggatacaggtacgcatgactctctgtctgaagcgagcacttttatcgaagtgatagaaaaacgtcaaggactgaaagttgcttgtttagagggaattgcttttaggcaaggttggatttctttagcaaaaatgaagtcattggcgaatttgatgttgagaaatcaatatgggcaatatttattgaaggtcattaatgaattatctgtaaaataa

SEQ ID NO: 4211 - DNA, 1671 bp, B.fragilis
attattcacatggagtggttatatagtctctttatcgaacattctgctttgcaggcagttgtcgttctttccctgatttccgccattgggctcggattgggcaaaattcatgtttgtggcatttcgcttggcgttacctttgtcttttttgccggcattctggccgggcacttcggattgtccattgatccgcagatgctgaattacgccgagagtttcgggctcattatctttgtatatgccttggggttgcaggttggtcccggctttttcagctcatttcgcaagggaggggttacgttgaatatgcttgccatcgcagtagtgattctgggtacgtttcttgcggttgtttgcagctataccaccggagtttcgttacccaatatggtaggcattctgtgtggtgccaccactaacactccggctttgggagcagcccagcagacgctgaaacagatggggcttgaaagcagtacaccagctttgggatgtgccgtggcctatcctctcggagtgatcggggtgattctggcagttctgttgatccgtaaattgctggtacgccgggaagatcttgaagtacaggagaaagacgatgccaacaaaacctatattgccgcttttcaggtacacaaccctgctatttttaataaaagcattaaagatatcgctcatatgagttatccaaaattcgtcatttcccgtttgtggagagacggcaatgtcagtattcccacttccgaaaagattataaaagaaggcgaccgcttattggttgttacatccgaaaaagacgcattggcccttaccgtactgttcggtgaacaggagaatacggattggaacaaggaagatatcgattggaatgctatcgacagccaattgatttcgcaacgcattgtcgtcacccgtcccgaattgaacgggaagaagttgggagctcttcgtctgcgccatcattacggaatcaatatcagccgtgtctatcgttccggggtgcaattgttggctactcccgaacttaccttgcagttgggtgaccgtctgacagtggtcggcgaagcggctgccatccagaatgtggagaaggtacttggaaatgccatcaaaagcttgaaagaacccaatcttgtggctgtatttgtcggtatcatcctgggattggccctgggagccgtacctttctcaattcccggtatcagtactcctgtccggctcggacttgcaggcggtcccattattgtaggcatcctgatcgggacctttggaccccgtttgcacatgatcacctataccactcgcagtgccaatctgatgctccgtgccttggggctgtccctttatcttgcctgccttgggttggatgcaggtgcccatttcttcgatacggtattccgtcccgaaggacttttatggatcggcctgggctttgggctgaccctcgtgcctacggtgcttgtggggttctttgcttttaagattatgaagatcgattttggcagcgtttccggtatgttgtgtggcagtatggccaatccgatggcattgaattacgccaatgataccatccccggagataatccgtcggtagcttatgctacggtctatccgttgagtatgttccttcgcgtcattatagcccaggtgctgctcatgtttcttctatag

SEQ ID NO: 4212 - DNA, 1032 bp, B.fragilis
ataatattaattatgtttaaagataaggtgttaatgattactggaggaacaggttcttttggtaatgctgtattaaaacattttttaaattctgatttaaaagaaataagaatattcagtagagacgaaaaaaaacaggaagacatgcgcattgaatataaaaatgataaattaaattttatcattggcaatgtacgtgattttgatactatcaacaatgcaatggcaggggttgactatgtctttcatgcagcagctttgaagcaagttccttcttgtgaattttatccaatgcaagctattcgtactaacttgtatggtgctgaaaatgtattagaggctgcagctcgtaataatgtaaagaaagttgttgttttaagtactgataaagctgcttaccctatcaatgctatgggaatgactaaagctttgatggagaagttggctatttctaaagctcgagatgctcgtgtacaagcaaatggaggggttatttgtgctactcgttatggaaatgtgatgtgttctcgaggatctattattcctttatttattaagcaaataaaagaggggcttcctttaactataacagagcctcgaatgacgcgctttatgatgtcattagatgatgcagttgatttggttttgtttgcttttaaaaatgctgaaccaggggacttgtttgttcaaaaggccccagcagctacaatccaagatttggctattgcattgaaagaactttttcatgcgaataatgagatacacataattgggcctcggcatggtgaaaagatgtatgagacattgtgtacgaaagaagaaatgtcaaaggctacggatatgggggaattttatcgtgttcccgcagattttcgggatttgaactatactaaatatgtccaaaaagatggtcctatgttagtagaacatgagtataattcagagaatacgcatcgcttaaatgtggaagagttgaaagaaatgcttttaacattagattatgtaaaagaagagttaggtataaataaataa

SEQ ID NO: 4213 - DNA, 564 bp, B.fragilis
atgaatataataaaaacagcaatagaagggcttgttatcattgaacccaggcttttccaagatgatcgtggctatttttttgaatctttcaatcaagaagagtttgaaacgaaagtatgtaaaactacttttattcaggataatgaatctaaatcaacttatggtgttattcgtggtcttcatttccaaaagccaccttttgctcagagtaaattagtaagggtaattagaggatctgttcttgatgtagctgttgatatccgtaaagattctcctacattcgggaaacatatttcagtagaacttactggagacaatcatcgtcagttctttattccacgtggctttgcacatggtttttgtgtgttaagtgaagaggtggtttttcaatataagtgcgataacttttatcatccagagtccgaagggacaattgcttggaatgatatagatttgaatatatcttggagaattccattggaagatgttgtgttgagtagaaaagataaaaatgctttaccgttaaaagaaatgtattctgatgtaaattattttagattttga

SEQ ID NO: 4214 - DNA, 1125 bp, B.fragilis
aaataccgaatattgcatcgtcaaaaagattataaactcaaaacaatagacatgaaaaaagctcttatttcaggtattaccggacaggatggttcattcctcgccgagtttcttcttcagaaaggttacgaagtacacggcatcctgcgccgttcatcttctttcaatacaggccggatcgaacacttgtactttgatgaatgggtgcgcgatatgaaacagaaacgtacagtcaacctgcactacggagatatgaccgactcaagttcactgatccgcatcatccagcaagtacaacccgacgagatatacaacctggcggcacaaagccacgtaaaagtatcgttcgacgtaccggaatataccgccgaggcggatgcactcggtacattgcgtatgcttgaagctgtccgcatcctgggactggaaaaacagacacgcatctaccaggcttccacttccgaactctacggaaaagtacaggaagtgccgcaaagcgaaacgactccgttctatccgcgttctccgtatggagtagccaagcaatacggtttctggatcactaagaactatcgtgaaagttacggaatgtttgccgtaaacggtatcttattcaatcacgagagtgaacgccgtggcgagactttcgtaacccgtaagatcacgctggcagcagcacgcatcgcacaaggcgaacaggataaattatatttgggtaacctggatgccaagcgtgactggggctatgccaaagattatgtagaatgtatgtggctgatcctgcaacatgacgtacccgaagatttcgtaatcgctaccggcgaaatgcataccgtccgcgaattctgtacactggcatttgccgaaataggcatcaacctgcgttgggaaggcgaaggcgtcaatgagaaaggaatcgacacggccaccggcaaagtactggtagaggtcgacccgaaatacttccgccctgccgaagtggaacaattgctcggtaacccgaccaaagccagaaccgtattgggatggaatccatgcaaaacaccattcccggaactggtaaaaatcatggtacgccacgatatggccaaagtgaaaagaatgattgcgactaaacatgattga

SEQ ID NO: 4215 - DNA, 1095 bp, B.fragilis
ataataatgatacctttagtgaaaccttatcttcctcctgctgatattttaatgccagaattacacaagatattgtatagtggctatattgcagagggagaagcagtttatcagtttgaagataagtttcgtgcttatattgggaatcctctgtcattagctttacattcgggtactgatggacttcatctatctcttttgttagcgggagtcaaaccgggtgatgaagtaattagtactccaatgacagcagaaccgactaatacttctatagctatggtaggaggcaaagttgtatggggagatgtcaaccctaataatggacttttggatcctcgcagtgttgaaagtgtgataacagaaaaaactaaggctattgttttagtgcattatgcaggtatggtctgtgatatggatgcttttaataaaatctcgcaaaagtataatattcctattatagaagatgctgctcatgccttaggaagtaaatatgcgggtaaaatggtaggttgcagttctccttatactattttttctttgcaagcaattaaacatatgacaactattgacggaggctttctttgtttgaaagatgaaatagaatttgataaagccagaagattacgttggtttgggcttgataaaaaacgttctcgtctggagaatgatattacagaggtaggttataaatatgcaatgaataatgtcaatgctacaataggaaatgttcaaatgaaatatgttgataagattattgcgagttacattgagaatggaagatattatgatctagcattgtcggacattgatgggattcatttggtagattattctgctaaaacggaagcttcttattggctttatactatgcgggttgatgaacgtgataattttataaaagcgatggaatcagcaggaattttagcttcgccacttcaccatcgtagtgatacacatagtatttttaaagagtctaagagggagttacctaatatggatagatggtatagggaattcgttcatattccttgcggttggtggattacagaagaggtaagaacacaaatagttgaagctatcaagaaagggtggtga

SEQ ID NO: 4216 - DNA, 252 bp, B.fragilis
ctattccttgtggatggtgggttgatagatgcctgctgtaaaaaaaagtataaatgtgttacttggtgtggcgtgaaaaatgtttgtattttacttttggaactgcttgttacttcctgttttgatgatgatttggagagaaaagttgacagtttggaatatgaaattgaaaaagttatttcgactaatgatatactgtctttaaagtatgaactttatttagcttgctatgaaggtaaattgctaaaatag

SEQ ID NO: 4217 - DNA, 1077 bp, B.fragilis
tttattatggtgccattatataaaccttatatgccggagcagttgccagatttagacgcaattatacattcgggggcattatcttatggaaagtggggacttcttttagaagaaaaattatcgactttcttagggattgaaaatttactgacaacaaactcatatgcttctgcgatacaagttgcattaacggttttagagttgaagccaggggatgaagttatttcttctccaatgagttgtttggcttctaatatgccattaaaaacttatggtctggatattgtttgggctgacattgaccctactacaggaacgctatccccggatagtgttagagaaaaagtaacaccaaaaacaaagttgatatttcataatcacttttgtggatatgtgggctatgttgatgagatcaatgcagtcgctaaggaatttggaatcccagttattgatgattgtgtagaagcttttgggtcgaaatataaaggtaaatatacaggaaatttaggtactgatctatctgtattttcttttcaaacagtacgtttacccaatactgttgatggtggagctatagtatttaataacaaatctttattagataaggctattttaacaagggattttggcataaatcgtaaaacatttcgagatgaatatgctgaaatatctccgagttgtgatatttctctttctggttatggggcaacaatgagtgagctaaatagttatattggctgtatgcagatggggacaattcaacagttgttggagactcagcgacttaactccgaacgttgggatacttttttaacagagaattatcctaaagtttataaattgaatacaagaagagaaatacaacctaattattgggtgtatggttgtttggctgaaaataaattagatatgatgcttcagtttagaagtttgggatattatgcttctggggtgcatctaaataataattgttattcaatattcggagataaaaaatatcttccaggtgtggatagctttaatcgaaattttttagctattccttgtggatggtgggttgatagatgcctgctgtaa

SEQ ID NO: 4218 - DNA, 1083 bp, B.fragilis
tgcgatggggtgtttcatcacgggaccattctatatataagtaagaagttcacagattcgggcgtactttccggatatcgtgatctggacgacttgctttttatctatcgtgagaaaatccatccggtaggtaaagtctatatttttattgaagaaatacaaaaagtggagggctgggaacattttgtccattcccattcacaggactttgtagatacttgcgagctgtttatcagtggttccaaccaggatatgctttcgggtgaagccgagaagcttttggccagacattacgtcagttttgagatatttccctttagcttttccgagcacaggatattggagagggtagaggctaccggcaaaaattacgcggaatatatgggtaagggggcactacccattcttttcaatcttccggatgcggaggccggatggaaagccatttccgctctccgcgatacgattctgtttcgtgatatcatccgccgatatcggattaaggatgcccgcctgctcgaagatgtgttcgtctatttgtgcacccatctcgctgagttgattactatcggtcagctggtcagtcactttgctgcccagaaccggaagacgagttatgatacggttgccaattatatctgctatctggaagacacctctctgattcatcgcgtggaacgttatcagatccgcagtaaagagattcttctgggtagctgcaaatactatattaacgattgggcattcatgcgccatctgtatcctttttttgccggttcccgaaaatcctgctttgagaaccaggtttatctggaactgcggcgtgccggatataccgtttttgtaggtgtgcttcgaggaggcaaactggtcgatttcgttggcaggaagaaagaccgcattgtgtatttgcaatgtgcacctctgctcaatgatgattttcaagtggagcaaatgtacaacacgctggagatgatacaagacaattatgaaaagtgggtcgtttctatggacgataccacattgccctccaaagaagggattcgtcacatacaagtctggcaactgcctgaaatactatag

SEQ ID NO: 4219 - DNA, 252 bp, B.fragilis
acgcctgtattccaatgtgttgttgcttttacttgtgcgtctctttggttttccgtatctttatgtcaaataaaggccatggatcaagaggaattacatactcagatattaatgcgagattatcttgagcgtcaggagttgaaagcttctgctatcgccaccaatcattgtgttgatatggaatccgatgaactgagacgttatgtatatgcttccttctggggcagctggaagagaaacaggagcagatga

SEQ ID NO: 4220 - DNA, 1416 bp, B.fragilis
ctaatcaaatcttattcaaacatgtttaaacatctaaatgccctgtttatcggacttgctctgtttgcatgcacctctggtgccgtagcacaaaccatcaagcctatcgagactccagtgcctgtacgtcccgccggacaaaaagatgtagtcggactgactactcctaaactcgacgtggtacgtgtcggattcattggtttgggtatgcgtggtccgggtgcagtagaacgcttcactcacatccccggaacacagatcgtagccctttgtgaccttatccctgaacgcgtagccggcgcacagaaaatcctgacaaaagcaaacttaccggaagcagcttcttactccggaagtgaagacgcctggaaaaaactttgcgaacgtaaagatatcgacctcgtttatatcgcaacagactggaaacatcacgcacagatggctatctacgctatggaacatggcaaacacgttgccattgaagttccttcggcaatgacgctggatgaaatctgggctttgatcaacacttcagagaaaactcgcaaacactgtatgcagcttgaaaactgtgtatacgacttctttgaactgactaccctgaacatggctcaacagggtgtattcggtgaagtactgcacacagaaggtgcttacatccacaaccttgaagacttctggccgtactactggaaacactggcgtatggattacaaccagaaccaccgtggcgatgtatacgctactcacggcatgggcccggcttgccagctgctcgacattcaccgtggtgacaaaatgaactacctcgtatctatggataccaaagctgtaaacggtccggcatacatcaaaaagacaaccggtaaagaagtgaaagacttccagaacggtgaccagacttctacattgatccgtacagaaaaaggtaagactatcctgattcagcacaacgtgatgactccgcgtccttacagccgtatgtatcaggtagtaggtgctgacggctatgcaagcaaatatcctatcgaagaatattgcatgcgtccgactcagatcgcttcaaacgatgtacctaaccacgaaaagctaaatgcacacggttctgtaccggctgacgttaaaaaaacgttgatggacaaatacaaacatccgatccacaaagaactggaagaaactgccaagaaagtaggcggacacggcggtatggactacatcatggactatcgtctggtttactgtctgcgcaacggtcttcctttggatatggacgtttatgaccttgcagaatggtgctgtatggccgacctgaccaagctttctatcgaaaacagctctgccccggtagctatccccgactttactcgtggagcatggaacaaggtgaaaggttacagacacgctttcgcaaaataa

SEQ ID NO: 4221 - DNA, 960 bp, B.fragilis
gatagttatcccgactctcggcaaattattatcaaaagacaacagtgcttacagctatctaccccaaacgatcaaagcttttccccaaggagaagttatgaaaaatgttatttcacgggtgggtttcagccaagttcagttcaggcggctgacatttggtatctgtacactttatacggctacgaaataaatattaatttaacatcttccccctttatgcaaaagtacggtttaattggctatccactgaaacattcgttttctatcggctttttcaatgaaaaattcaaatctgaaggcatagatgccgaatatgtaaacttcgaaattcctgaaatcaatgattttatggaggtgatcgaagagaaccccaatctgtgcggactaaatgtgacaatcccttataaagagcaggtaatccccttccttgatgaattggataaagacactgcaaaaatcggcgcggtcaatgttattaaaataattcgtacccctaaaagaaaaataaagctggtgggatataattctgatattataggattcagccagtccattcagcccttgttgcaaccttatcataaaaaagccttaatcctgggtaccggcggttcgtcaaaagcgatttatcatggcctgaagaatctgggtatcgacagtgttttcgtatcacgcaccaagaaagaaggtatgctgacttacgaagaattgacaccggaagttatggcagagcatacggtgattgtaaactgtaccccggtaggtatgtatccgaaagtagacttctgtcctgccataccttatgagttgctaaccccaaaccatttactctacgatttgttatataatcctaacatcactcttttcatgaagaaaggagaagagcatggggcagtaaccaaaaatgggcttgaaatgctactattacaagcgtttgccgcatgggaaatatggaataagtaa

SEQ ID NO: 4222 - DNA, 792 bp, B.fragilis
aatccgtgtccgattataagactacacaacccatccatgaagatgaaaatatcaaagccctctaaacagggagtaatcagagaaacgaaagactacttaatgattgccttgggaatgatcctttacggcatcggatggactctcttcctgcttcctaacgacatcaccaccggtggagtaccgggcattgcctctattgtttatttcgctaccggattcccggttcaatacacttactttgccatcaatgctgtcttgctgatggtatccctcaaagtgctgggatttcgattcagtcttaaaaccatattcggtgtattcactttaaccttcttcctgtccgttatccaaaagttaaccgcgaacgtaaccttgctacacgatcagccgttcatggcttgcgtgttgggtgcttctttctgtggcagcggtatcggtattgctttctcagccaacggaagtacgggaggaaccgatattatcgcggctgtcatcaacaaataccgcgacatcactttgggaagagtcatgctgatatgtgacctgatcattatctcttccagctatttcgtactgaaagactgggaaaaggtagtatatggatatgtgaccctttatgtttgcagcttcgtactggaccaggtagtgaacagtgcgcgccaatcggtacaattctttatcatctccaacaagtatgaagaaataggccaacgcatcaacgaatatccgcaccggggagtaaccattatcaatggcaccgggattctataccgggcaagagccaaaagatga

SEQ ID NO: 4223 - DNA, 825 bp, B.fragilis
cgacaattaccggggacgcggaggaggaggtcctttcatcggaggattcggaggaggaagttttggatccggcggtggaggcggtttcagcggtggaagcttcggaggcggttccggtggcggtggaggtgccggctcacgtttctaaaaaaatcaatccataaaatatgcgaatccggaattaaagtttttgctccctctgatttgcatgagtcattaatcagtaatacaaaaagaaacaatatgaaaaagtcagttattatccttattgccgtagtggcagttatcattatttgggctatcagtgcctataacggactggtatccatggacgagaatgtaagtagccagtgggctaacgtagagacacaatatcagcgccgtgcagatctgatccccaatctggtcaacacggttaaaggatatgcttcgcacgaaaaagagactctcgaaggagttgtagaggctcgtagtaaagctacccagatcaaagtagatgccaacgatctcactccggagaagttagccgaatatcagaaagcacagggagccgtcacatccgcattgggcaagctgcttgccattaccgaaaattatccggacctgaaagctaatcaaaacttccttgagttgcaagcacaactggaaggtacagaaaaccggatcaacgttgcccgcaaaaactttaacgatgctgcacaagcatacaatacatctatccgccgtttccccaaaagcatctttgcttctgtattcggcttcgagaaacgtacctatttcgaagccaccgaaggaacggaaaaagcaccggaagtaaaattctga

SEQ ID NO: 4224 - DNA, 2589 bp, B.fragilis
cggaaaatacccgtacttagatttcgaaaaagaaacaaacatgtgccgattggcgcttcaataaatgtgcaaatatgccaatgctttaatattatgtcatatacaattgaatcaatcgttgaaaaaataggtgcacggcgtctgggaaacaagcctgctgccatcgactggctactgactgacagccgttcgttatgttttccggaagagaccctcttttttgccattcccaccaaaaggaacaacggcgcacgctacatccctgacctttatgaacggggagtgcgcaattttgtagtcacaagcgaagatttcaaagggctcaccatggacagtgagcaactaaaagtgacaatggctcaggaatgcaatttccttattgcccccaatactttaaaagcacttcagaaattggccgaacaacaccgtggttccttccagattccggtagtcggcattacgggcagcaatggaaagaccattgtaaaagaatggcttcaccaattgctcagccccgaccgggttatcgtgcgttcaccgcgcagctacaattcgcaaatcggtgtcccgctgtcagtctggcaaatgaacgaggaatccgaactgggcattttcgaagccggcatttcggaaatgggcgaaatgcgtccgttacagaatatgattaagccgacaataggtatcctgaccaacattggcggagcacatcaggaaaacttcttttcactgcaagagaagtgcatggaaaaactaagcctgtttaaagattgcgacgtagtcatttacaatggcgacaacgaaatgataagcaactgcgtaggaaagtcaatgctgactgcccgtgaaatcgcatggagcatgagggatatcgaacgtccgctctatatcagcagggttgagaagaaagaagatcataccgtcatctcctaccgctatctggagatggacaatacattctgtattccctttatcgatgatgcttccatagagaactcactgaactgcctcgctgcctgcctgtacctgatggtaccggccgaccagatcaccgaacgaatggccaggctcgaacctgtagcgatgcgccttgaagtaaaagacggaaagaacaactgtatcttgatcaatgacagttataattcggaccttgcttcgctggatatcgctctcgactttctttaccggcgttcgcagtcaaaaggcctaaagcgcactttgatcctttcggatatcctggaaaccggacaaagcacgacaacactctaccgcaaagtggcacaactggttcacagccgcggcattgaaaagattatcggtgtaggtgccgaaatatcctcatgcgcatcaaagtttgatatagaaaaatatttcttccccgataccaaggcacttctggcatcagatgtaattaagaaactcagaaatgaaatcatcctgataaaaggctcccgcaacttcggtttcgacctcgtttcggaagaactggaactgaaagtacacgaaaccatcctggaagtaaacctgggagctatggtagccaacctgaatcactaccgctcgatgctcaaaccggaaactaaaatggtgtgcatggtgaaagcgtctgcttatggagcaggttcgtacgaaatagccaaaacccttcaggagcatcacgctgactatctggcagtggccgtagccgatgaaggttccgaccttcgcaaagcagggatcacagcctccattatcatcatggatcccgaactgaccgctttcaaaaccatgttcgactataaactggaaccggaagtatacaatttccatttactcgacgcattgataaaagccgccgaaaaagaaggtatcaccaacttccccattcacgtaaaactggatacgggtatgcaccgattgggattcgaagagaaagacatcccgcaactgattcgccggttaaagaaccagaatgcactgattccccgctctgtcttttcccatttcgtaggcagtgattctgcccagttcgacgcttttacccggcagcaaatagaacgatatgaaaagatgtcaaaggaactgcaagatgcattcccgcacaaaatactgcgccatatctgcaacacagccggtatcgaacgcttccccggtgcacagttcgacatggttcgtcttggcatcggattgtatggaatcagtccgatcgataactcaatcatcaacaacgtgagtaccttgaaaacaacgattctccaaatacgggacgtggcggaagaagatactgtaggttatagccgcaaagggcatctgatacgtccctcacgtatcgctgctatacccatcggatatgccgacggcctgaaccgccatttgggatgcggacatggctattgccttgttaatggcaaaaaagccccatacgtaggaaatatctgcatggatgtgtgcatgatcgacgtaacggatattgattgtagagaaggtgatcaagctatcatcttcggtgacgaattaccgattaccgccttatcggatgcgctcgaaaccatcccttatgaagtattgacaggtatttcaacccgggtcaagagagtatattatcaagattaa

SEQ ID NO: 4225 - DNA, 291 bp, B.fragilis
aaaaacgagacagcattacttataatttgtaagttccgatataaaaatccccctgctttggccttagtcgatcacgatataaggcaagagtcaggggatttttacattcccacattcttcatatttctcttaaaacccatttcaggcccagtcattttcgtgacatacaattttgatagaaaagtggcattcactcagtatattaattacaaaacaaaatatctttttgtctatattcctaaagcaacggtagaaaatctatttcaagcggcaactaaagtccatctttaa

SEQ ID NO: 4226 - DNA, 510 bp, B.fragilis
atacctattgccatgagtagtaatattttcctcaccattgctattgtcacaacaggcatcttcgcagtacaatttatcttatctatattttttggtgatatcgatgcagatgctgacatcgacacagatatcagcagtgtggtttcttttaagggattaactcactttgggataggattcggttggtatatgtatctgcagcataacaccgagatacagacctacctgacgggtgtcgccatcggactcatatttgtatttgccgtttggttcttatataagaaggcttaccaactacagcagaccacgcattcggaaagaacagaacaattggtaggaagagaatgcactatttatttcaaacagaacgaaaagaagtacactgtgcagatcagtcgtgacggagccatgagagaaatcgatgttgtcacggaatcgggtaaatcataccagacgggagataaagcaacaattacttcttataaagatggaactttatatattcaataa

SEQ ID NO: 4227 - DNA, 1578 bp, B.fragilis
ttaaatgatgcggatatgatgggactctttttcgtttatatagtaaagtcttctgtttgcctggcaggtttttatctattttaccgcttgttattgagcaaggagacatttcaccgatttaacaggatcgctctgttgactctgttgttgctgtctctgttgttgcctcttgttcaattgactactatcgaacagacagaagtacatcagacgatgcttactatcgaacaattattgatgatggcagatatgccggtatcggaggtgacacctgccgaagcggtgactttatccggcatacagattcttttgatggtttatttatcaggagttctctttttcgcctgccggcatatttattctttggggcgtctgttgatgctgctcaggtcaggggagaaagagaagatggaaaacggaatgaccttagtgattcatcaacaaaagatttcacctttcagctggatgaagtatattgttatctctaaagtggatttggaggaggatggcagagagatactcattcatgaggcagcacatgttcgtaatcgtcactctgtcgatttgctgattgccgatatctgtattttctttcaatggttcaatccggcttcctggctattaaagcaggaacttcagaatattcatgagtatgaagcggatgagtctgttatcagagagggagttaatgccaggcaatatcagttgctactgataaaaaaagctgttggcacaaggctctactctatggccaacagctttaatcacagtaaacttaaaaaacgtatcactatgatgttaaaagaaaagtcaaatccatgggcacgattgaagtacttgtatgtacttcctttggccgccattgctgtgactgcatttgcccgtcctgagatttcgggtaagatggatgaaatctcggccgtgaaagtgaatgatttcgtgcaaatagtagggactaaagtgcctgaaaaaaaggttgaggtgttgaaagatactgtgaaaaaagatgctccgaaagaagaggcttttgaagtatcccggttggaaacggtacctacgcactcgaaagtaaccataacggatgggatgaaaagaagcgggatggatttgttttcggttagaaatgccggttctcaacctcagcccttgatccttgtggatggaaaagagataaccggcgagcagatgcaacgggatatcaatccggatatgattgagtctatcagtgttctgaaagacgaagcgtcgacagccatatatggagataaggccaaacatggcgtaattctgattacactgaaaggaaaggatgtgcaaaatgtgctgtctctttctgcttcggattcggaagacggggtgaaggttgtaggggtggtcaaagatcatctggataagccattggcgggggcatctgtatttatttcgggaactgtctcgggaacaatgtctgatgcttatggacgttttgttcttttggctcccaagaacgctatgctccgtatttcatatacgggcatgacaacagttgaaaaggctgtggctccggaggtaaacgtgacattgaatccggcagactaa

SEQ ID NO: 4228 - DNA, 819 bp, B.fragilis
atttcaaccgcctttctcttaataatggcagaaattaaagaactgactttttgggatcacctggatgaactgcgccgggtgctgtttcgaattataggtgtatggtttgttttggctgtaggctatttcattgctatgccctatctgttcgaccgtgtcattctggctccctgccacaacgatttcatcttttaccatcttctgcgggacatcggacaggcattcgaccttaccgatgacttctttacccgtgagtttaaagtcaagctggtaaatatcaatctggcagcacctttttttatccacatgtccaccgctttctggatgtctgtagtcactgccacaccttatttgtttttcgagatatggcgtttcatccgtcctgccctttaccctaatgaacggaaaggagtccgcaaagccctgaccatcggcacggtcatgttttttatcggagtccttttaggttattttatggtctatccgctcacccttcgttttctctctacctatcaactcagcgcagaaatagagaatcagatctccctgaactcttacatcgacaattttatgatgctggtgctctgcatggggctggctttcgaactacctttggtaacctggttgctttccttgcttggattggtaaacaaatcattcttacgaaaataccggagacatgccattgtcctgattgtcatcgctgctgctgtcattactccaacaggagaccctttcacactcagcatcgtagctattcccctctatctgctttatgaaatgagcatattgatgattaaagacaaaaaccgctcgtag

SEQ ID NO: 4229 - DNA, 3132 bp, B.fragilis
agcaagtactaccaactcctgaacggcacctggaagttctattttgtagattcatacaagaacctgccggccaacatcaccgaccctgcaatcagtacagccgattgggcagacatcaaagtaccgggcaactgggaggtacaaggccacggagtagctatttataccaaccacggatatgaattccagccccgtaaccctcaacctcctactctgccggaagccaatccggtaggtgtttaccgcagggacatcgatattcccgccgactgggacggacgcgatatttacctccacctggccggtgccaaatcgggtgtatacgtatatatcaacggacaggaagtaggttacagcgaggactctaaaaacagtgcggagttcctgatcaataaattcgtgaagcccggcaaaaatgtccttactttaaagatttaccgctggagtaccggatcctatctggaatgccaggacttctggcgtatcagcggtatcgaacgcgatgtattcctttactcacaacccaaagccgcgctcaaagatttccgtgtaacatcgactctggacgatacatacaaagacggtatcttcaaactgggcgtagacctgagaaacaacggttcgacagccggcaatatgacgttggtatacgaactgctcgatgccaatggcaaggtagtggcaaccggagagaaagcaactaatgtagcggccggagagacccgtacgatgtctttcgaccagacacttccggatgtaaagacctggacttcggaagcccccaacctctacaagttggtgatgacagtaaaagaaaatggtaaagtgaacgaaatcattccgttcaacgtaggtttccgccgcatcgaaattaaaccgaccgagcaactggcacgcaacggaaagccctatgtatgcctcttcatcaacggacagccgctgaagctgaagggagtgaacattcacgaacataaccctgctaccggtcactatatgactgaagagttgatgcgcaaagatttcgaattgatgaaacaacacaacctgaatacggttcgcctgtgccattatccgcaagatcgccgtttctacgaattgtgcgacgaatacggactttatgtatacgatgaagcaaacatcgagagccatggcatgtactatgatcttgctaaaggcggtacgctgggaaacaatccggaatggttgaaagcgcacatggaccgcacaatcaacatgttcgaacgtaataaaaactatccgagtctgactttctggtcgctgggtaacgaagccggcaacggttataacttctaccagacttacctttgggtcaagaatgccgataaagacatcatgaaccgtccggtcaactacgaacgtgcccaatgggaatggaactccgatatgtatgttccgcaatatccgggtgccgactggctggaggcaatgggcaaacgcggcagtgaccgcccgattgttccttctgaatattcgcatgccatgggtaactcaaacggtaacctttgggatcaatggaaagcaatctataaatatccgaacctgcagggtggatacatttgggactgggtagaccagggcattgacgcagtagacgaaaacggacgtcacttctggacatacggtggtgactatggggtaaacactccgaacgacggtaactttaactgtaacggtattgtaagtccggaccgtactccgcatccggctatggccgaagtgaaatatgttcaccagaacgtggctttcgaagcggtggatccggctaatggaaaattcctggtcaagaatcgtttctacttcacgaacctacagaagtatatgatctcatataccattaaggccaatggcaaaacagtgaaaggcggcaaaatgtctgtcaatgtggaaccgcagggaagcaaagaaatcacgatcgcgacaagcggactgaaatcaaaacccggaactgagtattttatatacttcaacgtaacgactaccgaaccggaaccgttaatccccgttggacatgaaatagcatacgaacagttccgtctgcctatcgaaccgggcgaacgtactttcgctaccggtggtccggctctgaaagtatcggcagaaggcaatgaactgacagcgtcttcttcaaaagtaaacttcgtattcgataagaagaccggtctggtttcttcctataaggtaggtggaaccgaatactttaaagatggcttcggacttcagccgaacttctggcgtgcaccgaacgacaacgactatggcaatggtaaccccaaacgcctgcaagtatggaaacagtcgagcaaaaacttcaatgttgtggacgccaacatcgttatggacggcaaagatgccgtattgacagctaactatctgctggctgccggcaacctttacattgttacataccgcatctctccttcgggcgtagtaaaagccgatttcactttcacttctaccgatatggaagctgccaaaaccgaagcctcggaagcaaccctgatggctactttcactcccggcagcgatgcagcgcgcaaggctgcctccaaactggaagtaccccgtatcggtgtacgtttccgtctgcctgcagaaatgaaccaagtggaatatttcggacgcggaccggaagagaattatatagaccgcaatgcgggtacattgatcgacctgtataaaacgactgccgaccaaatgtacttcccatacgtacgtccgcaggaaaacggacaccataccgatacccgttggttgaccctgaataaaaaaggcggtaaaggactgactatttatgcagacaagactatcggtttcaatgcactgcgcaattcggtagaggactttgacggagaagaaaccgtatcccgcccctatcaatggctgaaccgtgatgccggcgaattggttcacgacgaaagcaaagccaaagatcaactgccgagaaagacgcatatcaatgatatcacaccaaggaacttcgtagaagtatgtgtggacatgaagcaacagggcgtagccggttacaacagttggggtgcacgtccggaaccgggttacaatattccggcaaaccaggaatacaaatggggattcacaatcgtaccaagataa

SEQ ID NO: 4230 - DNA, 303 bp, B.fragilis
gataaattgtactgcgaagatgcctgttgtgacaatagcaatggtgaggaaaatattactactcatggcaataggtatttaatgatttattttatagatatagttcccaaatatacacctttgatttttatatgcaaaggtaaactaataaaaaaatggaagaatcggaaaatgaatgtatatttgtaccctaaattattaaacagaaatagaaaaaactatgaagacaatcctactctttgctctgagtctgttgctctctttatccgtgtcggatgtttgtgcacaagagcgtatttatga

SEQ ID NO: 4231 - DNA, 1194 bp, B.fragilis
atatcaagccacaattcatttattccattatcatacaagaaaaaagcatacttcttgattcatactaactatactttccatatatttgcagtattcaacacacatcacatctttaatgatgaaaataaaaaaacgataagacaatacgaaattatgattaatactttaacatcgttgagattcatatttgcaataatggtttttggagcacattgctatgttatagacaatgttttcaatacccattttttcaaagagggatttgtaggcgtcagcttcttttttgtgctaagcggctttagtatagcatataattatcaagagaaactgaaagacgacaaaatagacaaacgcactttctgggtagcacgcattgcgcgtatttatcctttacattggctgacattgtttattgctgctattttagggagttacgttatagcctcgggaactttagattggcttaagcatttcttagcttcgctcactttgacaaatgcttatattcccagagccgactactttttctctttcaacagcccttcatggagtttatgctgtgaacagcttttttacatctgcttcccattccttatacctttagcaaaaaattacaagtatttgctttctgtttttggaattgtagcgatactaatagtcgtcggcatgtactttactccggaagatgaaataaaaggcttctggtacgtcaatccaattacccgatttccggatttcattgtcggcatgttactgttccaattgtatgaacgcttgaaaaacaagaatatcactgccttgcaaggaagtatcattgaaatctcatctattatcttatttttaattttctacctctatgccgccgatatacctaaagtataccgatattcatgttattattggctccctgttgcggtgattctgattagtttttcacttcagaaaggtatcttttcccgcattttatccaaccgttttctagtgatagggggagaaatcagttacagtttttatttgatccatctatttgtcttattgacatattcagaatggcaaaaagaaaataatcttcatacggaatggtacatttccgtcccgattttattcagtatcatcattctattaagcctgctttcttactactattttgagaagcctatgaataaacgagtaaaaacattactaaacagatag

SEQ ID NO: 4232 - DNA, 258 bp, B.fragilis
cacagagttaaagcttgttctttggatgtgaataaaaagttctttaaatgcaaaagacttgttatttgcgcacaagaacctgacaaccggcaaaagacgttaacaatgttaattgaaaaaaggtataaggatgaagataccggttcagacggcgtaaactcacttccgaaacttaagttatcttattcagccggtgtctgttttttcttattaaagcaagcaaaaaggacaattatcaacttggaaataaagaaataa

SEQ ID NO: 4233 - DNA, 789 bp, B.fragilis
aaaacaaataatttattaagcatgataagtcccttagcgtatattcatcccgaagcaaaaatcggtgaaaacgtagagatagctccttttgtgtacattgatagaaatgtagtcatcggagataacaataaaattatggctaatgccaacatcctgtacggttcacgtatcggtaacggaaatacaatctttccgggagccgttatcggagcaatcccacaagatttgaaattcaaaggtgaagaaagtacagccgaaataggtgacaataacctgattcgtgaaaacgtgaccatcaaccgaggtacagcagctaaaggcagaaccattgtaggtaacaacaacctattgatggaaggcgtccatgtggcccacgatgcattgatcggcaacggttgtatcgttggtaactccaccaaaatggccggagaaatcatcatcgatgacaatgccatcatcagtgccaatgtgttaatgcaccaattttgccgggtaggcggatacgtcatgattcagggaggatgccgtttcagtaaagacattcctccgtatatcatagccggacgcgaacctatcgcttacagtggaatcaacatcatcggactccgtcgtcgtggtttttcgaacgagattatagagaatatccacaatgcctaccgcatcatttatcaaagcggactcaacacttcggatgctctcacaaaggttgaagcagaagtgccggccagccccgaaatagaatacatcgttgattttattcgcaactcggaacggggaattatcaggtaa

SEQ ID NO: 4234 - DNA, 1170 bp, B.fragilis
ctcatgagtaatcaacgatacatgatgcgaggcgtcagcgcatcaaaagaagatgtgcacaatgccatcaagaacatcgacaaaggaatttttccacaagcattctgtaaaataatccctgatattttgggtggggaccccgaatattgtaatatcatgcatgctgatggtgcaggaaccaaatcgagcctggcctatatgtattggaaagaaacaggagatctctccgtttggaagggtattgcacaagatgcactgatcatgaacatagacgacctgctttgtgtgggtgccgttgacaatattcttgtatcctctactatcggacgtaacaagttgcttatccccggagaagtaatttccgccatcattaacggaacagacgaattgctggccgaacttcgtgaaatgggagtaggcgtatatgccactggaggtgaaacagccgatgtaggtgatctcgtccgcactattatcgtagacagtacagtgacatgccgcatgaaacgtgcagatgttatcaacaatgccaatatccgtccgggagatgtcattgtgggacttgcctctcatggacaggccacttatgaaaaagaatataatggcggtatgggcagcaatggactgacttccgcccgtcatgatgtattcgccaagtatctggctgagaaatatcccgaaagctatgacgccgcagtaccagaggaactggtttattcgggcggactaaaactgacagatacagtagaaggatctccgatcgatgccggaaaactcgtactctctcctacccgcacctacgcaccggtagtgaaaaaattgcttgatgcactgcgtcccgagattcacggaatggtgcactgttcaggtggggcacaaacgaaagtattgcactttgtaggcgacgtacgtgtagtcaaagataaccttttccctgtacctccattgttcagaaccattcaggaacaaagcggtaccgattgggctgaaatgtataaggtattcaacatgggacaccgcctcgaagtatatctctctccggaacatgcagccgaagtgatcgccatcagtgagtccttcggtatcccggcacaaattgtgggacgtattgaagagagtgataaaaaagaactgattatcaaaagtgaattcggtgaattcagatattaa

SEQ ID NO: 4235 - DNA, 261 bp, B.fragilis
gtgccactcaaggacgtgctttcgaagatattcgtaaaattgtccccaatcacttcctcttggtcccgggtatcggcgctcaaggaggttcttctcgaagaagtatgcaaatatggtatgaacagcacctgtggacttattgtgaattcctctcgcggaattatttatgtagataaaacagagaattttgccgctgccgcccgtgctgctgccaaagaagtgcaagagcaaatggcagaacagctgaaagctattttataa

SEQ ID NO: 4236 - DNA, 693 bp, B.fragilis
atagaaatcaataagaagaggaggatgttttccaagcatcctccttttttgtggaataaacccagccatcttatttgcaatctttcggttttttattacttttacgccatcaataaaacagtaacaactatgatatacagatttaccattatatctgatgaggttgacgatttcgtcagagagatacagattgacccggaagctactttcttcgatcttcatgaagctatcctgaaagcagcaaactatacaaacgaccagatgacttctttctttatctgtgatgatgactgggaaaaagaaaaagaaattacactggaagagatggacaataatccggaaatggacagctggattatgaaagagacccgcctcaacgagttgattgaagatgaaaagcaaaaattgctttacgtattcgattacatgactgaacgttgtttcttcatcgaattgtccgaaatcatcaccggaaaagaaataaaaggtgctaaatgtactaagaaatcgggtgaagcccccaagcaaacagtcgatttcgaagagatggcagccggaggaggctcactcgatctggatgaaaacttctacggtgaccaggacttcgatatggaagactttgatgccgaaggatttgatgtaaatgacggtgcagccggaggtggaagttcatacgacgaagataaattttga

SEQ ID NO: 4237 - DNA, 1113 bp, B.fragilis
atggcagacaacaatagtatattagaaaagctcgacggccttgtagcccgtttcgaagaggtgtctaccctcattactgacccggcagtgattgccgaccagaaacgatacgtaaaactgaccaaagaatacaaggagctggacgacttgatgaaagcccgtaaagaatacatgcaactactggctaacatcgaagaagctaaagatattctctcaaacgaatcggatgctgatatgagagaaatggcaaaagaggaaatggacaacagccaggagcgtctccctgtattggaagaggaaatcaaattattactggtaccggccgaccctcaggatggtaagaatgccattcttgaaatacgtggcggtacaggtggtgatgaagctgcgatcttcgcaggcgaccttttccggatgtacgccaaattctgtgaaacgaaaggttggaaaatggaagtatccagtgccaatgaaggcgctgccggcggatataaggagatcatttgcagcgttacaggcgataatgtatacggtacactaaaatacgaatcgggagtacaccgtgttcaacgagtacctgcaacagagacccagggacgtgtacacacttcggcagcctcggtagccgtactacccgaagccgaagagttcgatgtagtgatcaacgaaggtgaaatcaaatgggatactttccgttccggaggtgcaggtggacagaacgtcaacaaggttgaatcgggtgtccgtttgcgctacatttggaagaatccgaatacaggagtagcagaagagatcttaattgaatgtaccgaaacccgcgaccaaccgaaaaacaaagagcgcgccctggcacgcctccgtacgtttatctatgacaaggaacatcagaagtatatcgacgatattgcttcaaagcgtaaaacaatggtttcgacaggtgaccgttcggctaaaatccgcacttataattatccgcagggacgcatcaccgaccaccgcatcaactataccatttataacctggctgcctttatggacggcgatattcaggaatgtatcgataaactgactgtggccgaaaatgcggagcgcttgaaagagagtgaattgtaa

SEQ ID NO: 4238 - DNA, 393 bp, B.fragilis
gccatgggcaaacctattatcagaattttatatttccaacgccggggaatcgacgccaatggttattacagattgaattacatcattcaacgaggcagaaagattctatactatgccacagaaaccaaggactttgaatattcagactgtttcacttcttcctgtttagccgaacggaaagaaacgattctcgatacagcccaatacatcttcaaagttcacaaggtgagatattcccgcctgatactaagtccaagctactcatatatcactaggtataaatcccgtatccggcagatctgcaccgccacccgattttgtaaatcagacatcatttggacgatgtgtccccggagtttcatacctatttcaaagattccattttcattttag

SEQ ID NO: 4239 - DNA, 1107 bp, B.fragilis
actaacttaaaaataaaaaccatgaaagatttacttagtatcgtatctaaattcaaagtacaaggcacagtaggcgaaatcaaaccacttggcgccggcctgattaacgacacttacaaagttaacactaccgaagcagacgctcccgattatgtgttgcaacgcatcaaccatgcaattttccagaatgtggaaatgcttcaggataacattgctgccgtgacgggacacatccgcaagaaactgacggaagccggagagacagacgttgatcgcaaagtcttgactttcctcccgacggaagaaggcaaaacatattggtttgacggtgacagctattggcgtgtaatggtattcatcccacgtgccaaaacttatgagactgtgaatcccgagtattcatattatgccggagcagctttcggtaacttccaggcaatgttggctgacattccggcaacattgggcgaaactattcctgacttccacaatatggagttccgcctgaaacaacttcgtgaggccgtagctgccaatgcagccggacgagtagccgaagtacagtattatctggatgaaatagaaaaacgtgcagatgaaatgtgtaaggccgaacgtctgtatcgcgaaggcaaactgcctaaacgcgtatgccactgtgatacgaaagtgaacaacatgatgttcgacgaagatggtaaagtgctctgcgtaatcgatctcgatacagtaatgccaagctttatcttctccgactatggagacttcctgcgcacaggagccaataccggagatgaagacgataagaatctggacaatgtcaatttcaatatggagatattcaaagcatttactaagggatatctggaaggagccggttcattccttactccgatcgaaatagagaacctgccttatgcagccgctctcttcccttacatgcaatgtgtacgcttcctggcagactatatcaacggcgatacttactataagatcaagtatcccgaacacaacctggtacgtaccaaagcacagttcaaactattgcaaagcgtagaagaacatacccccgaaatggaggcatacatcaaagagtgtctgggataa

SEQ ID NO: 4240 - DNA, 219 bp, B.fragilis
cctggttcaaacgggatgaagagatcagatggttccatcctgaacaagagaaagaaatattatcgtatcttcaggtctcaattaaataaacaggtttatatagaagataaattcttaacaaagaagcgaaaaaagccggataaaataaaaagagttacaaagggagcgttattacataatatttttagtatctttgtcgataataagaatatcccttaa

SEQ ID NO: 4241 - DNA, 1647 bp, B.fragilis
caaactcaaaaaaagagaactatgacccaggaaatgatgatcatggctgccatacttgtggcggtaatcttaattacatttatcggtattctttcacgctaccgcaaatgtaaaagtgacgaagtattagtagtatatggtaagacaggtggagataagaaatcggcaaagttatatcatggtggtgccgcctttgtatggcctattgtacagggatatgagttcttgtcaatgaaacccatgcagatagactgcaagctgacaggagcactttcggctcaaaacatccgtgtagatgtacctactactatcacagtagctatcagcacagatcccgaagtaatgcaaaatgcggctgagcgtatgttgggattgaccatggacgataaacaaaacctgattacagatgtggtttacggacagatgcgtctggttattgccgacatgacaattgaagagttgaactccgaccgtgataaatttctttccaaagtaaaagacaacatcgatacagaactccgcaaattcggtttatacctgatgaatatcaacatcagcgatattcgtgatgctgccaactatattgtcaacttaggaaaagaagccgaaagtaaagcgcagaacgaagctcaggccaatattgaagaacaggaaaaactgggtgctatcaagattgccaaccagataaaagaacgtgaaaccaaagtggccgaaacccgtaaagaccaagacattgccattgcggaaaccaagaagttgcaagaaatctctgtagccaacgctgataaagaccgtatctctcaggttgctattgccaatgcggaaaaggaatcacaggtagccaaagcggaagctgaaaaaaacatccggatagaacaggccaataccgaaaaagaaagccgcattgcggaactgaattccgacatggaaatcaaacaggcagaagcacaaaagaaagcagccatcggacgaaacgaagcacaaaaagagattgcgttgtctaactccgaattagctgtaacccaagctaatgccgataaacaagccggtgaggcatccgctaaatcggaagctgccgtgcaaaccgctaaggaaatagcacaaaaagaagtggaagaggcgaaagcacgtaaagtggaatcatctctgaaagcagaaaagatagttccggcagaggttgcccgccaagaagccatcttacaggcagaagccgtagctgagaaaatcacccgcgaagcggaagcacgtgccaaagcgacactggcacaagctgaagcagaagcaaaagccattcaattaaaacttgaagcggaggctgaaggtaagaaacgttcattgctggccgaggcagaaggttttgaagccatggttaaagcagccgaatcgaatccggcgattgctatccaatacaagatggtagatcagtggaaagaaatagcaggcgaacaggtaaaagccttcgaacacataaacttaggcaatatcactgtcttcgacggaggaaatgggggcacgagcaacttcctgaacacattggtgaaaactgttgcgccgagtttgggcgtgttagacaaattacctatcggagaaacagtgaaaaatatgattcatccggaagaaaagaaagaagaaacagagaaaaaatga

SEQ ID NO: 4242 - DNA, 3543 bp, B.fragilis
acgagtaaaaacattactaaacagatagttcacaaaacaaattgcctacagaaactccgatatcgaagtaatgatactttcgtacacattttcatccgtccgcatgaaaatccgggaattatcatgtatttttgctgtatggaaaatgaggtaaacgaatcttttgaaatcctgcttgcagcctgtcggacagcagacagcaatctggcggtggcttacaaacagttgcgtgatttgctcgaacgattgtgccgggcacaaatgcaggatgaaagtcttcagatgactgacctttcagcacggatcagttttgtatcggcacgggcagggctgacaattgttgaacaaaaccgattacacacttttcgcctgacctcaaacgctattctcaatcgaaaagaggaacctgtacgcgaaaagttactgcgggatgccaagacacttgccttctttatacgtaaactttacgaagtcgagattcccggcgaactctaccacttactgccgcgtgccgacgcaacttacctcgtagcacctccggctaaaaagcgaatagagcgaatgcgtgtatgctatcaatatgccgacgagcagtatctatatgtaactccggtcgataccattgctgacgaatatctgaggatacgttataatgtgccgcagatcaacgaggagtttgctcaaacctgcgaaattttatggtgtcatgcacaactcaacctacttgatgtggccattgacaaaaccggtgtcctgactccttcgttcatcgtactcgaaccggattacttaatcgacatcagttcgttggcagaatgttttcgtgattacggacatcatcccgccaactatgtactggcccgcctccaacccatcgacaatgcccggccattattactgggaaacattgccaaccttttcctggacgaatggattcatgcagaaaacgcaccggactacagagagtgtatgcaaaaagcctttcgccgttacccgattgaactggctgcctgcaccgacctacgtgacagagagaaggaacgacagttctttgacgattgcaaactacacttcgaacatatccgcgaagtggtgacagacaccttccgtgcgccgggctatgaattggataagactgatgcagtgctcgagccctcgtacatttgcgaagcattgggactgcaaggacgattggactacatgcagcgtgacatgtcatcgtttattgagatgaaatcggggaaagcagacgaattctccatccgcaacaaagtagagcccaaagaaaacaataaagtacaaatgctgctctaccaggcagtgctgcaatactcgatgggaatggaccaccaccgggtaaaagcctatctgctctacacacgctaccctttactttatccggcacgtccgtcgtgggccatggtgcgccggatcatcaatctgcgcaaccggatcgtatctgatgaatatggaatccagttacgaaacagtgtggagtataccgcctccaaactccaagccatacgttccgacatactcaacgaacgaggattatccggccggttctgggaacaatatctccgcccgtccatcgataatctatcgcagaaactggcttcacttaccccgctggaacagtcgtacttctacgcactctataatttcataaccaaagagctgtatacttccaagtccggagacgtcgattacgaaggacgtaccggctcagccgccctgtggctatctaccctgacagagaaatgcgaagccggtgagattctttacgatctgcgcatcaaagagaatcatgctgccgatgaacataaagcatatatcctccttgagcaaaggaaagagggatacggagaaaataaactatccccggaacctaacgaaatatcctctgaggtagaaaaaggagcacaggccttgcctaatttccgtcagggggatgccattgtactttatgaacgcaaccggaacgaagataacgtcaccaataagatggtattcaaaggcaatatcgagttcatcacagaagaagagataggtatacgcctgcgtgccactcagcagaatagttccgtgcttccgccggacagcctctatgcaatagagcacgacacaatggatactaccttccggagcatgtaccaggcattatcggctttcgcttcggcaaccaaagaacggcgtgatcttttattggcacaacgaatgcccgaattcgagtacggacttgacaaacagattctaaccgccccggacgattttacacgggtcacactaaaagcactggctgccaaagactttttcctattggtaggaccgccgggaacgggcaagacctcatgcgccttgaaaaaaatggtggaaactttccattgcgaagcgcagacccaaatcctcctgctctcgtatacaaaccgggctgtggacgaaatttgcaaagccatctcatccattcggccggaggtcgactttattcgtgtcggcagtgagttgtcttgtgacgaagcttaccggcatcatctgattgaaaacgaactttctctttgtacccgccgctcggaagtagcagaacgcatcgcccgttgccgtatttttgtaggcacagttgcttccatctccggaaaacccgaactgttccgcctgaagagattcgatgtagccattatcgatgaagcgacccaaatcctggaacctcaactattaggtatcctatgtgcccggagcgaaaatggagagaatgccgtcggcaagttcatactgatcggtgatcataaacaattgcctgccgtcgtattgcaaaataccgaacaatcggaaatctacgatgaaggcttacgtagcgccggactgaaaaatctcaaggattctcttttcgaacgcctctaccgcaccctgcaaacctcttccgaggatctctttcccgactcagcatcggtatcggctccgaaccatcgctccttcgacatgctttgcaaacaaggacgtatgcatccggaagtagctcattttgccaatcaggcattttatgaaggacgcctgttaccggtgggattgcctcatcaaatggaagacaaccaagatgtgcaacgaatggtttttctaccttccgaacccgaacctcaaggtacatcggccaaagtcaaccattccgaagcacggatcgtcgcccgaatcgcagccgacgtttaccagcaatatggtggaacattcgacggaatgcgtactctgggtatcattactccctatcggagtcagatcgcattaataagaaaagagattgtcaaaatgggtattccggaactaaactccattttagtcgatacggtagaaaggtttcaaggcagcgaacgggatgtgataatctattctttctgtgtgaactatccttatcaactccgtttcctttccaacctgacagaggaaaacggagtattcatagatcgaaaactaaatgtcgcattgacaagagcacgcaagcaaagtcttcatcaccggggttccccgattattggaacaaaacccgatttatga

SEQ ID NO: 4243 - DNA, 1389 bp, B.fragilis
ccaatgctgaaacaaaaaactctgaaagagagcttttcactgagaggaaaaggtcttcacactggacttgacctgactgttacgtttaaccccgccccggataaccatggctacaaaatacagcgtacggatctggaagggcaacccattatcgatgccgtagccgacaatgtaggtgaaacgacaagagggaccgtgctgtcaaaaaatggagtaaaagtaagcacaggtgaacatggaatggcagctctatatgccttgggcatcgataactgtctgatccaagtcaacggaccggaatttccgattctggacggaagtgcacaatattatgtacaagaaatagagaaagtaggaatcgaagaacaaaatgccgttaaagatttctatatcatcaaatcaaaaatagaattccgtgacgaggagacaggatcgtctatcatcgtacttcctgatgagaacttcagcctgaacgtattggtatcttacgattcaaccatcatccccaaccagtttgccacactggaggatatgaaaaagttcaaagatgaaattgcccccagccgtacctttgtatttgtccgtgaaatcgagccactgttgtcggccggactcatcaagggtggcgatctggacaatgccatcgttatctacgaacgtgaaatgtcccaggaaaactatgacaagctggccgacgtcatgagagtccctcacatggatgccaagctgttgggatacattaaccacaaacctctggtatggcccaacgaatgtgcccgccataaattgttggatgtcatcggcgatcttgctctgatcggtaaacccattaaaggaagaatcattgctacgcgtcccggacacaccatcaataataaattcgcacgtcagatgcgcaaagaaattcgcctgcacgagatacaggcgcctacctatgattgcaaccgtgctccgattatggatgtgaaccgcatccgtgaactactcccccaccgttatccattccaattggtagataaggtgatcgaaattggtgccaactacattgtcggtgtaaaaaacgtaacctccaacgaacccttctttcagggacacttccctcaggaacctgtgatgccaggtgtactgcaaattgaagcaatggctcaaatcggcggattactcgttctgaattcagtagatgagccggagcgttattctacttatttcatgaaaatcgatggtgtgaagttccgtcagaaggtagttccgggcgataccctgatattccgtgttgagttattggctcctatccgccggggcatttcaaccatgaaaggctatgctttcgttggtgaaaaagtagtctgtgaatgcgaattcatggctcaaatagtaaaaaacaaataa

SEQ ID NO: 4244 - DNA, 1254 bp, B.fragilis
attcttatgaatatcagattaacttctttattcgtttctttattcctttctgttccggtatgggcgggcgggcataaaaatctgcccgctaaaggcgatcttcatattccggtttttgaaaatgtgaatgtgcgtttctctcccgatacgtatcctgataattataatgaagcagatggtacgggcgtataccatttggtcaacggacgtatcattctgaaaaagattactcttcccgaatacaaacgaaatgtgtcggtaagcctgaaagtaaccctcgcctccaatggagatcgttgggacaaatcgggttcttgctttgtattgcctaaatcatcggctattaacctactgactattgcccgtgacggcatgaagtttccttcggtagatagtttgaagctggagaaaatggtaggtattgttcccggaaaggattatttacccacagtggagctgatgcgtttcatgactccgttcggtgtaggacactatagcaataataatgattcgctgagcagtaaacgtcgtccggtctatatccccaaatgggaaagtaatgtcacctggcaacaagatataaccgatctttatccgttgcttgaaggcgaagcctatgtcggtatttatatcgatacatggacttctgaagggtatttggtcaatgcggatatcgacgtaaaagagagtcgtctggcttgtgacgtacttccaaaacgtcatgtggagccgttgatgaatacggtttactacatgggacaaagttatcccgatatctttgcccggagagatgtatctactgattttacagttcctaaaggtgccaaaaatatccggttaaaatatatagtgaccggacatggcggacatagcggcggggatgaattcgtgcaaaaacgcaatatcatttctgtagatggaaaagaggtgctcaacttcatcccttggcgtgatgattgtgcttctttccgtcgtttcaatccggctaccggtgtttggttgattaagcgcttggcttcttatattggtgagaaaggatatacggagaaagaagtggaagaacctctggcttcttcagacctatcccgttccaactggtgtcccggttcggatgttgtacccgaagaggctgttatcggtacacttgctcccggcaagcatacttttacagtcagtattcccgaagctcaggctgtggatggcaataaattgaaccactggttggtttcggcctatctggtgtgggaggaataa

SEQ ID NO: 4245 - DNA, 747 bp, B.fragilis
gtaaagatgaacaagcaatcattatttgaaaacatcaaacgcaaaaaatcatttctttgcgtaggacttgacacagatatcaagaagatacccgatcacctgttggatgatccggatcccatcttcgctttcaataaagcaattgtcgatgcaacggctgactattgcatcgcttataaacccaatctggccttctacgaaagtatgggtgtaaaaggatggatcgcttttgaaaagaccgtgaactacatcaaggagaattatcccgatcagtttatcatcgccgatgccaaacgtggtgacataggcaatacctcagcaatgtatgcccgtactttcttcgaggaactggacatcgactctgtcactgtagctccttatatgggagaagacagcgttactccattcctgtcttatgaaggcaagtgggtaatcttgctggcactgacttcaaataaaggttctcatgacttccagctgacagaagatgccaacggcgaacgtctgttcgaaaaagtgctaaaaaaatcacaggaatgggctaacgacgaacaaatgatgtatgtagtaggtgccactcaaggacgtgctttcgaagatattcgtaaaattgtccccaatcacttcctcttggtcccgggtatcggcgctcaaggaggttcttctcgaagaagtatgcaaatatggtatgaacagcacctgtggacttattgtgaattcctctcgcggaattatttatgtagataa

SEQ ID NO: 4246 - DNA, 756 bp, B.fragilis
ataaaatcgaataaaagaatgaactacccacaagaaaagatcaaaccttatagcaacgatgggaaaaagagcgaacaggtagaacaaatgttcgacaacattgcccctgcatacgaccagctgaatcatactctatcgttagggatcgaccggagctggcggcgtaaggcaatcaattggctcaaacctttccgtccgcaacaaataatggatgtagcaaccggcaccggtgattttgctatcttggcatgccatgaactgcaacccgaacaactgatcggaacagacatctctgaaggaatgatgaatgtgggacgtgaaaaggtaaaaaaggaaggtctttccgaaaaaatatcttttgcaagggaagactgtacctctctctcgtttgccgacaaccgcttcgacgctatcaccgttgcttttggtatccgtaattttgaagatttggataaaggactttctgaaatgtaccgcgtcctcaaaacaggcggacatttagtcattctcgaactgacaactccggatcgttttccgatgaagcaaatgtttaccatttattctaagatagttatcccgactctcggcaaattattatcaaaagacaacagtgcttacagctatctaccccaaacgatcaaagcttttccccaaggagaagttatgaaaaatgttatttcacgggtgggtttcagccaagttcagttcaggcggctgacatttggtatctgtacactttatacggctacgaaataa

SEQ ID NO: 4247 - DNA, 1188 bp, B.fragilis
tcgcatgcgaatatgattttagtgcagatattagtcaaagacctctttaatatgataaaaaaaatatttttctccagcttcctattgattataatgttctgcggatgtatgacccagaatgaaataacaggttcggtcgcaaagttagaaacagtagaaaaagtagtggatgacactcttttcctaaaaaatcctcaagtcttctgcttggaaaccaaagacaatgcattgataaagcgtataaatcgggtaatagaatggaaaaacacctattatattttagataaatccatgaagcaagtgttggctttcaatgacaaaggcagacacctatttaccatacaccgtgtagggataggtaaaggagaatatggaagcatactggatatagccatagacaggcaaaatgaaaatttagtattcctggctgacccgacctcactgatatattatgacttgcaaggaaacttcattaaaaccaccaaactaccgggatactatcattcaatagctattgataacggaatgatatacttagaaaacgaaacatatattaataatcagttatccacatcgtccatcacagtaatagcccctgacaaccaaaagactgaactattaaaaccactccgagaaatagctccttattgctttatcggaggaagccggctgaatggaaccactcctattgtatttaccagaaaattcgataacaccatctaccaactggaagacggaaagataaccccttactactctttcgattttatgaacgagaattttccggaagctgctaaagacaaagaatacacctgtcgtgagcttaataagttcacctgggatcgatatgtatatttaatggctaatgtggcaaatgctccccagtatttaatgttctgtacgaatctgttcggtgtatatgtatttgataaaatgcaaaacaaattattgaaatacaataagatacgaaatacgggataccaaacagacttacaccaatacataccggtggaaggagccaacaaccgtgtattcttcacggtttatcctacgaccctgttcagcctcaaagctatcgtagacaatcatccatctttcaaggataaaatgtccgataaactatataaattgacagaatcattggacagcgactctaatcctgtcattttcagctatcagataaaataa

SEQ ID NO: 4248 - DNA, 231 bp, B.fragilis
agacacaagaaaggcgttgtcaataaggtaaatcgtgtatgggtagtggggaatggagctatgctgccatataaggtttataataagaactactggagcgaggtgcccggaaacctctatattgatatacccgaacgtgtacaggatgagcagatcactgtgattgccgtattgctggacggccctatcaagctttatcgcggagtgggacaagtgattgaaagtaactaa

SEQ ID NO: 4249 - DNA, 1806 bp, B.fragilis
acagaaatagaaaaaactatgaagacaatcctactctttgctctgagtctgttgctctctttatccgtgtcggatgtttgtgcacaagagcgtatttatgacatttcccagtttggcttgaaagctaatagtaagaaaaatgcgtctcctgtggttcgtaaggccatagcgaagattaaagctgaatgccgtgatggggaaaaagtgatacttcgttttcctgccggacgttacaattttcatgaagcgggttctaccgtgcgtgaatattatatttccaatcacgaccaggacaatcctaaaaaagtggggattgccttggaggatatgaaaaacctgactattgacgggcagggttccgaatttgtgttttatggaagaatgattccggtttctttgcttcgttcggagaattgtgtattgaaaaactttagcattgattttgaacaaccccatattgctcaagtacaagtggtagagaatgatccggaaaaaggaatcacgttcgaacctgcaccatgggtcgattaccgcatcagtaaggattcggtattcgaaggactgggtgaaggctgggtgatgagatattcatggggcattgctttcgatggcaaaacgaaacatgtggtatataataccagtgatatcggttgtcctaccaagggagcttttgaagtggctccccgccggatttgctctccaaagtggaaagatgcacgtctggtgcccggcacagtggtggctatgcgtggatggggacgtccgactccgggcattttcatgtcacatgatgtgaatacttccttgcttgatgtcaaagtacattatgccgaaggtatgggattgctggcacagctttgcgaagatattacgcttgatggttttggagtctgcctgaaaggcgataatgatccgcgctattttacaacgcaggcagatgctacacacttttccggatgtaagggaaagattgtttcaaagaatggtttgtatgaaggaatgatggatgatgccattaatgtacatggtacgtatttgaaagtcatcaagcgtgtggatgatcatacgctgataggacgttatatgcacgatcaatcctggggctttgaatggggacgtccgggtgacgatgttcagtttgtacgttcggaaacaatggagttgattggcaagcagaatcagattactgccattcgtccgtatgataagggtgagatacaaggtgcccgtgagttcagcattacttttaaagaggcaatcgatcctgctattaacgaaaaaagtggctttggtattgaaaacctgacttggacccctgaagtgttatttgccggtaatacgattcgtaataaccgtgctcgcggtacactattcagtactcctaaaaagacagtggtggaggacaatttgtttgaccatacttccggtacggctatattgctgtgtggcgattgcaatggctggtttgagacaggtgcttgccgtgatgtcaccattcgtcgcaatcgttttatcaatgcgcttactaatatgttccagtttaccaatgcagtaatctctatctatccggaaatacctaatctgaaagatcagcaaaagtacttccatggtggtaaagatggaggtatcgtgattgaggataatgaattcgatacgtttgatgcaccgattctttatgcaaaatctgtagatgggttgatattccgtaacaatgtgatcaaaaccaatacagagtttaagcctttccactggaataaagatcgattcttgttggaacgagtgacaaacgtgaagatttcagagtga

SEQ ID NO: 4250 - DNA, 681 bp, B.fragilis
gaacgtaaagaaacaagattatcagatatgaaaaagtctactcttaccctcctgttatttattctgggtatttcttcttccttttctgtcggagcacaggaagctaaaacggtgtttgtgaatatacctgactcgctttgtccgttgctgtcatcagtgaaccgggcagattgtatcgattttattgaaagtaaaatgaaagctcaggtgaccaaccgtttcgggggcaagtcggagatgacggagttaagtcccgattatgtgtctctgcaaatgtctgacgcaagcaattggcagatgaagttattgccgttgaatgacacaacgaaagtggtttgcgccgtttctacagtttgcgctccggcatgcgacagtcatatccggttctataccacggactggaaagagcttcccgccaccgactttttgccgtcggttcctcagatgaatgatttcttcacctcttccgattctaccgactatgactttatcgatgcccgcctgcaagcggatatggctttgatgcaagcagaactgtccaaagagaatgggacattgacttttactttgacaactccggaatatatggaaaaagaaacggcggaaaaactgaaaccgtttctccgccgttcaatagtttacacctggaaggatgggaagtttatcccagacactctttga

SEQ ID NO: 4251 - DNA, 2112 bp, B.fragilis
cgaactgtttggactctgaagccatatttattccgagtcggaggattacactttaaccattatgtatttatgaagagattattatccgtttttttatttctattttgctgcgttatagcggccgatgcacaagacgatgccgcacagtatgattcgataatgaatctgatgaaaaataaaaagattcctttgatggaacgttattatatgaccggggatatcgaatatctttcacgggagcatcagattgccgtgctgaagcaattgattccggaagcgaaagaggtggaggataaggcggtcattacccgtctttattccattgtagccatgttcgaaaatcaacttggacatatgactgaggctaaaaactatctggacagtgcttttatgaataagggaaagtttgaaaacaacaatatttccggtatgatgcactacattgccggaatctattattcggataagaacctgatggaacaggcacatgagaattattatcaggctgctgagtattttaatcgcaatgaaatgaagccggccatcttaacggagatttattatgatctgtctatcatttactcgatgtggcaagatgatgagggattacatgaattgtcggaagcgatgaaagacttaccggtagatttcccttttcagcagatattgaagtggaccataaaggtgaaatacttttatgccttatatcagaatgaacaccgggtggatttgctggattctgtgacgaagtataaccaggaggcttttaaggtctacacatccaccgaaaatccttatgacgtgggatatgtcatatccgacaattatttgcaccaggcaatagtttacagcgaggcgggaaaaatcaaggaagccgaacagtgctttgaaacgggtaagaaactgatgaatcctaaaaagatcgatgccaatgtttcggtcagttatgtttcgggagtaattgcctattatcaggcagattatgaattggccgaacaacatttacaggacggactgcgtgagttgaagcggatggatgaagagcaggaggtggattactatcatgctttgattgaattctatacactgttggctaaggtatacgagaagcaggaactttataataaggctttggaggcagcccgtaattcactgaaatatgaaactcgcttgtttgacaaaaatagcaataagacgatccagaaattacggacacaatataatctgaatgaaaaggaacgggttgtggagcaattgtccgctattaacgaaaagaaccgacggattaatattctttcggccattcttattgttctggcactggtcactatctttttacttttgaaacgctatcgttcgcgccagcgtattcatgaaggaatgttgcagattgccaaactaaagcagcaggaagctgaacttctggttaagttgcagaagacaaaacttgaggaaagggaacgggagttccagtctttagtgcatgaagcgcaacagcgtaaagttcaatattatctggaaggtcttgaggtggaaagaaagcgattggcgaaggaacttcatgataatgtttccaatgaattattggccatcaagatgaaaatcaccgatggaacaagtagctgtgaggagatcatggacacgttacaaactttgcaagcggaagtacggggcatttcgcatgacctgatgccacctattttcaaatacgcttcgttatcggagattcttcaggattatgtatatcagcataatcagccggggcagaccgaactggagctgttgctcgaaccggaggataactttgacaatttatcgcagaaggtgtcgctggagatctatcgaattgtacaggaagctgttggtaactcgttgaagcatgcacaagccacgttggtgaagattatcctggtgcgggaagataacaaggtgaaattgacagtttcggataatggaagaggatttgagcaacagaccgggaagacgggaattggtcttactatcataaaagagcgtgtggaaaacctgaggggaactctgactttgaactctgctccgggaaaaggaacagagctgatcgtggaaatcgatctggagaatctggaaaaataa

SEQ ID NO: 4252 - DNA, 240 bp, B.fragilis
  unsure (12),(35),(87),(98),(136),(140): Identity of nucleotide sequences at the above locations are unknown.
tggcgcagtcgncgcatgcacgacgcacgcacganatcgagtcactctcacggatactcacgattcctccttacctcgttcatcacngcgtacactgntacgagtctagcgcgacgggagcactgtcctcacctcntatntcgtgtaatgtcgtctcgtctattctctcattgtaataagcatgtggccggtactcgcgacgacacactccagcttatctcacctctctatagtaagagc

SEQ ID NO: 4253 - DNA, 195 bp, B.fragilis
tctaatattagcttcttcacctcacggatggactcttcgggcgaaagccgggatacttccttttttgtcaactataaaagagggcttacacgtccgaaaactgaattagattccatgagtaaaagaaaacttaccaccaaatttgaagaagaacccccaaaaaatcgatctttcatcttccaccctctgttttaa

SEQ ID NO: 4254 - DNA, 957 bp, B.fragilis
aatatcctcaggagatattcgaataagcctatagcttctaatttaaagaattctattatgtggttacttcttgcttttctctcagcgacattgctgggcttttatgacgtgtttaaaaagaaagcgttgaaagacaatgcggttttaccggtgttgttcttcaatacacttttttccagtcttatatttcttccttttattttgttgtcggcatttgcgcccggagtgctggagggcactatgctcgatgtaccggtggtgggatgggaagtacataaatttattattattaaatcatttattgttctttcctcgtggatactcggatatttcgggatgaaacatctgcctattactattgtaggaccgattaatgccacccgtcccgtaatggtgcttgtgggagccatgctggtatttggcgagcgcttgaatctctatcagtggatcggcgtgatgttggccattatttctttttttatgctgagtcgttcggggaagaaggaaggtattgactttaaacataacaagtggatacttttcattattctggcagccgtagcgggtgcggtaagtggcttgtatgataaatacctgatgaagcagctgcctcccatggtcgtacagtcgtggtataatgtgtaccaaatgtttattatgtgtcccattcttgcgcttctttggtggccgaaacgtaagtcatctactccgttccgttgggattgggctatcatttttatttccatctttctctgtgctgccgattttgtttacttctatgcattgagctatgaagattccatgatttcgattgtctcgatggttcgacggggaagtgtgattgtatctttccttttcggtgctatggtgttccgtgaaaagaatttaaaaagcaaagcgattgaccttattctggtgttaataggaatgatattcctatatttgggaactaaataa

SEQ ID NO: 4255 - DNA, 957 bp, B.fragilis
ttatataaaagtatgaaagcattaacaaaaacagatttcaactttccgggacaaaaaagtgtgtaccacggaaaagtgcgtgatgtgtacaacatcaatggcgaacaactcgtaatggtagctaccgaccgtatttcggcctttgatgtagtgttgcccgaaggtatcccttataaaggacaaatgctgaatcagattgcagcaaaattcttggatgcaaccacagacatctgtccgaactggaaactcgccactcccgacccaatggttacagtgggagtactctgcgaaggtttcccggtagaaatgatcgtacgtggctatctttgcggaagcgcatggcgtgcttacaaaaacggcgtacgcgaaatctgtggcgtaaaacttcctgaaggtatgaaagagaaccaaaagttccctgaaccgatcgtcactccgactacaaaagcagaaatgggattgcacgatgaagatatctccaaagaagaaatcctggctcagggactggctactccggaagaatatgccatcctcgaaaaatatacattagctttgttcaaacgtggtaccgaaatagcagcggaacgcggtttaatcttggtagacaccaaatatgaatttggaaagcacaacggtaccatctatctgatggacgaaatccatactccggactcaagccgttatttctacgccgaaggttatcaggaacgttttgaaaaaggcgaagcacagaaacaactttccaaagaatttgtacgcgaatggttgatggaaaacggtttccaaggcaaagaaggacagaaagttcctgaaatgactcctgctattgtggaaagcatcagcgagcgttatatcgagctgtttgaaaacatcaccggcgaaaaattcgtgaaagaggataccagcaacattgccgaacgtatcgaaaagaacgtaatggcattccttgcaaaatag

SEQ ID NO: 4256 - DNA, 1200 bp, B.fragilis
agatttcagagtgaaatccgcctctgtaaaaacacttataaatgtatgaagagaattctattgttccttttggcctgttgtcctatgcttctttgtgcacaggaagataacagtaagtatctggccggtgcagtacccgtagtcaacggaaaagtcatttttgcagaagtaattcaagcttccgatatgtcgaaacggcagatctatgatgctttgttaaaatgggcagagaagcgttttacaccttcaaaaggacagaaggggagagtcgcctattttgatgggaaaaaagggcagattgcatgtttgggtgaagagtatttgcaactttcggcaacgaatagcttcttcttggatcgtgctactattaaataccggctggtgattaactgcctggacggttcctgtaagatggagatgtacaacatttcttattttcatggtgatgatacagagatggaggcggaagattggatcacggatgagaccggattgaataaagccaaaacgaaagtggttgccaaatatggaaaactccgtatcaaaacaatcgatctgtttgatgacttgacggagcaggttacgaaaacgctgggaggagcaaaatcagaggttcctctattggcaaaagaacctaaagttactccggaagtgttcgatcgggaatttccaaaggctgtggagcagggagctatggcagggtataaacatattcctgctgataagattccgggtaatatcattaaaatgctctctgaagattggatgttgattacagccggtacggaagataaatacaacatgatgacagccagctggggcggactggggtatctctataataagccggtttcattctgttttatttatcctacacgctatacttatcaattgatggaaaagaatgatacatatactatcagcttttatacagagacttatcgggatgctttgaaatattgcggtagtcatagtggcgaagatgttgataaagtgaaaggcgccggattgactcctcttactactccttcgggcagtaaagctttctctgaagcatggatgatcatagaatgtaagaagatgttatcccagccgatcactcccggagcctttgatactccggagttgaaagaagcatggaaggataaatctttgcatacgatgtatatcggtgagataatgaatgtgtgggtcaaataa

SEQ ID NO: 4257 - DNA, 240 bp, B.fragilis
aaaggctgtggctccggaggtaaacgtgacattgaatccggcagactaaaaaatatttattgtggggtgctactcccacagaccaatgtgtcaaaactcaccatggaggacaagccttctatcctcggtcggaaggatggaaaaaaacgggaaaatatcgatttgaaagaactttatcaattatataatgaaatagattcgtatattagccaacgatataacgaactgtttggactctga

SEQ ID NO: 4258 - DNA, 444 bp, B.fragilis
  unsure (15),(137),(237),(243),(280),(303),(355),(366),(404),(408): Identity of nucleotide sequences at the above locations are unknown.
gcttggtgtgggccntgcgatacggtactaatgtgcgcgatgatgtatgggtatggtgaggcacagccggctagacgaggtgatcatgtggatgcgctctgtctacatcgcctcgctgtgataatgcatatgtgtanatacgccttcgaacctctctcttgtgatgagtgtgcgcatgcgctacacagacaacatcgtctactactatgtcttgctgtttacatggcgcctgcgttntcatcntgtctcacgtacgtgttcttgctgatggcgcagtcgncgcatgcacgacgcacgcacganatcgagtcactctcacggatactcacgattcctccttacctcgttcatcacngcgtacactgntacgagtctagcgcgacgggagcactgtcctcacctcntatntcgtgtaatgtcgtctcgtctattctctcattgtaa

SEQ ID NO: 4259 - DNA, 951 bp, B.fragilis
atgaaaaagggaattaagataggcgtcataacattattattgctgcttaccggatgtacgataggcggaagttttttcatgctcaattattcacttcgtccggaagcgaagatacgtgccaaaaatgctgactcctatcctttcatatacaagaattatccttttctgcgtccctgggtggatagtctcaatcaggctcatgcacttcgggacacttttgttttaaatccggaaggtatccggctacatgcttattacattgcagctccgcaaccaaccaaaaagacggcagtcattgtacatggttatacagacaatgccattcgcatgtttatgataggttacctgtataaccatgatttacaatacaatgtactattgcccgaccttcaacatcagggggagagtggtggtcccgccatccagatgggctggaaagaccgcctggacgtaatgcaatggatgcacatcgccaaccagatttacggggacagtacccaaatggtagtacacggtatttcaatgggaggagctaccaccatgatggtttcgggagaggcacaaccttatttcgtaaaatgtttcgttgaggactgtggttacaccagtgtatgggatgaattttcacatgaactgaaatcgagttttcacctcccgtcattcccactgatgaatacaaccagctggctatgccagaaaaaatacggatggaattttgaagaagcctcctctttgaatcaagtaaaaaaaagtcatctaccgatgtttttcattcacggtgacaaagacacatacgtgcctacatggatggtctatcctctttatgaagccaaatcggccccaaagcaactctggattgtaccgggagctgcacatgccgtatcttataaagagaacaaggaagaatacacccggaaagtcaaagaatttacagaccgctacattcactga

SEQ ID NO: 4260 - DNA, 1050 bp, B.fragilis
agtaagattatggagttctcggctaagcaaattgcagcatttatccaaggggaaattataggtgacgaaaacgctactgtacatacattcgcaaagatagaagaaggaataccaggcgctatctctttcctttccaatccgaaatacacaccttatatatatgagactaaagctagcattgtgttggtgaacaaagattttactcccgaacaagaagtaaaagcaacgttaatcaaagtagacaatgcttacgagagccttgccaagttgctcaatctgtatgaaatgagcaaacccaaaagaaccggtattgacgaacgtgcctatgtagcggaaaccgctaaaataggaaaagacgtatatatagctcctttcgcttgcatcggtgatcatgcggaagtaggagacaacacagtgattcatccgcatgccactgtgggaggtggtgccaagataggcagcaattgtatcttgtacgccaactcgactgtataccatgattgccgggtaggtaataactgtattctgcatgcgggatgcgtgatcggagcagacggtttcggttttgcccctaccccacaaggatacgaaaaaattccccaaatcggtattgttatcctggaagacaatgtagaagtcggcgccaatacttgcatcgaccgtgcaaccatgggagcaaccgttattcatagcggagtaaagttggacaatctggtccagatagcccacaacgatgaaataggttcgcataccgtcatggctgcccaagtgggcatcgcaggttctaccaaggtaggcgaatggtgtatgttcggcggacaagtaggcattgccggacatctcaaaataggcaaccaagtgaatctgggagcccaatcgggtgttcccggaaatataaaatccggtagccaacttatcggaactccccctatggagctaaaacaatttttcaaagcatccattgtacaaaaaagccttccggagatgcagattgagttacgcaatctccgcaaagaaatagaagaattaaaacaacaattaaataagtaa

SEQ ID NO: 4261 - DNA, 915 bp, B.fragilis
ccaatcgttatgactgccaaaactttaattgtacttataggtcctacaggtgtaggaaaaacggagttaagcctccgcatagcagaatatttcaagacgagtatcatttcgtctgactcccgacagttatacgccgaacttaagataggaacggctgctccgaccccggagcaattaaaacgggttccacactactttgtaggtaccctgcaacttaccgattattacagtgccgcccaatacgagacggaagtaatgagtgttctcgaacagttatttcaacaacatcatgtcgtcctgctcaccggaggctctatgatgtatgtggatgccatctgcaaaggcattgatgacataccgacagtagatgccgagactcgtgagctcttgctacataaatatgacacagaaggactcgataatctctgtgccgaactgaagctactggatccggagtactataaaattgtagatttaaaaaatcccaaacgggtcattcacgccttggagatctgttacatgacagggaaaacttatacctctttccgtacacaacaaaaaaaggaacgcccgttccacatcctaaaaataggactgacgcgagatcgcgccgaattatatgatcgcatcaaccgtcgtgtagaccagatgatgaacgaaggattgctggaagaagcccgctccgtatatgcccaccgagagttgaactccctgaacactgtaggctataaggaaatatttaaatatctggatggagagtgggatcttgacttcgctatcgaaaaaataaaacagaactcacgtatctactcacgcaaacaaatgacctggttcaaacgggatgaagagatcagatggttccatcctgaacaagagaaagaaatattatcgtatcttcaggtctcaattaaataa

SEQ ID NO: 4262 - DNA, 795 bp, B.fragilis
agcagtatctttgcacgcaaaaaccaagtgaacggaatgagcgtgcaaagatattttatttatttagcctatgatggcacccattatcatggatggcagattcagcctaacggaatcagtatacaagaatgtctgatgaaggcacttgccaccttcctaaggaaagatacggaagtgattggggcgggacggaccgatgccggggtacatgcgtctctgatggttgcccacttcgactacgaaggtgaacctttggatgtggataaagtagctgagaagctgaatcgtcttttgccgcaggatatttcggtctataaggtctgtcgggtaaagccggatgctcatgcaaggttcgatgcaacagcacgtacttacaagtattacattactactgtaaaattcccgttcaatcgtcaatatcggtatcggatacataatccgctcgactttcaaaagatgaatgaggcagccctgacattatttcattattcggactttacgagttttagtaagttgcatacagatgtaaaaaccaatatttgtaagattatgcatgccgaatggactcaggaggatgaatatacctgggtgtttaccatccaggcagaccgctttttgcgtaatatggtacgtgccattgtcggtacgcttctggaagtggggcgtggcaaactgtcagtcgatgacttccgtaaaataatagagcagcagaatcgctgtaaagccggtacttcagctcccggaaatgccctcttcctggttaatgtagaatatcctcaggagatattcgaataa

SEQ ID NO: 4263 - DNA, 1128 bp, B.fragilis
aaaaaagtcatctaccgatgtttttcattcacggtgacaaagacacatacgtgcctacatggatggtctatcctctttatgaagccaaatcggccccaaagcaactctggattgtaccgggagctgcacatgccgtatcttataaagagaacaaggaagaatacacccggaaagtcaaagaatttacagaccgctacattcactgatatgaaacagatactcacatacctgctctttatatggatactcctcccactaaaagcagaagaaaaaatatataccgtagacaacatccctaaagtacacttgcagaacaagatgcagtatgtttgtaatcctgccggcatcttgtcacagcaagcttgtgacgaaatagatgcaatgctatatgcactggaacagcagacggggattgaaacagttgttgccatagtgccatcgatcggagataaagattgctttgaattctcccatcagctactcaatcaatggggagtaggcaaaaaaggtaaagataacggactggttatcttattggttaccgatcagcgctgtatccagttttataccggatacggattggaaggcattctgcctgatgccatatgcaaacgtatacaaatgcaagagatgatcccctatctcaagaaaggagagtggaaccaaggaatgctggcaggagtaaaagctgtatgtcagcgcttggacggctcgatggtaaacgatgatgaaggtcgtggagaagaagggatatctgtctccatgcttctcgttgtcatcttaagttttatcacgatagcgggagtggtcggcatactggcagtacgtgcaagtacccgttgccctaaatgtgggaaacatcaactccagcgcagtagtacgaaattgatatcgaaccgtaatggagtaaagaccgaggacattatatatacctgccgcaattgcggacatactgtagtccgacgccaacaatcgtatgacgacaattaccggggacgcggaggaggaggtcctttcatcggaggattcggaggaggaagttttggatccggcggtggaggcggtttcagcggtggaagcttcggaggcggttccggtggcggtggaggtgccggctcacgtttctaa

SEQ ID NO: 4264 - DNA, 693 bp, B.fragilis
aaaagactaattatgaatcaatctaagtgcaggagccactttgtaatttctatctttttatgctttatattgccttgtctggcgggttgcaaaaagaaagacatgtctcttaagcttaacgaaccgcgcaatattaaaggagtggtgagctataaacgttcgtttggagatctgaatgatgtacagttaaaagcagcacatgcgtggggcattgcaccattggcttcgcgcgaagaagcggaagagatggatggaaagttagttcatattgtcgataatgacttttatgtggtagactcactcactcattctattccttatttagtgccgcgcgccagtgcgttactcgatacgataggggcaaatttcttggattcattgactgctaaggggctcaatccgaataaaattattgtaacttccgtacttaggacggagaatgacgtaaaacgcttgcgtcgtcgaaatgggaatgcatcgaagaattcttgccatttttacggaactacattcgatgtgagttggaaacggtttaagaaagtggaagatgaggatggacgtcctcttcaggatgtgagtgctgatactttaaagctggtattggccgaagtcttgcgggatgttcgtaaggcggataaatgttatgtaaagtacgaattgaaacagggatgttttcacataacaacacgctaa

SEQ ID NO: 4265 - DNA, 1023 bp, B.fragilis
attgattcaatgatagaaaaactgatagttcttgaggatattgatccggtcatcttttacggcgtaaacaacgccaacatacaattaataaaagctttgtatccaaagctacgcattgttgcccgaggcaatgtcatcaaagtgctgggcgatgaggaagaaatgtgcgcttttgaggacaatatcaccaagcttgaaaaatattgtgccgaatacaattcgctgaaagaagaagtcattatcgacatcattaaaggtaatgcaccacaagctgaaaaagcgggaaatgttattgtattcagcgtcacagggaaacccatcattccacgtagcgaaaaccaactgaaattagtggaggggtttgccaaaaacgatatggtatttgctatcggaccggccggttcgggcaagacttatacagcaatcgctctggccgttcgtgcactgaagaacaaagaaatcaagaaaataattctcagtcgccccgcggtagaagccggtgaaaagttaggctttcttcccggagatatgaaagataaaatcgatccgtatctacaaccactctatgatgctttacaagacatgattccggcagccaagctgaaggaatatatggaactgaacatcattcagatcgctccgctcgcttttatgcgcggacgtacactcaatgacgcagtagtcatcctggacgaagcccaaaacaccactacccaacaaattaaaatgttcctcacccgtatgggaatgaatactaagatgatcattaccggtgacatgacccagatcgatcttccggcctcacaaacatcgggattggtacaggcattgcgtattctaaaaggagtgaaaggaatcagctttgtcgaactgaataaaaaagacattgtgcgacacaagcttgtagaacgtatcgtggacgcttacgaaaagttcgataaggaaaagaaagccgaacgggaaaaattaaacggtgaacggcttacaataagtaaagaacggcaaaacgttggtaatttgtaa

SEQ ID NO: 4266 - DNA, 999 bp, B.fragilis
aattacttgattatgaacctgaatactccggtagagattccatctggattcacccccatcagccatgcccagcaactgctgattatgggttcctgctttgcagagaacatcggtaccctgcttgctgaaaataaattccggatcgatatcaatccattcggtatcttatataatccacgatccatctcaatggctttgcgcgaaatcatcagccaaaagcaatacaaagcatccgatctgtttctgcatcgtgaatgttggcacagcccgatgcatcacggctctttctccgccgccacccttgcagacaccttacggaatatccaatcccgtctggaacaggcacataaagagctgaaacaacttgaccggcttatgctgaccttcggcaccgcatacgtatacgaacaaaaagagacaggaaaggtagtggccaactgtcacaaattgcctgaaaagaattttatacgccgccgccttgagatagacgagatagtagaagactataccctgctattggacgaattgatctctttgaatcctcaactaaagatcttgttcacagtcagccccattcgccacatacgagacggaatgcatgccaaccaactcagtaaaagcgtgctgctgcttgccatcgaccgactgatgcaacgttatccacaggtcacttgctactttccttcttatgaaatagtattggatgaacttcgggactatcgcttctatgcagatgacatggtacacccatccacgttgaccgtcaattatctatgggagcgtttttcggagactttcttcacccccgaaacccaaagcctaatcaaagagtgtgaaacgatacgaaaagcgattgcgcacaaacctttccatcccgagtcggaagagcataaaagatttttaggacaaattgtgttaaaaatagaacgacttaacggaaaatacccgtacttagatttcgaaaaagaaacaaacatgtgccgattggcgcttcaataa

SEQ ID NO: 4267 - DNA, 240 bp, B.fragilis
tacaataccgttatgacaaacctttttttattaggattcatgcccagtggttccgaatggattatcatcctgttggttatactcttgctttttggtggtaaaaagattcccgaactgatgcgcgggctcggcaaaggagtgaaaagttttaaagaaggggtgaatgaagccaaagaggaaataaacaaagcaaaagaagaaatcgacgaaccggaaaacaaagaaaagaaagataactga

SEQ ID NO: 4268 - DNA, 186 bp, B.fragilis
ccacatccggtgggttatgacatcttactacccgccccctatgctgtcacatgggtacattatcacatgaccaatcgttatgactgccaaaactttaattgtacttataggtcctacaggtgtaggaaaaacggagttaagcctccgcatagcagaatatttcaagacgagtatcatttcgtctga

SEQ ID NO: 4269 - DNA, 408 bp, B.fragilis
actaaatcttttcgttatttgtgttcaaatgaagaaaaggttatgaaaagattaacagcaaaagaagaagagattatgggatttttctgggagaagggtcctttgtttgtgaaagagatactggcattttatgatgagccaaaaccacatttcaatactttgtctacaattgtgcgcggattggaagagaagggctttttagcacatcatacttatggcaatacctatcagtattatgcggtagtcagcgaatcggactttagtaaacgtacgctgaaaagtgtaattagcaagtatttcaataattcgtatctcagtgctgtgtcgtcattggtgaaggaagaagatatttcgcttgacgacctcaagaagttgattcaggaggtggagcaaaagaacgaagaataa

SEQ ID NO: 4270 - DNA, 1314 bp, B.fragilis
aacagagaattttgccgctgccgcccgtgctgctgccaaagaagtgcaagagcaaatggcagaacagctgaaagctattttataatgcctcacgaacggaagattatcaatgatccggtattcgggtttatcaacataccaaaggggttgctgtacgacatcgtacggcatccccttttgcagcgcttaaaccgcatcaagcaagtaggactttcgtctgttgtttatcccggtgcacagcatacccgctttcaacactctctgggtgccttctacctgatgagcgaggccatcacacaactagcttccaaaggtaactttatattcgacagtgaagccgaagccgtacaggcagccatcctgttgcacgacatcggtcacggtcctttctcgcatgtacttgaagataccattgtcaaaggagtatctcacgaagaaatctctttgatgctgatggagcggatgaacagggagatgaacggacagctgagtttggctatccagatattcaaagatgaatatcccaaacgtttcttacatcagttagtaagcggacaactggacatggaccgtttagattacctgcgtcgtgatagcttctacaccggagtctcggaaggaaacatcggttcggcccgtatcatcaaaatgcttgatgtggcagacgatcatctggtagtggaatccaaaggaatctattccatagaaaatttcctgactgcaaggcgattgatgtattggcaggtttatctgcacaaaacatcggtagcttatgaacgaatgttgatcagtgccctgttacgtgccaaagaactcgcttcgaaaggagtcgaattatttgcttcaccggcattgaaattttttctgtataatcacatcgatccggaagtgttttacaataacccggactgtctggagaactttattcaattggacgataatgacatctggacagctttaaaggtatggagtacccacacggataaggttttatctacattaagcctgggtatgattaatcgcaacatcttcaaggtggagatatgctccgaacctattagtgaagaacgaaaaaaagaattgactttactgatcagccgacaattaggcattactctttccgaagcggactattttgtctctacccccagtatcgaaaagaacatgtatgattcggctgatgacagcattgatattatttataaggacggaacaataaaaaatattgcagaagcatcggacatgctaaacatttcattgctctctaaaaaggtaaagaaatactatatctgctacttgcgttgggatagataa

SEQ ID NO: 4271 - DNA, 864 bp, B.fragilis
cgcgtttcgaccgtgaccgccgccgtaacgccaaagacggaaatggaaaggacgaaggcggaaacggaaaccggaaaaagaaaaagaagaataataaccgcccgcaacaagctgccaatggcgaaacacagagttcacagcccactccgattaatgcacaggagaacaacggttctcagcctgtacaaaaccaacagcgtacacgtggtgaacgtccgaaaaacaataatcgcaacaacaaccaaccacgtaaaaataatgagtctcgtgaaccgcgtagcaacgagaaccgggaaacgcgtaaaaacgaaccccgtgaacagcgccctcctcgcgaaccacgcggaccgcgcaacaatgaacaacctaaacgtatcgagaaagctcaggaaaatgaaaagcctgctcaagaatagcatttgcatgctccttaccacatgggttctgactgcatgtgacgaaaatactgtgtatcactcttaccaatccactcccccggatggatggaagaagagtgatacactctttttcaacgtgtctctaaaagattccctagccaacctgcgactgtccgttggtgtacgcaacagcagtaactacccttatcagaacctgaatatcctcatccattataatctggaagattcaactgtatggaagacagataccctgaagtttatactgactgaccgggaaggtaaatggacaggaaccgactggggaagtctgtaccaatcggcactccctttgaaggactggtttgttaaacatcccggcaactatactttcaagatagtacacgaaatgaagaatgaacaactaaccgggatcagtgatgtgggattgaaaatagaacatttatag

SEQ ID NO: 4272 - DNA, 525 bp, B.fragilis
ttgaatgaccacccgtggaacttccaccccgtggtgaagaccgcagattctataaaagtggtgttggggatggaagaggacttggccggagccggttacaacgttaaccagtcgaagattgcgattggttccggagggttgacgggtaaaggttttctgaatggtacacaaaccaagctgaaatatgtgcccgaacaagataccgatttcattttctgtactgtgggtgaagaacaggggtttgttggttcggcagccgttcttttgcttttcttggcattgatactccgtcttatagcgacgtcagagcggcagacttctactttcgggcgggtttatggctattcggttgtgagcattttcctgttccatttgtttattaacatcggaatggtacttggtctgactcctgtaatcggtattccgttgcctttctttagttatggcgggtcatctttatggggatttacgattctgctttttatctttctgcgtatcgatgcggggcgtagcatacggctataa

SEQ ID NO: 4273 - DNA, 348 bp, B.fragilis
cagaaggttaaatcaagttataggaagaggaaaaacaaaaggagaaaaaagattgagaatgaagaaaatagagaaaaaagggggtattttctgggaaaagggataagtgctggtccgaaagggatcgttgcgattaaagcaagtatagatacgattaaagcaggtatgagtgtgattaggataagtatgattgtgattagagcaagtataggtgcaattaaagtaagtataggtgcgatcagagcaggtataggtgtatttaaagcaaatgccggtgcaatccggaagaacatttgcgatcaggaaagtttcattataaagtattttcataagcaaaatttagggtaa

SEQ ID NO: 4274 - DNA, 303 bp, B.fragilis; identical to SEQ ID NO: 2481

SEQ ID NO: 4275 - DNA, 192 bp, B.fragilis
cctccaaccaagttggatgacattccttcagaatgccgggttgtcccattcggaaatcttcggatcaatggtcatttgcacctacccgaagcttatcgcagcttatcacgtccttcatcgcctccgagagccaaggcatccgccatgcgcccttatttactttcttttatcgccagggatcatttcctttga

SEQ ID NO: 4276 - DNA, 1089 bp, B.fragilis
caacagaaaaagaatcataactgggaacaaaggcaatcttttcaggttctacaacgatttcgtttcatctttttttcgtatttttgtcccaatatgcatccttctgcaaggatagcaaagacgaataaaaaaataatgagagtaattgatttaatacatagcaacgaaaaaacagctttctctttcgaaatactccctcctttaaagggtacgggcatcgagaagttgtaccaaaccatagataccttacgtgagttcgacccaaagtatatcaacatcaccactcatcgcagtgagtatgtatatcgggatttaggcaacggactttttcagcgcaaccgcctgagaagacgtccgggaaccgtagctgtagctgctgccatccagaataaatacaacatcacagtagtaccccacattctgtgtagcgggtttacacaggaagagacagaatatgtactgctcgaccttcagttcctgggtattacagatctattagtgcttcgtggagataaagccaaacatgaaaccgtgtttactcctgagggagacggacatcatcatgctttggatctgcagcaacaaatcaataacttcaacaaaggtatttttgtagacggatcggagatgaaagtgactaatactcctttctcatacggtgtggcttgctatccggaaaagcatgaagaagctcctaatatcgatatggatatctattggttgaagaagaaagtggaagccggtgcagaatatgccgttacccaactgttttacgataacaaaaagtactttgaattcgtagaaaaggtacatcaggcaggtatcgacatccctatcatcccgggtattaagccctttaaaaagatatcacaactgaatatggtgcctaaaaccttcaaggtagaccttccggaagagttgaccaaggaagcactgaagtgccaaaccgatgaggaagcccgtcaggtaggcatcgaatggtgcatcagccaatgcaaagagttgatggcagccggtgtgcccagtatccatttctactccatcggagcagtggacagtatcaaagaagtagccaaagcaatttattaa

SEQ ID NO: 4277 - DNA, 183 bp, B.fragilis; identical to SEQ ID NO: 2746

SEQ ID NO: 4278 - DNA, 288 bp, B.fragilis; identical to SEQ ID NO: 2800

SEQ ID NO: 4279 - DNA, 1479 bp, B.fragilis
agcaataactttaaaataaagtatatggaatttaaactgcataatgggagcggaggtctttgttgtaaaagctgttcccgacaagataaaaaactaaacacctatgattggctggccgacataccaggcaatgcagaggagagtgatatggtagaagttcaatttaagaacacccgtaaaggctactaccgtaacagtaacaaaatcaaattggagaaaggcgatatcgtagctgtagaagctactccgggacacgatattggtactgtcaccctgacaggacgattagtccccctccagatgaaaaaggcaaactttaaacaggatgccgaaatcaagcgtatctaccgcaaagcaaaagctgtagatatggagaaatatgaagaagcaaaagccaaagaacataccacaatgattcgtgcacggcagatagcagccagtctgaatctggatatgaaaattggtgatgtagaatatcaaggagacggcaataaagctatcttttattatatcgccgacgaacgcgtagacttccgccaattgattaaagtactggccgaagcttttagagtacgtatcgaaatgaagcaaatcggtgcacggcaggaagccggacgcatcggaggtatcggcccttgcggacgtgagttatgctgtgccacctggatgaccagttttgtatccgtatcaaccagtgcggcaaggtatcaggacatttcactgaatcctcaaaagttggccggacagtgtgccaagttaaaatgttgcctgaactatgaagtggactgctatgtagaagcacaaaaacgtctgccctcaagagaaatcgaactggaaaccaaagacggaacctattacttcttcaaagcagatatcctcagtaatcagatttcgtattcaaccgacaaaaactttgcagcaaacttagtgaccattagtggaaaacgtgcattcgaagtgatagggctgaacaaaagaggtattaaaccggacagtctgttggaagccgaacgcaaaccggaacctaaaaagcctgttgatttgctggagcaggaaagcttgacgcgtttcgaccgtgaccgccgccgtaacgccaaagacggaaatggaaaggacgaaggcggaaacggaaaccggaaaaagaaaaagaagaataataaccgcccgcaacaagctgccaatggcgaaacacagagttcacagcccactccgattaatgcacaggagaacaacggttctcagcctgtacaaaaccaacagcgtacacgtggtgaacgtccgaaaaacaataatcgcaacaacaaccaaccacgtaaaaataatgagtctcgtgaaccgcgtagcaacgagaaccgggaaacgcgtaaaaacgaaccccgtgaacagcgccctcctcgcgaaccacgcggaccgcgcaacaatgaacaacctaaacgtatcgagaaagctcaggaaaatgaaaagcctgctcaagaatag

SEQ ID NO: 4280 - DNA, 1113 bp, B.fragilis
gccatgtttttcagagacgtcatcggacaagaagaggccaagtatcgactgatacaagaagtcagcgaaggacgtatcccccatgcccagcttttttgtgggcccgaaggggtaggcaagtttccgctggcactggcctatgcacgctatctgagttgcaccaatcgtagtgacactgatgcttgcggagtctgtccgtcatgtgtgaaattcaataagctggttcacccggatgttcatttcgtttttccggtagtaaaaaacgggagaagcgatgactacattgtagaatggagaaaattggtgttaaacaatccctattttaccatcaatcattggctgaacgaaataaatgcagaaaatgcacaggcggtaatctacaccaaagagagtgatgagatcatgaaaaagctcagccttaaatccagcgagggcggatttaagattacactcctctggctgccggaaaagatgcaacaggcttgtgccaacaagttattgaaactgctggaagaaccacccgaaaagacaatcttccttttggtttcggaggctcccgatttaattctccaaacgatattgagccgcacgcaacgcttcaatctacgtaaaattgaggaagagtgtatggccgaggctttacaaagcaaatacggggtccagcaggcaaccagtatttcgatcgcccacctagccaacggaaactttatcaaagccctcgagacaattcacctgaatgaagagaatcagttgtttttcgaactgtttgtcagtttgatgcgactctcttaccaacggaaaatccgggaaatgaaattatggagtgaacaagtggcaggcatgggacgcgaacgccagaaaaattttctggaatactgccaacgaatgatccgggagaattttatctacaacctacaccggaaagagttgacttatatgacattagaagaacagaacttcgctacacggtttgccccttttgtcaacgaacgaaatgtaatgggcatcatggatgaactgagtgaagctcaaaaacatattgaacagaacgtaaatgctaaaatggtatttttcgacttctcgctgaagatgatcgtactgttaaagcaataa

SEQ ID NO: 4281 - DNA, 294 bp, B.fragilis
tcccagggatcatccagcgggattgccggcgccggcgatttcgtcgcccccgggcccctgtttcggggggggacagtcgggaaaatagccgtaggttccaaagtggttagaaaagccgttcctttgcgaggagatgacctgacaggccgcccggtagtcacgggggatttaaatagaataatagttccccccccaggggggagtttgccatttttcgccggtccatacgccctgcagggaaatggggttttagtgttccgggtaatgcacccgatttatcaatttcggtcttaa

SEQ ID NO: 4282 - DNA, 2487 bp, B.fragilis
gtagcgcggtccttccagccccgtggtgaagacgaacgattaggaataccggcattcaaactggccgacggtccgctgggcgttgcatcctggggattattcggacgcgccaccgcatttccatcagcactttcgctggctgcctcttggaataaaaatctggcagagaaaacaggagcaatgtatgctcaggaatggcgtgcaagaggtattcattttctcttagctcccggagttaacaactatcgggcttcaaaaggagcccgtaattttgaatattttggtgaagatccttatctggcatccgagatggtagtcccctttataaaagcagtgcaagacggaggagtcattgctaccatcaaacatttcgcagccaacgatcaagaatttgaccgatacaccgtcagtaccgaagtatccgaacgtgccttacaggaaatctatctgcctcccttcaaagctgctgtgcaaaaagcaggtgtcaaggctgtcatgacgggttataacctagtgaacggagtatattgcactgaaaacaaacatctgatcgatattttaaagaaagactggggcttcaaaggcatgttaatgtctgactgggcatgtacctattccgccgaaaatgccgcaaactacggtttggatcttgagatgggcagcaatgactggttcacccgtaaagaacttctcccacttgtcaaagaaggaaaggttacagaagaagtaatcaatgataaagtgcgccgcatctatggtgcctgtatttcaatgggatttttcgacaggcctcagcaagacaccgatattccgacttttaatcctcaagccaatcagatggctctgaataccgcttgtgaaggaatcatcctgttaaagaatgaacagaataccttaccgatccaccgccccaaagtaatagctgtgatcggaccgactgccaatccggctatcgtttcggatagaatatacaatgtaaacagcatcgtttacggtggtgggggaagttcaaaagttcatccctggtatgtagtttcagcgttagaaggtatccgtcaggagtttccggaagcaaccgtactttacacggaaggaatatccaaccaattcaaaccccgcttattccgtaacagtaaattccgtacgaaagaaagtaaacccggactggaagcgagctattatgcactatcttccgacacttctgccacactctcggataaaatgatccaacagcaagcagtagcggcaggaagaactgtaagtgttaatcaatcggccgaccggactgtagaaaccgataaagaagaaagcggattgattctccgccgcaccgaccgcacggtaaattatgaatggtggggatatcctttcaacgaaagtaaattgggaaatgattatcgggtgtgctgggaaggatatgtagatgtcgagaaaacagacagtatccgattctttgtcgacgcacaaggtgcctatcgtttatggatagacggaacattagcattggatgcctctcaatctcaatcattcgatgttcgcaataccgcaatttccgcaaaaaaaggggatgccaaacatattcggctggagttctgcaaccaacgcagtacaccggcagagatccggatgggatatgcttatcaaagtgatattgacttttctgaagcgaaacgactggctgccaaagccgatctggtggttttctgtgccggactggatggcagtatcgaactggaagggcgcgaccgtcctttcgacctgccttacggacaagatatgttaattcaggaactggtaaaagtaaatcctaagttgatagttgccatccatgcaggaggcggaataaacatgacccgatggatcgatcaggtgcctgcggtagtacacgccctctatccggggcaggaaggcggacatgctttagctcatattctttcgggtaaagtgaatccgtcagccaagctaccattcactatcgagaaaagatgggaagactcacctgcctgcggtcattacgatgaaactcgcaaggaaaagaaagtgtattatacagaaggaatattcaccggttaccgtggatacgatcaaaaaggtatcgaaccccttttcccttttggattcggtctttcgtataccacctttgactattcgggcctcaacatccgtatgacggataaaaaacagaagcaactcgtcgtttcattcaccgtaaccaataccggacagcgagacggatatgaagtcgctcaactttatgtacgcgacatgcaatctaaagagccacgtcccttgaaagaattaaaaggtttcgacaaggtatatctgaaagcaggagaaagcaaacagatagaaatcggtttgagtgaagacgcattccagtatttcaacgccaaacaaagccgatgggtatttgaaaaaggtgaatttgaaattctagtaggcgcctcctctaaagacatcagactggcagagaaaataaaaatgtag

SEQ ID NO: 4283 - DNA, 978 bp, B.fragilis
atagagaaaccgattaaaaagatggactatatttcttttttatctctatatttgtggcgtgaaccgatgaatcttattagtatggcaaaacaaaaagacggctttctgggcgaacaggcattggtgttgcctcctgccattgtgcaacgtatgaagactgatcctgcaacttctatactctatataaccgatataggctattatccaaaggcttataatcactttcgggagcgggatactccgattgaccagtatgtgtttatctattgtacggagggtaggggatggttcagtctcgatgggcagaaacacccggtagtgcctaatcaatactttatacttcctgcaggacttcctcatgcgtatggcgctgatgaaaaggaaccatggacaatttactggattcacttcggaggaacacttgctccgctttattgtacgcatcgtacctgtaggctcacggatataaaaccgggaatgcattcgcgtattagttaccggacagaactgtttgaggagatctttcgggtactgaagatggggtatagcttggagaatctttcatatgccagctctgtattccatcattatttgggatcattgcgctatctcagagagtatcgggaggctttttcagagcatcgtccggcaggagaagaagatcctgtaaatgcagctattcattatatgaaggagaatctgggcaagaagctgactttagccgagctggctgattacacggggtattcatcctcatatttctctaatctgtttttgaagcgtacaggatatgccccattgagttattttaatcagattaagattcagaaagcctgtcagtttctcgattttaccgatatgaaagtgaatcaggtctgttatagagtgggtattgaagatgcttattatttctcacggctgttcagccagataatgggaatgtctcccagggaatataaaaaggtaaagaaaggataa

SEQ ID NO: 4284 - DNA, 1047 bp, B.fragilis
cggtcactctatggtgactgctattctcattgtatttataatagcacaagtctgaaagtagaacattataaactgatcttttttaatattatgaaaatcaaactactattactactctgttgtggtctgtggagcagttgcaactcgtatgactattgtccggtcactccttcagagagtgatcttgtattcaccggacttgcccggtcgtgggacgaagcaatgcccttgggaaatgctaccgtcggtgccttggtatggcaacgtgactccaccctacgcctgtcactggacagaaccgatttatgggatttacgtccggtagacagtctgtcgggagataacttccgcttctcctgggtaaaagaacatattcgccaaaagaactatctgcccgtacagaaaaagctggactggccttatgacatgaatcccgcgccgtccaagattcccggagctgccatcgaatttccattagagcagatcggcactccgactcaggtaagactttacctgaacaatgccttatgtgaagcagactgggcagacggtacacaaatgcagactttcgttcatgctaccgaaccgatcggatggtttgtattccgtaacctgaaaaccccgatagaaccctccatcatcactcctgtatacaataaaacgaagccggatggcagcctcgatccggtttcgggacaagatctgcaccgattgggctatcaacaaggaaaagtggttcgtgaaggaaaccaaataacctaccatcaaaagggatacggagacttttcgtatgacgtaacagtctgttggaagcaagaaggcgaaaccttgtacggtacctggagcgtcacctcttccttatccggcgagcaagcttccgaaaaggcagaagccgccctgcaacgcggggtaaagcatgattatcaggcccccctggaatattgggacaggtactgggcacaatcatgcatcactctacccgatgctgactggaaaaaccgattaagaccgaaattgataaatcgggtgcattacccggaacactaa

SEQ ID NO: 4285 - DNA, 1449 bp, B.fragilis
tcggtttctctatttatttctattctcaaacccgcttactttgcaatatcaattaaaccatttaataacatgaaacagacacgaggctatttactacttatctgcatcgtctcagccatgggcggattactgttcggctatgattgggttgttatcggaggagctaaaatcttctatgaacctttctttggtattgaaaactctgcggctctacgtggctgggctatgagcagcgcactgataggctgtctggcaggagccttgctctcaggaatctggagcgacaaatacggacgcaaaaagatgcttgtcatagcctcattcctgtttgcactttcggcttggggtacgggagcagtcgatcatttttcctacttcatcttctatcgcattgtaggcggattgggcatcggcatcgcatccaacatttctcccgtatatattgcagaggtatctcctgcccatgtacgcggcaaattcgtatcgctcaaccagctcaccatcgtattaggtatcttattggcacaattggccaactggcaaatcggggaatactacacacaaggttccgatatactcagcgaaacaagtgtgcaatgggcctggcgatggatgttctgggcagaactgatcccggcaggaattttcttcctgttatcgttcatcatccccgaaagtccccgttggctggctaccgtccatcaacaggagaaagcacaaaagacactgacacgcatcggaggggaaacgtatgcccgccaaaccctggaagaactgaaccaactcactcaatctcaaggcaaccggcaaaacaacgaatggaaatcggtcttccgcccggaaatgcgcaaagtactgatcattggaatcgttctggccatattccagcaatggtgcggcattaatgttatcttcaattatgcccacgagatcttttcatcagccggatatgccgtttccgatgtactgatgaacatcgtagtgaccgggatcactaatgtgatatttacgttcgtcgccatctatacggtagacaaatggggacgtcgtacactgatgctgatcggttcggcaggattagcgctgatttaccttatattgggaacctgctacttcctggatgtaaacggtttacccatgcttctactggtggtacttgccatcgcttgctatgctatgtcacttgccccggtagtctgggtggtgttatccgaaatcttccccgtgaaaatacgaggtatggctatagccatctctactttcttcctttgggtggcttgtttcatactgacctataccttcccggtattgaatgaaagtataggtgccgaaggaactttctggctatacggtggtatctgcctggccggattcctgttcatacgccaaaacctgcccgaaacaaaagggaaaacactggaagaaatagaaaaagaattaatcaaataa

SEQ ID NO: 4286 - DNA, 3309 bp, B.fragilis
aacaagatgaaagaaagtgttaatgtatgggaggaagacatcctgctccctacctatggcatcggacgccctgagaaaaacccgatgttcctggagaaacgtgtctaccagggaagcagcggagccgtatatccgtatccggtcatcgagaaaattgaagatacctgcgaggagaaaagttatcatgccgtatggctggagaacgaatacatcaaagtcatgatcctgcccgaactgggaggacgtattcaaatggcattcgacaaggtaaagcaacggcattttatctactacaatcacgtaataaagccggcactggtaggactcaccggtccctggatctccggaggcattgagttcaactggcctcaacatcaccgtcccagcaccttcttgccggtggactacagcatcgaacgatgtaaagacggaagtgtcgttgtatgggtaagcgaacgggaacggatgttcggtcaaaaaggaacagccggatttacactccgcccgggacgtgccgtactcgagatacaaggaaaagtttccaacccgactccgcttccacaaactttcctttggtgggccaatccggccgtagcggtcaatgactgctatcagtcagtattcccatcggatgtcaacgctgtattcgatcatggaaaacgggacgtgtctcgttatcctattgctaccggaacctactataaaatggattattctgccggcgtagatatttccagatataaaaatattcccgtaccgacctcctacatggcaatccggtctaactataattttgtaggcgggtacgaaaatgatacacaggcaggtgtcctgcatgtggccaatcatcacatatctcccggaaaaaaacaatggacctggggaaacggggatttcggacaggcatgggaccgcaacctgactgatgctgacggtccgtacatagaactgatgaccggagtctatacggacaatcaaccggacttcagttggttgcaaccttatgaagagaagacttttacccaatacttcatgccctatcgggaattgggagttgtgaaaaacgcctcctccgaactcttaatgaatctggaaaccgaaggagaagaatgtcgtttgaagttgtttgccacctcggctcagcaaggattacgcatcgtagtccgtcaagcgggtgttatacgctttgaggaaatcggtagcctctcgcctgaacaagtattcgaccggctgatccccataaatgatcttcacgaagcggaagtcattatctacgataccaacggacgaaaaaagctaagttggaaggccgaaccggaaacaatcaaagcagttccggaagcagccaaacccgcccttgcaccggaagagatcaaaaccaacgaagaactctatctgaccggactgcatctggaacaatatcgtcatgccacttattgcccgaccgactattatcgggaagcactccgccgggacaatggagatgcacgttgcaacaacgccatgggactatggctgatacgcaaaggagagtttgcgcaggctgaaccatatcttcggaatgccattgcccgactcaccgaaaagaatcctaacccctatgatggagaagctttttataacctcggacttgctctaaaatttcagggaaaagatgatgaggcctacgattcattctataaatcgtgttggaacgcggcatggcaagacgcaggctactattcgctggcccagatctccgtgtcccgcagcaattgggaagaagctctcgaagagattgaaaaatcccttctccacaactggcacaatctgcgcggacgccatctgaaagcaatcatactccgccatctcgaacaaaaagaggaggctcttgcctggatagaagactccttgaagacggatgcattcaacttcggttgcctgttcgaaaaatacctgatcacccgggatgaaacagtattgatccaacttcggaacctaatgaaacgtggagcacccgattacgaagcactggtactcgactatacttctgccggacgattcgaagaagcactggctgtagccgaacttgccattgcccaacctgccggtgaacagacactcttacattattacaagagttggtgcctgatccgtctaggaaaaacagccgaagcacaaatagccattgccactgccgaaaaagaaccggccgattattgtttccccaatgccctggaagcgatagaagcccttcagtgtgtagtcgactttgcaggaaaagcccccaaagcactttattacctgggaaatctatggtatgataaacgccggtatcccactgccatcgcagcctgggagcgctcttcgcgcgaagacgagacattccccaccgtatggcgtaatctgtcactggcttacttcaacaaaatgaaccgtccggacgcagctgtcgccttactggaaaaagcattccgcctggatcacacggatgcccgtgtactgatggaactggatcaattgtacaaacggctgaaccgtccgcacatagaaagactgtgctttctggaacagcacatagatatcgtaatgacccgtgacgacctgtatctggaatacgtcactttactgaaccaaaccgggcaatatcgggaagcaatccgacggatagaccaaagaaaattccatccgtgggaaggaggagaaggtaaagtacccgcacaatatcagctggcacgcctggaactggcaaaggagttgataaaccggaaaaaatatgatgacgcactcgccttaatagatgaatgctacatataccctgcccatctgggtgaagggaaactaccgggggcacaggaaaatgacttcaattattacaaagcatatatcctgcaacaacaagggagaccggaagaggctcacagcctgttcgtcaaagcctgttcgggaaacagccagccagccgctgccatgtattacaacgaccagaaaccggataaaatattctaccaaggactggcataccggaaattaggagaggaagaaaaggcacgcagccggttcaaccaattaattacttatggagaagaacacctcttcgaccgattcaagatggattattttgccgtatctttacccgatcttttgatttgggaagacgatatggataaaaagaaccgcattcactgcaactacctgatggcactgggacatctgggactgggaaatagaacaaaaaccgaacacttctttgatatagccgcctcaatggataacaatcatcaaggagtacaaattcaccggaaattaatgaataccattctatcatga

SEQ ID NO: 4287 - DNA, 2823 bp, B.fragilis
caatcatcaaggagtacaaattcaccggaaattaatgaataccattctatcatgaaacaatcttttcaaaacacccggtaccgggcgattctgctcctgaccggattgatgcttgccatgaccgctatggcgcaaaccctaacgaatgatgctcttgacttgtcgggcatgtggcgtttccaactggatccgatgggattcggtaaaactcccggttcggaactctatctggacaagctctctgaaaccattatgctccccggatcgacagaccagggaggtaaaggaattaaaaatacggcacgctacgtagaccgtttaagccgtaaattcgaatatcagggagccgcctggtaccaacgtgaagtagtgattccggaagattgggcagatcgggagatttacctgaagctggaacgttgccattgggaaaccaccgtctacgtggatgacaaagaggcaggaatgaaagagcacctgagcacaccgaacacgtttgtattgactccgctacttactccgggaatccacacactgaccatttgcgtaaacaatacacttaaatatccgatggatcaatggaaccatggaacaaccgaatatacgcagactaactggaacggaatagccggagacatcttactatatgccaaggagaaagcgcatatccgccagatcaatgtataccccgatgtcagctcgaaagcagtggaagtatctgtacaacccgctcccctaaagaccggacagacaggaaaactggagctatgcatccgcgagcaaggaggtaaaataatagcccgtcaaacactgaatgcagacagtcttcaggtacatgcaggcatacgccaaacgctcccgatgggaaatagggtgaagctctgggatgaattcacaccttatttatacgagatagaagccagttggaacgtagacggaaagacagatactcaaacccgaactttcggcatgcggaacgtagagcagggtaaacatcatatccgcctgaacggaagagacattcacttacgtggagtactggattgtgcagtctttcccctgaccggttatccgtcgacaaatgtggatgactggaaacgcatcttcaccaccattaaagaatatggaatgaatcacgtacgctttcactcctggtgttcgccggaagcagctttcgaagccggtgacgaagtaggtatgtacctccaggccgaacttcccatgtggatcaaagatgtgggtaaatatcctgaccggcgtgatttctttgaaaaagagatgtatgccattctcgatgcctatggcaatcacccctctttcatcctgatgtgtaacggcaacgaaaacgaaggtgacttcgccgtattggaagatctggtaaaaaaggcacagaagtatgataaccgacggctttatagcgcctcgaccgcacgtactcatactccttcggatcagtactatgtgtcgcatgtcacctcgaaaggatggattaccgtatacgagggaaagccatcgactgactgggaccgttgcaaagaatcggatatcgatgtaccggtgattgctcacgaaaccggacaacgctgtatgtatcccaactttgaggaaatgaagaaatataccggcgttgtagaagcacgcaatttcgaggtattccgcgaacggcttgccaaaaacggcatgttgcaccaagccaacgatttcttccgggcaaccggagcacatacggtgctgcaatataaagaggtaaacgaatcgctgctccgtactcgcaactccggtggttttcagttgttgggactggccgatttccccggacagggcagtgcctttgtaggcatcctcgacgctttctgggaaagcaaaggactggtaacacccgaaaagttcagagaatcgtgtgctccgaccgtactcctggcacgtttacccaaacgcactttcagaaacggggaaaaactaaaggcaaaaatggaaatttaccatttcggtaaagatgccctgaacagccggaaactgaactggacactgaccggtgaagacggaaccgtataccacaaaggaagcctgaagacaaaaagcatacaacctgctacggtagattcactcggaatcatcgaactccccttgaacgggatggacagtgccctcaaactgaccttgaaggctgagctgggcggtatacacaatgaatgggatgtgtgggtatatccggaacaaccgaaaacggaacaatacaactttgtctacacccgtacctggaacgacgaaaccaaacagtggctcaacgaaggcaagaatgtactgttaattcctgaaaagtgtaaaggacgcaaagcgcacttcgccagccatttctggaacccgattatgttcaactggaatccaatgatcgtaggtacactgatcgataacgagcatcccgcctttcgcgacttccccacccggaactatgccgactggcaatggtgggacatcctgaactattcgacagccctggaactcgacgaactgaaagaaatcaccccattgatacagagcatcgactcatacgagaccaaccaaaaactgggtatctcgttcgaagctaaggtaggaaaaggaaaactattcgtgctctgtgccgatccggaaaagaaaatagatgaaagacctgcgatgcagcagttactaacgtctgtccgtaattatgtgtcatccgggcatttcaacccgacaaagagtttacccgtctacctgttggatgcacttttcgccccagcatccgaagagaaatccggagacaagggtagcaaggcgatcgaattgctattgaataaatag

SEQ ID NO: 4288 - DNA, 675 bp, B.fragilis
aagaaatatgcagtcagattgttacttttgcaaaaaaaaaactatttttgcgaattgtttatcttaaaaatacatagaatgtcgacacatggtagcctttcggaagtggaacgattcaatcttttgtataaaagttcgtttaataaggtttgcaactttgcatgcttttatgtgcgcaataagcaagcttctgaagacatcactatggacgccttcctgcaactgctcgaaaccatgaaggtggaatcggttgataatcccatggctctccttatcaccatcgtgaaacataaatcgttggattatctcaaaacacaagtacgacgggaagataccaaagatgatcttatacaatggaaacagcgcgaactagccatccgaatctcaaacttggaaggctgtaatcccagttatattttctcacaggaaatcaaatctatcgtaatgaaaactctcaatcaattaccggaacaaaccaaaaaggtattcattatgagccgctttgaaaataaatcgggaaaggaaattgctcaaactttgggcatctcggtcaaaggggtagattatcacatgaacaaggcccttaaggaacttcgtgctgccctcaaagactacctccctatcttaacttggctctgttttatgaacccaatcaataaagtgtggatttcttaa

SEQ ID NO: 4289 - DNA, 1320 bp, B.fragilis
aaactaaccgccatgcctaccattttagaacgtctgaccgcattgttcagccgggatatgcgggccgtcctccgcaatccgcgtgccatcagtatgattgagaatccttccatacgggtccagatggccgccatccggagggataaaagtgtcatctgctttatagacaagccggtggaaaaagtacagctcgccgcagtcgggaatgcaccacacaacatccacttcatcgcttcgcccggtgagaaggtacaactatccgtcatccggcataaaccgggctatatcggttttatttccaaccctacggaaaaagcgcaactgacagccgttgaaaggaggcctgaatgtatctccctgataagcaagcctgcggtaaaggtacagttaatggctgttctgaaagatccggcacatattgcctccatcaaagaaccggccgaaaaggtacagctggcggccgtgcagaagaacccggaatacatccgccacattgaatcacctacggtgaaagtacagcatatggctatccaaggcaacgcggataccctgcggcacatcaagtccccggcagataccgtacagttggcggcagtccaagccaaaggagaaaccatcaggtatgtgtccgaaccatcggaggctgtacagctggccgctgtcaggaacaatccaatgaatatccggtatattgagaaccctacggaaaaggttcagctgtctgtcctgcatgccgatagggaggcggctgcgcttatccattttccttcggatgaagtgaggaagcaggccgaagagatgtacgggctgaaactggagaagccggcggaccgggaagcggagccgtcatccgaagcgccggaatcttccgcaacacggcgcacacccagaaaaaagaccgaacagagtacgcaatccacgcgaaaaccttccgccaggcaggttaagacggcaataaccaaactggataaggagatccgggaaatccgggaactcccacagggtaaggacagggaacaaagacttatcaaggcctttgaggaattcaattcatccgccgtccccgaaaagaaagggtgcgacgtggagagcatcctcaaggaccttcgcgggaagggagtcaaggtggaagccatgaaagctgaagagtggcactccctgatgaatggaaaggccatacagccctcccttatatccggagcgtccaagccggccgcaaagggagcctccttcatgcttaccaagactccggtcgggtatgcggtaaaagctgtgaatacggtcaacagcctaacccgacaggccagtgccgacatgtaa

SEQ ID NO: 4290 - DNA, 3684 bp, B.fragilis
gtaaacaagtatttctctttaatgaccaatcaagtaacatacttattctttcatgggatgaaacagatatccgaaaatcttttcacaaccgaggagcaggcaatcatagcccgcagtaaggcggaaggcagttacatgaaagctccgaacggacaggcaaccaacctgaatgaaaagcagtgggcacaggtacgtacccgggcattcagggagtggttcggggattgggaaaacaatccgaatgaagcatccaaggtcagagatgccaatggggagcctctggtggtgtatcatggcactccgatttcacgggatcaggcggctgacaggagtaaattcagaattgccgatgattgggagattcaaacaattaacgcacctttccatacgttcaggggtggtgcatacaatggactgatctttacctctttgacggaagaaaaagccagaagtatcggtgaaacgcgcagcatgagcatcccggacagtgaagacggcagggagcagtggaccacagacagttatgtgtatgacctcttcgtcaatgccgggaaaccatttgacgtaaagaatccaaatgccgtaaaagatgtcctggacgcattgaaaggacagctcacggcctatgatttctatcttggcatggaagttcccgtttcccgggaagaggcggaaaagatattggaagggggaaattcatggcgtgtggttgagacaccttccatgcaggaaatcatccggtcacggggatatgacgccatccatgccttggatgaaggtgttcaatatatggctgtattcgctccaaaccaattgaaggcatccggtaaatatttatattccgaacggaacacaggcgttttttcaccgggcaacaacgacatacgtttccgggaagtccatcatggcgcccccgcctcctttaccggttacaggagtatgaaaacggaaacggtccgcgatgacaatattcctgccgtcttagctgccctccgtgataagctggaggatacggaacaggaatggcaggacaggattcttgattatatcgcagagaattatcctacacaagcgaccgtttccgcacagacaagatctccggaaggactgaaggagagggaggcaatgaaaaaagataaaacactcatgaagatgaaagaagaagccgttgcagcattgaatgccgctgatgaaaaagtaatggaagcgttcaaaaaagagaatggtgatatactctttcgtgaggtcaaaggaaaagacggcggcaagtctttggtaggcctgcataatatcactgaggagaagttgcttaaagccttgaaacttgggggacttgccaatcccagcgccgccgtgatcgatatagccaggcagtcacatgaaggatacggcgagatctccctgatactcccttcttccatgattgacaaacgtaccggaaggaatgccggaacattcagcggggacgcgtggacccccgtctatccgcaaatagaaaggcagttttccggtgacggtagcgggcgtgtccgggatgccatttccaggctgccgcaagagatgaaaccgaatgtacgcagtacctggaacagctacatggacgggcgcgacgaggggagtgcgttcgcttatcagtttttatatgaaaggggcgaggcacccgaattcaggaaggtggagccgctctttggggaacatctgcggaaccggatatccgccatcgacgcgctcgatgactatgatgaacgcaacacggccctgttggaggtttatatagaagagaatttcggtggtgatcagacaaaattcaaagattatatcgaaacaaggaaacgggtattacaggataaaatacaagcgttcccggaacaaaaacaaaaaggtttggcttacagaaaagcggtccagaagctgaatgatatagaagaaaggggctatgaatacagttccgtacaagacttctatgacagggtgaaggcagatatccgccaggccggcagtgttgatacctaccataccctgcaggatgccttggataagatcgacggatcggaagcgctgagcaggcagtatgcggagtggaaggaaagccttgcggacaaatacggtatcaaggaggtacttttcaaaggttatactccggatggtatcaggatctatcttccccataccctggagaatgtctccgggttaatgaaacggcagggcctggccgccgcaaccggctggggaggctccttctctgaattcgcggccgctcttatgaagccggtcggcacactggacggtattcgccggcagaaaggaagactgaccactgaccatagtgatctggaggcattcagggacaaatggcaggaggtctattttaatctgggaatcaagcttaacccgggcggcggcacctttgatgataccggcctttaccgtgtgggggatatcgcgctgaaacctgatcccgggagttttgccaaacgtgagtacggggtggaacttaccggggaggatgtacggcaacttaaagagatggttgatgccatacaaaatgaatatcccgccatgtattttgagaccaaattcgagcgtccggtctatttgaatgaatttgtagcagcggtcgtgccggagaatgtaagtgaagacgtttccaaagcggtccgtgaaagcgggctgcaagtgtttgtttataaacccaaggatgaatcctcgagaaacgaggctgtgaaactggcgtcggaaattaaaggtgtacggttccggcttgcgggtgggacgggagccttcactcctgcctgtacagcaagcgggcaggttttcctttccgatgaacggatggcggaactctcccgccatgccgttttcctggcccgcaaacagcacatccccgtgaacatcatccattccatcggcgaggtggattctcccaaagtacgtgcccttattgcgggcgggaaggatataaggggctggtatgacatcccttcggaccgtatctgcctgtacctgcccaaagcgcgcggcaaggaggatatcgagcgtaccctgctgcacgaaggagtggggcattacggcttgcgcagactggccgggtggaagcatatggacgcgttcctagatgacatcttcgccggatgcggggaaaaggtgcgcggggagattatccggctggccggtacgggaaaaatggatatacgtaccgctacggaagaatacctggcacaaatggctgaaagcgggacggatgcccgtgtatgggacaagatccgccttgccttcaggaaccttctgcggaagttaggtttcagcatcgaggttgatgacagggagctgaagggtctgctcgcggccagccgggaaaacctgaagagaacggcggccacccgcataccggaaaagatacagaccccgaaaggagaacttgagcttacccccggatatgccgccggatctctcagaagtaaagacggagtccgggatgtcacaccgttcctgaaggagatgaagagggccgggctgaagccggcctccctcagtccggaggaatggaaatctcttttcagcggtaaaggaatagcgcttcccgacggcaggatgcttatggccgtaaaggaaccggccggatatggactgaagataaccgctccggctctccggagtatcaaaacggcagaaatggaaatataa

SEQ ID NO: 4291 - DNA, 2445 bp, B.fragilis
attatggattttaattcctacaaaaaagttatttcaaactgtaaccatatcgttaaagttggtatggtttcggcttatgctctttttttaggcgtaaatactgccctggcgagtgtaaccgagtacatggatcaaaaagtatcccttaagacacagaattataccattgaatctgtgattcaacaagttgagaaacaaacggattatttgtttgtatatgacaagaacgatgtggacgtaaaacgcaccgtatatgtaaatggaagcaataccgatgtaatagagctgctgaaaggcatctttgacaacaccgatattgattgcaaggtgctaggtaacaatataactctctctaaaattactaacgtagcgactagaattgctcaacaagacaagaaaacagccaaaggtaacgttatcgattctactggtgaaccggtaatcggtgcttcagtagtagagcaaggtactaccaacggcactgtgaccgacatcaacggtaactttacactgaatttgagtaccccaaatgccaaaattgaaatttctttcatcggctacaaaactcaggtactgactgcccaatttggcaaacagatggctgtaaagctggtggacgataccgaattgctggacgaagttgttgtagtaggttacggttcgcagaagaaagttaacatgaccggtgctgttgctacgattgactctaaatcattggcttctagaccaatatccaatatatctcagggattgcaaggtttagcaccgggtgtaactgtaaccaatgccggcggtcagccaggtcaggataccggtaaaattctaatccgtggtttgggttcattcaatgcttcttctccgatggttttgattgacggtgtagaaggcgatatgaacgtggttgacccgagcgatatcgaaagcatctctgtattgaaggatgcttcttcagctgccatctacggttcgaaagctgctaacggtgtaatcttgattactaccaagcgcggacagagtggtaaacccaaattgacttacagtgctttgttcggatggtcaaaacctgccgatttgatggaccgtaccaactctgctgaattggctgaattgaccaatgaagctgaatactgggatgccatctctcaaggtgcttctcctgaacaagctgaaaagagaaaaccctacactcaagaagacatccgtaaatatgccgagggttctgacccatacggtcatcccaacactgactggtacgacttgttctataccggctctggtttcatgaaccgccataacataggtatggacggtggttctgaatgggcgaagtatagagcttccctgggttatgtaaaacaagaaggtatcgttgaaaacgcttctaacagacagttcaatgttcgtaccaacttagatctgaagctgactgaacgcttgaaatcaagaatcaatctggacttcgctaatacattgatgaaagagcctactgacccgatttcttggtcaaacggagctgcttatcaagtattcagacaagtaaaccgcatctctccgatggttccttacaaaaatgaagatggtacttatggtaccattgccgatggtaaccccattgcattccaagacttgggttctaccggtgatacagacaaagattacttgaatgctttcgctgaattttcatacgatatctgggacggtttgaaaattaccgccaacggttcttacaacgtagtgaacaagagttacaagctgtacagaaaagacttgcaatataatgcaaacaaatatgacggtccaatccgcctgactaagagccacactaaggaaatccgcagacaaggtgatatcttgttgaactacgacaagaccttcgcccagaagcacaccgtaaacactttggctggtttccacacagaactctattcttatgaatatgatgatgcttacagacaaaacttcccgtcgtcagacgtaactgatatgaatgggggttcagagcaggtattatcacctgtgggacaactttgcaataagaccgtgctccccccggcgcacaaatgcacccccaccgtttgtcccccgtttctgaaaaaagaaacgaccgtagccgacggggttggtctcccccgccgccgtcaatgggaacgcaataaccctcacccctggagggaagcggggggcgcttcaaaacgggcctacgcggcacgtttgggcgagactcggatgaagcgggcaaagccggggtcgcaccccaccctcaagagtcacttcccgcccatggcgcgggaccgcccgtggggggggagatctaccgaccccaaacaacatttcgagttgatccagatctccgttttgcgggggcgccaatcaacctgcgacagtgggggggtcgaccccgccggggatgtcgacggagaacaagaacgatgcatgaggttgtag

SEQ ID NO: 4292 - DNA, 423 bp, B.fragilis
ccccaaacaaaccatgttatgttgaatgaaaacaaccggtcctcggaccggatcctgaccgagaggatcctggacgatccagacatgatcctgaaaattgagaatccttccctgaagcagcagatggctgccgtacagaagaaacctgagctgatcgccagcttgccgcttgcgggagaaaaggtgcagcttgcggcggttatcgcctgcccggaaagcatcctgcttgtagatactcccgcacctgccgcctgcttcatggccgtggaacggatgctcaaggaggaacttcttcccgtgccgggtgtcctgaatgcggcaagggagctgatactgcagatgaagaaggataaagccgatggaaaatcgagcggggccgccattgagaaattcctggatgaagtcaaacccattaaaaactaa

SEQ ID NO: 4293 - DNA, 255 bp, B.fragilis
aaaatgcctgagcctatccggccggacacaaaaaacggcaaggtactgaacttactgcctaatgttattttttatggtatctttttattattctacaattcgcgatcgtttttccaaactgttgtggatcctagattgaatcatattctatacaaaaatgtaatatatattgttataagaaaaaattttgtgagagcccccaatgattggcatcgcaacagcttcaattgtcagccgcttgatatcaccgaataa

SEQ ID NO: 4294 - DNA, 963 bp, B.fragilis
agaattatggacgacgaattattaatagcttattttaaaggagaggtttcggatgaagaaactcaacgaattactgaatggatagaagcggagatagaacaccagcgttactaccaacagctttgccgtctgtttgaaatgagttactggattgaggacatgcccgaacaaacagaagttgccctcccccaaaaagctaaaatcctcccgtggaaacattatgccatatctttcatgaaggtagcggctatcttcgtgctgggctttgccctgcacttcttcttgaaccggcagacaacaacaacccaccacgaactacaacaccaaatccatgtaccaactggacagcatgtagaaataatgctggccgacggatccaaggtatggctgaactccggcagtaccctgaccttcccctcgaaatttaacggaaaaaaacgcctggtagaacttgacggtgaaggattcttcgaagtaaaatccgacaaggagcatccctttatcgtttctacttctaaatatcaagtaaaagcggtaggtacttcctttaatgtatacgactatcaggattctcctcaatttgaagcggccctattgaacggtaaagtggaagtcactactaatgcaaaaaaatcatcggccgtaattcttacccccaaccagcgtgcagcgctatgccaaggagtattgaaggtcaaaccgattgaaaatactaacaattatctgtggcgcaaagggatactctattttaacgaacctctgttggaagtgttcgacaaactgcaagaatactatgatgttgaattccaaatcagaaatacttctttaaccagaaaatcaccctactgcaccggtaagttccgtgccaaagatggactggaacacatcatacgagtgctgaaagaaaccaatcattttgactatcaaattgattacgaaaataaaaaaattatcatcttataa

SEQ ID NO: 4295 - DNA, 360 bp, B.fragilis
attatgaatatggataagaatgattctttcgacgggcccctgcaggagggcagacatacgaccctgcgttccttttcctggggaaacagggagtttaccatttcctcagacaaaatcagcctgtatgtggggggcataccctatgacacgaagccgatgctggatattctccgcggatccggagtagatcccgggaaactctctcccgccaggtggatctctttgctccgggggcagcctacacgcctgccgggttgtgaaaagcccttcatgctggtcaaagccccatccggatatactctcaagtgccctggaaataacccaggggcaggaacaaggcttttccaaccggaaatgtag

SEQ ID NO: 4296 - DNA, 1647 bp, B.fragilis
ttagtcgataccatgaaaaaagccgtaattctattttcgcttttctgttttctgtgtgctataccggtagttcaagcagcagataccatttttgttcgtgaaacacgtattcctattttgatagaaaggcaggataatgtcttattctatctccgtttggatgctaaagagagccagaccctgaacgatgtagtgttaaacttgggtgaaggagtgaatctttctgaaattcagtccataaagctttattatggaggtactgaagcattgcaggatagtggtaaaaaacgttttgctcctgttggatatatttccagtaacactccggggaaaacacttgccgccaatccgtcttattcaatcaaaaaatcggaggtgactaatcccggtaatcaggttgttctgaaaggagatcagaaactgtttcccggaatcaattatttctggattagtttgcaaatgaagccgggcacttcgcttaccagcaaggtgaccgcggatatcgcttcaattactttggatggcaaaaaagccctgttggatgtagtttcagaaaatgggatagaacaccgtatgggagtaggagtgcgccatgccggagacgataattctgccgcattccgtattccgggattggtgactactaataaaggtacgttactgggagtttatgatgtacgttataacagtagtgttgacttgcaggagcatgttgatgttggtttaagccgcagtacagatggtggaaaaacttgggaaaaaatgcgtttgcctttggcttttggagaattcggtggtttgcctgccggtcagaatggggtaggagacccttctattcttgttgatacaaaaacaaataatgtttgggtggttgctgcctggacacatggtatgggtaatcagcgggcatggtggagttcacatccgggtatggatatgaaccatacagcacaacttgttttagctaaaagtacagatgatggtaaaacatggtctgcacctattaatattacagagcaggtgaaagatccttcttggtatttcttgttgcagggaccgggtaggggtatcactatgagtgacggtactttggtattcccaactcagtttatcgattcgacacgtgtgcccaatgccggtattatgtacagtaaagatggtggcaagaactggaagatgcacaattatgcacgtacgaacaccacagaagcccaggtagctgaggtcgaacccggagtgttgatgttgaatatgcgtgataatcgcggaggaagccgcgctgtggctattacaaaagatttgggtaaaacatggacggaacatgaatcttctcgtaaggcattgccggaatctgtttgtatggctagtttgatcagtgtgaaagcaaaagataatgtgttgggcaaggatttattgattttctctaatcctaatacgacaaaaggacgctataatactactattaaaataagtttggatggcggtgtgacttggtcacccgaacatcagctgttgttggatgaaggcaataactggggttattcttgcctctctatgattgataaagagacgattggtattctttatgaaagtagtgtggcgcacatgacattccaggctgtgaagttgaaagacattattaaatga

SEQ ID NO: 4297 - DNA, 1599 bp, B.fragilis
ttatatatgactaatacaaatagcattatgaagaaaatatttacatatatgttagcagggctttctctcctgctgttttcaagatgtgatgcgctggatattgatcctaccagttctattgcagatagtaattactggaagacagaggcccagttcagcacttttaatgtggggttgcacgcattgcttagagaatgcagctttaactttttcttgttaggtgagcctcgtgcagatatttacggagatgttcctttcggaggagaagcaactcaaggtatggagcgtctgcctttcaatacaatcaataaagagaatacaggaataagcaacttcgcaggaatgtacaaagtgatcaatcagatcaatctgatgatagccaaaacaaaggaaacgacagtactctccgaagctggtaaaaactattacttaggcgaagcttatggaatgcgtgcttatctttatttccatttgctacgctcttggggagatgttatcctctatcttgactatacgaatggggcttctttggatttaagcaatctatcaaaagcagcttctcctgcggaggaggtgatgaaacaaatcaaagaagacattacagcgtccgaaaaaggatttggcagcgattattctttcaaatatggcagatattactggtcgatggctgctacacagatgttaaaaggtgaggtttatttatggagtggtcgccaaatgggtggcggtacagccgactatactacagccaaaactgctttgcaatcaattgtcagcaatgcaaatgttagtttgcaagatgatttctcaaaagtatttgcttataacaataaagacaactctgaaatcattttctcaatacgtaacgctaaagacgagtataatatgtgggacgataaattcagacagaacctggtgccccaacaagcatatatgacctctacttattgcaataaagagggagtgtcatttaaagatttgcccgaaggacaattgaacggtttgattcgtctacagataagatatgatttgtacaataaagcattccgcgatggagacacccgtaaagatgcttctatgacggcagtctaccagaaacagcaggatggtacagttaaatatattgctccattttgtaataaataccagggagttctacttgatggagcttcacaacgtagcttcttgaatgattatccaatctaccgatatgccgactgcctgttattgcttgctgaggctaaagcattgttgggtgaggatcctactgccgaaattaatcaggtccgtgaacgtgcttatggaaaagaattctttgaaaccaacaaagctacattggcttatcccaatgataaaggagacttctatacagataataaatatatgtccggcgacgaagatcctttggaagctattttgaaagaacgtatgcgtgagtttatgtttgagggaaaacgttggtatgacttaagattgcttggtgcagactatgtgactaaacgtacttcagccgttgctacccgcttattatggccgatcaacgaaagtgtattgacagataatccggcattaaaacaaactccgggatatcagaattga

SEQ ID NO: 4298 - DNA, 282 bp, B.fragilis
gatcgtcgcgctgctgtagatgcaatcaacggagtcaacatagatctatcgccgccgtcgatggccggcgccgtcggtatgcgcgagtggccgcacctcctcatagtcctctcagtggaggaagaacctgacggtaggtcacggctgtttgcgcttgctgcgtgggttcatgaaaggccatccgcattcactaaagatgcgtgtgcagccacccgcgacaccgctccgcgtgcggctggaaaaacactccattccgcccaattgttgatgaaaacaagatag

SEQ ID NO: 4299 - DNA, 3252 bp, B.fragilis
gactgtactcattttcaggtatttatatttatggagtttagaagagataattttccttttttattaactaaaaatcaatttatgaaaaaagtcctttttattttgttgggctgtttgctatcgtttaatgtgatggcacaggtaaaggcgatttcgggactggtaacagatgttactggggagcccgttattggggcaagtgttgtagaagtgggaaccactaatggagtaattactgatttaaacggtaagttctcgttaaaggtggcacctaattcacaattcttggtgagctatattggctacaagcaacaaacaattaaagttggctctgaaagcacttataatattgtgctgaaagaggatgcggaggttttggatgaagttgttgtagtcggttatggttcgcaaaagaaggtgaacgttacaggggctgtaggtatggttagtgccgaggcgttggaagcgcgtccggtggcaaatgcttcacaagcattgcagggtgttgttcccggcttgaaccttactgttggtaataacggtggtgcccttgatggaacgttaaacatgaatattcgtggagccggaacgattggtgatggatcgggttcttctccattggttttgattgatggcattgagggtgatctgaatactgtcaatcccaatgatatcgaatctgtttcggtattgaaggatgctgcatcggcttctatttatggtgcaagagcttcattcggtgtaattcttgtaacaacgaagagtggtaagagcggtaagaccaatgtgtcatatagcggtagtgctcgtttctcagacgctattggtgtaccggatattatggattcttacacttttgctcagtacttcaatcgtgcttctgccaataagggtggtggtgacatttttgcccctgctgtaatggagcgtatcaaagcttatcaagagggaacgctgaaagctactactgttgataatggagcaggcatttggcaaaaatgggctaacgcgaatggagatacggattggtttgaagaattctatgatcattgggcaccatctcaggagcataatcttagtattaatggtggtacggataagactcaatacctgatcagcggaagtttcctggatcagaaaggtttgatgcgtcatggaaaagacaaatttcaacgctacacgctgaacggtaagattacaacggctgtcactgattggtttaaggtgacatattctactaaatggacccgtgaggattttgagcgtccttcttatctgaccggaaactttttccataacttagctcgtaaatggcctgtacatccggcttatgatccgaatggattccctatggatgagggcgaagtggagcagatggaaaatggtggaaagcaaaacagtcagaaagatttttatacgaatcagttgcaactggttttcgaacctattaaaaactggaaaatcaatcttgacggtagtgtacgtaccactactcaatatcagcattgggaagtattgcctgtttatgcttataatgtagccggagatccttattatacagtgtgggatatgggatatggttcttatgcggcaggttcttctcgagtgaatgaatatagttggaaggaaaattattatactacaaatatttattcggattatttcaagcagttcgataacggacattattttaaagtgatggccggttttaatgcagagttatataaaaccagaaacattacggctgaaaaaaatactttgattaccccgggggtacctactattaatacggcaactgatgatccgcaggcttatggtggttatgctgacaactcagtagccggtttctttgcgcgtgttaactggagttataaagaccgttatatgtttgaggctaatggtcgatatgatggttcttcccgcttcgtaggaaaagaacgttggggattcttcccatcattctctgccggttggaatattgctcgcgaaccatttatggaaagttttgctgaaaagatcaatatgggaagtttaaagttgagagcttcttgggggcagctgggtaatacgaataccaatgatgcgtggtatccattttatcaaacgatgcctgtagggtctaattacggctggctagtaaatggcgaacgtcctaactatgctacaaatccgggtattgtcagctctaagaaaacttgggagacagtggagacttgggatgtcggtttggattggtctttcttcaataaccgtttatccggttcattcgactatttcgtacgttatacttatgatatgatcggcccggctcccgaactttcaagtttgttgggaacttcagttccgaagattaacaactcggacatgaaatcgtatggttttgagttggaggtaaattggagagatcggatcggtgaagtttcttatggagcaaaatttgtactttctgatgaccaacagaagattctgcgctatccgaatgactcgtatgatgtaggttcgtattataaaggtgaacatttgaacgatatttggggattgacaacaatcggtattgctaaatcacaggaagagatggatgctcatttggcaaaagtcgatcaatcttctgttggaaccaattggggtgtcggtgatattatgtatgccgatttggatggtgacggaaaaatcagtaacggaaccaataaattaggagatacgggcgattatcgtattatcggtaattcgactcctcgttttaaatatggtattacactggatgctgcctggaaaggattcgatttcagcatttttatgcaggggatcggaaaacgtgacctatggctggacggatgttatttctggggagccaacggacaaggaaatgagtggcagtctaccggctttgccgaacattgggatttcttccgtccggagggtgacccgttaggtgctaatttgaattcatattatccgcgcgtcaactttagtggggatcgtaataccaaggttcagacgcgttatttacagaatggggcatatctgcgtttgaagaatgttcagttgggttatacattgcctcgggtatggacagagaaagccggaatatcttctgtacgtgtatatgtttcgggtgataacctggcaactataaccagtctttctaagattttcgatccggaagctaccggaagtttggccggaacaggatccggtaagttgtatcctttgcaaagagtgatatctgttggtgttaacgttaatttttaa

SEQ ID NO: 4300 - DNA, 2586 bp, B.fragilis
aaaagtgagcagtttatgatgaaaaagttattgtatggacttgtatgttgttgcagtttagcctatgggcaaaaccaagacacttcggatgtgttaatgctgaatgacgattggtcgttttcacaggtaggaacagaaaaatggctgacagctactgttccgggcacagttcatcaggatttgattcatcataaactgctacctgatccgttctatgggaccaatgaaaaaaagattcagtgggtggaggacgaagattgggaatataaaacttgttttgtcgttacagaggaacaattaaagagggatgccgcccagcttttctttgagggattggatacctatgctgacgtttatctgaacggttctttggttttgaaatcagataacatgtttgtgggttatgcggttcctgtaaaacaggtgttacgtaaaggtgagaatttgctgcatgtctattttcattctcctataaaacaaactcttccacaatggtcatccaatggatttaattatccggctgataatgatcaccacgaaaagcgtcttagtgtatttactagaaaagcaccttatagttatggatgggactggggaatccgcatggttacaagcggtatctggcgtcctgtgactcttcgtttttatgatgttgccactattgccgattatcatgtgaaacagttgagcctgacagatcaagtcgcaaaactttctaatgaattggaaattaatagcatttcagagaaggaaaaatctgctgaggttttgatctcttattcattgcaaggagggaaagaagtaacagtaaaggagaacgtgacgttaaaaccgggtttaaataagattcatattccgttggatattcagaaccctgtgcgttggatgcccaatggatggggagaacctcatttatatgatttctcagcacaagtgatatgtgacggtaaaacaattgcctcgcgccagcatcgcatcggacttcgtacgatacgggtggtaaacgaaaaagataaagagggagaatctttttattttgaagtgaatggtatcccgatgtttgccaaaggagccaattatatccctgatgatgcattgcttccctgtataaccactgagcgttataagactctgttccgggacatgaaagaggccaatatgaatatggtacgtatatgggggggaggaacttatgaggatgatcgtttctatgatctggcagatgaaaatggtattcttgtttggcaggattttatgtttgcttgtactgcttatcccagcgatcctactttcttgaagcgggtagaagaagaggctgaatataatatcaaacgtctgcgcaaccatgcttcattggccatgtggtgtggaaataatgagattctggaaggattgaaatattggggatggcagaaaaactatactccggaagtgtatgaaaatatgttccgggggtatgataagttgttccggggattacttcctgccaaagtacaggaactcgatgaaggtcgtttttacaagcattcttctccttattttgcaaattggggacgtccggagtcatggggcataggtgacagtcataattggggagtgtggtacggcaaaaaaacattcgaatcattagacacggatttaccgcgatttatgagtgaatttggtttccagtcgttcccggaaatgaagacgattgctacatttgctgctccggaagactatcagattgaatcggaagtgatgaatgggcatcagaaaagcagtattggtaatgacttgatacgtacctatatggaacgtgattatatcgttcctgagaaatttgaagactttgtgtatatcggacttgtgcttcagggacacggcatgcgtcatgggatggaagcacatcgtcgtaaccgcccttattgtatggggacattatattggcagcttaatgatagctggccggtagtttcctggtccagtatagactattatggcaattggaaagcgttgcattatcaggcaaagcgtgcttttgcgccgttactggtcaatgcaatacaggaaggcgatagcttgaatatttatctgatatccgatatgttggaaaagcagagtcagcttacacttgaaatgaaagtcattgattttaatggcaagacattagacaaagaagtcatcaaggcagttgaggtagcgatgaatacttcttcttgtatcgtgcgtaaaccgttggacacttgggtgaatccggaacagcgaaagagcagttttctactacttagcctgaaagataaatcgggtaggaaagtggctgaagaagtttatttctttgataaaaccaagaatttggagttgcctcagacagctatttccatgaaagtgaaacaactcgatgggaagtgtgaactgaccttgtcatctcctaaactggcaaaagatgtctttgtccagattcctgttcaaggagcccgtttcactgataatttcttcgatctgttgccgggtgaaaacaaaaaaataacgataacgtctccggagattaagaagggagaaagcttgaatatcacagtgaaacatgtacgagatacctataactaa

SEQ ID NO: 4301 - DNA, 1650 bp, B.fragilis
aagataataaatatgaaaagagcaaaatctacaatattatatagtttgttggttgcctttgtcggagtattatatacttcttgtgctgacaaattagatctttctccaatagactactatggaagtggttcatattggaaaacagaagcgcatgtaatcgggtatatggatggtatccacaagcacttgcgtgatgcaactttccaacatacgtttatttggggggaagctcgaggtggagctttaattacttctggtactagtgccgatggtatgggtatgctatatggtgatattaaacttcaaaattttgatgaagatcatacaggagggatcaaaaaatttggtgatatttttggtcgtctaacaaacttaaatctttttattgcaagagtaacagatgctacttatatggatgatgtcaaaaagggatattatcttggacaagcttatggcttaagggcattttattatttcgatttatatcgtacctatggcggtgtgcctctacgtttgactgctgatgtggtagaaggggttattgatcctaataaactttatatggcacgtgccactcctaaagaagttatggatcaaataaaaaaggatttggataaatcaatggaatcttttggagataataattcgtttgatcctaataatcgtggaaataaaaaagggtattggtcaaaagctgcaaccgaatgtttaatgggggaggtctatttatggatttcaaaagtgtcgacaggagatgatgctgccaatgaggccaatctggagatagccaaaacacatttgcaaaatgtcatcaacaattacggtctaaaaatgttagacgatttttcgtcagtattcgatgccaaaaatggtaagggaaactctgaaattatttttgctgtcagatatatggaaggcgaagctggcaataataacaacttattcacttatgctatggctacaggtagtacgaaagacaattatctggctaatggcgagaaattcctggatgctttgaatattgcaaatacgggcagtcagcagttggaatacaaacatgaaatttataatagttttgatgtggctgacacacgtcgtgaagccacattcattgcttcatattctaaaaatactgaaaccaaagagttaactttaagaggaacacacgttcgcaaaaacatcggttatgtgaatgctcaaggtagtcgtatctattgtggggattatattatttatcgtctacctctcgtatatttaatgcttgccgaaattgagaatatgcagggaggagatgttgccaaatatattaacttagttcgtgaacgtgcttatagcaccaattgggataaggcgatttatgggtatacaaatgccgatttcacaactaatgaattggccattcttcatgaaaaggataaagagtttattcaggaaggacagcgttggtgggatattcgccgaatgacgttaactaaggggggcaaacatcttgtctttgtcaaagaaggtagtatcggaacagatatgcctactttagatgaagcgactgaagcgcataaagtcctttggccggtagataaagatttgttgggtaatgaccctttaatttaccagaccccgggatatgcaacttataaaaaagcagaatag

SEQ ID NO: 4302 - DNA, 2076 bp, B.fragilis
gcaatgataaagatactattcttatctctgttcttgatggtatgcaccattttatccgcacagaagcgggtgaaagtggcttgtgtagggaatagtattacatacggatatactcttccgaatcctgcaacggactcttacccatcacagttgcaacaactcctaggggagacttacgaagttggaaatttcgggaaatcaggagctaccttattgaataagggacatcgtccttacatgcagcaagaagattttaaaaaggcaattgcttttgccggtgatattgttgttatccatttgggtattaatgatacggatccacgtgattggccgaactatcgtgacagtttcgtgaaagattatctggcgttgattgattctttcagagttgctaatcctaaatgtcatattattattgcccgtttgacaccgatcgctgaccgtcatcctcgttttgagtcaggtacccgtgattggcatggagaaattcaacaaagtattgagacgatagctaaatatgcaggagttcagttaatggatttccatgaaccgctttatccttacccctatcttcttccggatgctgtacatcctaacgtagagggagccggtattcttgcaaaaacggtatattcggcgattacaggagattttggagggttacatctatctgagttgtatactgataacatggtacttcaacacggagagccgttggctatccgaggcaaagcaaatgcgggtgaaaaagtgactgtttcaatagctaaacagaagttgactgcaaaggctgcttccaatggagactggactgtcaccattcagccgttaaaggccggtggtccatatacactgactgtctctgccggaaaacagaaacaaacattcaataatgttttggccggagaagtgtggctttgttccggacaatctaacatggaattttatttgagttggagtaaaacggctaaaagagatattccgcaggctgctaatgatcagattcgtttgttcgatatgaaggcacgctggcgtacggacgcagtggagtgggatgcatccgtattggattcgttgaatcatttgcagtattataaagataccgaatggacggtttgttcacctgcaacagcaggttctttttctgctgtggcctattattttggcaaaatgctgcaggatagcctgaaagtgcctgtaggattgatttgtaatgcgattggtggttcgcctactgaagcatgggttgatcgcagtacattggagtataagttccctgctatattacgtaactggactcaaaatgactttattcaggattgggtgcgcggtcgcgctgctcttaatgtgaaaaaggctactaataagcagcaacgtcatccttacgaaccttgttatttatatgaggcaggtattcgtcctttggagcaatatcctattaaaggcatcatctggtatcagggtgaatcgaatgcacataatcgtgaggcacacgagaaattgtttaagctcttggttgagagctggcgtaaaaactgggaaaatgagaatttacctttttattatgtacagttgtcaagtatcaaccgtccgtcatggccctggttccgtgatagccagcgtagaatgatgtatgaaatacctcatacgggtatggcggtatcgagtgacctgggtgattcacttgatgtgcatcccaaacataagcagccggtaggcgagcgtttggctcattgggctttgaatcaaacttatggaaagaagaatgttacaccttcgggaccaatgttccgtaatgtagagtttcgtgatggcgctgcttatgtatcattcgattgtgccgaggggatgcatgcatcggacggaaagccgttacagacattcgaagtggcagaaacagaggatatttattatccggccacagccgaaatcgtaggaaatcaaattaaagtatatagtaaagaagtgaaaaatcctcttcacgtgcgttacggttggcaaccttttacccgtgccaatctagtcaacggtgacggtttaccggcgtctacgttccgtacggactggggaaaataa

SEQ ID NO: 4303 - DNA, 1566 bp, B.fragilis
attatgaaaaaaataatatatatcatttccttatttgtatcatctgttctttatacgtcatgtgatgcgttggaccttgctcccgaagattatttcggaagtggtaattactggaataatgaagcccaggtagaaggattcatgtacggaatgcactctcaattgagaggaaactataacatgttttattgcttgggagaactgcgtggtggtacacaacgcgttggtagctcttctcaaaatacgagtttggactacgctatactgcgtaccaataccttaagtcaagataatccgggattcactaactggtttggactatacagtcctattatgcaagtaaatcactttattcaaaaagttgaaaatgagtgtgctttcctaagtgaagcagatagaaaaacctacttaggacaggcatacggtttgagagcactttattattttatgctttataaaacttatggtggtgtacctatagttacaactgtagagttgttggatggtaaagttactgcggacaaattctacgttgaacgtgctaccccggaagctactttatctttcataaaagaagatatcggaaaatcagaaagttattttggcacaacggaaataaataacaagcatgataaaacaatgtggtccaaagctgcaaccttaatgttaaaagccgaaatctatatgtgggctgcaaaagtttccattaatggttatactgcttccggaaaatctgatttggagatcgccaaaaacgccttaaatgggataattggtaaattccagctattgaataagtttagtgatgtgttcagtacttccaatagaaacaatgctgaggttattttcactttacattttgcagatggtgaggcaaccaattggggaggtatgtttctttatcaggatgcggtgttcattggacaggtttacggtcgcgatgacaagaaaatcgaaacagatacattaaatctgaaaggcacaggcggcgttttccgccatgaatacacagaagatttctggaaaagttacgatgaaaaagatactcgccgtgatgcgacattcttagagtattatactaaaaagaacaaggaaggttttggctgcgtcatgcagaaagctatcggttctatcaattcaaataataaccgtatttacgataccgatttcattgtctatcgttatgctgatgctctgttaatgatggctgaagtcgaaaatggtcttggaaatccatgtgccggctatatcaacgaagtacgtaaacgtgcatatggctccgattatgaagctaataaatatactgaaggaaattatgcggaaaacgaattagccattctccatgaacgtgataaagagtttgtttgggaaggtaaacgttggtttgatgtggttcgtatgcatgatgccaacggtaagtctctggcattttctgctacggctaattatccggcagacaaatcgattttggatccgagtgaagaatacaagctgttatggcctattgatgtagatgtcatgagtgtcaatcccttgctgaaacagacccccggatatgaaaaataa

SEQ ID NO: 4304 - DNA, 195 bp, B.fragilis
cacacagaaaacagaaaagcgaaaatagaattacggcttttttcatggtatcgactaattaatatttatgttatcgggagcaaagatagtattttttattatataacggttatgttaattaaatattttattatatacggtcgatttaataaacaagacactattcgacgcaaagcattaaaccatcggaaataa

SEQ ID NO: 4305 - DNA, 2022 bp, B.fragilis
agtattatgaagcttaaaataaaaaatctgtttgtacaagcatgttttgttgcgggaggggtaatggcgctcacgtcctgtaatgactttcttgatagagaacctctttcttctgtcacaccggaagtctactttcaaacggtggatcactttgccgcttattccatagcgaggtatcaaaactattttccttcgcatggtggttatggagcaggtatagcgaataacgatggtggaacggataatatggtggccggagggcgtagtagtcgctatgtaaaagggctttggaaagttccttccagtgatggtaactggagtttcagcaatatccgttattgcaactacttctttgagaatgctgtgcctaaatatgaagcgggtgaggttgccggagcagatgccgatattcgtcattatattggcgaaatgcatctgatgcgtgctcttgtgtactataatttattgcgtacttacggtgactttccgatcgtaacagaggttttgcccgatgacaaaacggtgctgatggaaaaaggtgtccgccaacctcgtaatctggttgcccgctttatcctgaaagatttggatgatgctgccaatatgatgtacagtaagggatttaaaaataatacccgtttgaatcgtgagacagctttgctgattaaatcccgggtggcactgtatgaagcttcttttgaaagataccacaagggtacagggcgtgtaccgggagatgataactggccgggaaagaaagtacattctaatttctcattggatgtagaagctgaggttgacttcttcttgacagaagccatgaaagcagcggaagaagttgcagataaaataactttgacccctaatacaaaggttgaagatcctgctagtccttctattacatccggatggaatccttattttgaaatgtatgccaatgttgatttaagcggctatgacgaagtgttgttctggcgtcagtatgcaaaaaccggtagtttctctatcatgcatggcaccccggcatggattgcgtccggttctaatcatggcttgttgaaaagctatgttgaaagcttcttgatgcaggatggtctgccttggtatgcggccagtagcgcagcaccttataagggggatgctacattggatgatgtgaaggccaatcgcgataaccgtcttcagttgtttatgtttggtgaaagcaattttgtaccagtatattcgaccgaggaaccgggcactgtgaaaatgtttgctccgcatcctgtatctaaccgtgaagagatgagagatcagacaggatatcgtattcgtaaatatgccagctttgatatggcacagaatgtatggggaaaagctgagtcgactaccggatgtattatttatcgtggcgtagaggcttatctgaattatctggaagcttattatatgaagaatggtaacgttacaggtaaagcagctcaatattggagagccgttcgtgaacgtgcaggcgtagatcctgattttacaaaaacaatcaatgcgaccgatttgagtcaggaaacagattggggtaaatattcgggtggacaagttgtagacgccaccttattaaatattcgccgtgaacgtcgttgcgaatttattggtgaagggatgcgttgggatgatttggtacgttggcgttcaatggatcatctgctgacaaaaaattatatccctgaaggatgtaatttctgggatgaaatgtacaaatcggctaataaagatgagaatggtgctgaggttacatttaaagattctggtgaagaaggttctaatatctcttcacgctcctttaaatacctgcgtccgtatgccattttgaaaaccaataatgatgtatacgatgggtatacctggcagaaggcacattatctcaatcctgtgccggttcgtgagatggaattgctgtctccggatgaaaaagcagagacatctgtattgtatcagaatccttattggtcaactaagattggggaagtggctgaagaataa

SEQ ID NO: 4306 - DNA, 630 bp, B.fragilis
aaacgaatgaagaaaattttattaatgatgttgttgctcgcctcaatggcgagcaacgcacaggaacgcaaatattctacgttctattatcaacgtgcaactctgtttgaggagttgcctgtgacttcaaaagatatcatttttctgggtaatagcattaccaacgggggagaatggagtgaattattgaataataagcatgtcaagaaccgaggaatcagtggtgatatctgtatgggtgtttatgatcggctggatgcgattttgaaaggaaaacccgccaaaatattcttgttgatcggcataaatgatgtaagccggggcacttctgcagatacaattgtgaaccgtattggtatgattactcaaaaaattaaacaagattctccaaaaacaaagctatatttgcaaagtgtacttccggtaaccgatcattataagatgtttggcggacatacgtcacgctggcaggaagtgaaaaagatcaatgaaggactgatgtatcttgctgataaagagaatgtgacctatatcgatctttattctcattttgttgatgagaagaccgggaaaatgaatattgagtatactaatgatggtttacatttactgggaaaaggctacttataa

SEQ ID NO: 4307 - DNA, 3282 bp, B.fragilis
aaagcaatacttatgaagaaaaccatcttcttgattttgtgcattttatgttctcttggggccatggcgcaaaagaaatctatcacgggtgtgattacagatggtgccggtgagtcaatcattggtgcaagtgtcgttgaagttggtacaactaatggtaccataactgactttgacggcaagttctctttaacgatagctactggtgctaaatttacagttagctatattgggtataaatctcagacgattactgttggtgctgaaaatacctataatatagtactgaaggaagacacagaagtgttggatgaagtagtgataacaggatatggaggttcacaaaagcgtgctactttgactactgctatctctaaattggataactcggtacttaaaaatgcggctttcagcaacgcaggacaatccttgcaaggctctgtaacaggactccgtgttgttaacaaaacaggtcaacccggtagtgaaccggatattacattacgtggtggtgccactattacaggtgataatagtaaagcacttatcgtagtcgatggtattgtccgcaatagcatgagcgatatcaatccttccgatattgagtcgattcaagtccttaaagatgctgcttcaaccgctatttatggagcgcgtgccaatggcggtgttattttggttgagactaaaagtggtaaagaaggtaaagcatctgttaactataaattcaaaatgggtgtgaatttcgctcgtaaaggttatgacttttgcgatgcgcacgactacatctactacaatcgtttaggttacaaaagaaccggacgtaccaatgtagatacacaaatgggatatggtattggtaacaatctatttgacatccgttatttgacagatgaaaacgctaacttaaagaatgaaggttgggcttctatggcagacccattttatgatggaaaaacaattctatataaagactactcaggtgagttggatgatgttgttttcaataatagcgctttgacacaagaccattatgtaaacattacaggcggtaacgataaaggaaccttctctgccagcctaggctattacaaagaagatggtcagattagaggtaccggatacgaacgtttcaatggagcattgaacggttcgtataaagtattcccttttttgacggtaaaggcaaatgcgacttactcttggtcaactcaaccggaactctggatcggtcaatatgaatttttctaccgtacacgctctcaacgtccgacatggaacccttggaatgaagatggaactccggcctccggtttcggtacaggagacggtaatcccgattattacagagataagttgacgagcgagaacagcactaataaatcaacctacagtgttggatttgcccttgacattttacctaaaaaattagtgttaaatggcaatgcttcactttatcgttatgactggcagagagagaagtttaataaatcttatcaagctcaatcttccgcaactcctgacaatacacgccaggctgaggcttatgttcagaaatacaatcaaattcagttgaacggaacactgacatacacagatacttttgcagaaaagcataatctggaagcaatgttaggaaccgaatatttcacttatgatcagttcgattttgaagctaaaactcaaaattctccgactgatgatattcctaccttaaacgcaggctctacaagaacctatacttcaacaaccaaaacagcatatcgtattctttccggattcggacgtattaactataactacgatatgagatatttaatttcgtttgttgctcgttatgacggtatttcgaaactgaaagataatcgttggggattcttcccgggtgtgtctgtcggttggaatattatggaagaaagattctggaaagactctaagatatcaggagttatttctaacttgaagccccgtttgagctatggtgtcaatggaaatgtgaatggaatcggaaattttgatgtatatggcgcatattcacaagtaggcgcaaaaacatacggaggttcaaccgcattctacaattcaggtttggtaaacactggattacgttgggaacaaagtcagtcatttgaagcaggacttgacatcggattcttaaataatcgtttgagctttatcctcgactattataaccgtactacaaaggatttgttaaccaaacaagctcttccgggatataccggtttcacggaaatcatgaccaatatgggaactctgcgtaattatggttttgaaatggaagtcagagctaatattctgaataatccgaaagggttaacatgggatgtaacagccaacctgtcttctgttgcaaataagatcgtaaaattgccctacaatggtaatcccaataatcgtgttggtggttatgaagtagcaaccggacgtaaaaaagccgatggaacagatgaaaccaaatggatcgccggtcgtcaggaaggtggtaaactgggagaactagttgcctataaacaaaaccacatattcaaagattgggatgatgtgaaaaaatatgccaataatcgtatcgatgaggtagccaacttatatggtccgggacttgcagcccaatatgccggaaaagagggatggcaacctatcgaaccgggtgatgtttgctgggaagacattaatggcgatggtgttattaatggatacgaccgtcaagtagtaggaaatatattcccaaaagttaccggtggattctccactacattgggttataaaaacctctctttatatgcccgtttcgattatgctttaggacatacgatttataatgaccttgcagcacgttcattggggcaatatcaaggttcgttcaacatcattaaagaagttaaaaaaacatggagtgaaacaaataccgatactgatctgcctgcattctattatgccgaccagttaagtaagaagaatataacacgttcaaataatggtcttacggctattgacaataacagttcacgtttctatgaaaaaggtgactatttggcccttcgtgaactgacattgaactataatctgcctaaaacatggattagtaaagtaggcatgacagatgcctcagtttatgtaacaggtcagaatctattctatatcactggatacacaggcgtttcacctgaaccggctgtagatacgacttatggccgtggaatagataacggccgttatcctactccgagaacagttttattcggtttgtcagtgacattctaa

SEQ ID NO: 4308 - DNA, 1305 bp, B.fragilis
ggattgattagacggctccttgagcccccggtgaagactgataaaaaaacattgatgggtaatggaaattttacaggaaccgaaatatatgattaccatcgaaaaatgtatggagaagatttcacttatgcagattttgcccccatgttcaaagctcttagttatgatcccgaagaatgggctgatttatttgagcactcaggtgcgaaatatgtagtgctgacaacgaagcatcacgatggatttgccttgtggcccagtagagaggcatcaatcagttatggcagaccatggaatagtatggaaattggagcacatcgtgatttagttggggaatatgtaaatgcattacgtaaaactgatataaaagttggatgttatttctctttgagagagtgggataacccactatataataaagaaacaatggatttgttttatgaacgccattggtttccgcaattacaagatctggtaaatcgttataaaccggatctgatatgggctgacggtcccgatcagataaatgataaacagtggcaggccgaaagaacattagcttggttatattcagaatctccggtaaaggacagcatcgttgtcaatgatcgttgggctaacaataccggtaaaaaacacggtgattattacacgcgagaatatagtaataccaatagttcttacaataagccatgggaggaatgtcgtggtataggcttatcgtttggttataatcaaaatgaagatttgggagattatacttcgccgaaggctttaatattgacacttgtcaatattgtaagtcaaggagggaacttattactggatatagggccgaatgccaatggtaaaatacctcctatcatgcaggaacgtttgttgcaaattggaaaatggctgaaagtaaatggagaagcgatttatggcacacgtgcttggggcaatttttgtcagtggtccaaaggaagcaaagagtggaaatcaaaagaaaaacactacgtcagtggagatgcaatcttgaaacaaactgttgatcccgatccgggatatgcagtgaaagaggtgttttttacgaagaaagggaataatgtatatgctatcctgccacgataccccaaaaataaaattgtgttgaaagacatacagacaacaggtaggactaaaataaccctattaggatcggacaaaaaagtacaatggaaacaaaaaggtaatgatattgaagtaatcatgcctcttctatatgttgatgaactaccttgcgattatgcttgggtacttaaactggaaaagatttcagagtaa

SEQ ID NO: 4309 - DNA, 2019 bp, B.fragilis
ataccgatgagaaacaaacaaattttcttaatcagtttcattatttacttatgcacaatttcttcggttcgggcaggtgaatatcacctgctcccggaaccgcaaaagtttacccctttaggttccagttttgtgctgggcagaacaaagctttctactccggtgcttcggcaagagtgggaagcttttgttgttgataggggtggagtgattgatgacaaagctcgtgcaagtattgaagtgaaactggtaccttcgttagaagaggtacctttgaacgcagacgaagcttatcgcctggtggtaaataatggcaaagttacggttgaggctgtgacggagcatggtgtgtattgggctatgcagactttggcccagctacaggatgtacaaaagaaaaaggcaacattcaacggttgttcaattgttgactggcctgctttccgaatacgcggctttatgcaggatgtagggcgtacgtatatgtcgattgaagaattgaaacgtgaaattgctgttctttcacgatttaaaattaatgtttttcattggcatctgactgaaaatcaatcatggagattgcaaagtaaaatttttccgatgttgaatgacagtgtgaacacgactcgtatgccgggtaaatactatacattggaagaagcgaaagatttagtcgctttttgtaaagcgcataatatacttttaattccggaatttgatatgccggggcatagtggggcttttgtccgtacattccgtcatgatatgcagagcccggaaggaatgaaaattcttaaattgctggtagatgaagtttgcgagacttttgatgtaccttatcttcatattggtacggatgaagttcgatttaccaatccaaagtttgttccggaaatggtcgaatatgtccgtgccaaaggaaagaaagtcatttcgtggaatccgggatggcattataaacctggcgagattgatatgacgcatttgtggagttatcgtggaaaagcccaaaaaggtattcccgcaattgattctaagtttcattatctcaatcattttgatacttttggcgatatcattgcattgtataacagccgtatttataatgttgagcaaggaagtgacgatattgcagggacaattcttgccatctggaatgaccgttacgtagctaacgaacgcaatattatacttgagaataatttctatcctaatatgctggctattgctgaacgtgcatggaaaggcggaggtacagaatattttgataagaatggtactatcttaccttctgaaggctctccggagtttaaagaatttgctgattttgagaatcgtatgctttggcataaagagcatacatttaagggatatccgttcgcctatgtaaaacagacgaatgtaaaatggaatattactgatgcatttcctaatggtggagatttgaataaagtctttcctccggaacaggaattgaaggattcttatttatatgaaggaaaagagtatggggtacaccctgccattggtgcgggtatctatcttcgtcatgtatgggggaaaatggtacctactttctataaagatccgcaagagaatcatacggcttatgcctatacatgggtttactctccgaaagatcaggaagtagggctgtgggctgaattccagaattatggtcgttcggaaatggacctggctccattgcaaggtaaatgggactataaaggcagccgtatctggatcaataatgaagaaatacagccacctgtatggacagctactcatcgtacaaagagtaatgaaatagcgttgggaaatgaaaattgtgtggcacgtccacctatcgccgtccatctgaataaaggctggaataaagttttcctgaaattgccggttggcaaattcaatatgcccgaggtgcggttggtgaagtggatgtttactacagtttttgtaactcctgacggagaaaatgcagtggacggacttatctattcgcccgacaaaacgaagtga

SEQ ID NO: 4310 - DNA, 216 bp, B.fragilis; identical to SEQ ID NO: 1094

SEQ ID NO: 4311 - DNA, 1557 bp, B.fragilis
ataatttgtatgagaaatctttttaaaattgccggtttactggcgctcacgggatttatttcttcgtgtaacgacaaagaaactacagctaattaccaggtaattcctttacctcaggaaattacgactgctcaaagccaaccatttacattaaatggtagtgtaaaaatcatctatccggaaggaaatgaaaagatgcaacgcaatgcccaattcctggctgattatctgaagaaagccacaggtaaggattatgccgttgaagcaggtactgagggcaaaggtgctattctgcttaagttgggtatggaatcagaaaaccccgaagcttatcagttgagtgtgaacgcagatggtgtaactattgctgctcctactgaagctggtgtattctacggtatccagactttacgtaagtctattccggtagctatcggtacaactccttcattgccggctgtcgagattagcgactatcctcgttttagttatcgtggtgcccattttgatgtaggtcgccatttcttcacagtagacgaagtaaagacatacatcgatatgatggctttgcataacatgaaccgtttacactggcacttaaccgaagatcagggatggagacttgaaatcaagaagtatcctaaactgactgagatcggttcaaaaagatcggaaactgtaatcggacgtaattccggtgaatatgacggaaaaccttacggtggtttctatactcaggaagaagccagagaaatcgtagcgtatgctgcagatcgttatatcactgttattcctgaaattgaccttccgggacatatgcagggagcattggccgcttatccgcatttgggatgtacaggtggaccgtatgaggtttggaaaatatggggagtatctgatcaggtgctttgtgccggaaacgacagtgtattgacttttattgatgatgtcttgacggaagtaatggatatcttcccttctgaatatatccatgtcggaggtgacgaatgtccgaagactgaatgggcgaaatgtccgaagtgccaggctcgtatcaaggccttgggaatcaagagtgacgctaaacattcaaaagaagaatatttgcagagttttgttatcaatcatgcagaaaaattcctgaacgaacacggacgtcagattattggttgggacgaaatcctggaaggtggactggctccgaatgctacagtgatgtcatggcgcggcgaaggtggcggtatcgaagctgccaagcagaaacatgatgttatcatgactccgaacacttatctttactttgactactatcagaccaaggatacagagaatgagcctttggctatcggtggttatttacctttggagagagtgtatggttaccagccgatgccttcttcattgactccggaagagcaaaaatatattattggtgtacaagctaatctttggacggaatacattcctactttctctcaggctcagcatatggtgttgccgcgttgggctgctttagcatatgtgccctggcctaatcctgaaatgaagagttattaa

SEQ ID NO: 4312 - DNA, 1590 bp, B.fragilis
aaaattaacattgtaacaaatatgaaaaagataacatctattttattattcttatcagcgttgctgtatgtttcatgtgacgctttagatctttcgccagaagattattacggcagtggtaacttttggactaaagaagctcaagtagaaggatatatgaatggcttacacaataatttacgaagttcctataccatgttttatgtacttggggaagctcgtggaggtacatctcgttatggcacatcttcgttgggtacatctatgtcttatagtgatcctattaaaaacaatatgttgactaaagacaataccggtattagtaattggtatgatttatacggtagaattatgcaggtaaaccattttatatcggaggtgtcaaacggatgttcctttttaagtgaaagtaaaaaaggattttacttgggacaggcatacggtttgagagcattgtattattttatgttatataaaacttatggtggcgtacctttgattactgatgtcaaagtgcttgaaggaggaaagatatctgcagatgccctttatacggaacgttctactcctgaaacaatactcaaatttattaaaagtgatcttgaggcttctgaattaaattttggaaacaatgttactatagatagagcaatgtggacaaaatatgcaaccttaatgttaaaagctgaagtttacatgtggtcagcaaaagtgactacaggcgatcatcaagccacaggaaatagtgatttggcaattgctcagacagctctccagcctttaatcaaccaattctcgttattagataatttttcagaggtcttctctaaaaaagcaaatgatgaaattatttttgccattcgttttaaagatggagaagcaactaattgggccggtccttttatttattatggtaatatattcgaagggcaacgctatggccgtgatggcaaattaatgcaggatactttagatttgaaagggacagtagggcaattccttcatgaatataagaaggcactttgggattcatatgatgatgaagatatgcgacgcgacgctactttcatggatcattatggtagtgcccaaaaggaaggatttggcattgctatgaaaaagggtatcggttctgtcaattctaacaaccagcgtatatttgatacagatattattgtatatcgttatgccgatgtactattgatgatggcagaaatagaaaatgccctttcaggaaaatgtgcaaattacgttaatgaagtacgtaagcgggcttatggtaagaactggcatccacaattcgcatacactgatggaagttatgctgacaatgagttaactattttacatgaacgtgataaagaatttgtttgggaaggtaaacgttggtttgatgtagtacgtatgcacgatgcaaacggaaaatcattagctttttcagtagcagctaattatcccaacaatgagactcctgatgaaagagttccattaattaaagaaagtgaagcccataagttgttgtggccgatagacgtcaatacattaaataatgacccaaaattggaacaaacaccagggtatgataagtga

SEQ ID NO: 4313 - DNA, 522 bp, B.fragilis
agttttatgattattcttattgcaggagatacacatacggggaaaaccatattagcacaaaagctattggaaaaatataaatatccctacttatcgatagatcatttaaagatggggcttatcagaagtggacaatgtaaattgtctgctgatagtaatgatatggaactgacaaactatctgtggccaattgtcagggagatgataaaaacctgtattgaaaattctcagaatatgattattgaaggatgctatattccttttgattgggaaaaagatttcacaaatgaatatatgaaacaaatacaatacatctgtctcatattcagccaagaatatataaagcataattttcaaaacatattgaaatatgaaaatattatagagaaaagacagtcaacagacttaatttttgaagatataagtaaaaccaacaaatataatttggaacaatgtatatcaagaaagtataattacattttgatagacaaggactatctaatagatacagatgatatataa

SEQ ID NO: 4314 - DNA, 3357 bp, B.fragilis
acatctttattattaactcaaaaagcaatacttatgaagaaaaccatcttcttgattttgtgcattttatgttctcttggagccatggcacaaaagaaatcaatcacaggtgtggttacggatgctagcggtgaatcagtcatcggagcgagtgttgtcgaggtcggtaccaccaatggtgtgattactgacattgacggtaagtttacattgtcggtcgatcctaacggaaagatcaaagtctcttttgttgggtatcaacctcagacaatcgatgtgaaaggtaaaggttctttcaatattcagctgaaagaagactctgaaatgttggaggaagttgttgtaacggggtatggtggcaaacagctgcgtacgaaagtgacaaactctatcgctaaagtaaaagaagaaaccttgaaacaaggtatgtttactaatccggctcaagctctttcgggtgctgtagcgggtttgtcagtaagccaaacttccggtaatccgggtagtgctccaaccttagtacttcgtggtggtacaaactttgatggttctggttctccacttattttaattgatggtcaggtacgttcttctttaagcgatattaatcctgatgacattgaatctatggaagttttgaaagatgccggtgcaacagctatctacggtgcacgtgcaaatgacggtgtagtacttgtaacaaccaaacgtggtaaatctggtagagcagaggtgaatctgaaagctaagtttggtttaaactatttcaaagattcctataactttatgaatgccggcgattatctttattggatgcgtacaggttatatgaatgcttacgttggagatatgaaacatccggacggtgccggcataaaaggatggtcttctttaagtggactaacgactgcaactccttacggaacaggtaacctgtattttgacaaagatggtgtaacgccattagacggaaataagacaagctccgctatatggagtccgatgctatattcggataatttatcattcttgcttgatcagggatggcaaaccatgatagatccgatatatggtgataaaattatctataaaaacaccaatattgccgacttcaatatcaataccccatcattctctcaagattataacttgagtgtcagtggtggtaatgataaaggtaactattatgcaggtttaggttacaataaaagtgaaggtacggcagtgggaaactggtaccaacgaatcacctttacttttaacgcagattataaacttaaagaatggttgacttctaattcaagtttcaattttgcggatgcgacttggaatggacttcctgcatcacaaacagctgaagcaaactatttctcacgctgtctttcattacctcctacgttccgaggctacaatgcagatggtgatatgttgttaggcccgaactccggtgatggtaatcagcaatacaatttcaagcagtttgtccgtgataataatacggataagtttacaatgaatcagtctttcacaatcgatttcatgaaaggtctatcattgaaattaggggctatttggtattattctgaagaaaaaacagaagctttcaataaagattatttgagttctcccggtaatttgattacatctcattctacttctgcttcatacgcacgcactcttgaccaaacatataatgcagtgttgaactataattatcagatcaacaaagataacttcttggatgcaatggttggttttgagtactatgattcatacagtaaaggatttagcgcttctggttccggggctcccactgatgactttatggatttggaatacacttccaaagaggaaggtaagcgttccatagactcttcacattctcgtcaacgcattatgtcattctttggacgcgttaattatgactaccaatccaagtacctactttctttggttttgagacgtgacggatattcaaaactggccgaagagaaccgctggggagtgttcccgggggtatcagccggttgggtattcagtaaagaagagtttatgaagaatacagcatctattctttcatttggtaaattacgcgccagctttggtttaaatggtaatgtaaacaagaactttgttggtaactatacagtgcaaggtgcttatggaagtaatcgttataatggttcaaccggtttcttgttgagtagtattcctaatccctatttgatgtgggaaaaatcgagaacttttgaagtaggtctggatatgggcttcttagaaaatcgaatcaatgccaatttaacttattacaatcgtctgaccagtgataaatatgctaatatcacagttccttccacttcaggtgtaagttcggttacttcaaacaatggtgagttccagaatcaaggttttgagtttgaattaggtttccggattattgatgctaaggactggaaatggaatttaaactggaatggtgctttgaacaaaaacaaggttgtttctttgccggataacggacttgaaagaaatcgtcagagtgcttatcaagtttatacaggaaacggagatgaaaagaaatgggtcggaggataccaggagggccaacgtccgggtgatctctacatgtttgttgcagaaggactgtacaaatctcaagatgaaatacccgctaatctgattgatttgacaacaggtaacaatggttctagcggccgtcctctgtatggtggcactgaaggttacaataaactgacagattctcagaagtcgaatgctcttcccattcagccgggtgacgtaaaatggaaagatgttaataacgatggagtcattgacaattatgacatggtaaaggttggaaatactgtgcctaaatggaccggtggtatcaatacaactgtaagttggaaggaccttaccttgtcggcacgtttcgactatgcattgggattcactgctgtagactggaaaacgatgtggatcatgtcatgtgctcaaggtacatacaatactattgaggagaccaaaaacacatggactccggaaaatccgaatgctaaatatccgacttatgtatgggccgatcaattgggtaaacgtaattattgccgtagttcatccatgtttgcctataatggaaactatatagcattacgcgaattatcactgtcatataaattgccttcaatattggttcagaaagctaagttatctaatgtagaactttcaataacaggtcagaatttaggttatttgacagaagcaaagcacttattctcacccgaaaaagctgataataatggaggatatccattgcctcgcacagtgatttttggtattaatgtttctttctaa

SEQ ID NO: 4315 - DNA, 3309 bp, B.fragilis
acatctttattattaactcaaaaagcaatacttatgaagaaaaccatcttcttgattttgtgcattttatgttctcttggagccatggcacaaaagaaatcaatcacaggtgtggttacggatgctagcggtgaatcagtcatcggagcgagtgttgtcgaggtcggtaccaccaatggtgtgattactgacatctccggcaagtttacgttaatggtcgatcctaatggaaagatcaaagtttcttatgttgggtatcagcctcaggtactcgatgtaaagggcaaaaattctttcaatattaaattgaaagaagactctgaaatgttggatgaagtagtagtcacaggttacggtggtaaacagctgcgtacgaaagtgaccaactctatatctaaagtaaaggaagaagcattgaaggtcggtttattttccaatcctgcccaagctctttccggtgcagttgctggattgaaagttacccaagcgtctggtagtccaggggcaactccaacaattgtacttcgtggtggaaccaatcttgacggatcaggttcacctttagttatgattgatggtcagcttcgtgacggcttaaatgatatcaatcctgaggacatcgaatcaatggaagtcttgaaagatgcaggtgctaccgctttgtatggtgcacgtgccagtaacggtgttattttggttacgaccaaaaatggtaaagccggatatcgtgaaataaatttcaaagccaaattgggtgttaactatgtgaataacccctatgaatttttaggtggtgaggattacatcaatgttctacgcactacttatgctaaatccggttattattgttctgatggtgaatatgtatctattgctcctttgacaaatttaacaggagcttctccttttggtactgggaatgttttaggtaaatctgcctggaatattatgggaaaaacagcagataatgcttatttattacaaaaaggttggaaagaaatggttgacccattggatccttcgaatatgattatctacaaagacatcaatcctggtgattataacttgaataacccttctctctcacaagattataacattaatatgtccggaggtaatgatcgaggaagttattatgcaggtatcggctataatcgtcaggaaggtcttcctgtcagtactttctacgaacgttatagctttgttttaaatgctagttataaaataacagattggttaacaagtacatctaattttaattacaaccgtgctaactggaaaaatatgccgggatcaaacacaagtgaagggaattacttcggtcgtattatgtcaactcctcctacatctcgttttgaagatgaagatggaaatccaactttaggtcccaacgttgctgatggaaatcaggcttttcaacctgaaaaatggcaaaactttaatcaaacagataaatttactatgattcaaggatttcagattgatatcatgaaagggttgtttatcaaaggtacagcaaactggtattattcagaaggcttatatgaatctttcactaaagactacatggacaatatgttgacagagcattatactaaaactcgtgaaagcactgcgaaattcgaacgtaactttgcgcagacctataatgccgtcctaaactttactcgtacgtttgctatagatcataatgttaatttgatgttaggtatggagtattatgacaattacaaacgtggattcgaagcaaaaggtagtggtgcgccaacagatgatttttcagacttgagtttaacggataatggagaaggaaaacgtacgattaattcttggcatgaacaatatcgtattctctcttatttcggccgtttgaattatgattataaaggacgttacttagtctcagcagtgttccgtcaagatggatattcttccttattgggagataatcgttggggattctttccaggtgtatctgccggttggatttttggccaagaaagtttcataaaagaaagtcttccttttctgtcatttggtaaattacgtgccagctatggtgtgaatggtaatgcttcaggtatcggtgcatatacgttacagggatcttataacacagcagtatataacggtaatacaggttttttgattggatctttacctaatccgggactaagatgggaaaaaaccaaaacagctgaagtcggtatggatttaagttttcttgagaaccgcttaaatgcaaactttacttattacaatcgtttgacttcggataaatatgcagattttagtttaccttcgaccaccggcttttcttccattaagaacaataatggaaaatttcgcaacagtggagttgaaatagaactttccggaaaaatcctaaagaccaaagattggagttgggaagcatctgcaaatatctcatttaataaaaataaagtagtagcattgccagaaaatggtttagatttaaatcggcaaggtgggcaacaaatttatacgggtaaacaacttgcagatgggacctatgaaaaaaaatgggttggcggttatcaggaaggacaagaacctggagttttagtcgtttataaatcagatggcatatatcgcagttgggatgaaatacccggagacttagtaattacttccggaaactattttggtaaaaaaatgtatggtcctgatgcatggaaaaagctaacgaaagaacagcaaaagaatgctttgccaattatgccgggcgatatgaaatggaaggatattaatggagataaaattattgattcttatgatcaggttgtagctggtaatacttcccctcactggatcggtggctttaatacaactttacgctggaaaaacttccagctctacggtcgttttgattttgctttggactattggatttacgatcatactttaccagaaatattcttagcctgtgcccaaggaacttataatacaacaaaagaagtattcaatacttggtcagacgaaaatccaaatgcaaaatatcctcgttatgcatatgcagatgtattaactaatgccaattatgctcgtaactctactatgtttgctcataaaggaaattatttggcaatcagagaaatctcattgagttattcgcttcctaaagtatgggcaaacaaagcatactgccaaagagtagatgtgtcgatcaccggacagaatttgggatatatcacatcagctaatgtagcttctcctgaggtttcgaatgcaggttcaggatatgctttgccgagaactctcttgtttggattgaatgtaacattttaa

SEQ ID NO: 4316 - DNA, 3363 bp, B.fragilis
acatctttattattaactcaaaaagcaatacttatgaagaaaaccatcttcttgattttgtgcattttatgttctcttggagccatggcacaaaagaaatcaatcacaggtgtggttacggatgctagcggtgaatcagtcatcggagcgagtgttgtcgaagtcggtaccaccaatggtgtaattaccgatattagcggcaagtttacattaatggtcgatcctaacggaaagatcaaagtttcttatgttgggtatcagcctcaggtactcgatgtaaagggcaaaaattctttcaatattaaattgaaagaagactctgaaatgttggatgaagtagtagtcacaggatatggtggcaaacagttgcgtaccaaagtgaccaattcaattggcaaagtaaaggaagatgttctacaaaaaggactcttttccaatccggcacaagctttgtctggggcggtatcgggtgtacgtgttcttcagacctcaggtgatccaggagctactcctactataatcctacgtggtggtaccgattataacggaacgggatctccattagtgttagtagacggacaagtccgtggaagtctgagtgatatcaatcctgaggatattgagtcaatggaagtcctaaaagacgccggtgccactgctatttatggtgctcgcgctaataatggtgtaatcttagttactactaaacgtggtaaagaaggtaaaggtgaggtcagtgtaaaggctaaagtcggtatcaactattacaataatccttatgaatttatgaatgccggcgattatatctattggatgcgtacggcatatcaacgttctgggcaaatctataaagattccaaaggtaattgggttggtacagcagatatgaatagtctaaataatgcaactccctatggtacgggtaatctctattttgatcctagtaccggggccgtacttgatggaaataaagacgtgcgtgccgtatggagtacaatgaaatatacggatgatctggcttttttattgaagcaaggttggcaaaccatgacagatcctgtatatggtgatcaaataatttataagaatacagatcctgcctcgttcaacctacatactccatcactttctcaagactacaatatcagtatttctggaggtaacgataaaggaaattattatgctggaatcggatataataatacagatggtacagctacagggaattggtataaacgtctaacatttacgtttaatgctgattataaaatcaaaccttggcttacatccagttcatcgtttaattttgcagatgctacttggtatggactttctcctggttccagaggtgaagtggaatatttcaatcgaatgctttcattacctcctacattccgtggttacaacgctgatggtgaaatgttattaggtcctaattcttctgatgggaaccagtcattcaatttaagtaagtttaagcgtgataacaacaccgacaaatttaccatggtacaatccttcgatataaaattaatgaaaggactgaatttaaagttgacagcgaactggtactttgatgaagctaaatatgaagcattcaatcaagactacttgtcaagtcccaataacatgaatacatctcgttctacatcagcagaatttgatagaacgctcaatcagacctacaatgcggttttaaattatgattatcaaattacgaaagatcattatctggctgcaatgttaggttttgaatactacgatgcttatcaaaaaggatttaacgcttctggatcgggtgctccgactgacgattttggtgatcttcaatttacaagtaatgaagaaggaaaacgtaatattgattcatggcatagtcgccaacgcattatgtctttctttgggcgtgtgaattatgacttccaaagcaaatatttggtatcattcgtattaagaaaggatggctactctaaattagcaaaagacaaccgttggggagtatttcccggaatttcagcaggatgggttttcggaaaagagaaatttatggaatccctccaacaagtagtttcctttgccaaattgcgcgcaagttatggattgaatggaaatgtaaataaagattgggtcggtaattacacagtgcagggatcttacggaagtaataaatataacggcaatactgggtatttattaggttctctccctattccttatttgcaatgggaacgttcacaaacttttgaagtaggtatggatttaagttttcttgaaaacagaatcaatactaacatgacgtattacaatcgtagaacggaagataaatatgccactattcctttgccatcttcatcaggggtttctggtataacctcaaataacggtaaattacagaatcaaggacttgagctggaatttggttttaaagtgcttgagaaacgtgattggaagtggaatatcaatctgaacgctgcctataacataaacaaaattctggaattgccatacaatggactggagagaaatcgtcagaatgccatggaggtgtatacaggtcgcaaattggatgatggcagctatgagaagatgtgggtaggaggttatcaggaaggacagcgcccaggtgacatctatgcatacaaagcagaaggattatacagaagcgaatccgaaattccaggaaatttgatcgataagtctacaggaaataacagctcaaacaataagattttgtatggtccggaagcatgggctaaattaacagatcaggaaaaaagtaaaggtttacctatacaacctggagatgtaaagtggaaagatgtgaataatgatggcgtcattgacgtatatgatcaagtgaaagtcggtaatacaacgcccaaatggactggtggcttcaatacgactatatcatggaaagatctgacattatcagcacgttttgattatgctttaggctttactgtaattgattggaagactccttggatcatgggtaatatgcagggaacttataatacaatctcagataccaaaaatacatggtcacctgaaaatccaaacgccaaatatccaacttacacgtgggctgatcagttaggaaaacgtaattatgcacgtagtagttctatgttcactttcaatggtaattatctagctcttcgtgaacttagcttagcatatagattaccctcacaattaattaaaaaagctggaatgaacgatgtttccttctctattactggacaaaatcttggctatctgacagaagctgagcatatgcactctcctgagagcagtagtaataatggaggatatccattaccacgaactattatttttggagtaaatgtttccttttaa

SEQ ID NO: 4317 - DNA, 258 bp, B.fragilis
gaattttcattccttccgggctctgcatatcatgacggaatgtacggacaaaagccccactatgccccggcatatcaaattccggaattaaaagtatattatgcgctttacaaaaagcgactaaatctttcgcttcttccaatgtatagtatttacccggcatacgagtcgtgttcacactgtcattcaacatcggaaaaattttactttgcaatctccatgattgattttcagtcagatgccaatgaaaaacattaa

SEQ ID NO: 4318 - DNA, 1158 bp, B.fragilis
tttatcatgttgactcaaattatcaatggacgcatatttactccgcaaggttggttgaacgaaggttctgtgttgatgagagatggaaaaattctggaagtaactaattgcgatctggcgctgatcggtgccaatctggtggatgccagaggaatgtatattgttcccggctttgtttgtatgcatgcccatggtgggggaggacacgattttacagaatgtaccgaagaggctttccgtacggcgatagctgcacacatgaagcacggtgccaccagctttttcccgacactttcttcttctccgttctccgaaatacgcaaagctgtagatatatgcgaaaaactgatggccgaacccgatagcccgatactcggcttacatgtggaaggcccttacctgaaccgtaagatggcgggagaacagtttgcaaaccaagtgaaagaagtcgatgtggcagaatacacctctttgcttgaaagcaccgattgcatcaagcgttgggatgcctctcccgaactgcccggagcacttgactttgcacgttatctgaagtcgaagggaattgtaggagctgtttcgcatacggaagccgaatatgatggcataaaggaagcatacgaggcgggatttacacatgctgcgcacttctacaatgcaatgccgggctttcataagcgtcgcgaatataaatacgagggaacggttgagagcgtctacctgaccgatggcatgactatcgagctgattgctgacggcattcatttgccttccactattttgaaactggcttataagctgaagggtgtggagcatacttgtctggtgaccgacgcgctttcatatgcggctgctgaaggtaaggcgatcgacgatccccgtattattatagaagacggtgtgtgcaagcttgccgaccgttcggccttggcaggtagtattgctaccatggatcagttggtacgtacgatggtgaaggctgatattcccctggcagatgccatacgtatggcttctgagactcctgcccgtattatgggagtttatgaccgtaaaggatctctccagaaagataaagatgcggatattctgattctggatcgtgatctgaacgtcaaggcggtatgggctatggggcagttggtgaaagagtcgtaa

SEQ ID NO: 4319 - DNA, 1197 bp, B.fragilis
ataccaccgttacgaatccgtattataactaaactcaaaataggtatgcaaaaccgaagagattttctcaagacggctgcctttgccgctatcggttcgggactgtcattgcaaggagcttttgccggagagaaagcccctgtttcgttcgcgatcaatcaactcggcctgggggcaaagatgaaattgcgttttttcccttacgaactgaagttgaagcatgtatttaccgtggccacttattcgcgcaccaccactcccgatgtgcaggtagagatagagtatgacggagtcatcggctacggtgaggcttcgatgcctccttatctgggacagacggtagactcggtgatggggtttctgaagaaagtcgatctggaacagttcgacgatccgttccggctggaagatatactggcttatgtagatggtctcactccgggagatacggctgccaaagctgccatcgacattgcattgcacgacctggtgggtaaacttttgggagcaccctggtacaggatctgggggctggataaggcgaaagcaccttcgaccaccttcacgataggcatcgatacaccggaagtggtacgtgaaaagacgcttgaagtggccgggcagttcaatatcctcaaagtgaagctggggcgtgagaatgacaaacagatgattgaaacgatccgttcggtgagcgatctgcctatcgcggtcgatgccaatcagggatggacggataagaaatatgcattggacatgattctgtggctgaaggagaaagggatcgtgatgattgaacagcccatgcccaaaacacagttggacgatattgcgtgggtgacccagcatagtccgttgccggtttttgccgatgaatctttgcagcggttgagcgatgtggccgggctgaagggggcttttaccggaataaatatcaaactgatgaagtgcaccggtatgcgggaagcctggaagatggtgacgttggcgcgtgcattgggaatgaaagtgatggtaggctgtatgacggaaacttcgtgtgcggtctctgccgccgcacaattctctccggccgtcgactttgccgatctggacggaaacctgctgatagcgaacgaccgcttcaaagggatggaagttgtaaaaggtaagatcaccctcaacgaccttccggggatcggggtggttaaaatatga

SEQ ID NO: 4320 - DNA, 1356 bp, B.fragilis
acttttgaaacttatttggatatgagaaaattgctttatattgtgatgatattcatcggcgtctccgcctgcacctcccggcaggagtccaagccttacgactgggacgacgacctgcatcaacgattgctggcggatttctgcctgaccgaatcccaggtgaaagactatatccgcaaatacattcccgacgtgacggacgaacagatgcgccaatgggaagagagcaaggcgcttgagtgccgggtgatcgacggagagaaacgttatttccgcaatgccggtcccaacctgttccggatagactctgcctgctgtgccgtcaaaatggagaaagagggtacttcactgagcacgagcgaacaggtcaataaagaacatctgcccgaagtgatggctgctgtcaggaaagaaaaaactcctgtggtgcagcccaaacgcatgcgggtcacttatacgctgacggtggacagcaatgccgtacctgccggaaaaatgattcgttgctggttgccctatccccggacagaccagccccgccagcaaaatgtaaaattgctccatgtcagcgaaccccgttacacattgtccccgccttcatgccggcacagcaccctctatatggagaaacaagctatccccggtgagccgacggtcttttcggaaacctttgagtacacctcgtgtgccgaatggcatccgttgaagcccgggaatattctgccttatgacactgccggcgctctttataaggaatatactgccgaacgggaaacccatatccgcttcaccccccgcatcaaggagctggctgccaatctgacagtcggtgaaaccaatcctttgttgaaggcacagcgcattttccgttggataaacgatcatttcccctgggcttcggcccgcgaatattccactattgagaatattccggaatatgtgctcgacaatcgtcacggcgattgcggtcaggtgagcctgctgtttatcaccctctgccgttgcagtggcattcccgcccgcttccagagcggctttatgatgcatccgcgtgcctggaacctgcacgactgggcggaagtctatttcgaaggcgcaggctgggtgccggtagaccaatcgttcggtattcccacatttgccgacaatcccgaagaaaagatgttctttatgggaggtatcgactcctggcgcatgatagtcaacagcgattattccatgccgctggtgccggagaagaaatatccgcgtagtgaaaccgttgatttccagcgtggcgaggtggagtgggaagggggcaacctgtacttcccgcagtggagttatcacatggatatagactatctgaattattaa

SEQ ID NO: 4321 - DNA, 213 bp, B.fragilis
  unsure (50): Identity of nucleotide sequences at the above locations are unknown.
aaattatttcttttgggattcccaacaggaagagaattttttactttgtntttaagatggggggataaagactcagtgggtgttaacgaatttttgtccttgctccccaagggggtgacacgggttctgaacacccttatatttctctcttctcgtgacgccgacagcccgaagaggtgtgtgggtgttgtaaaaacgcgatttgtgcgatag

SEQ ID NO: 4322 - DNA, 1221 bp, B.fragilis
cccccaaatctttctttcatgaagaatatgattccttttgtatcgctgcttttggcagtgtccgcctgtacgggtattcctgaaaacaagaaaaatgccctccctcaagatgtagaacgattgtccggtgaagtccgcgaccgcttcattcccgataagcgtgtcatcctttgggatgtggattacgatgtatccggaaagacgattaccgtaaagggggcaactacttcgccggaagctaaggcggctttgttatcggggctggaagagaaggcttatgaagtaaaggacagcctgcaattggttccggacagtgcggctctggaaggaaagatgtacggcattgtcaatctttccgtatgtaatatgcgtgtagaggatgatttttcttcggaaatgaccactcaggcattgatgggaatgcccgttaaagtgttgcaacatcgtaactggtatcgcatccagacgcccgataattatatcgcatgggtacaccgggtgggaatccatccggtcaccaaagccgggctggatgcctggaacaaggcagataaaattgtagtgacgtcgcattacgggttcacttatcagcagccggatgaaaagtctcaatccgtgtcggacgtggtagccggaaaccgtctgaagtacgaaggtaagcaaggaggattctataaagtctcttatccggacggtcggcaggcttatatctcacaatcgatatcgatgcccgaaaaggagtggcgtgcctctttgaagcaagacgcttcaagcatcatccgaaccgcttataccatgatggggattccttatctctgggcgggtacttcttcgaagggagtcgattgcagcggctttgtacgtaccgtcttattcatgcacgatatcatcattccccgtgacgcctctcaacaggcttatgtgggcgagcatatcgatattgctccagacttcggcaatgttcagccgggagatttgattttcttcgggcggaaggctactgccgaaaagagggagcgtgtggttcatgtagccatttatctgggtgataagaagttcatccattcgcaaggcgatgtgcatgtcagcagtttcgatccggcagatgccgattttgatgagtacaatctgaaccgcctgctgtatgcggtccgtgtgttgccatctatagataaggaggaaactttaaataccaccgttacgaatccgtattataactaa

SEQ ID NO: 4323 - DNA, 303 bp, B.fragilis; identical to SEQ ID NO: 2491

SEQ ID NO: 4324 - DNA, 1566 bp, B.fragilis
atgaataaaaagaatagtatgaaacagacaacaaaaaacattctcgggataggagcagtagttcttctcagtgcaggagttgccggagtgacaacctatacgatgttgaagccggagaacagagacagcctgtcgtttaatgaacagttccgtcagaatcccggtgctcgcttggctgcttatgacgccattaatgcccagcctgtagatctgacgcaggcggcggaaaattcgcttcatgctgtagtacatataaaatcgactcaacaggctaaagaacaaactgtgaccgtacgcgacccgtttgcagagatattcggggatatcttcggtaatggcggcagacagcagcgccgtgtacagacccagccgcgtgtcggcttcggttccggtgtcatcatttccaaagacggttacatcgtcaccaataatcacgtgatcgacggtgcggacgaaattatcgttaagttgaatgacaaccgcgagttcaaaggtcgcatgatcggtaccgacccgaattcggatttggctctggtcaagatcgagggagacgatttcccgaccatccccgtgggcgattctgatgccttgaaagtaggagagtgggtattggcggtaggtaacccgttcaatcttacctcgactgtaactgccggtatcgtcagtgccaaggcacgtacgctcggtgtgtacggcatcgggggagtagaatcgttcatccagacagatgccgccatcaatcagggaaacagcggtggagctttggtgaatgcaaaaggtgaattggtaggtatcaatgccgtgctttcttcgcctacaggcgcttatgccggatacggttttgccattccgaccagtgtgatgaccaaagtggtcagcgacctgaaacaatacggaaccgtacaacgtgcgttgctgggtatcaagggtacttcgcttgcgggtgacggtgatatgatgtccgatcagccgatcgacaaatcgggagccacactgtccgataagcgcaaagagttcggcgtagtggatggcgtttgggtacgcgaaatcgtagatggaggttctgctgccggttccgatatcaaggtagatgatgtcatcatcggtatcgatggcaagaaagtgcagaactttgccgacctgcaggaagccattgcacagcatcgtccgggcgataaagtgaccgtgaaggtgatgcgtgacaagaaagaaaagaatatcaatataacattgaaaaacgaacaaggtacaacaaagattgtgaaggatgcgggtatggagattctgggcgctgccttcaaggagttgccggacgacttgaagaaacaactcaatctcggatacggcttgcaggttaccggagtcacttcgggcaagatggcggatgccggtgtgcggaagggcttcatcatcctgaaagccaacgatcagcctatgcgcaaagtcagcgaccttgaagaagtgatgaaagctgctgtgaagtcaccgaaccaggtactcttcctcacaggagtattcccttcaggaaaacgcggctattacgctgtagacttgactcaggagtga

SEQ ID NO: 4325 - DNA, 408 bp, B.fragilis
cagaatatgaaatacgtaaaaatactgtttgctgtggcattggtgtttacattgtgctcggcgttttcgttgaaaaaagggggacataaacccgtttatgcctttggggtatcggcttcatttaccgatacggtgatatactacaccgaaattcagatgcttgacagcgtggcgctggataaaaacggattcctgccgcatagagaactgtacagttatcagttgaagaattatttggaattcgataaaggacttcctaaccgtacttgtatgatctatttctcggaaaataaaaagaaattaggaaaagaggccgccaaggttgtggggaaattcaagaagaataaaacggtggctgtcgagaaaatcgatcctcagaatttccggttcagtaaaccagaagagtaa

SEQ ID NO: 4326 - DNA, 693 bp, B.fragilis
aatatggtgaagtttatagaatcagaacttgttctgctgaaaaaggaaatagacgagatgtggacattggtttacaaccagttggacagggcaggggaggcagtgttgaccctggataaggaactggcccagcaggtgattgtccgtgaacgcagggtgaatgctttcgaattgaagatagacagcgacgtggaagacgtgatcgctttatataatccggtagctatcgaccttcgctttgtgttggccatgttgaaaatcaacaccaacctggagcgtctgggcgactttgcagaaggaatcgcacgttttgtagtgaagagtgaagagccggttctggatgaagagttactgaaacgactccgtctggaagagatgcagaaacaggtgctttcgatgcttgaagtggcaaaacgcgcattgaacgaagagagcctggagctggcaacctccgtattcgctaaagataatttattggacgagatcaatgcggaggctacggctgttttggcagagtatatcaaagagcatccagaaagcactctctcgtgcctcaatctggtgggagtattccgtaaattggaacgttccggcgaccatataacgaatattgcagaagagatagtctttttcatcgatgctaaagtcttgaagcatagtggcaaggtagaagagcattatcctgctaaataa

SEQ ID NO: 4327 - DNA, 210 bp, B.fragilis
aagagaaacgaaagaagatccggaaagaaagcgggaaaattatttcttataacagctattaatgatctgagtgatacagaatgggctctgcgggtaggagacataaagaaaacccatatcgctcttatcggaaacggaatttatttcaccacagattacaccgattttcacggattatatcatccggttctcggtggaagaaattattaa

SEQ ID NO: 4328 - DNA, 1320 bp, B.fragilis
ataaaaaaagaccctacctccatgaagttgatataccgcattatcatccgcatcgcactcatgctgacagttgttctcggggcatgggctgtatttttctatatagccgtaatagatgaagtgaacgacgaagtagacgactctctggaggattactcggaaaccatcattatccgtgccctggccggagaagaactgccctcgaaaaacaatgggtcgaacaatcaatactatcttagaaaagtaagcaaagagtatgccgacgaacgcgaagatatctgctacaaagactccatggtctatattgtggagaaggaagagactgaaccggcacgcatactgaccaccttattcaaagatgacgaagggcaatattacgagcttaccgtatcgacaccgacgatcgagaaggacgacctgaaagacgccatgctgggatggattatttttctgtacatcgtcctgctgctcaccatcctgattgtctgcatctggatatttcaccgcagcatgaagccactttacaacctgctgcgctggctggatgcctacaggataggtcgtcccaatcgccctttgaagaatgaaacgcaaattacggagttcaggaagctgaacgaggcagccatccgcaacgcggaacgaagcgaacacatctttgaacagcaaaagcaattcatcggcaatgcttcacacgaaatgcaaacaccgttggccatctgccggaatcgcctggaaatgctgatggaagacgactccttgtctgaagcacagttggaagagctgataaaaacgcaccagaccctggagcatatcactaagctcaataaatcgctgctgttactgtccaaaatagataacggacaattctccgatacccgaacggtagagttcaacagcatgctcaagcgatatatagaagattataaagaagtatacggctatcgggaaattgagctgacgctggatgaacagggaatattccgggcggagatgaatgaatcgctggcagtagccctgataacgaacctgctcaaaaatgcgtttgtacacaacgtagacggtgggcatatccggattgaaataaccggtcatagcatgaccttcaggaatagcggcgcaggccgccccctggatgcgacccatatctttgaacgattctatcagggaagcaaaaaggaaggttcgaccggactgggacttgccatagccgactccatctgcaaattacagcatctcacactcaggtattattttgagaaagatgaacactgtttcgaattgcggaagaacaatttcaccacagattacgcagattaa

SEQ ID NO: 4329 - DNA, 1185 bp, B.fragilis
ttcatgaaactgaaaataaccttgtattccgtatgtctgcttatgctgcttgctgcctgtcagcaggatgggccgacacctgaaccgagtgtaggttcgcgtaccgtgttagtgtatatgatagcccagaactctttggcaccgttggcctcggccgatattgaagagatgaaagagggaatgcggcaggttgatgccacatccggtaatctgctggtgtatatagacgattattcggctccccggctgattcgtctgggaaaagacaaaaaaggaaaagtggtggaagagaccattgaaaattacccggagcaaaattcagccgatgcaaatgtgatgaaaaaggttatatctactgccttcaatcaatataaagcggagaagtatggcatggtcttctggtcgcacggtgagggatggataccttctccggcaaagacacgttggtttggtcaggacggcaataactatatggatatagctgatttgcacgcagccttacaggtggcacccgacctcgacttcttgtttttcgatgcatgttttatggaagctgtagaggtggcgtatgcgttgcgcgactgcggaagttacctgatcagttcgcctaccgagattccggggccgggcgctccttatcagacagtggttcccgcgatgttttctgccgaaaatgcagctttgaagatcgcttcctgctattatgattactatcaaagcagatataatgacggaatcggtatgtccaatgaagattggaccggtggtgtttctgttggggttgccaagatgagtgaactcgagaatctggctgttgcaacgtccaaagtgctgcccaggtatatcaccgggaaacagaattttgatctttccggagtgatgtgttatgatcgccgcactgataagcaatattattatgatttagaccggttcatctatcagataactgcagggaacggcgattatgatagttggcgggaggcgttcgataaggtaatggtttactggaaatccactccccgcaactattctgcctacgccgggatgttcacgatgaatcaggatacgaaagggctttctacctatattccccgtatgtccgctccgtcgttgaatacttcttaccagcagactgaatggtataaggtatccggttgggcggataccggttggtataagaattag

SEQ ID NO: 4330 - DNA, 288 bp, B.fragilis
aaggtgctgtgccagaactcaccacagagcggcacagagcagagtatcacagagttttttactacgaatcaacaacttaaaatcgtctctgtgttactctgtgtgctctgtggtgagtatggccataccagcgaatcgcctgccgaaaaagtattcggtagcttaataatagctaaggaaatcgaaaagagggtaccggcaatcaaccagtcggtactctttttgtttatattagtagataataatggtgaaaaagttgtgaaaatttatacgttaacaaataaatag

SEQ ID NO: 4331 - DNA, 906 bp, B.fragilis
caaataaatagtcgtaactttgcactccaaatctgttttataagaatgagacaactaaagattaccaaaagtatcactaacagagagagcgcttctcttgacaagtatttgcaggaaatcggtcgcgaggacctcattactgtagaggaggaagtagaactcgctcaacgcattcgtaagggtgaccgtgtggcattagagaaactgacacgcgccaatcttcgtttcgtcgtatccgtagctaagcagtaccagaaccaaggcttgagtttgcccgacttgattaatgaaggcaatttaggactgatcaaagctgccgagaagtttgatgaaacacgtggcttcaagtttatcagttatgctgtatggtggattcgccaatctattttgcaggcattggcagagcagtcccgtatcgttcgccttccgttgaaccaggtcggttcgttgaataagatcagcaaagccttctctaagtttgaacaggaaaacgagcgtcgtccgtcgcccgaagagttggcaggtgaactggatattccggtcgacaagatctccgatacgttgaaagtatccggccgccatatctcggtggacgctcctttcgttgaaggagaagacaacagcctgctcgatgtgttggtgaacgatgattcgcccatggcagaccgttctctggttaatgagtctcttgcgagggaaattgatagagctctttctacgttaaccgatagggaaaaagaaatcattcagatgtttttcggtatcggacagcaggaaatgacattagaggaaatcggcgacaaatttggtctcacacgtgagcgtgttcgtcagattaaagaaaaagcaatcagaagattaagacaaagtaatcgtagtaaattgctcaaatcttacttgggataa

SEQ ID NO: 4332 - DNA, 618 bp, B.fragilis
attaaaaatagaactatgttttccggaatcgtagaagagtatgctaccgttgtggcactggtgaaagaccaggagaatatacatttcacactgaagtgttcgtttgtaaatgaattgaagatagatcagagtatctctcacaatggggtctgcctgaccgtggtcagcatgactgaagatacctacactgtgactgccatgaaagagacactggatcggtcgaaccttcgtctgctgaaagtgggggacaaggtgaacgtggaacgcagcatgatgatgaacggacgtctggacggccatattgtgcagggacatgtggatcagaccgccgaatgtatcgatatcaaagatgcagacggaagctggtattttacgtttaaatatgctttcgacaaggagatggccaagcgcggctatattacggtcgataagggttcggttacggtcaacggtgtcagcctgacggtatgcaacccgactgacgatacttttcaggtggcgattatcccatatacctacgagcataccaatttccatactttcgggaagggcagtgttgtcaacctggaatttgatattatcggcaagtatatcagccggatgatccagtacaaataa

SEQ ID NO: 4333 - DNA, 1584 bp, B.fragilis
cttcacagcagctttcatcacttcttcaaggtcgctgactttgcgcataggctgatcgttggctttcaggatgatgaagcccttccgcacaccggcatccgccatcttgcccgaagtgactccggtaacctgcaagccgtatccgagattgagttgtttcttcaagtcgtccggcaactccttgaaggcagcgcccagaatctccatacccgcatccttcacaatctttgttgtaccttgttcgtttttcaatgttatattgatattcttttctttcttgtcacgcatcaccttcacggtcactttatcgcccggacgatgctgtgcaatggcttcctgcaggtcggcaaagttctgcactttcttgccatcgataccgatgatgacatcatctaccttgatatcggaaccggcagcagaacctccatctacgatttcgcgtacccaaacgccatccactacgccgaactctttgcgcttatcggacagtgtggctcccgatttgtcgatcggctgatcggacatcatatcaccgtcacccgcaagcgaagtacccttgatacccagcaacgcacgttgtacggttccgtattgtttcaggtcgctgaccactttggtcatcacactggtcggaatggcaaaaccgtatccggcataagcgcctgtaggcgaagaaagcacggcattgatacctaccaattcaccttttgcattcaccaaagctccaccgctgtttccctgattgatggcggcatctgtctggatgaacgattctactcccccgatgccgtacacaccgagcgtacgtgccttggcactgacgataccggcagttacagtcgaggtaagattgaacgggttacctaccgccaatacccactctcctactttcaaggcatcagaatcgcccacggggatggtcgggaaatcgtctccctcgatcttgaccagagccaaatccgaattcgggtcggtaccgatcatgcgacctttgaactcgcggttgtcattcaacttaacgataatttcgtccgcaccgtcgatcacgtgattattggtgacgatgtaaccgtctttggaaatgatgacaccggaaccgaagccgacacgcggctgggtctgtacacggcgctgctgtctgccgccattaccgaagatatccccgaatatctctgcaaacgggtcgcgtacggtcacagtttgttctttagcctgttgagtcgattttatatgtactacagcatgaagcgaattttccgccgcctgcgtcagatctacaggctgggcattaatggcgtcataagcagccaagcgagcaccgggattctgacggaactgttcattaaacgacaggctgtctctgttctccggcttcaacatcgtataggttgtcactccggcaactcctgcactgagaagaactactgctcctatcccgagaatgttttttgttgtctgtttcatactattctttttattcatttaattgttaatattctactttcatttaacatttacgacgttaaaataacgacaaaaatcattctgttattctccttgtcactcttttttgttctcttttaa

SEQ ID NO: 4334 - DNA, 387 bp, B.fragilis
tttgcagatggagtcggctatggcaagtcccagtccggtcgaaccttcctttttgcttccctgatagaatcgttcaaagatatgggtcgcatccagggggcggcctgcgccgctattcctgaaggtcatgctatgaccggttatttcaatccggatatgcccaccgtctacgttgtgtacaaacgcatttttgagcaggttcgttatcagggctactgccagcgattcattcatctccgcccggaatattccctgttcatccagcgtcagctcaatttcccgatagccgtatacttctttataatcttctatatatcgcttgagcatgctgttgaactctaccgttcgggtatcggagaattgtccgttatctattttggacagtaa

SEQ ID NO: 4335 - DNA, 570 bp, B.fragilis
ggtggaccggggagtagaggtgaaaaaagtatgaacgactttctgcaattggtaaatgcccggcaaagtgacagggcttacgataaatcgcgtcttgtggaggcggataagctggaacgcatccttgaagcgggacggctggcaccttctgcctgcaatgcccagccttggaggttcgtggtagtgaccgatccgtcattggcggagaaggtcggtaaggctgctgcgggcttgggaatgaataaatttgccaaggatgctccggtgcatatcctcgttgtagaagagtctgccaacattacttcgcggctgggcggaaaactgaagggaaaacattttccgttgatcgatatcggtattgtggctgcacacatggtgctggctgccgaaagcgaagggctgggatcatgtatactcggctggttcgatgaaaaagagataaagagcctgaccggtattccctcttccaagcgtgtattgctggatatcttgatcggatatccggtgaaagagaaacgaaagaagatccggaaagaaagcgggaaaattatttcttataacagctattaa

SEQ ID NO: 4336 - DNA, 378 bp, B.fragilis
accctgaagggtgccgcgctttgggatgaagtgaaggacaaactgaaagaatcggcttttgccttgtccggcggacagcagcagcgtctttgtatcgcacgcgcaatggctgtatcgccttcggtgctgttgatggacgaacctgcttcggcgctcgaccctatttcgacggcaaaggtggaagagttgatacacgagttgaaagaacggtataccattgtgattgtgacgcacaatatgcagcaggctgcacgtgtcagtgataagacggcgtttttctatatggggcagatggtggagtttggcgacacgaagaagatctttacgaacccggagaaggaagcgacacaaaactatataaccggacgtttcggatga

SEQ ID NO: 4337 - DNA, 1356 bp, B.fragilis
ctgcttttcttttttttaatttcaaataccagacctatgaatcagcgtctctccgatatatggaaattcattacctatgatatctggcggatcacggaaagcgaagtcacccgcaccaagttctcgatatacaatatcatcaaaacgatctatctctgcgtcaaccgcttcaacaaagaccgcattgtcaataaagcctcagcgctgacctacagcaccctgctcgccattgtgcccatactcgccatcgtctttgccatcgcgcgcggattcggggtctccactttgatggaaagccagtttcgtgatggcttcggaggatccaccgaggcgacggatattatcctgcaattcgtagactcatatctgtcacagaccaaaaacggtatttttatcggagtcggcctggtcatgttgctgtggaccgtactcaacctggtcagtaacattgaaatcaccttcaaccgcatctggcaggtaaagaaagggcgcagcatgtaccgcaaaatcaccgattacttttcaatgttcctattgatgccgatcctgatcgtagtatcgggcggtctttccatctttgtaggcacgatgctgaagagtatggcggattttgttttacttgcccctatcctgaaattcctgatccgtctgattccgttcgtgctgacctggctgatgtttacgggactctatatcttcatgcccaataccaaggtgaaattcaagcatgcactgatctccggcatcctggccggttcggcttatcaggcatttcagttcctgtacatcagcagtcagttgtgggtgtccaaatacaatgccatttacggtagtttcgccgctctcccgatgttcttgttatggttgcagatatcatggaccatctgcctgttcggtgccgagctgacgtatgccggccagaacatccgcaacttcagtttcgacagagatacgcagaacatcagtcgccgttaccgcgatttcatatctatcttaatcatgtctcttatagccaaacgtttcgaaaacaacgaaacgccttacaccgccgaagagatatccgaagaacatcgcatcccgattcggctgaccaatcagatactttaccaactgcaggagatacacctgattcacgaagtagtcaccgatcaaaaaagcgaggatatcgcataccagccttccatcgacattaatcaactgaatgtagcgctattgctcgaccggctggacacatacggctcagaagattttaaagtcgataaagacgaggaattcagcgagcaatggaaggttttgcttgactccagggaagaatattataaaaaggcaagcaaagtattgctgaaggacttgtag

SEQ ID NO: 4338 - DNA, 474 bp, B.fragilis
ttgctaaaaataaaaaccaataaaaaaaagacgattatgaaaaagttacttcttttattcgtatgcctgttcactctgcaaaccatcgcaagagcggacgatgataaaccgattcaagtaagccagatgccgcagaaggcacagcagttcatcaaacaacactttgccggcagcaacattgccatggccaaagttgaaagcgatttcttacagaaaagctacgatgtcatcttcaccgacggcaacaaagtagagttcgacaagaaaggaaactggactgaagtaaattgcaaattcagtgtagtgccacagggcatcatcccctctcctatccaaaaatatacagccactaattatccggacgctaaagttctgaaaatagaacgcgataaaacggattatgaagtgaaactatccaatggttgggaactaaaatttgactctaaatttaatttaatcgatattgataactaa

SEQ ID NO: 4339 - DNA, 852 bp, B.fragilis
aaaagtatagtagatatgaaattgaaaatgtattttcttcttctagcactgggtgccctgggattacaaagctgtaatgacgatgacgatcatctgtcttccgtgcccacggaactgaaaaacgcatttaccgaaaagtatccgtctgtcagcaacgaaaagtgggaaacaaaaggcaactattacatagcggaattccgtcaacagaactacgaaacctcggcctggtttactccgaacggaatatggcaaatgacagagaccgacctcccttatcaggctctgccggcagctgtgaagagtgcattcgaaagcagtgaatacgccaagtggaaagtagacgatgtggacatgttggaacgtccggacatggagaaggtatacgtcatcgaggtagagtccggaaagcaggaattcgacctgtattactcggaagagggtatcctggtgaaaagcgttgcggatacggacaacgattcagagaactatctgcctgccgagattccggcagccattgagacctttatcaaaaagcaatatccaaacgcacgcctggtcgagatcgaagtggagcacgggatgactgaggtagacatcatcgacggtaatatcagtaaagaaattgtattcaacagctctaacgaatggatatctacttcttgggacgtacgccgcaacgaactaccggaaacagtgacccatgcgatcgcttcttcagagaaatatgcgggatatcaaatcgatgacgcagactttgttgaaacacccggaggagaatattatctggttgaactggaaaaaggagaattggaagtgaaagtaaaggtgaacgctgaaggagagtttatctga

SEQ ID NO: 4340 - DNA, 711 bp, B.fragilis
gccttttctttgcaggtagaaataaaaagccctatgaaaatattaataatcgaagacgaaccctcactgagggaactgatccagcgttcgctcgaaaaagaacgctatgtagtggaagctgccgcagacttccagtcgggattacgcaagatagaggactacgattatgactgtgtcttgctggacattatgttgcctgacggcaatgggctgaacctgctggagcaactgaaaaagatgcgtaaacgggaaaacgtaattatcatatcggccaaagactccctggacgataaagtactgggactggaactgggtgccgacgactatctgcccaaaccctttcacctggccgaattaaatgcccgcatcaaaagtgtgatccgacgccagcgccgcgacggagaaatggacatacgcctggccaacatacgtattgtccccgatacattccaggtattcgtagatgacaaggaaatagaattaaaccgcaaagagtatgatatccttctctactttgccaaccgtcccggacgactggtaaacaaaaacacgcttgccgaatcggtgtggggagatcatatcgaccaggtagacaattttgatttcatctatgcgcaaatcaagaacctgagaaagaaactcaaagatgccggtgccttggcagaactgaaggctgtatatggattcggctacaaaatgactgttgaataa

SEQ ID NO: 4341 - DNA, 285 bp, B.fragilis; identical to SEQ ID NO: 4185

SEQ ID NO: 4342 - DNA, 1158 bp, B.fragilis
gatgcttattttcttttaattataatagaactgaatatgaaaaaaatagcaatagtaacagctagttttgcaccaatttctaccccaagggcaaatagagcaactgaactggcgaaagaatttgcgaaacaaggttgtttagttacagtctataattgtacttcggttgtagatggcacatttaatataaatgaaaatattagagttgttgatttgaatatacgtaaagctagtattatgaaatcttcaactaaaaataatgttacatataccattttagataaaggtattattttgattagaaaattagtatattactttttcttgggttcatggctgctttatttatttggcttaaaaaagaaactaagatttgatgataaatatgatttattaatttctataggactaccttttacaatccattggggggtatcgttaagaatacatggacataatatagcaagatgttacgttgctgattatggtgatccattttcgagaggtaatgataacttgaaatgtgctaagtattttcaatggatagaaaaaaaagtaatagataaatttgattatataactattcctacttacaatgcaatagattcttatacttggttaaaaagttcggattgtattaaagttattccacaaggattcaatttttctgaagttaagacacttgattatgtacccaataaaatacctacatttatctatgctggtattttctattcggatatacgaaatccaaagaatttatttgatattctacttaaattagattttgatttttgttttattatttatacggtaaaaggtcttcaagatagttattcatgtataaagccttatatcgataaacttggtagtaagttagttatatatgattcaattccaagattagctctaatagaaaagttgagtgtagctgattttttaattaatatgagcaatacttcagccaatcagatacctagtaagttgattgattatgctctatctcacagacctatttattcttgtacacctaattctattgacttagataaattaattagcttttgtaagggagattataccggttctgaaaatatcaaccttagagattacgatattactactatagtaaatagttttttttctttaatgcaataa

SEQ ID NO: 4343 - DNA, 1296 bp, B.fragilis; identical to SEQ ID NO: 845

SEQ ID NO: 4344 - DNA, 624 bp, B.fragilis
  unsure (557),(601),(602),(603),(607),(608),(620),(621): Identity of nucleotide sequences at the above locations are unknown.
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagataggtcttcacaacggggntggaagtatcagcatcgtacgtattcaaggggccatcgttcccnnncctnnccgggccccatnnccc

SEQ ID NO: 4345 - DNA, 276 bp, B.fragilis
aggcataattttttctccttctttactaatgttactactacgtttcattcatgtttcgttgatcaacactgcaaagatgaagatttacaaattatcggcaaaggaaaaaacggtccggaaagcagttttctcagaaaaacttataacacgcttattatctgtatcataattctaagctcttcgttcaaaacaggtgcatacacatgtacccaatatcagttaagttttagttcatccgacaaatgcatagttccaatacagaaagtctcacaatag

SEQ ID NO: 4346 - DNA, 954 bp, B.fragilis
gttatgtactatttaataatcctggttctgctatttttggcagaacttttttatttccgtattgctgataaatgcaatatcatcgataaaccgaacgagcggagttcgcacacccggatcactttgagagggggaggaattattttcttctttggcgcattagcttactttctgacgaatcagtttgagtatccttggtttatgctggctttgacattgattacttttatcagttttgtagacgacattcgttctacttctcaggggttacgtttggtgtttcattttacggcgatggctttgatgttctatcaatgggggttattcagcctgccttggtggaccattgtggttgctttgattgtttgcacagggattatcaatgcctataattttatggatggtattaatggcattacaggtggatactcgttggtggtgctggcggcattagcatttataaatggggtatatgttccatttgtagagccggctttgatttataccatgctttgtgctgtgttggtctttaacttcttcaatttccggaaacaggcaaagtgttttgcgggggatgtaggttcggttagcattgctttcgtgatcctctttctgatcggtatgctgataatccgtacggaaaatttcagctggattgtcttgttggcagtctatggggtggatagtgtgctgacaataattcatcggttgatgttgcatgagaatattggtttgccacatcggaaacatttgtaccagattatggcaaatgagctgaaaattcctcacatggtggtttcgttggtgtatatgttggtgcaggcagtagttatagccgggtatcttctattcccggggaatgaatatgggtatttgtcgggtaccattattgcgctgagtttggtctatattctatttatgaagcgtttcttttgcttgcatcaagcgaagtga

SEQ ID NO: 4347 - DNA, 762 bp, B.fragilis
aaaatgtctcttgaggttttgaaaatttcttttattgttgttgaatatcattcaatagaagatattataacgtgttattcatctattattggtattataccttctaattggcaatgtgaagtgattgtttcttctaattcagtttatccattaaagcagcaggaggaacttaaaactttatataaagatattaaatggaggtttaacgaaaagaatgggggatttgcttatgctatgaatcaaggtttatcaatagcagatggtgatattcttgtaataatgaatcctgatgttaggctgaaaacgggaattgaaaagatggtaacttatttgtactcccataatgaaataggagttattgctcctaaaataataaatattaatggtaaaatacaagatagctttcgggattttattacaccaatgaacttcataaaacgacatttgagccgtatattcaaatctactaatcagattggtattattgaggtcattagtcaagtggattgggtaattggagcttttatgatgatgccgcgtcaagcttatgaggtagtaaaagggttagatgaatattattttttatattgtgaagatatggatttctgtaagaggatacaattggaaggtttttctgtggtttattaccctgaaagtgaaatagaatatgaaggaacacgctctgcaagacggtcgttgaaatatgcttgcatattttttaagtcattgttacgatattggactaaatttggattcaattag

SEQ ID NO: 4348 - DNA, 276 bp, B.fragilis
cacgttggatacaagttctgtgtcaactccattgatgccctatctctaaacaagggaaagctggaacgggatttaacgaaccgttctgatgtatatatgcccttggagagtatcatgttcgctggctacaacgcttacgtgtttataggtgatgagttaaagtctgctacgtttaaggatacggagcaccaggtttgcaggtccatacgaaaagttgaaaaccgcaccggagaacgtttcaaactatctgaaagaggcggtcaattacctcgataa

SEQ ID NO: 4349 - DNA, 219 bp, B.fragilis; identical to SEQ ID NO: 4194

SEQ ID NO: 4350 - DNA, 252 bp, B.fragilis; identical to SEQ ID NO: 860

SEQ ID NO: 4351 - DNA, 252 bp, B.fragilis; identical to SEQ ID NO: 860

SEQ ID NO: 4352 - DNA, 390 bp, B.fragilis
gatcccctaaattcaccatccgtaagtataatagcttttccaataataggatgctctaagaacatttttataccatcttcgtatataagatctctaccagaagatgtttctaaggcactgccaagctcaaaaagagtcattgtgcgttcaataaaagggctgttaaaatattccttaaaaaataagtctatactatctaagtttagtaatagcactatgaaacaaaaggcagtcgttaaaataatcttaaaattcagtttcaaacagagatataatgctaaaatggcaaataacgcaacaaaagggcttctagaatttgctaaccccattgataccaatcccaaaatgataggaatggaaaaaagccatttccatttatttcttttatag

SEQ ID NO: 4353 - DNA, 1053 bp, B.fragilis
aatatgatagattttaaaattaaaatctcagacaggttaaagtatcccgtattttgtactatattagctgtttttgcttttgatttaagaactttctttggagcttttctgcctataagcctaattacgtcagtggttcttataatttttatctattgtttctgtcttctttttttgagctcgcataggattttacctattaaaataagaaatatggatattctattgattatctttttttttatttatggagttcggatgtactataacatatttgtagagcaactttatcagttattatttgtaaatcgatttacctgtattgtatactatatgtttatatgtatactaccctatgtaatttgccggcggattccttggaatattattaattttagaaaagtcttatggactctgtggtggctatttgtgctagggcttgtgcttgctttaaaatcggtgttatctatattagcctctggagatagtttctttaatggtagggctgatgcgaatacttatttagatactatcggatatgggcatacagggcttagccttgttcttatctgtttttcacttatttctttctataaaagaaataaatggaaatggcttttttccattcctatcattttgggattggtatcaatggggttagcaaattctagaagcccttttgttgcgttatttgccattttagcattatatctctgtttgaaactgaattttaagattattttaacgactgccttttgtttcatagtgctattactaaacttagatagtatagacttattttttaaggaatattttaacagcccttttattgaacgcacaatgactctttttgagcttggcagtgccttagaaacatcttctggtagagatcttatatacgaagatggtataaaaatgttcttagagcatcctattattggaaaagctattatacttacggatggtgaatttaggggatcttatgttcataatatattcttggaggtgtttatgggattaggattagtgggtggaggtttatttcttccttaa

SEQ ID NO: 4354 - DNA, 192 bp, B.fragilis; identical to SEQ ID NO: 4203

SEQ ID NO: 4355 - DNA, 210 bp, B.fragilis
agtctgctacgtttaaggatacggagcaccaggtttgcaggtccatacgaaaagttgaaaaccgcaccggagaacgtttcaaactatctgaaagaggcggtcaattacctcgataaatttgggaatgaaatatttgcctatctaaaggatggtaattatccgattgataagaactctgctgaacgaagtattcgcaaacttatcacgtag

SEQ ID NO: 4356 - DNA, 1413 bp, B.fragilis
gtgaataagctacttaaaaactggtcatatttgttactgtctgatatatctcagtcagtaattaatttttttgtttttatgttgttggctaggaaattaactcctgtcggctatggtgagtttaatgtaatactagctatagtggctatattttcagtagtagcgacgaatttgggagctaaccatgtaataacaagagaggttactttacaccccgataacacgaagggaatttgttataatgtaatacctttaaggttaattgcattagcgattgcttttcttggtgtctttgtttatatagtttgtgggaaagatgtgtcatttagttcgagcttttatatttttattttgatatttgccacatctgtttgggattttgctgagtccgttgcttttggtcgtttagtaactaaatatactacttttttcaatctttcattttcatgttcttggttgctatttgttctttttctgccagaaagttattttagtatagaagttgtattggttatttattctctgttgtttgtatgtaaatcgattggttatttgggacgttcttgtgagaaatttgtaaaaactactttgccagttatatcattgacaaaacgatctttatttatgatgagtcttccttatttatggatgagagtgtttggaatatttggtgagcaaattccaattctaatcttgaataataaatgtggaactgatcaagtaggctacttttcggttggcttccgattgattattccaattaccatcgctataaatacaggattgagggctgttttcccctttatgacaagagcttatacagaagatcctaaattattttctgagaaattaataaaggtttttactttcgtaatgatttgggggactctagtagcaggtattttggttttatttagtgaatattggattcccttctttctaggaaaatcatatttaaattcaattgatgcatttaattatttggcatggtttggagttggaatgtgttttgatttgttgttatctacgctcttgtcatctacatataaacaaaaaatattagcagctattacaactattgatttttttattgtcatagcttttttgtattggggagctcaatatggagcaatagggttagctttagctaagttgttgagtatgctatttatattgggttatcatattatagttgtttgtaaagtatttaatatgagtatccggaatcgtaattttattatttctttggtggtttatttgtttgctatgtctgttaccttatttatttcattattcattcttaaattactactatttatattacctttcttggtggtgggatttattccaaataatcctattaggcaatgtatagtaggagtacgttcattgatatataaaaataaaatatga

SEQ ID NO: 4357 - DNA, 516 bp, B.fragilis
atgaaacgtagtagtaacattagtaaagaaggagaaaaaattatgcctttattttatagagcgagacaatcgcagttgaaaactaaagagggaaagaaacagtggcacctgactctggtgaaagttggaaaaatggtaacttcacaacagttggccgaagtaatagctgaaaaatcatcgttgacaccgggtgatgttcataatgtgattcgtaacttgatgactgccatgcgtaaagaattgttgaatagccgttcggtacgtttggagggattaggcactttcacgatgaaagcttgtacacaagggcatggagtggatcaagaggaagaggtgagtccgaatcaggtggcggctcttcgttgtctgtttactccggaatatactcgtcccgcagctatcggcactacccgtgctttgcttcagggagtggaattccagaaagtcagtgcgatagggggagcaattaatggcggatcgggtagtggagatattgtggatgatccgacagcctga

SEQ ID NO: 4358 - DNA, 189 bp, B.fragilis
aggagtataggcttggcacggatgagccaaaagggaatggcggagaaatccggtgtgagtcttgctactataagccattttgaacaaggtgtcaatcagaacatgaccctgaataatttcatatcattgttgcggataatcggcatggagcaacgtataaatgattgcctgagttgcccatgccactaa

SEQ ID NO: 4359 - DNA, 243 bp, B.fragilis
ctcacttttatattcttgatagtgttcaacccactctttaaacttatacccatcgttataagttatagtaatagctgcaatattcatattttatttttatatatcaatgaacgtactcctactatacattgcctaataggattatttggaataaatcccaccaccaagaaaggtaatataaatagtagtaatttaagaatgaataatgaaataaataaggtaacagacatagcaaacaaataa

SEQ ID NO: 4360 - DNA, 183 bp, B.fragilis
ataaaaattataagaaccactgacgtaattaggcttataggcagaaaagctccaaagaaagttcttaaatcaaaagcaaaaacagctaatatagtacaaaatacgggatactttaacctgtctgagattttaattttaaaatctatcatatttcaatatatcatgatatatattatcaattga

SEQ ID NO: 4361 - DNA, 918 bp, B.fragilis
aatatgaatattgcagctattactataacttataacgatgggtataagtttaaagagtgggttgaacactatcaagaatataaaagtgagttatatcttcacatcattgtggataacggttcagaagatgaatatatggcgcaactgaagtcaacttttacagattctataattatcgaaagaggtaaaaatggcggttgtactcatgcttataatgatggaattagatatgctcttaatgataagcatgttgatgcaattatgttgataggaaatgatataaaattatcggttcatggtgtgaaaggtttgtatgatttcttaatgtctaatgctgaatatgggatggttgagcctatactattagcgaaagactctgatattgtggaggactttggtaatgagatatcgaggtatttgcagatgaaaccttttgcagtagggcaaaatatcggtaatttaacaggagatgaagtcagaactgtatttactgtaactggtggcatgaacttggctaaaagagagttttatgagattgtgggattgcaagatgatctattatttatgtattcagatgaagtggatatgggaattagagctaaacattgtggattcactatggctgtgactaaaaatattcaagcctggcatcaacatattaatcctggaggaactgtacgtagacagatgtatacatcttatcttataggtcgaaataaggtatatcttgcgaataagcactttggccgtctgcggcaggtggaattgttcttatatcattttttcttatttataggtggatatttgaaaaatataaggaatagggaagcacaagcgcatttgattcaattcataaaaggttcgtggaatggtcttataggaaaaatgtcattagttggaataattaaagggtattga

SEQ ID NO: 4362 - DNA, 264 bp, B.fragilis
ggctcgattttgaaatatctatctttgttgcctaaccaaaattatatccctatgtttagcagtggagatatgtccgaagatcgtaaaagccgttatatcagttatctcgttgactacgtcaatgagaccgagttggacaagaaagcgctggaacttgtcttggaggattttcttagtgcctggaacgatatgaaagctgaactggctgagttacaaaggagacaagacgaaatggttttccaaactacaggagtcagcctctga

SEQ ID NO: 4363 - DNA, 234 bp, B.fragilis
cgaaacagtatgctctacttcggcagtgacgagggagtagagatggttgccacgtaccatagcctaatcagtactgtgaagatgcaggggcggttcgtttgggagtttctcagtaagttttttactaatatttttaacggttgcagagattatttgaatctctcaccaaaaatatcggactggactatggcaatagtaaataaatcactgaatcttttaacaaaacaattttag

SEQ ID NO: 4364 - DNA, 984 bp, B.fragilis
ttaaagggtattgaatatatggatattgtaaaggattataaaaaagttatagaaattactttaggagaagtagtggcatctcctgatttttttgtttcagttggggctattgattatggatatattattgataatggttgtatccttcctttctatataaaaaagaaattcctttttcgttatatgattttttcaacgggtatattaaattgttcgtcctctgaacaagaacaagtgtttttagaccggcttattccatttgtgaaagagtcatttaaaattgattttatattatcgcaacatgtaaatgctttgttttctattgttcctcctagatctcagtattgtttgtttggctcttatattttagacttgtcattgaccgaagatgatatatgggcaaaaatgcactctaagcataggaatgtaattagaaaagcagagaaagatggggtgattattacttgcggggatgacaataaagaagaatgcattaagttggtgcaaaacactttactgagacagggaatagcacctatcaatgataatgttttttctaatttaggtaatgttaagtatgtggactattggctggctactcttaataatggaatagagggtggggcaataatatattggcatccgaattgtggtgcctattatatgtatggtggatctggagaaaaacctcatactggtagtatgaatttactacagtggaatgtcatcaaaaagatgaaggaaaataacgtgaagttttatgattttatgggggcgcgcatgaatcccgaagttggtagcaagtatgaaggtattcaaagatttaaagagcgatttggaggagaacttaagaaaggatatctgtggaaatattctttgaatgattttaagtattggctgtatagattgctggtatttatatatagtaaaggtcattttcatggagatattattgatcaagaacgtaaaagaggtaatatatga

SEQ ID NO: 4365 - DNA, 1017 bp, B.fragilis
tggaatctaatgaatattcttattacaggggcttatggatttgtaggcactaatctaattaataatttaaaaattaaacacaacctttatggacttgatatagtttgtccgacaagagaaggagtactgaaaacattttattggaaagatattaatccagagtcattctcattacaaaaccttcctaaatttgatgcaatcatccatcttgccggaaaggctcatgatacgaaaaaccaatcagctgctcagtcttattttgatattaataccagtctgactcaaaagatatttgatttctttttggagtcttctgcgaagaaattcatattttttagttcagtaaaagctgcggcggatagtgtagtgggagatatgcttactgaggatgttattccggctcctgttggtccttatggggaaagtaaaataagagctgaagagtatataaaagaacattttgcatttcctgctgtctctccctgtgagtgttctccttttcgggagatgacttcggttacagagaaacaggtttatatattaaggccttgtatgattcatggtccggggaataaagggaacctgaatctattgtataatgtggtgaagaaaggaattccctggccattgggtgacttcgaaaatcgtcgttcgtttacttcaattgataacctatgctatgtgattgagggattattgactaaagaggtacctacgggcatttatcacatgggggatgatgaagctttatcaacaaatgagttgattgccatcatgtgtgaggcaatgggaaaacagccccatatctggaagatgaataagggctttatggaaggatgtgccggactgggaactttactccatttgccactgaatacggaaaggcttcgtaaactgacagagaattatgtggtaagtaatgctaagatcaaagctgctctcgggattgataaaatgcctgtgacagctaaagaggggttgattaaaaccattcgttcatttgaagaaactaaataa

SEQ ID NO: 4366 - DNA, 210 bp, B.fragilis
ggacatactgtcgacggagtatgcagcagcagtacacatcgtactgatgatatagagggtaagatagatagacacgcgtacagaccgacagatatgaggggagtgctgattaaatattatgacattactgttggatgtagcttggtgattgaggggccagctgaggtggcactacattggatgacaggacggcgaacgagagagttttag

SEQ ID NO: 4367 - DNA, 1038 bp, B.fragilis
tatatgactgttaagaagtgtgtgttaacgttggattatgaattgtttttcgataaaagcggaacgccacaagtctccatgcttaatccaacagatctattattaaatgttttagaagaaacgtcatctaaagctactttttttattgatactatttatttgaataaacttagaaatagtaatgatataaaaaataaaatattatttgataatatagtaaaccaactaaaaagaattgttaagcaaggtagtcggatagagttgcacttacatcctcattggattgatgcttatcagaatggagatcaatgggtatttccttcttacgcacattataaattgggcagtttatctgatgaaactgtagagtgcctatttaaagaaggtattttattattgaatgaaattgcacaaagtgttgatcgtgattataggataatggctttccgagctggcggttggtgtgttgagccatttactaagttgaggaatctatttgtagcaaacaatatacttatagattcatcagtggtttctggaatgaaattttctggtgaggttcataatattgattatagttccattttacctaacactcactactatttttcagattcggtttatgaacagaatagtacaggtgtgtttttagagattcctattaatggatatcaactgtctgccttaaataaaattgtgtggaaaatgaagagtatattggcaggtgaaaaggcgaaaatatatggtgatggtgttggtatgcaaagtgttgagcatcaaacaatattgaataaaattcttaaattgtttgttggacaggggcagtatgttcaatattcgttagatggttatattgattctgataatctcaataatgctattaataatagtaaacttagttttatttcattggttgcgcatccaaaaacattgacaaagtcttctctagatgcaataaaatatcttactaatgtaggatgctcatttgtctcaattgataatatatatcatgatatattgaaatatgatagattttaa

SEQ ID NO: 4368 - DNA, 717 bp, B.fragilis
atgatatcagtgtgcatagctacttataatggaagtaagtacataaaagagcagatagactctattttacctcaattagacgagtgtgatgagattattgtttcggatgattcgtcgacagataataccctctccattcttaagtcctatcatgataggaggatcattatatttactaatcaaaagttcaattctcccatatataattttgaaaatgctttaaagcatgcaaaaggtgatattatctttctttcagaccaagatgatatttgggagtttaataaggtccaagtaatgatatcctttcttcagaaaaaatcattggttgtgtctgattgttatattattaatcaagataaaaatgtaatttgtgattcgttatttaatggaaaagttccaaacgccggagtattcattaatatacttcgtaatcattatattggttgttgtatggcgtttcggcgagagattttaaatgcagcattaccttttccttcttctttagccatgcatgatatttggttaggattatgtgcgtctgccttttattctgctgtatttatacctaatcggctcataaaatatagacgacataatactaatgcttctccgacactagaaaatagtaatttgccattattgtatagggtacagtatcgatggaccttgattatagcgcttgtaagaagagcgttgaaaataagtaagcatctatag

SEQ ID NO: 4369 - DNA, 804 bp, B.fragilis
tacagtcttacaatgaaatcttccatggctatgataaaacataaaaaggagctggttgaatatgcacggcacctgaaactaccgaacttggcagaacatgtgggtgtgatacttcatgaagcacaggagaagcaactgacctattcggagttcctggcgaattgtcttgccagggaaatccagggcagagaaaggaaaagctacctgacacggttgaaactctccggactccccgccaaatacgatctggacctgtacgactatgacagggcggaaggaatggataacaggaggctgcgcgaactgcgtgagctggtatgggtgaaccaggcatacaatcttctcctggtaggcccttccggaaccggcaagacctttatagccgccggactcgtgtatgaagccgtaaaagcgggatacgaagcatatctgatgacactggaggagctgctcacatgcctgaaaacgaaagaggtctccgcacatgcgatgaaaacatacaagcggatcatgaaggcccggctgctggccatagacgatgccacactgttccctttgaaaagagaagaagccgtgttgctgttcaaactggtcaatgacttccaggaaaggacatcactcatcatcacggcaaacaaggcactcacccgttggctggaaacattggaggatgaagcggtcacagccgccttgcttgacaggctgctctactgctgcgagattatcaggctcggaggaacaagctatcgcatgcaaaacaggaaaacaatttttagcaaccaaaacacggatataggcacgtaa

SEQ ID NO: 4370 - DNA, 1002 bp, B.fragilis
agaccagacaccggaatggaaacaaagagccaaaatttaaaagacaaactgtatatgtggtacaaggtaagagaacttcagtcgaaaggactgagcaagacacagatcggaaaatatctgggcgtggaccggagcactgtgcggagatatctgcggacaagccgggaagagtttttcagaaagcagaactcccaccgggagtatgaactcaagttgggaaagtacgaggagtatgtacggggtacactggaagaatacccgtacatatcggctgcccgtatgcatgactggctcagggagtgttaccccgattttccgcgggtatgtgacaagaccgtattcaattttgtagacaggatacgcaggaagtacggtattgggaaaaaatccgaggcccggatacggcgtgattatgagaagttgcctgagaccccctacggggaatatgcccaggcggatttcggggagaagtggatacctgtgaagaatggcggaagcacgaaggtttacttcttcgccatcgtactgacgcgttcccgctataagtttatccatttcagccgtcgtccttttgatacggagcttgcgatttatgcccatgaactggcctttcagtatttcgggggcaggcctgaaaagattatctatgaccaggacagggtgcttatagcacgcgagaacctgggagatttgatactgaccgggaaatttcagtcattcataaaagagcagcatttccagccggtattttgtcgcaggtcagaccctgagtcgaaggggaaagtggagaatgtggtgaagtatgtgaaagagaattttctggtggcccgtgttttacaggatatccccgggctgaatgaggaagcccggaaatggcttgaaaggacgggtaatggaaaagtgcacgggaccacccgcctggtcccctctgaggagttcgctgtggaaaaaggatacctgaaccttattatggtctacccgagccaccacaggagcagatga

SEQ ID NO: 4371 - DNA, 1779 bp, B.fragilis
aaaagtggcgcacaaatttgcgcgccacaccctatatcgaagttacttcggttggtaatgctccttgcggtggtgctgttattgtcttcctgccgtcaggacgatgattcatatagtagtcacccgggccccaccacccttgtaagtctgtctgtgtccgcttccaacagtggtgcggtagcggcttccgatgatccggcttcatccatcagagacctttgtattctccaatttaatgtaaacggcacaggtttcggcaatttgcgtcatgtggccaagggctcaccggcaagtgcggggactttcaatgctacattgttgcagagtgtaaatccggatgacaagtataaacttgtgttgcttgccaacctgcccgattacggtttcctgaacagtctgtcggggaaatcttatgaccaggtgcaaaagacattgctgagcgaagagcttagcgggcggaacaatattccgtctttcgatggatcccgtcccttccagatgttcggagtagccaattccggaaattcaatagagatcactgaaaacatgagtctgtccgatgtgtccctgatacgcggagtggcgcgtgtggatatcggcattggtataaaaaatgcagatgatacatggaataaaaacggggtgaaatttaacatgacccagattcagatctggaaagcgggcaagcaatatgcgtacatgccttctgaaaataatttttcctccacaggacgagtggatggagtgactataacaggtccttctcccgtggggactacggaaacgaaggtttatgacattacacatattataaacaatacttattgttgtggaaagatctatcttcctgaagccgatttgaactggggagatgtatatgatgctagccacacagatcgcctggcagttattgtagggggtaaatataacggttcgcaaacagaaacattttaccgcgtggatttcaaaaatgatgtttcgggtgaaaaaatggacatattgcgtaaccatgtttatcggtttaccgtaacgaaggtaacggatgacggttatgatacagccgaactggcctataaaagtataccgaaagatataagctttactgccgagcttactccatggacattccctcctgcggtttccgtgccttccataatcggttaccgtatggtgtaccaaaacacgaatggtggcatgttgttgtggaatacagcaaccggacttactattcctaaaaagagagatacctggaaggggactaaaatgaactttaactataacggattttatgacgaaacaaataacgcttatgctataacctatccgatagaacctcgaaacggatcgctatatcacaccatagaggtggcttttgattatgagggagtatacccctcccttatggtatcggccgatgatgtcactgacgtgacgggtggagataccaatccgtggaaaacgggtaaaacccttacggcttttgacatttgccgcaactatgaaggagacggatttggcgactggaggcttccgcggctttccgagctggctttgctctatttaaacagagggagcctggaggcaatgagagggtttgctccactaagcggaacttactggagcggttcggaatatctggtaagtgattcgaaggtagataaaagacactccgaacaggcttggggaatcaactttgatgctacgaatccgggcaatgcggcaccctatgacaaaacaacgaaaaaatttaaaatccggtgtgtacgacaaacgcagtaa

SEQ ID NO: 4372 - DNA, 195 bp, B.fragilis
caaccaaaacacggatataggcacgtaaaaagagttaaggaaagtgaagcatcttcgatgctggagtgggatatactaaattacctaaaaaagtggcgcacaaatttgcgcgccacaccctatatcgaagttacttcggttggtaatgctccttgcggtggtgctgttattgtcttcctgccgtcaggacgatga

SEQ ID NO: 4373 - DNA, 645 bp, B.fragilis
ggagttcgctgtggaaaaaggatacctgaaccttattatggtctacccgagccaccacaggagcagatgaaagaatatcacgtgcgtaaggacaacacggtccagtatagggggaattattacagcctgccatgcggcacttaccggagcgggcagacgagggtctggttgcaggaaactgaggggtatgtggaactgtacagcaaggagacgggaaaaatcgtcgccagacatcccctctgtacccgaaaaggaaaaacgatttatgacgaaagacacagaaggcccaagagtattggggcacagaagctggccgaacgtatccttgtttatgtatccggaaaccgggaggtcgccttgtggatggagaacctcaagagaaagaaagaacgctattacaaggataatctggaagtggttctgcacatgatgccgggctatgacaaggatatcttgatagaggcagtgcacatatgtcttgataagggcatctacaatggcgattccgttaaaagcctgtgtgaacacgtgcacaggagacggaataaagaaactgaaacagacaggacggacagttgcccgccgcgacaaaccgggctgatacagtcttacaatgaaatcttccatggctatgataaaacataa

SEQ ID NO: 4374 - DNA, 372 bp, B.fragilis
  unsure (365),(366),(367),(368): Identity of nucleotide sequences at the above locations are unknown.
aatccggtgtgtacgacaaacgcagtaaatgaaaaaatatcatatacaataaatatggatactcaaaagaaacataatttatccgggacaatcatccttgtatcgtgctttttattactggcaggagcctgtgataatagtgaccggatcgagacagagactcaggcaaacggtgtgctcctgaatttcaatgcgtcgacgattgatgcaaccactactgaaacaagaagttttgttcccattgaaggttttgccaaaaacgaatatatttttggcatgtctgtcaccaaagataatgcatcacggggtgagatttttgaaggatgcagcatggtcgtcagtggtggaaggtcacgcggtcaatnnnnttaa

SEQ ID NO: 4375 - DNA, 219 bp, B.fragilis
tatgtacctttcttttttcataagccgtatggtgatatcgggtcatcggacggcggcaaagctacaaagaatctacggaatgaccaagggatagcatcggtttgtaagcagggacctctcctctaccacaaagacggtataagaatcccttataaaggggatttcaagaacaatccccatactctacttttgcagcaggaaatgatccgtgaaaattaa

SEQ ID NO: 4376 - DNA, 2259 bp, B.fragilis
tatccccaccctatgactatcgaagaaataaaaaaccaagtattacaaggaacggctatcagccgagagcaggccggatggctggcgctctatccccgtaaagaagagttgtatgatgccgcgcacgaaatcaccaccgcctgcgcttcgcaggagttcgacatgtgttccatcatcaatgcccgctcgggacggtgtccggaaaattgtaaatggtgcgcccagtcgtctcactacaagaccaaggccgatgtatacgatctggtgagcgcagaagagtgcctgcgacaagcaaaatacaacgaagcacaaggggtcaaccgcttttcattggtgaccagtggacgcaaaccttctcccaaaaacatgaaagagctctgtgtagcggtccggcggatgcgtcgccattcgtctatccggttgtgcgcttcgctcggactgttggacgaagaagagttgcaggcattgtatgatgccggagtgacccggtaccactgtaacctcgaaacggctccttcccacttcgactcgctctgtaccacgcatacacaggaacaaaagctgaaaaccttgtatgccgcacgacgagtagggatggacctctgctgcggaggcatcatcggcatgggtgaaactgtggaacaacggatcgaatttgccttcacactccgcgatctcaacatccaatccatcccgatcaacttgctgcaacccatacccggcactccgctcgagcatcagtctcctctcagtgaagaagagatactgaccactgtggctcttttccggttcattaaccctgcggcttacctgcgctttgccggagggcgctcgcaactgacaccagaggccgtccggaaatccctctatatcggcatcaactccgccatcgtaggcgatctgctgacaacactcggctccaaggtatcggacgacaaagagatgattctctcggaaggatatcactttgccgactcacaatttgaccgcgaacatttgtggcatccgtatacttcaacttcgaatccgctcccggtatataaggtgaaacgggctgacggtgccaccatcaccctggaaagcggacagacactgatcgaaggaatgtcatcgtggtggtgtgcggtgcacggatacaatcacccgatattaaaccaggctgtacaagatcaactcagccggatgtcgcatgtcatgttcggcggactgacgcacgatccggctatcgaactgggcaaactgttgcttcctctggtcccgccctctatgcaaaagatattctatgctgattccggctccgtagctgtcgaagttgcactgaagatggccgtacaatactggtatgcagccggaaaaccggagaaaaataatttcgtcaccatccgtaacggttatcacggagatacctggaatgccatgtcggtatgcgatcctgtaacggggatgcacagtatctttggttcggcacttcccatccgccacttcctccctgctccctcctcccggttcggagatgaatggaacccggaagacatccgtccgttggagcatctgctggagaaacataccgatgaactggcagctttcatcctcgaacccattgtacaaggtgcgggaggcatgcgtttctaccatccggaatatttaagagaagctgcgcgcctctgccaccggtatggggtactgttgatcttcgatgaaatagcaaccggattcggacgtaccggaaaactcttcgcctgggaacatgccggagtagagccggacatcatgtgcatcggcaaagcattgacaggtggatacatgactttatcggcagtactgaccaccaatgaagtggcagactgcatctccaaccatgcaccgggagcattcatgcacgggcctacgtttatgggaaacccgttggcatgtgccgtagcctgcgcatcggtacggttacttctaacttccggctggcaagaaaacgtaaaacgaatagaagctcaactgaaccgtgaattagctccggcacgtgagctccctcaagtagcggacgtccgtgtactgggtgccatcggagtgatcgagatgaaagaaccggtgaatatggcatacctgcaacgccgttttgtggaggaaggcatctggctccgtccgtttggcaaactgatctatgtaatgcctccgtttatcattacgcccgaacagttgaccaaactcacggaagggatgataaggatcataagtaacggccttcccggttcccaaacgaaatag

SEQ ID NO: 4377 - DNA, 1470 bp, B.fragilis
aaaactaaaccaacagtaacaatgaaaagaaaaatcatatacttcctcttggccctcgcagtagtaatgccggccagtgcccagaaattttttaaagatgccatcagtctatccgatgtttcattatggcaacagggcaattcgctttatgtagacatgaagatcgatatgaaaaatctgacagtcagtcccgaacgtatgctcacacttactccgctcctgacagacggacagcacaacgtagcgctggaagagatcatcatcaacggcaaacgccgtcagaaggcttatttgcgcggattagccatcagccgcgaactacctgcaggaatcgtaattccttataataaaagagaagtgctcaactatgcccaggtgatcccttacgaaccttggatggcaaatgcttcattgaatctggtagaaaatctatgcggctgcggcaacaacgaagagatgcttgctcaggagctgataacaaacgacgtttctaccgaagcgaaacgcctgagtgccatgataccggtggttgcttatattcagccgactgtggaggtggtgaaaaaccgtagcgaacagtatgaagctcacctcgactttcctgtcagcaaagctgtgatccagccggaattcatgaataaccacaaagagctgatgaacattcatgctatgttcgacaagattcagaatgacaagaacctgacagtaacaggaatcagtatcgaaggattcgcttcaccggagggtccgttgaaattcaacgaacaactgtcgcagaaacgtgccgaagctctgaagaattatctgactaccaacgaaaaagttcccggcaaactttacaaagtaacttttggtggtgaaaattgggacggattggtacaagcattggaaaaatcgtccatgaaggataaagataaatttatcggtatcatcaagaatacgactgacgatgcgcgccgcaaacaggaaatcatgcgcgtggacggcggtgctccttatcgcacaatgctgaaagagatttatccgggactccgcaaagtgaactgcaagatagactacaccgtagccaacttcgatgtagaacaaggacgggtggtgataaaagtcaacccgaaatatctgagtctgaacgagatgtatcaggtagccaacagttatccgaaaggaagcaacgattttgtgaatgtattcgacattgccgtacgcatgtatccgaacgatgaagtagccaacctgaatgccgcagccgtatcactgaccaaaaaagatctggaaaacgcaatcaaatatatggataaagccaaccatcaaacagcagaattcatcaacaacgtaggtgtatacaacttcctcaatggagatgtacaacgtgccatcgctgccttcaaccaagctgcccagatgggtaacgaggccgctaaagccaacctacagcaactgcaacagatcttgaatatgaagaaaaaataa

SEQ ID NO: 4378 - DNA, 573 bp, B.fragilis
atcacggtgccagctataccgagaactctttctggaaagtgtctgtttccgtatcgcccaccaaactggaagacaaaccttgggaggcgttcaaagtgtcgtttggtaaagaatcgtctaccgaagtgtcttacaaggactaaatcgatggactattcctgcaaggggcagtttggtaacgggctgtacagtaaactttggcaggtttattcccggagagttctacgacagggccggaagccctttgtttacgaaacgagtcaggggttgcgtgggatagacgctgcacaagcgatgacacccaattatgtgacatggggaggctggacccttcgccagaattatttagatcacatcaacaacagtatgaagttgcatcaacagcagtgcatttactctctagagtcggacgcacagcccggagtcgtttctgtggctatcacagacgccatcgatttacaaaagacgtatgtacactataactgcggcattcgctatgggcacgattcggctaggacggatctcaaaatgtcgaagatggtgtggattgatttcaggcagtgggacaattga

SEQ ID NO: 4379 - DNA, 423 bp, B.fragilis
ttgatttatactctttggacattttggcatgccctttgctttttatttagcataaaagttgttttaattattcacaccaaaaaaattacgattatgaaaaaggtattagtagcattagcaatgattatgggattaggaacatcagtagcgtttgccagtgtatcgggtgacactttagcagtagaacaaactctgcaaactcctcaggacgaatttacacaaatagccgcaaaggaacttcctgctgctgttatcaatgcattggccaaagattatgaaggtgcttcgataaaggaggctttcgtttcggaaagagaaaccggtaaggtatataaagtgattgtgactgtaatcaaggaagatcaatctacggaagatgtaactgttcttttgaatgagaaaggtgagatagtgaaagaataa

SEQ ID NO: 4380 - DNA, 1365 bp, B.fragilis
aaaaaatatacgattatgagatatgatatagctattatcggtggtggacctgccgggtatactgctgccgagagagcaggagctaacggtttgcgtgctgttttgtttgagaaaaaagcaatgggcggtgtgtgtcttaatgaaggatgtattcctaccaaagccctgctttattccgctaaggtgctggacggtattaagagtgcgccgaaatacggtgtctcggtagagggggctcctgcatttgatatggaaaaaatcatcggccggaaaaacaaaacggtgcagaagttgacgggtggagtgagaatgacggtaaactcttacggagtgactattgtagataaggaagcggtgatagagggcgaaggtgaagaaggattccatatccgctgtgatggagaggtatacgaggcaacctatctgttggtttgtaccggatcggataccgtgatccctccgataaaggggctttcggacgtggattactggacctcacgagaggcgctggatagcactgttcttccatcatcgctcgccattattggaggcggagtgatcggaatggagtttgcttcattctttaacagcatgggcgttagggtgaaagtgatcgagatgatgccggagattcttggagcaatggataaagaaaccagtgcgatgttgcgtgctgactataccaagaaaggggttaatttctatctgaacacgaaagtaaccgaggtgagtgataaaggagtaacagtggaaaaggatggaaagagttcgtttatcgatgccgaccggattttagtgagcgtaggccgtaaagcgaatatcacccaagtaggattggataaactgaatattgagttgcaccggaatggggtcgttgtagatgaacacatgttgacctctcatccacgtgtatatgcttgcggtgatattaccggcttttctttattggcacatacggctattcgtgaagcagaagttgccattaatcatattttgggaatagatgaccggatggattatgattgtgttccgggcgtagtctataccaatcccgaactggccggtgtgggtaaaacggaggaggagctgatagctaagggtatttattaccggatacaaaaactaccgatggtttattcggggcgttttgttgccgaaaacgagttggggaacggactgtgtaaactgattatcgatcataatgatcggattgtcggctgccacatgttgggcaatccggcttcggaaattattgttgtggcaggcattgctatccagagaggatatacggtcgatgaattcagaaagagtgttttcccgcacccgacagtcggtgaaatttatcacgagacattgtttgcctga

SEQ ID NO: 4381 - DNA, 423 bp, B.fragilis
cccgatatcaccatacggcttatgaaaaaagaaaggtacatatcacattcgtttatccgcttccgccagtggagccggaaggcttatgccatatttgccactctgggtttgtgtgtcaccatcggacagttgagaaagaacatcaccgaatgtgcgttgtgcaagcagcaaactccacatacaaccggacttgatccgcaacgggaaacagaagattccgttccggaagaagattgggagaacctcacgttatctcccgaaccattgctcttgcttcttactcaactccaatcatccaaatattcttatgccggtgccgcacagtcaactgttgtgacatccgcctcacacattacacctaaagaggttgcctcccatcccgatgggaccggcaacctcttttttaatatccccaccctatga

SEQ ID NO: 4382 - DNA, 183 bp, B.fragilis
ccgggaagaactggaagcgaaaacgcattggggagaagaaacccagacgcaacaacccaaaggctaaagttcaccacaaaaggcactgagggtgtcatagttcaccactgtgtacacggattagctagatatatatttaatctactgatagcctatgatatttatctgtataatctgtggtga

SEQ ID NO: 4383 - DNA, 390 bp, B.fragilis
actttcggaacagacgcagtgcccgacacctcggcagcctttggagcagacgccgtttctacagagcctgcggtttccgatgcttctccggaaccttctccatccatatctacaatggcaactaccgtacctaccggtaccgtatcgccttctttaaacaatatttccaccacttttccggcaacgggagaagggatctccgcactgaccttagcagtattcacctcgaaaagtacgtcgtcctcattgaccacgtcacctacctgcaccgaccatgataaaatggttccttcggtaatactttcgcccaacttgggcatttttatttcgaatcttgccatatacacaattatttattctttcacttgtacaagtagaacaagattgtga

SEQ ID NO: 4384 - DNA, 3132 bp, B.fragilis
ggtatgaagaccaatttacgtctattatttacgttgctctttgtcgtttcggttgttgcattacgtgccggaacaatgaatgacatacgtgtttcgggcactgttgtgtccgaaggagacccgttgcccggtgtgtcggtattagtgaaaggaaccggcgtcggtactattaccggtattgacggcaagtattccatcaatgttccgtccgatggtacgctggtattcagttttatcggactgaaatctgtggaacataaagtgggaggacgctcagtgatcaatgtcgagctggtgcccgacagtaagcaattggaagaagtaatggtagtagcctatgccactgccaagaaatatagtttcaccggtgccgcctctaccgttaaaggtgacgagatagcgaagttacaaacctcgagcgtatcacgtgcccttgaaggaaccgtagccggtctgcaggcaagtgccgcaagcggtcagccgggtaccgatgccacaatccgtattcgcggtatcggatccatcaatgcatccagtgcacctctctatgtagtggacggtgtgccctatgacggtagtgtgaactctatcaaccccgaagatatcgcatcgatgaccgttctgaaagatgcggcctcagctgctttgtacggttcgcgtggagccaacggtgtgattattatcaccaccaagcagggacaaagcgattcgaagactacagtgaacgtgaaagccagcttcggtggttccaatcgtgcggtacgtgattacgaccggatcggcaccgatcagtatttcgaactttattgggaggctttgcgtaaccaatatgcactggatacaaagaactatactcctcagacagcagctatcaaagcttctaaagacttggtaggaaagctgatgggggccggccccaatccttatggctctaaatatcctcagccggtaggtacggatggaaaattggctgatggggccgttccgctctggaacttcgactggcaggatgccatggagcagcaggcacttcgtacggaactgggactgaatgtttcaggaggcggcaaaaccaatcaatactacttctctgccggatacctgaatgataaaggtattgcgttggagtccggttatgaacgctttaatctccgatcgaacgtgacaagccagatgaccaagtggcttcggggaggagtgaacatgagttttgcccactctttgcagaattatcccgtatcatcggatacgaaaacaagtaatgtcatcaatgccggccgtttgatgaacggattctatcccatctatcagatgaacgaagatggaacctataaactggattccgagggacagcggatatatgatttcggttcttaccgtccttccggttcgatggctaactggaaccttccggccacattgcccaatgataagtcggaacgtatgaaagatgaattttcaggacgtactttccttgaagttacctttatcgaagggctgaagtttaagaccagcttcaactttgacctgatcaactataattcactcgactataccaatcctaaaatagggccggctgttaacaccggaggttcatcgagccgtgaaaacgaccgtactttctcgtggacctggaataatatcctgacttatgacaaaaccctcggagagcatcatttcaatctgctggccggacaagaagcctattcctaccgttacgatgtgctgcgagcatcccgttcgaacatggcattgcctgattttcccgaactggctgtcggttcgttggtaaccggagggacaggataccgcgtagattactcgttggtgggatatttcctaaatgcccaatatgactatcaaagcaaatatttcttctcgggttcgtatcggcgggacgggtcttcccgttttgctcccgaaacccgttggggtaatttctggtccgtcggtgcttcctggcgtatcgaccgtgaagatttcatggtagctgcgagcgactggctttctgccctgactttgaaggtcagttatggtgcgcagggtaacgataacctgggaacgtattatgccagcagcggactttattcggtggtaagcaataatggggagaatgcgttggtatccgatcgtctggctacaccaaaactgaaatgggaaaccaacctgaacttcaatgccggcatagacttctcgttgttcaacaaccgattctccggttcgttcgatttcttccagcggcgttcgaaagatttgctctattcccgtccgctggctccctcgctcggttataattcagtagacgagaatgtaggcgaactgaagaataccggtgttgaaatcgatctgaaaggtaccttaatccatacccgggactttatgtggcgattggggcttaacctgacacattataagaatgtcgtgaccgaccttccattgaaagatatgcctgtaagcggagttcataaactggctgtgggacgttctgtctatgatttttacatgaagcaatgggcgggtgttgatccggagaacggcgatccgttgtggtacaaaaatgtgaaagatgccaatgacaagatcaccggacgtacgactaccaatgactatgcccaagcggattattactataccggcaaatcatccttacccaaagtgtacggaggatttaataccgctttctcgtataaaggctttgaactgtccaccatttttgcctatagtatcggtaattatattgtggaccgtgacgtaactatgctgtggcataacggaagttctaccggacgtgcctggtcgacagagattctgaaccgttggacaccggagaatcgatatactgatgtgccggctctgaaaaccgtatcgaacagttggaatgcaaattccacccgtaacctgttcaataactcgttcctgcggatgaagaatatcacattatcatataacttcccgcaaccgatgataaagaaaatcagcctgaacagtctgcaattgtttgtgcaggccgataatctgcttaccgtttcgaagaatcagggactcgaccccgaacaggatatcagtggactgacgtattaccgttatccggccatgcgttccatttccggaggaatcaatgtttcgttctaa

SEQ ID NO: 4385 - DNA, 603 bp, B.fragilis
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgccgtttcatcaggcagacacccattag

SEQ ID NO: 4386 - DNA, 225 bp, B.fragilis
agaatccattttagtaatatgaagaaattgctttgtccccagtgtaaaatagccggtatgtatgtaaaaaacgatcagggtgaacgtctgttagtatatattgcccaagatggaacagtcgtacccaaatatccggaaatcccaatcgaaggattcgattttacggaagtatattgtctgggctgttcctggcatggatcgcccaaacaactgacaagattctaa

SEQ ID NO: 4387 - DNA, 222 bp, B.fragilis
aaaaggaatttgaagtttgatccggtcataccgcagagtagcacaggactgactgttatgtcgttcgtgtgttactctatggcaggcctgtgtgtgttaaagtacgaactttactgctgcccatcggtttttctcttgatggtgtacgaaggtgagtccgtgcttttctgcttcccggcggatagccggaatatcatcgatatagaatccgctcataaataa

SEQ ID NO: 4388 - DNA, 1569 bp, B.fragilis
tcagacagatacaattcaaccatatacaatagtgtccaatatctggacgccaccgtgtacagatattggacacttgacgattgtttcccactggaatactttctgatacttctccggcataaattctcaatccgaaaacgtctaaatattggacactctcttgcagggagttacaaaaacaaatatctttaccacgaacttaaaaaaggaagcgaatcaaaaggagatgctatgaacacaggaaccattctgattgtagacgataacaaaggagtattggcctcactcgaacttctgctcgaaaactacttcagcaagatactgacagcttcgaatccaaatcagatcaccgccctgctgacaacgcgccgcatcgatgtagtcatcctggacatgaacttctcggcgggtatcaacaatggcaacgagggactttactggttggggcacatccggcagatggctcccaccctacccgtagtgatgctgaccgcttacggagatgtggaacttgccgttaaagcacttaaaaacggtgcagccgacttcctgctgaaaccatgggacaaccagaccctgatcgacaaggtgacggaagcctaccatagccgcaaagctccggaacgtactgcaaaagttgacagggctgagggattcgaaatgctggtggggcgttcgcctgccatgttgcaactgatgaaagtggtatcgaaagtggcacgcacggacgccaacatcctgataacgggagaaaacggaacaggcaaagaaatactggcacgggagatacaccgcctctcacctcgtggcgcacgtccgatgctgaacgtagatatgggggccatcagcgagtcgctgttcgaaagtgaactgttcggacacgaacggggagctttcaccgatgcccacgaaagccgtcccggaaagtttgaagcggccaacggcagttcactgttcatggacgaactgggcaacctccctctcccactccaaaccaagctcctcaccgtattgcaaagccggaatgtgactcgtctgggcagtaacaaagtgattccggttgatatccgcctgatttcggcaacgaacaaagatataccggaaatggtgaagcagggcatgtttcgcgaagacctgttctaccgcatcaacaccattcatctagaactgcctcccctacgtgaacggggagatgatatcctactctttatcgactgcttcttacgtaaattcacctctaaatatcaacggcaggaaatacggatacacgagcagactgtcgaaaaattacgcagttatcattggccgggcaatataagggagttgcagcacaccatcgaaaaagcggtcatcttgtgtgaaggcagcgtaatccgccccaaagatatcctggtgaaacagacctggcaaccgcaggcaaccgccactgtccccaatctggaagaggtggagcggagggccatcgaaactgccatcctgcaaaacaacggtaacctgactgccgcagccgaacaattgggagtgagccggcaaacattatacaataaactcaaacgattcaaactctga

SEQ ID NO: 4389 - DNA, 1380 bp, B.fragilis
ataattgtgtatatggcaagattcgaaataaaaatgcccaagttgggcgaaagtattaccgaaggaaccattttatcatggtcggtgcaggtaggtgacgtggtcaatgaggacgacgtacttttcgaggtgaatactgctaaggtcagtgcggagatcccttctcccgttgccggaaaagtggtggaaatattgtttaaagaaggcgatacggtaccggtaggtacggtagttgccattgtagatatggatggagaaggttccggagaagcatcggaaaccgcaggctctgtagaaacggcgtctgctccaaaggctgccgaggtgtcgggcactgcgtctgttccgaaagttcaggcggaagtaaccgctcccaaagtggaacgttggtattcgccggcagtacttcaattggcacgggaggcgaagatttctcaggaagaactggattcgattcccgggacaggttatgaaggtcggctgagcaaaaaagatatccgcacttacatcgagatgaagaaaggtgctccggcagccgacgtctctactacggtggtttcgacggtttcggcaaataattcgggctcttctcctgttccttctgcagaagtacaaaagaaggctgccgctacggctcctcaggctcagcatggacaatctgcttctgccgtttcttcagatgcatcggtagaagtcaaagagatggatcgagtacgtcgtatcattgccgaccatatggtgatgtcgaaaaaggtttctccgcatgtgactaatgtggtcgaagtagatgtcacccggctggtgcgttggcgcgaaaagaccaaagatgatttcttccgtcgtgaaggtgtgaagctgacttatatgcctgccattgctgaggccactgctcaggcgttggctgcctatcctcaggtaaatgtctcggtggacggatacaacatcctgtataagaaacatatcaatgtgggcattgctgtttcgcaagatgatggaaacttgattgttcccgtagtgcatgatgccgatcgtttgaatcttaacggacttgccgtagctatcgattcgttggcgaaaaaggcacgggttaataagctgatgcctgatgatatcgacggaggaacattcacaatcaccaatttcggtacgtttaagatgttgttcggcactccgatcatcaatcagccacaggtggctattctcggagtgggtgtcattgagaaaaagccggctgtggtggagactcccgaaggagatgtgatagccattcgccataagatgtacttgtcactctcttatgatcaccgtgtggtggatggttcactgggaggtaacttcctgcacttcattgccgactatctggagaactggaaagaatag

SEQ ID NO: 4390 - DNA, 207 bp, B.fragilis
cacggtccccagcaacagttcggcaattacggactctcttttctctgtaatatgagtttttactccgaactatttgccggtacgccgctggcattcgaccgtcggcagcaggatattctcgtatctctgctcctgaaagggtaccaatggattgtatggaggggtaactgggatgtaaccggcctgaaccgaaaactttttccatag

SEQ ID NO: 4391 - DNA, 870 bp, B.fragilis
atcgtacttttgcaaataaaaacacctatgaagtactttgagttcacttttgatacacatccttgcaccgaaacggtgaatgatgtgcttgctgccgtgttgggcgaagccggattcgagagttttgtcgaacgggaaggcggactgaccgcttatattcagcaatcactttacaacgaagagacattgaaaacagagctggcaaattttcctgtgccggatacggaaatttcttatacgtttgccgaggccgaagacaaggactggaacgaagaatgggaaaaaaatttcttccaaccgattgtgatcggagaccgttgtgtgattcatagcacatttcatcaggacgtgcctaaggcagaatatgatatcctgatcaatccgcagatggcattcggaacaggacaccatgaaacgacaagcctgattatcggagaattgttggatagcgaactgaccggcaagtcgctgctggatatgggctgcggaacttcaatactggctattctcgcacggatgcggggagctaagccttgcacagccatcgatatcgacgaatggtgtgtacgcaactcgatagagaacatcgaactgaacggagtgacagatattgccgtctcgcagggagatgcttcggcattgcaagggaaagggccattcgatgtagtaatagccaatatcaaccgcaatatcttactgaacgacatgaagcagtatgtagcatgcatgcatccgggatcggagttatttatgagcggattctatatcgatgatattccggctatccgccgggaagcagaaaagcacggactcaccttcgtacaccatcaagagaaaaaccgatgggcagcagtaaagttcgtactttaa

SEQ ID NO: 4392 - DNA, 252 bp, B.fragilis; identical to SEQ ID NO: 860

SEQ ID NO: 4393 - DNA, 1218 bp, B.fragilis
atcaaactcaaaaacattacaaatatgaataaaaaccaagaaacggaaagaggtgaactcacccgtttccttgacgagctgcaactccttaaaaagaaagataacttccgtacccttcctaccctggtgcatcagggcaaagaggtaatcatcggaggacaacggatgctaaacctttcgtcaaatgattatctggggttggctaacgacagtggattgttaaaagctttctggcagacagtgaagccggaagaaattaagttctcctcctcttcttcccgcctgcttaccggcaattttgccgcatacgatgaactggaagctaccttgtcttccttatttggaacagaagcggcactggtattcaattgcggatatcatgccaataccggaatcctacctgccgtatgcgacacaaaaacactgattttggccgacaagttgatacatgccagcctgatagacggcattcggctatcagatgccaaatgtatccgctaccggcacaacgaatacagccagttggagagactagtagagacttaccacaaagaatatgaacagattattatcgttaccgaaagtattttcagtatggatggtgacgaagcagacttaccccggttggtcaaactgaaacgcaagtatccgaacgtattgctttacttagacgaagcccatgctgtcggtgtccggggaaccggcggactgggatgtgccgaagcatacggatgcatatcggatatcgactttttggtgggcactttcggaaaggcactggcttcctctggggcatatatcgtgtgcaggcaggtgatacgggactatctgataaataaaatgcgtccctttatcttcaccactgcactcccgcctgtcaccctgcaatggacctcatttgtactgcgccatctggcggaatatcaggagaagagggaacacctggcagccatcagcagcaacttgcggaccggcctccaggagaaaggatacttttctgcctcggccagccaaatcgtacccatgatcgcgggtgaaagttcttccgccgtccgtatggcagaagagctgcaacgcaaagggttttatgcgttgcctgtccgtccgcctacggtaccggaaggaacttcccgtatccgtttttcattaacggcagacgtaacggaaaaggaagtgaaaagagtgatagcaacaatacggcctgtatcatcaaagtaa

SEQ ID NO: 4394 - DNA, 1692 bp, B.fragilis
tccccggaaaagggctgttgcaatcatatgctccgctccggtttaatcatgcataaatcacatataacagatatagtaaagtataaaataacagatgatatgagaacaatacgatttaacaataacagacatatctcttcttctcctcttcttcggacagagggtgggagagaggtttccgtgagtaatacctccggagataagatccctaaaggtaagttttcctttctccttctcttcttccttttgttcctggggagttgcagcagcgacttcctcgacaataagccgacagatgccgtagattccggcctcgtacctgtaccttcgaatgccgaacgcatctttaacggtgcgtggtacaatctattcgaatatggtaccacttatgccaacatcggctatcgtgctttgatgtgcctggacgacatgatggccgacgacgtggtttcgcgccctatgtatgggtttaattcttcttatcagttcaatgacgtggtgatgccttccgacggacgtaccactttcgcctggtatctgatgtataagaccattgacaactgtaatacggccatttctattcaagctaccggagacgatgatacacctgagttccggcatgcccagggacaggcacttgccgtacgtgctttctgttatcttcatttggcacagcattatcagttcacctatctgaaagataagaatgctctttgtgtaccgttgtataccgaaccgaccaatccgaataccaaacctaaaggaaaggcaacgctcgaagagatctatacacagatcatcaatgacctcaaccgtgccaaaggacttcttgacggttatgtgcgtccgaatgacaagtcgaaatacaaacctaacaccgatgtggtaaacggacttctggcccgtacttatctgctcaccggacagtgggacgaagccgccaaagccgcattggaagctgccaaaggttacactctgatgacggatgccaaaaactatatgggcttcaacgatatatcgaataccgagtggatctggggacatccgcaatctgtcagccagtccgatgccagctataacttctattatctggatgtggtagaacccgattcatacaatagttttatggccgatccgcatttcaaggacacctttaccgaaggtgatatccgtctggaattgttccagtggatgcgtgaaggttatctgggataccgcaagttccgcatccgttccgaccagacgggcgatattgtcatcatgcgttctgccgaaatgtatttgatagctgccgaagccttggcgcgtaaaggtcaattgggcgaagccgtaaaaccgctcaatactttgagaaacgcccgcggactggccgattatgatcttaccggaaaaaaccaggagcaggtgattgatgaaattctgatggaacgtcgccgtgaattttggggtgaaggatttggcattactgatgttctccgtacacaacgtcctgtggtacgtgtcgctttgaccgaagatgaagctgccaaagaatatgattgctggcaacagaacggtacttataaaaaatatcatccggaaggtcattggttcaccagcttccccgatggaacgaagtttgtgcccaatagcatatattatttgtattctattcctgaaaaagaaacgaatgcgaatccgaatctgaaataa

SEQ ID NO: 4395 - DNA, 1668 bp, B.fragilis
acatatatgaatatgaaaactttattcatttttctatttgttttgcttgcattttactcctgcgatacggatgaaccgatcagcgcagaagacttatcggctgcaaccggtactaatacggatgaggtcgatgtagcttccaggtcgggcagctatctgatctggcttaatggaatgagtgcggaaacaaagaaagttgcagatcaactgcaaaccgtgaaccactatgacaagatggtggcttttaatgatttaccagggacagacaaggtggaaaccttggaaaccatggcaaaagattctttgaacgatctgacaattgtaggcagtgttgccgatttcatagcaggtacttacagtcctgagatgatacaggacatccgtcacaatcgtcagggagtcatcttaattgccaaagacggtaaggcccaagatttgaaggcgcaaatgcttaaacttttcgggctttatgtagataagggatattataaagtcagctttccgcgtgaacagcgctatgcctattatgacgcaaacgatccggatgctttgaagaagctttgcggaacgggtggtctcaatcctcacacccgtagcatgttgggctctcccggaccgacggatgatccttcggctccggaagttaccgaacgggctttgcatgctatgaagaagatctatatcagcaatcggtattatgtatataccagtgattataaatatcacatgaccggatatgagacgctattaccctatactgctgatatcaaagagtatctcccgagggatgataaaaagtatgatgggatggtcgatcgcgaatggaccattgatgcttataatctgcgtatttacgcaccgaccaatggagataatatgcttgctgtttatagttcgggtggaaatggtttttccaacaggctcgaccattcattggtatctttgaataatgcaccgatgtatgaactttgggcattgatatggggattgcgaaacaatgcttatacgaagattaatatccgtgacgaccaaagttcacagttgaatctcaaactgattgactttgcgccgggtttgccggagacagagagtaccattgagcatgcatacgaaaagagcgtgggatttgatttgggagcgactccggttttaaagggtgagtatcgttggggtaagtccattacatatcagttggcggaaatgacccgtgaggtgactcgtaccattaccgatgccgagatgagttattgctggaagtggtatcctgaaacgcttttccggggtagtaaggctatgaatgcagaggggatgatcgatgctgttactatgatttcgcctgcatggtatgatattctctatgatcatgtggcgggaactccgggtacggataatcctttctgtgactatgacaacgacttgcagtttaaccagaatctgctcaattacgagcagcaatgcgccattactgcccggacaaccggtgcgtcggctggtgttgtagccatcgagataaccgatggaatggtcttacagcgtggaggagcttggtttacgagttggggagcggcggtgattcattctttgccgagcagtgccggaacagcttacaataccactgtggatgtacacaaaaccactacagtgtggatagactataataactggtaa

SEQ ID NO: 4396 - DNA, 459 bp, B.fragilis
tgtatcatgaacaatagtattttaatcaataacgttcaaattttcgatggaagcagcgaacagaccggccggggaaatgtgctggtggtaaacagccggattaaaaccgtttcagaaagtccgatccctacggacggaattcccaatgttaccattcttgacggaaagggaaaattcctgatgcccggactaatcgacgcacactggcatgcttatatgtcatgcaatacgatgatggatctgcttactgcagacaccgcttatacgcagttcaaagccggacaagaagctcgagctaccctactacgcggcttcacaaccatccgggatgcaggtggtccggtcttcgggcttaaacgggccatcgacgaaggaatcctttccggaccacgcatttatcccagtggctctcttatctcccagacaggaggggcatggagatttccgggcggtatatga

SEQ ID NO: 4397 - DNA, 1326 bp, B.fragilis
attaacatgaaacattttatatcattttgtacctttcttcttttttcaactctcttgtttgcacaagcagagaggtcgctcgacgaatgtatccgtattgcatggaaacagaatccgtctttacggaatagcgggatagatatcaaagaagcccggatggattacatctcttctgtggcgagtttcctgccccgtgtcagtgtatcggccgaagccggacgtaacttcgggcgttccatcgacccgaataccaacggatataccaacgatacctttgatgaaggaaccgtcgggctggacatgaccctttcgctctttgagggtttcacccgtatcaaccgggtacgttttgagaagatgaaccgcaaccggagtgagtgggctttgaaagaacgccgtaacgaactggcctgtcaggtgacggatgcctattataaacttctgcttgaagagcggatgctcgatctggctttagagcagagccgccttagcgagcgttatctcaaacagaccgaggctttcgtcgagttgggattgaagtcggtttctgatttgcaggaagtcaaagcccgtcgcgaaggtgatatttaccgctatcaggcccgtcagaatggttgtcgtctggcattgctccgcttgaagcagctattgaatctgcatgccgaagatacgctggccgtacaagatactatcaactacgaacttctttcggcctatccgctgccacaaacggaagaactctatacgcagtctctggtggcgatgccttcgatgcggatgatggaactcaggcaacgtgcagcccgtaaggagtatgccatggcaggaggtaaattttcgccaaccgtctttgcccgcttttcaatggcttcccgttacctcgatggtttttctaccaaacagttgaacgacaatttaggcaagtatatcggtatcggtatttccatccctctgctgagcgggctggaacgactgactaccctgcgcaaacacaagttgaatatattccgcctccggaacgaggaagaactgcaaaagcaacaactctatacggaggtggagcaaacggttctttctctccgttccggttatgatgaattccggcaagtgttgcagcagttcagagccgaagagctggtactgaaagaatccgaacggaaatgggaagaggggcttatctccgtctttcagttgatggaggcccgcaatcgcttcatctcctccaaagccgagttggcgcgggtacgcttgcaggtagatatgactttgaagatggaaacctattatcgcacggggagcttctgtacgttgcccggtgaagagtga

SEQ ID NO: 4398 - DNA, 600 bp, B.fragilis
accaaaatgaaaatgagaacaatcaaacattttttagcagcatgcttcctgcttgtatttgccacaagcatacatgcacaagagcagggaacaaaaacttatcttcccaagttcgccatcaaaaccaatgccctctactgggccaccagtactccgaacctgggatttgaagtagccttggcgaaaaaactcactcttgatgtatcgggcaactacaatccctggaaattttccaaagacagacagatcaagcactggctggtacaacctgaactccgctactggctttgcgaacgtttcaacggtagttttttcggtctccatggccattatgccgatgttaacatgagcaatctcgacatcttcgggttgggcaactaccgctatgacggcaagatctatggtgcaggtatctcttacggctaccattggatactgaaaaaccgctggagtatggaagccactatcggtgcaggatatgcccgcctggactatgacaaatacgcatgtggcaagtgtggtgaaaagctggggcacaacaacaagaattatttcggaccgaccaaagtcggactcagcatcatttataccatcaagtaa

SEQ ID NO: 4399 - DNA, 207 bp, B.fragilis
tctgtggtgaactatgacaccctcatgcactctgtgccgaatgcgacttattttattccggaatcttactcataccgcaatgaccgtgccggtttgcctacgataatcttcaccgtctggcaggctaccgtcacaaacgaaatcaacagcatcaacactaccggaactgcaaagaaccatatcttcagatcggtacggaaagcataa

SEQ ID NO: 4400 - DNA, 804 bp, B.fragilis
cgagaggttgaatttgaaatagaaaaggccttttctccgttctcctgcaaagaagggaggaaaaggcttccttttaacaaaataattatgattaagacagaaaaactatctatgctcttcaccactgaagaggtgcagaccaaagccctgaacgaagtgaccatgcaagtagaacagggagaatttgtagcgatcatgggaccttccggttgtggcaagtccactgtgctgaatattctgggcactctcgattcgcctacttccggctcttatttttttgagggaaaacaggtggacaagatgagtgagaatcaactgaccgcccttcgcaaaggaaatctgggattcatctttcagaagcttaacctgatcgatgaactgaccgtatacgacaatgtggaactccccctggtgtatctggggataaagcccgcagtgcggaaagagaaagtgaaacgggtgctcgagaaagtaaacctgttgcatcgtgccagtcattttccgcagcagctttccggaggacagcagcaacgtgttgccatagctcgtgccgtggtgacggactgcaagttgttgcttgccgatgaacctaccggaaacctggactcggtgaacggtgtggaggtaatggagttgttacgagaattgaaccggcaggggactaccattatcatcgtcacccactcacaacgtgatgccacttatgcccaccggattatccggttgctagacggaaaaatagtggccgaagacatcaaccgcccgctgaccgaaacctccgggcctaacacagagagcgtatga

SEQ ID NO: 4401 - DNA, 225 bp, B.fragilis
gaaagccgtttagtggctaaaaacataaatcaatctcgcgcatcctttaaatatccgttctcacgcattagcaagaaagcaagcagattccatagcaagcataacacattatcaataattactttacttctttctaaagtatctttatctcaacccgggtatgcgggacgagataagaacctaaccattttcactaaagatactaagaaaaacaaactgctttaa

SEQ ID NO: 4402 - DNA, 1548 bp, B.fragilis
cctatgaaagagcttatcaatcgcctggaagagttgaacaggcaagccgaaaaaggtggtggagacgcccgtatcgagaaacaacattctgtcggaaaattgacggcacgtgaacgtatcgacctgcttctggagaaaggatcgtttattgaactcgataaactggtgacccatcgttgtacggatttcggtatggagaaacagaaaatatccggtgatggagttgtaaccggatatggtatgatcggcaaacggcttgtgtatgtttttgctcaggacttcaccgtttttggcggtgcattgtccgaaacgtatgccaggaagatttgtaaagtgatggatatggctatgcagatgggagcacccatcatcgggctgaacgattcgggaggagcccgtattcaggagggagtccgttcgctggccggttatgcggagatatttctgcgtaattctttggcttccggtgtcatccctcagatcagtgccatcatgggtccgtgtgcgggtggggcggtctattcgcctgcattgaccgattttatcctgatggtgaaaaattccggttatatgtttatcaccggtcccgatgtggtgaagagcgtgacacaggaagaagtcagcaaagaagatctgggaggggcggatgtccataccatgaagtcgggggtggcacacctctctgccgaaaatgatattgaatgcatcaattacattcgtgaactgatttcttatctgcccggaaataatatggaagagcctccgtttgttgctactaccgattctccgacgaggcttacgcccgaactgtcggatctggtgcctaccaatcctaatcagccgtatgatatgaaagagatgatccgtgcagtggcggacgataacagtttctttgaattgcaggaagagtttgcccgtaacatcgttatcggttatattcgcctgaacgggaagacgataggggtggtggccaatcagccgttggcattggccggaacgctcgatatcaatgcctctgttaaagcagcccgttttgtccgtttctgcgatgcgttcaatattccattgctcacactggtagatgtaccgggattccttccgggggtagatcaggagtatggcggcatcatccgcaacggtgccaagttgctttatgcctattgtgaagctacggtgccgaaggttacggtgattgcccgtaaagcttatggcggagcttatgatgtaatgagttccaagcacatcaggggagatgtgaatctggcttatcccactgccgaaatagccgtgatgggccccgatggagcggtgaacattcttttccgcaaagagattgacaaagctgccgacactgaagccaggcgtaaagagttgcaggatgactatcgcagcaagtttgccaacccctaccgggctgccgagttgggctacgtggacgaggtgatcgatccggccataacccgtatgcgcctgatacgcagttttgagatgcttgccaacaagcggcagtctaatccgcctaagaaacattcaaatcttccactttaa

SEQ ID NO: 4403 - DNA, 690 bp, B.fragilis
caaaaaagagataagaaaaacgacctgcgggtctcaaacaaaagaagtatgaaaaagaatgtgtattttatcagcggcatcgatacagatgcaggcaagagttatgccacaggattcctggcacgcgaactgaaccggaaagggcaacgcaccattactcagaaatttatccagacaggcaatacaggccactcggaagacatcgacctgcaccgccgcatcatgggcatcgcccccactgatgacgaccgggaaggactgaccatgcccgaaatcttctcttacccctgttctccacacctcgcttcacgcatagacggacgtcccatcgactttgacaaaatagaacgtgctacagaagagttgagccgccgttacgacgttgtcctgctcgagggagccggaggcctgatggtgccgcttaccgacgaattgctcacgattgactatattgcgcagaaggaatacccgctgttgtttgtcacttccggcaaactgggcagtatcaaccacacattgctcagcctggaagccattaaaaaccgggggatcaaactggataccgttctctacaacctctacccgacggtagaggaccggacgatacaggaggatacacaactcttcatccaacggtatctgaagaaagattttccggagactaaattctgcatggtaccggaattataa

SEQ ID NO: 4404 - DNA, 1530 bp, B.fragilis
agcagaggagaacatcgtatgataaaaaagatattagttgcgaatcgtggcgaaatagccatgcgtattttccgtacctgccgggtaatgaatattgccacagtggctatctacacctgggtagatcggggtgccttgcatgtgcgttatgccgaagaggcttattgtatttccgattctccggaagatacgtcttatctgaaaccggaaaagattctgcaaatagccaaaaagacaggagctgccatccatccgggatatggctttctgtctgagaatgcggacttcgcccgtcgttgtgaggaagaaggggtaatctttattggtccgagtgccgatattattgcccgaatgggtatcaagactgaggcccgccggattatgcgtgaagccggtttaccgatcgtaccgggcacggaagatccggtgaaaggcattgccgaagccaaaaaggtggctgccgaagtaggctatcccatcatgctgaaagcactggccgggggtggtggaaaaggtatgcgtctggtacgcagtgaagaagaaatggagacggcattgcgcctttcacagtctgaagccggaacgtcgtttggcaacgatgctgtttatattgaaaaatatatcgagaatccccatcacatcgaagtacagatactgggagataaatatggaaatgtaattcatctttatgaacgggaatgttccattcagcgacgcaatcagaaagtaattgaagaatcgccttctccttttgtgaagcccgaaacacgtgccaagatgctgaaggttgcagtggaggcctgtaagcggattaattattacagtgccggaacgctggagttcatgatggataaagaccagaatttttattttctggaaatgaatacccgcctgcaggtggaacatccggtgacggaagagtgtaccggggtcgatctggtacgcgacatgatactggtagctgccggcaaccgtctgccttacaggcaagaagatgtcgagttccggggagctgccattgaatgtcgcatttatgccgaagatcccgagaataacttcatgccttcgcccggggtgataaccgttcgtgaagctcccgaaggacgtaatgtccgtttggacagtgcggcttatgcgggatttgaggtttcgctgcattatgatccgatgattgcaaagctctgttgttggggacgtaatcgtgattcggctatttcgaacatggcccgtgcgttgcgcgaatataagattctgggtatcaagactacgattcctttccatcagcgtgtgttgaagaatgcggctttcctgaaaggagagtacgatactacctttatcgatacgcgcttcgataaggaagacctgaaacgcaggcagaataccgatccgacggtagcggtgattgctgctgcgctgaaacattacgaagaagagaaagaggctgcttcacgcgccactacgcttccggtagtaggagattcgctttggaaatattacggcaagttgcaaatgactgccaataactattaa

SEQ ID NO: 4405 - DNA, 1254 bp, B.fragilis
ttatctatggatacaatgatcgaacgcaaacccggaatgaagcggaagcattattatgccgtcgccggagccgtggtattggtgggacttgttttttactttattttcagagacacttcctcttctatgaatgtggaaaaagaccggctgaccattgctacagttacccggggagagttcagtgattacatccgggttatcggacaagtgatgcccaaccgcatcatttatatggatgcgatagaaggaggccgtgtggaagagcgcctgaaagaggaaggagccatcgtcaaggcaggcgatgtgattcttcgtctcagcaatccgctcctgaacatcggcatcatgcagagcgaagccgatctggcctatcaggagaacgagttgcgcaatacccgcatcagcatggagcaggaacatctgcggctgaaacaggaacgcatcggcctgaataaggaactggcagtgaaacaacggcgttacgagcaatacagccgccttatcaaagagcagctgatagcgcaagaggagtttcgcctggctgccgaagagtacgaagcggcaagggcacaactggaagtcattgacgaacgcatccggcaggacaattttttcagggaaagccagatcagcagcctcgacgagaatatccgtaacatgaagcgcagcctcgccctggtacgcgagcgggtggaaaacctgaaggtaaaagctcccatcgatggacaggtgggtaatctcgatgcccagatcggccagtccattgctgccggcgaacatatcgggcagatcattacccccgacctcaaagtacaggctctgatcgacgaatactacgtggagagggtagttcccggacttccggcggatttcacccgtgacggaggcaactataaacttgaagtgaccaaaccctatccggaagtaaaagagggacaattccgtaccgaccttcagtttactgccggacgtcccgaaaacatccgtgccgggcagacgtatcacatcaatcttcagttgggagatcctgcccaggccattcttgtacctcgtggaggattctttcaaataaccgggggccgctggatgtatgttcttgacgaaagtggtaaatttgccacgcgccgtcctatccgtatcgggaggcagaatccgcagtactacgaagtgaccgaaggattgaaaccgggcgaccgggtgattatttccgggtatgaattgtttggagataacgagaggttgaatttgaaatag

SEQ ID NO: 4406 - DNA, 357 bp, B.fragilis
gcttctattcgttttacgttttcttgccagccggaagttagaagtaaccgtaccgatgcgcaggctacggcacatgccaacgggtttcccataaacgtaggcccgtgcatgaatgctcccggtgcatggttggagatgcagtctgccacttcattggtggtcagtactgccgataaagtcatgtatccacctgtcaatgctttgccgatgcacatgatgtccggctctactccggcatgttcccaggcgaagagttttccggtacgtccgaatccggttgctatttcatcgaagatcaacagtaccccataccggtggcagaggcgcgcagcttctcttaaatattccggatggtag

SEQ ID NO: 4407 - DNA, 729 bp, B.fragilis
aatttatcacgagacattgtttgcctgatgcggtttataaatagctcttttacggatgccggtttcaatctggcggctgaagagtatttgttgaagcagggtacagaagatgtattcatgctttggcaaagtgctccgtccgtaattataggcaagcatcagcgggtggaaacggaagtgaaccggatgatggcggaacaaaacaagattcctgtattccggcggttttccggtggcggtgccgtatatcacgatttgggcaacatcaatcttacgttcattgaaactacctgtctggcgcgtttcgaaacttatctggagcgaacggttgaaatgttgactgccgccggagttgcagtgagaggcgacgaacgattgggtatttatgtcgacgggcgaaaagtctcgggcagtgcgcaatgcgtacatcgcaatcgtgcaatgtatcattgcacactgctgtatgatacaaatctggtgttgttgaataaattgcttgaggtagaaggacttgaggaaaaggttgccgtacatcctgctgtccgttcggtacgtagcgaagtgacgaatctgaaagagtatatgcatccggctctatctacagataaattccgggagtgggtttttcgttattttgcaggtccttcggttgccgaagcgttcagtaaggaggaactggctattatcgaggggttacgggaaaataaatacaacactatctgtaactga

SEQ ID NO: 4408 - DNA, 207 bp, B.fragilis
gtggcatcacgttgtgagtgggtgacgatgataatggtagtcccctgccggttcaattctcgtaacaactccattacctccacaccgttcaccgagtccaggtttccggtaggttcatcggcaagcaacaacttgcagtccgtcaccacggcacgagctatggcaacacgttgctgctgtcctccggaaagctgctgcggaaaatga

SEQ ID NO: 4409 - DNA, 525 bp, B.fragilis
ttaaaaaaacgatcaatcatgaaaaagataggaatattctatgctgccaaagccgataaaacctcttgggtggctgaaaagattcaaaaagaatttggtacttctgccgagtctgtagctatcgaaaatgcctggcagaatgattttgaagcctatgataatttcatagtcggtgcttccacctggttcgatggcgaactgcctacttattgggacgagcttctgcccgaactccgcaccttgcagttgaaagggaagaaagtggctatcttcgggcttggcgatcaggtgaagtatcccgagaactttgccgatggtgtcggactgcttgccgaagtctttgagaatgatggagctacgcttgtcggttttacttctatagacggatatagtttcgagcgttcccaggctctgaaaggtgataaatggtgtggattggtcattgacatcgaaaatcagtcggaaatgactgataagcgaataaaagactggtgtaggcaggtgaaaaaggaatttgaagtttga

SEQ ID NO: 4410 - DNA, 2433 bp, B.fragilis
cacagagagcgtatgatagggaattattggaatagtgcctaccgcaacctgatgaagcggaaaggattcagtttcatcaatgttttcgggttggcagtcggcatggcatcggctctgctgatcttgacttacgtcacctttgagttcagtttcgacaagatgcaccagaagtacgagcgcatcttccgtgtggaaagtactttctacgagggagaagtgcagaccgactattgggccagcagttcgttcggttatggttcggccatgaaagagaatctggccggaattgaagactatacgcgggtggtttccttgtatcagccggaacagattgtgaagtatggtgaacttactttgcgcgaaaaccagatagcttatgccgatcccggcttcttccgtttgttcgactttgagttggtgaagggagataaggccacttgcctttccatgccccgccaggtggtcatcaccgaacgtattgcccggaagtattttcaggacgaagaccccatcggaaagatacttatctttacgggaccgtatgacaaggtgatttgcgaagtgacaggggtgatgaaagagatgccttccaattcgcatatccattataatttcctgatttcctataagtcgctcgggcaatatctgcatgactattggtacaagcacgaggtttatacttatgtgctgctcgattcgcccgaaaggaaggaagagatagaaaaggcgtttccggcaatgtcggagaagtataagacggacgaggcgctgaaaaataaaatatggggtgtgtcactgacaccgcttgccgatattcatcttaaaccgcaagttggttacgaggccgaaatcaagggaaaccgtacggccatgatcgccctgatctttgctgcaattgccattttggctattgcctggatcaattatatcaacctgactgtggcccgctcgatggaacgtgccaaggaggtaggagtgcgccgggtaataggagctttccgcaagcagcttgtatctcaattcttgtttgaggccttggtcatgaacctggttgcattggtactggcagtgggactgatcgagttgatcttgccatacttcaatcagttggtaagccgtacggtaactttctccgtttggctgacgggatactggtggcttttgcttttgatcgtatttgtagggggaattttcctctccggttactatcctgcattggcgcttctcaaccggaaaccgattacgttgctgaagggaaagttcctgaacagcaagtcgggcgaaggcactcgcaaagtattggtagtcgttcagtacacggcatctatgattctgctctgcggcacattgattgtgtttgcgcagttgaacttcatgcgcaatcagtcgctgggagtgaagacggaccagactctggttgtcaaatttcccggacggaccgaaggcatgaacacgaaactcgaagccatgaagaaggccattgcccgcctgcctttggtagacaaagttaccttctcgggtgccgtgccgggcgaagaggtggctaccttcttgtctaacaggcgaaagagtgatgctttgaagcagaatcgcctttatgaaatgttggtatgcgacccggattatattgatgcttatggactgcaactggtggcagggcgcggattctccgaagattatggagacgatgtgaataagttggtggtcaacgagtctgctgtccgtaacctgggaattgcctctaacgaagaggctctcggcgaagagatagaggtggaatgtaccgatgccccgatgcagattatcggagtggtgaaggactaccatcagcaggcactcaacaagaattataccccgattatgctgatccacaaagataagatcggttggctgccgcaacgctacatctccattgtgatgaagtccggcgacccgaaggaattggtttcgcaggtggaggagatctggcatcgctatttcgaggattccagctatgacttcttctttctcgatcaattcttcgatcatcagtatcgtcaggacgaggtgtttggtgtcatgatcggttgtttcaccggactggccatcttcatctcatgtctgggattgtgggtattggtgatgttctcctgcactacccgtaccaaggagatgggtatccggaaagtattgggagctacccgttggaatctgttctatcagctgggtaaaggctttttccaattgatcctgatagcggtaatcattgcgttgcccgttgcttggttcagtatgaatgcctggttgagtcattatgctttccgtaccgatctgaagatatggttctttgcagttccggtagtgttgatgctgttgatttcgtttgtgacggtagcctgccagacggtgaagattatcgtaggcaaaccggcacggtcattgcggtatgagtaa

SEQ ID NO: 4411 - DNA, 1542 bp, B.fragilis
atgtttcttaggcggattagactgccgcttgttggcaagcatctcaaaactgcgtatcaggcgcatacgggttatggccggatcgatcacctcgtccacgtagcccaactcggcagcccggtaggggttggcaaacttgctgcgatagtcatcctgcaactctttacgcctggcttcagtgtcggcagctttgtcaatctctttgcggaaaagaatgttcaccgctccatcggggcccatcacggctatttcggcagtgggataagccagattcacatctcccctgatgtgcttggaactcattacatcataagctccgccataagctttacgggcaatcaccgtaaccttcggcaccgtagcttcacaataggcataaagcaacttggcaccgttgcggatgatgccgccatactcctgatctacccccggaaggaatcccggtacatctaccagtgtgagcaatggaatattgaacgcatcgcagaaacggacaaaacgggctgctttaacagaggcattgatatcgagcgttccggccaatgccaacggctgattggccaccacccctatcgtcttcccgttcaggcgaatataaccgataacgatgttacgggcaaactcttcctgcaattcaaagaaactgttatcgtccgccactgcacggatcatctctttcatatcatacggctgattaggattggtaggcaccagatccgacagttcgggcgtaagcctcgtcggagaatcggtagtagcaacaaacggaggctcttccatattatttccgggcagataagaaatcagttcacgaatgtaattgatgcattcaatatcattttcggcagagaggtgtgccacccccgacttcatggtatggacatccgcccctcccagatcttctttgctgacttcttcctgtgtcacgctcttcaccacatcgggaccggtgataaacatataaccggaatttttcaccatcaggataaaatcggtcaatgcaggcgaatagaccgccccacccgcacacggacccatgatggcactgatctgagggatgacaccggaagccaaagaattacgcagaaatatctccgcataaccggccagcgaacggactccctcctgaatacgggctcctcccgaatcgttcagcccgatgatgggtgctcccatctgcatagccatatccatcactttacaaatcttcctggcatacgtttcggacaatgcaccgccaaaaacggtgaagtcctgagcaaaaacatacacaagccgtttgccgatcataccatatccggttacaactccatcaccggatattttctgtttctccataccgaaatccgtacaacgatgggtcaccagtttatcgagttcaataaacgatcctttctccagaagcaggtcgatacgttcacgtgccgtcaattttccgacagaatgttgtttctcgatacgggcgtctccaccacctttttcggcttgcctgttcaactcttccaggcgattgataagctctttcataggctattattttaa

SEQ ID NO: 4412 - DNA, 435 bp, B.fragilis
agaaagtggcttgtaacggggaaagtgtatgatgtggactacaacgtagggggtgactctatctattccattatcatcaatcatcattcgcacggagtacagatatctccgacttcccattcctcttataccattatgaataagggggaactttatcagatcgagctgaaaggagaactcgagaagatacataatgcccgtagcggagcagatgccgtagggcgtcaggtagttgtagctcccatgccgggcgttatcctgaaaacttacgtcaggaagggagatgaagtgaagaagggtgatccgctgtgcgtactggttgccatgaaaatggaaaacgaaattcgttcggtggccgatggggtggtgaaagagatttttgtggaggagaatacgaaagtggggctgaacgaccgtatcatggtggttgagtag

SEQ ID NO: 4413 - DNA, 1302 bp, B.fragilis
gatgaagatggccagtccggtgaaacaaccgatcatgacaccaaacacctcgtcctgacgatactgatgatcgaagaattgatcgagaaagaagaagtcatagctggaatcctcgaaatagcgatgccagatctcctccacctgcgaaaccaattccttcgggtcgccggacttcatcacaatggagatgtagcgttgcggcagccaaccgatcttatctttgtggatcagcataatcggggtataattcttgttgagtgcctgctgatggtagtccttcaccactccgataatctgcatcggggcatcggtacattccacctctatctcttcgccgagagcctcttcgttagaggcaattcccaggttacggacagcagactcgttgaccaccaacttattcacatcgtctccataatcttcggagaatccgcgccctgccaccagttgcagtccataagcatcaatataatccgggtcgcataccaacatttcataaaggcgattctgcttcaaagcatcactctttcgcctgttagacaagaaggtagccacctcttcgcccggcacggcacccgagaaggtaactttgtctaccaaaggcaggcgggcaatggccttcttcatggcttcgagtttcgtgttcatgccttcggtccgtccgggaaatttgacaaccagagtctggtccgtcttcactcccagcgactgattgcgcatgaagttcaactgcgcaaacacaatcaatgtgccgcagagcagaatcatagatgccgtgtactgaacgactaccaatactttgcgagtgccttcgcccgacttgctgttcaggaactttcccttcagcaacgtaatcggtttccggttgagaagcgccaatgcaggatagtaaccggagaggaaaattccccctacaaatacgatcaaaagcaaaagccaccagtatcccgtcagccaaacggagaaagttaccgtacggcttaccaactgattgaagtatggcaagatcaactcgatcagtcccactgccagtaccaatgcaaccaggttcatgaccaaggcctcaaacaagaattgagatacaagctgcttgcggaaagctcctattacccggcgcactcctacctccttggcacgttccatcgagcgggccacagtcaggttgatataattgatccaggcaatagccaaaatggcaattgcagcaaagatcagggcgatcatggccgtacggtttcccttgatttcggcctcgtaaccaacttgcggtttaagatgaatatcggcaagcggtgtcagtga

SEQ ID NO: 4414 - DNA, 1509 bp, B.fragilis
caacaatacggcctgtatcatcaaagtaataaacttatgaaactgaaaagactatatccaccccaaaaatctgtaaactcccttcactctgagacaggaaccggatgtgaagtcgccggatgccctcccctccgaaaagaggctctcctcttctttgccggatggggaatggatgaaactcccttcatgcacaatctccccccaaataaagatctgataatctgctatgattaccgttctctcgattttgacagcacattgctctccacgtatgacgggatctatgttgttgcctggtccatgggggtatgggcagcttcccaagtgttaccggacagcaacctccccctcaagcaaagcattgccatcaacgggacacctttccctatcgatgatatgcggggaattcctcccgccatatttgaaggtacactcaataatctcaatgaagcgaccctacagaagttccgccggcgaatgtgcggatcgggaagtgcctttcaggctttcctggaaatagctccccaacgaccggtagaagaattgaaagaagaactggtggccatcggcagacaatacagcgaactgcccccatccacctttgtctggaataaggcaatcatcggagaatccgatcatatcttcccaccgaagaaccaggaacaggcctggcaaaaatattgcaatgaaattcagcgatatgacggagcacattatgacgaaaagatattgaaagaaaatctcgctcctgctgcttcctccaaactactgatcgcccaacgcttcacgaaagcaatcggcacctatccgcacgaagcccgggtgcaacaacaaatcgcccggaaaatgtgcagtttgttgcagcaacacctccctgcgcactccctccgccgtgttgtagagttcggctgcgggacgggtacttattcgcgtctgctactccgttcgttccgcccggaacacttgctgctgaacgacctttgcgaagagatgcgccatagctgcagagatatcctgaacgagcgggtctccttcttgcccggagatgccgaagcacttgacttcccacacggaacggaactgatcacttcctgttccgtcctgcaatggttcgaacatcccgatgcttttttccggaaatgtgaaaacatcctgaatgcgcagggatacattgccttcagtactttcggaaaagaaaacatgaaggagattcgccaactgaccggacagggactcgcctaccgttcgagagaagagctgactacctcgctctcggcactatacgacattgtgcacacagaggaagaagtcatctcactgaatttcaacaatccgatggaggtgctttatcatctgaagcagaccggagtgacaggtacttgtaaccaaagctggacccggagcaaactgaacctcttctgtcaggaatacgaacgtctgttcagtcccggcaaaggttctgtttcactgacctaccaccccatctatataatagcaaaaaagagataa

SEQ ID NO: 4415 - DNA, 1131 bp, B.fragilis
cggacacttatccatccgggaaagccgtccgggacaaactattttcagtctcgatctgccttaggagcgaaacattttaattggtgtaatgttataaatagagaggaatctctattctcctttttatttattatgaaagaaaaatattggaaatattctctgattattatcattatcggactgggcattatcttgttccggcaaatcactcccttcctcggcggattactgggggcactcactatctacatccttgtacgcaaacagatgatctatctcggtgcacgaatgaaacgaagcttcgcagcactgctgattacaggagaagccattctgtgcttcctggttcccatctcgctgattgtatggatgctggtcaataaattgcaggatatcaacctggatccccaagccatcattacccctgtcgaagagttagcgggaatcattaaagcaaaaacaggatatgatgtgctgggcagcgacacactttcattcatcgtctccctgcttcccaagatagggcaggcagtgatgggaggcatcagcagttttgccgtcaacctgtttgtattggtcttcgtactgtacttcatgttgataggaggaactaaaatggaagcctacatcgacgacatcctgcctttcaacgaaaagaatacccgggaggtaacccatgaaatcaatatgattgtccgttccaatgccattggcattcccttgcttgcagtcattcagggaggggtagccctgatcggttatttcatcttcggagcaccgaatgcctggctgataggagtgctgacctgcttctccacaatcatcccgatggtggggacagccttggtatggtttccggtagccgcctatcttgcactgaccggcgagtgggcaaacgccatcggactggcggcttacggtggaattgtcgtctcgcaatgtgataacctgatacggtttatcctccagaagaaaatggcagacacccatccgctaataaccatcttcggcgtagtcatcggattatccttgttcggattcatgggagtcatcttcggaccgcttgtgctgtcgctgttcttgttgtttgtcgatatgtttaaaaaagaatatctggacaataagaaataa

SEQ ID NO: 4416 - DNA, 1209 bp, B.fragilis
ttaaagattatgccaaccatatcgattcgcggaacagagatgcctgcatctcctatcagaaagctggctcccctggcagatgctgccaaacagcggggaatccatgtatttcacctgaatatcggacagccagacctgcccactcctcaggccgcgattgacgcgatacgcaacatcgaccgcaaggtgctcgagtacagccccagtgccggttatcgtagctatcgcgagaaattagtaggatattacgaaaagttcaatatcaacctgacggcagatgatattatcattactaccggtggctccgaagcggtgcttttctcattcatgtcgtgcctcaatccgggagatgaaatcatagttcccgagccggcatacgccaactatatggcttttgccatttcggcgggagctaagatacgtaccattgccacgacaatcgaagaagggttttcacttccgaaagtagagaagttcgaagaactgattaacgagcgtaccaaggggatcttgatttgtaatccgaacaatccgaccggttacctgtatacccgccgtgagatgaaccagattcgtgatctggtgaagaaatacgatcttttccttttctccgacgaagtctaccgtgagtttatctataccggttcaccttatatttcggcctgccatctggaaggaattgaaaataatgtggtgctgattgactccgtatccaagcgttattccgaatgtggtatccgtatcggtgccctgatcacgaagaacaaagaggtgcgtgatgctgtaatgaagttctgtcaggcacgtctgagtccccctttgatcgggcagattgctgctgaggcctcgttagatgctcccgaagaatactcgcgtgaaacctatgatgaatacgtagagcgccgtaaatgcctgattgacggactgaaccgtataccgggtgtgtattctcctattcctatgggtgctttctatacagtagccaaactaccggtcgatgattcggataagttttgtgcgtggtgtctgtctgagttcgagtacgaagggcagactgtgtttatggctcctgcttccggtttttatactactccgggttccggaaaaaatgaagtccgcattgcctatgtgctcaagaaagaggacttgacccgtgcactctttgttttgcaaaaggcattggaggcttatccgggaagaacagaataa

SEQ ID NO: 4417 - DNA, 2088 bp, B.fragilis
actgtgatcatctgtgtgatttgtggtgaaaatcctaaacccactttaaatatgaagaaatacgatataaaaaccactgacgaacagactctccgcaagtggtatcatttaatgactttggggcgtgcgctcgacgagaaggcacccgcctatttgctgcaatctcttggctggtcctatcatgctccttatgccgggcatgacggcatccagcttgctatcgggcaggtttttactcttggtgaggactatctttttccttattaccgggatatgctcactgtgctttctgccggaatgactccggaggaactgattctgaacggtatctcaaaagctacggacccgggtagtgccggacgtcatatgtccaatcactttgccaaaccggaatggcacatcgagaatatctcttctgctacgggtacgcacgatcttcatgcggcaggcgtagggcgtgccatggtttattatgggcataagggggttgccattacttcacatggtgagtctgccacatccgagggatttgtctatgaagctatcaacggggccagcaacgaacgtcttccggttatttttgtattccaggacaacggttatggcatttccgtccctaaaaaggatcagactgccaatcgtaaagtggccgataacttctccggttttaagaacctccgcatcattcattgcaatggaaaggatgtatttgactcgatgaatgccatgaccgaagcccgtgaatttgctatagccaaccgtactccggttatagtacatgccaattgcgtacgtatcggttcgcactccaactctgataagcatactctctatcgcgacgagaatgagttggcatacgtgaaggaagccgatccgctaatgaagttccgccggatgctgttgcgctacaagcgcctgaccgaagaggacctccaacagatagaagctgccgccaagaaagaactggctgccgccaatcgtaaagcgttggctgcacccgatccgattccagagagcatttatgactttgtccttcccgaaccgtatattcctcaaaagtataaagacggacttccggggcctgtcgaaggtgagaagagtttcatggtgaacgccattaatgaaacgctcaaagaggagtttcgccgcaatcctgatacctttatctggggacaagacgtggccaataaagataaaggaggcgtattcaatgtcaccaaggggatgcaacaggagttcggtgatgcccgtgtgttcagtgctccgatagccgaagattatattgtgggaacggccaacggaatgtgccgtttcgatcctaaaatacatgtggttattgaaggcgctgagtttgccgattacttctggcctgctgtcgaacagtacgttgagtgtacacacgagtattggcgtagcaacggtaagtttactcccaatattacacttcgccttgcttcgggtggatacattggcggtggattgtatcattcgcagaaccttgaaggggctcttacgactttacccggtgcccgtattgtttgtccgtcgtttgccgacgatgctgccgggctgctccgcaccagtatgcgttccaagggattcactctttatctggagcccaaagcgctttacaactcagtagaggctgctgccgttgtgcccgaagagtttgaagttccctttggtaaggcccgtattcgccgcgaaggaaccgatctgactataattacttatggcaatactacccatttttgtctggatgttgccgaacgtcttgcccgggaaggggtggggagtgtcgaagttatcgatctacgttcgctgattccgttggataaagaagcgatttttgcttccgtacggaaaaccggtaaagtgatggtggtgcatgaagacaaagtcttctccggattcggtgccgaaattgcagcgcagattgccggggaaatgttccgttacctggatgccccggtacaacgtgtgggctccacctttactccggtaggtttcaatccgatattggaacgggctatcctgccgaatgatgaaaagatatataaagcagccaaagagttgctggagttctaa

SEQ ID NO: 4418 - DNA, 1317 bp, B.fragilis
tacttgtacatgtcgttcactcatccacataatcaaagcaattcagtttcctcttccggagcgaaggggaaattgaggctttcttattttcttgcccgtcggatttatcgtgatacggatggtggaaaacaagtttcccgtcctgccgttgtgattgccatgattggtattgccatcggtctggcggtgatgatcattgccgtatccgttgtgattggattcaagagtgaagtacgcaataaagtaatcggattcggttcgcatatccagatcagtaatttcgatgcggtaggttcttacgagacccacccggttgtggtgaatgacagtatgatggtcgcactttctgcccttcccgaggtaaagcatgtgcagcggtactccacgaagccgggaatgattaagacagacgatgcttttcaggggatggtgctcaagggagtcggcccggagtttgatcccacctttttccgtgatcatctgatagaaggagagatcccggctttcagtgatacggcctctaccaaccaggtagtgatatcgaaagcaatagccgacaggctgaaattgaagttgggagataaaatctatacctacttcattcagaaagacgtgcgtgcccgccggctgacggtgaaaggcatctatcagacaaacttttccgaatatgataatctctttctgctgaccgatctgtatctggtgaaccgtttgaataactgggctcccggtcaggtgagcggggcggaattgcaggtgcgtgattatgataagctggaagatatcacctatcggattgctaccgatacggataataagcaagatatctacggaggtacttattatgttcaaagcatagagcagatgaatccccagatatttgcctggctcgatctgctcgacctgaatgtatgggtgattctgattctgatggtcggcgtagccggtttcaccatgatttccgggttactgatcatcatccttgaacgtacacagatgatcggcatcttgaaggcattgggagcaaatgatttcactatccgtaaagtattcctgtggttttctgtcttcctgattggcaaggggatgttgtggggcaatgcaatcggtatcgttttctgtattttgcagtcacagttcggactgttcaagctcgaccccgaaacctactatgtaagtatggtgccggtctctatgaatatctggcttttcctcctgatcaatgccggcaccttattgacttctgtactgatgttggtcggaccttcttacctgataaccaaaattaatccggccgactccatgcgatacgagtaa

SEQ ID NO: 4419 - DNA, 1248 bp, B.fragilis
aacgataacataatgaccataaacctaatcacatttgcatcgattctgcataagcaggtaactatacgtagttcgcacgaagccgtacttagtgaactggaaaaatatttcaccgtgaagtttgtcgattaccgggacatccaccagttgacaaaagatgatttcagcatcatcttcatagctaccggaggggtagaaagattggtcatgcaatgctttgaatcgctcccccgccctgccattattctggccgacggaatgcaaaactccttggcggcggcgcttgaaatctcttcctggttgcgcggccggggcatgaagagtgagatcctccacggggactttatgagtatcgtccagagaatacaggtactatataccaatttcaaggcgcagcgttcgttggtaggactccgcatcggggtgatcggcactccctcttcctggttgattgcaagcaatgtggactacctgctcgcaaaacgacgttggggaatcgagtatctggacatcccgttggaacggatttatgatgtatatgaccggattaaggataacgaagtcggcgcttcgtgtgccgctgtggcttcacaggcactggcttgccgcgaaggcactcccgaagatatgattaaagccatgcgtctctatcgggccattaagcgaatctgtaaagaagaaaaactaagtgcagtgacagtgagctgcttcaaactgatagagcgtacaggcactacaggctgtcttgcccttgccatgttgaacgacgaagggatcattgccggatgtgaaggcgacttacaatccgtatttacattattagtggctaaagcactgaccgggaaagtgggtttcatggcaaatccttcgatgataaacgcccgtaacaacgaaattatattggcccattgcacaatcggaatgaaacagaccgaacgttacatcattcgcaatcactttgaaacagaaagcggcatcggtattcaaggactgctaccggaaggagatgtcaccattgtgaaatgtggtggcgaatgcctggacgaatattacctgtctaccggaactctgaccgaaaataccaattacatcaatatgtgccgtacacaagtacgtgtaaagatgaatacaccggccgactatttcctgaaaaacccactgggtaatcaccatatcctgttacaaggcaattatgaaaactccctgaatgaattcctaatggcaaactcttgtaaacgtacagaatag

SEQ ID NO: 4420 - DNA, 1512 bp, B.fragilis
aaacagacaattatgacactgatccttgccatcgttccggtattgctcttgattgtattaatggcattttttaaaatgccgggtgacaaaagtagcgtcatctccctgatagtaactatactgatagctcttttcggattccattatgcggtagacaacttggtattttcattcgtatacggtgcactgaaagcggtttctcccatcctgattatcatcctgatggctatcttcagctacaatgtattgctgaaaacagagaagatggagattatcaaacaacaattctcttccatctctaccgataaaagtatccaggtactgctccttacctggggtttcggagggttacttgaagccatggcaggttttggtacagctgttgccatccccgccgctatcctgatcagcctgggattcaaacccatcttttcagccaccgtcagcttgatagccaatagtgtggctacggctttcggtgccataggtacaccggtactggtacttgccaaagaaaccaatctggatgtacaggtgctgagtacgaacgtcgtactgcaactttccgtactaatgttcctgataccgttggtactactcttcctgaccgacccaaaaataaaatcattacccaaaaacctatttctggcactgctggtaggcgctgtatctttaggtagccagtacgttgcggcccgatatatgggagccgaatcaccggctatcatcggcagtatcttgtctatcgtcgttatcgtcatttatggcaaactgactgcccccaaaaaagagaaagcgcagcagaacgcactgaaagggaaagatatcctgaatgcctggagcatctatctgctgattttgttactgatcatactgaccagtccgctttttccgggcctccgaagtacgctcgaaaacaattgggtgacacgcatcagcctccccatcaatgactccaccgtgaattataccatcgcctggctgacacatgccggagttctgctttttgtaggcacatttgtaggcggtctgatacagggagctaaagtgaaagaactgtttgtcgttttatggaacacggtgaaacaattaaagaaaacgttcgtcaccgttatctgcctggtgggtttatctaccattatggatacggcaggcatgatttccgtgattgccactgcactcgccacagctaccggaagcctctaccctctctttgctccggttatcggttgtttgggtaccttcatcaccggaagtgatacctcctcgaacatccttttcggaaagctgcaagccagcgtagcagggcatatcaatgtcagtcccgactggctatcggccgccaatacggtaggtgcgacaggaggcaaaatcatctctcctcaaagtattgctatcgccacatcagcaggcaaccagcaaggtaaggagggagagatcctgaaagcagccattccttatgcactggcttatgtagtcataacgggaatcattgtgtatatattcagttaa

SEQ ID NO: 4421 - DNA, 1443 bp, B.fragilis
atcgttagaatgaacaaaaatactattctatatgcaatattggcaatactgtactttatgttattttcttgctcccaagaagagttgattctgccagacccgacacctctggatgcctataaaagacagagtactcaactgggtattgacagagaaaaaatcaatattaatacagaagatgctagtatagtcgcagaaatattcaatagaaaaaatcatcatttaacaaggaattcgttaaatgaacctaccaaacggataaaagaaatctttactttatataataatggaaaaccgatgatgtatattatcaattatcaagatcaaaaaggttacaccattattagtgcaactaaaaaatactatcctgtaatcgcatactccgatgtgggctctttttctctgcaagagtcttataacgatggttcctccattctattagatgagtataagaaaattatgcaatataacgaaatacagccagatagtatcatagataaatataggaaaaaatgggttgagtttgaaaatttaaaaacagaaaagctaagtgatgtttctacaagatccttaagtgattatgcaatgtccattaaaaaagaggagcaaaaaaagatctggactaacaagggttatgaatgccatgacttgggcgcaatccgaaattttctttctaaggaaagggctgatggatacatcagagacatctgtaatcatacggatcaaaactataactgtgagaaagtaaacctactgttaataaaaaaatatccaataaaaacgattggaccattactaaaaacgagttggcatcaacgctctccctttaatgtagatgcccccaataagttggctggttgcgtaccaattgcaattgcgcagatagccaaatattatgaatggcccgttacatatagttggacacatattccattgagatgtaatacgaatatggaagatgatgaatttttcaaaaagtttatcaaagacattcgtagtttctcaaaagtaacctacaaagataaagccacgggagctacgatgggcaacgctgtaaaagcattcaaaaaattgaattattctgcaacactaatggactacaaaagaagtgagacaattcaagaaatacaaaacaacagacctgtttttatgggaggagacagaaaagcaattttttttgatataatcactaaaggtcatgcatgggtatgcgatggttatgaagtacgccagacacaatatgcatcattagtttggggaagtaaattcaatatacccgatatggaagaacctgattattttttcaccaatggtacctatgatacctctgaatttcttcatatgaattggggatggggtgaaaatgggggaaatggatggtatatttttgacaacatatataatagaactcatgatgtcagctatcatttaaatagaccttaa

SEQ ID NO: 4422 - DNA, 846 bp, B.fragilis
acgtacagaatagccacacagagactgaacgggtcagaaactttttctgattcgttcggccctattaatatatacaatgaaaaacacactcgatatatgaaaagaatctccctgttcgtgctatttatctgcacgatcttttcctgcctttctgcacaaaccgacaaagagaatgaacgtatcaagcagaactacatccggtctataatcgggatggatgaagagaaacaaccctatttacaattattgtcgaagattcctcccgaaaaagaggtttccgaccagaacgttatcgaactacaacaactttatcccatccgacaggaggagatacatcgcctgatcagcacgatccggggagacggttcatggccggatattaattacgctgacacaaaacgctcgggatgggaaccgaaacaacataccgaacgaatactgaaactgaccaaatactatgccagtgaacaagagaacgtatctgcacaggagatttccgcagtagtcagcatcatccatcaagctatgaagtactggtttgtccaaaagccggtctgcaaaaactggtggtacaatcagataggtattccccgcaccttgggtccggccttcctccttttcgaaaccgaaatgacggagaaagaaaaacaagaggccatccgggtgatggaacaatcacagtttggcatgaccggacaaaataaggtatggctggcaggcaacgtactgatccggggattacttctgaacgatgccgaactgataaaggaagcacgggaaaatatatgctcggaaatcgtactgggacagaaagaggggattcaaccggactggagttttcattag

SEQ ID NO: 4423 - DNA, 1278 bp, B.fragilis
actcaaacgattcaaactctgaccccaatgatattcagtcaacgcatctatttcatcatactgtttcacgtattgctgatactgggcacagcaggcaccggactatggttggtcgtgtcgcatacgggatacatcatcggcggtatactgctgctctgttcgctgttccagatcggtgcattgacccggcagttgaatacgtttaaccggaaaatcagactgttcttcgacgccgtgcaggataaggataatatgctctactttccggaggcaaatgtcggcaaagagcaggcacagttgaaccgctccctcaaccggcttaacgacctccttgcccgcaccaaaggcgaaagtcacaaacaagaacatttctatcaatcactgctcgaggaggtgcccagcggcgtgcttgcctgggacgactcgggtagaatcattattgccaacagtgccgctttctcgctgctgaaatgcaaccgtctctataccgaaacccaattggcacaactgctgaatgtaaccggcatccgcaagagtctcagcatatcggagaaaaagatgattctggacggcgaaaccatcaccatcttgtccatcaaagacatcggcgacgaattgagcgataaggagaacgaatcatggagcaaactgacgcatgtgctgacgcatgaaatcatgaataccatcgcaccgatcctttcactctcacaaaccttgtccgaacgtccggatatcaacgaaaaatcggcccgcggactacggattatacaggctcagagcgaacggctgatggagtttacggagtcattccggcatctgtcctatctcccccatccggaaaaaaggcgcttcgcattgaccgagatgctccgcaatcttgaagaattgctgcaaagcgactttcgggaacgcggtatccggttcatgctgcaatgcgtgccggacccgatagaaacagatggtgatcccaatcaactgtcacaagtctttcttaatctgctgaaaaatgcgatgcaggcactcgagggacaggcggatggaagaatcattctccgcgtacggcgggcagaccgtctgcaggtcgagatagaagataatggccccggcataccggaagagatacgggaacagatcttcattccgttcttcacaacgaaaacggaaggaagcggaatcgggctcagtctttgcaaacagatcatccggcaacatgacggacacttatccatccgggaaagccgtccgggacaaactattttcagtctcgatctgccttag

SEQ ID NO: 4424 - DNA, 1305 bp, B.fragilis
aaggaagccttttcctcccttctttgcaggagaacggagaaaaggccttttctatttcaaattcaacctctcgttatctccaaacaattcatacccggaaataatcacccggtcgcccggtttcaatccttcggtcacttcgtagtactgcggattctgcctcccgatacggataggacggcgcgtggcaaatttaccactttcgtcaagaacatacatccagcggcccccggttatttgaaagaatcctccacgaggtacaagaatggcctgggcaggatctcccaactgaagattgatgtgatacgtctgcccggcacggatgttttcgggacgtccggcagtaaactgaaggtcggtacggaattgtccctcttttacttccggatagggtttggtcacttcaagtttatagttgcctccgtcacgggtgaaatccgccggaagtccgggaactaccctctccacgtagtattcgtcgatcagagcctgtactttgaggtcgggggtaatgatctgcccgatatgttcgccggcagcaatggactggccgatctgggcatcgagattacccacctgtccatcgatgggagcttttaccttcaggttttccacccgctcgcgtaccagggcgaggctgcgcttcatgttacggatattctcgtcgaggctgctgatctggctttccctgaaaaaattgtcctgccggatgcgttcgtcaatgacttccagttgtgcccttgccgcttcgtactcttcggcagccaggcgaaactcctcttgcgctatcagctgctctttgataaggcggctgtattgctcgtaacgccgttgtttcactgccagttccttattcaggccgatgcgttcctgtttcagccgcagatgttcctgctccatgctgatgcgggtattgcgcaactcgttctcctgataggccagatcggcttcgctctgcatgatgccgatgttcaggagcggattgctgagacgaagaatcacatcgcctgccttgacgatggctccttcctctttcaggcgctcttccacacggcctccttctatcgcatccatataaatgatgcggttgggcatcacttgtccgataacccggatgtaatcactgaactctccccgggtaactgtagcaatggtcagccggtctttttccacattcatagaagaggaagtgtctctgaaaataaagtaaaaaacaagtcccaccaataccacggctccggcgacggcataataatgcttccgcttcattccgggtttgcgttcgatcattgtatccatagataa

SEQ ID NO: 4425 - DNA, 1371 bp, B.fragilis
atagaagttttcagtatgagtttcaacattgtaaaaaacgacaagaagcgtgtcatcatcgtaggtggtggcttcggcggtcttaaattggccaacaagctaaaaaagtctggtttccaggttgttttagtcgataagaacaattatcaccagtttcctccccttatttatcaagtcgcttcagccggacttgaacccagttccatctctttcccgttccggaagatttttcagaaacgaaaggacttttacttccgtatggcagaagtacgggccatcttccccgagaaaaagatgattcagacttccatcggtaaagcagaatacgactacctggtactggcagccggcaccacctccaacttcttcggcaacgagcacattgaagaagaggccatgcctatgaaaaccgtttcggaagccatgggactgagaaatgccctactggcaaactttgaacggtcgatcacttgcagtacggaacgtgaacggcaggagttgctcaatgtcgttgttgtaggcggaggggccaccggagtggaaatagccggagtgctttcggaaatgaagaagttcgtactgcccaacgattatccggatatgcccagcagcctgatgcacatctacctgattgaagcgggcgatcgtctcctggcgggaatgtccgaagattcatcccgccatgccgaacagtttctgcgtgaaatgggagtcaacatcctgctgaacaagcgggtgacggattacaaagatcataaagtgatgttggaagacggtacagagatagcgacacgtacgtttatctgggtgagcggcgtggcagccatcactttcggcaatatagacggagaattactgggacgcggaagaagaatcaaagtagacgaattcaaccgtgtacagggaacagacactatttttgccatcggggaccaatgtattcagactacggacaagaactatcctaacggacacccgcaactggcacaagtggccattcaacaaggcgaactgcttgccaagaacctgcaaagactacagaaaggaaagccgatgcagccgttccattaccggaacctgggatcgatggcaaccgtagggcgcaatcgtgccgtggcagagttcagtagtttcaaaaccgccggatggctggcttgggtgatgtggctggtcgtccatttacgttcgatcctgggagtacgcaacaaagcaaacgtcctactgaactgggtatggaattactttacttacgaccagtccctgcgcatgattgtctatgcaaagaaggcgaaagaggtgcgtgaccgggaagaactggaagcgaaaacgcattggggagaagaaacccagacgcaacaacccaaaggctaa

SEQ ID NO: 4426 - DNA, 1035 bp, B.fragilis
tggatctgcttactgcagacaccgcttatacgcagttcaaagccggacaagaagctcgagctaccctactacgcggcttcacaaccatccgggatgcaggtggtccggtcttcgggcttaaacgggccatcgacgaaggaatcctttccggaccacgcatttatcccagtggctctcttatctcccagacaggaggggcatggagatttccgggcggtatatgacgaaccccgtccctttgactgttgcggactgacgcataccgaaaagatgggagctgccattatcgccgacggaatagacgccgtgaccgtcgccgcacgcaataatctcggcctgggagccagccagattaaattgatgacaggcggcggggtagcttcctggtatgatcggttggaagattcccagttcttcgagaaagagattcatgctgccgttaaagcggggaaagatgcaggaacatacgtaatggtgcatgtctatgtgcccagagctattcaacgagctatccatgcaggtgtaaaaagcatcgagcacggccatctgattgacgaacccaccatgcagctgatcgcagaaaaagagatatggctcagtatgcaacccttcactttaggagataatcaattcccgacaaaagaacaacaggagaagcatgccttggtagttcaaggtacggaccaaacctatcaactggcaaagaaatacaacgtcaagctggcatggggaacagatttactgttcaatcctgccaacacgaagaatcagaatcagggaatccttaaattaagacaatggttcagtaactttgaaattctcaagatggtaacacatgataatgcggaattgctggctctgtccggtgcacgaaatccctatcccgggaaattgggtgttatagaagaagatgcctgggcagacttaattctggtagatggagacgtactgaaagacattaccctattgggagatccggaaaagaatttcataataatcatgaaaggaggagaaatatacaaaaatagagtctga

SEQ ID NO: 4427 - DNA, 1188 bp, B.fragilis
aacgaaccattaaaaaagattatgatgaaaacaaaaatgatatatatgatacttctgttctcaagtattcttttcgggggatgcgttagggatgtcattgatgatgttccggggacggatgaggactatgcggcagataagaaggacgtggtcctgatacgtatgggaactaacgatgcggaagtgaaagatattacatcccgcttgttcaacaacattccttcttcctgggaaatagggaaaaagaccattgtggactatgacaagatgaaagatcctgagacggaacttaatgccgacatcaagaatccgaagatttatatgacggtcattttgaatatcgatgatgttatctccggtaaatatccgatatctctgttccgtatgttgaagttctataaaagggatttttatgtgattgccactcagtccactccggaacagaaggaggagatgctttcactgataggagtctatatggaagcaggttattatgcgatcaactatgataacgtacagcattaccgtatttttccttctgccgatccgtatgccaaagataatatgattggtaagggagtggcttccttcaatcaaaaactgttgacccgctctgccgataccttacccgaaggtaacgatccggatcccggatataatgcacaaatggcggataaggaggctttgaagaggattgagatttacaaccgtatctatggctatgctcagggagacatgaactactccatgcaggcggtcccttataagatgaaacagggtgccgcacccgatgtgattatagataactcctgggcgatagatgcctataacttccagatatacagtaagaacaacaactgtatattgagtatcacgaataatgccggaaatggcttcactgccaatatcaaagactataccactcccaaaggtgccaatgtctatgcttacatctggaatttgatgcgggaggcttccagtgagataaccgttcattcggacggaggaattttcagggagatcagttatcagccgcagacggtgaatcacggtgccagctataccgagaactctttctggaaagtgtctgtttccgtatcgcccaccaaactggaagacaaaccttgggaggcgttcaaagtgtcgtttggtaaagaatcgtctaccgaagtgtcttacaaggactaa

SEQ ID NO: 4428 - DNA, 1173 bp, B.fragilis
atggaagcattcacattcaatacaactgaactgatactactgtcggctacaggtgttcttttaatcattcaacttatctactatctcggactgtacaaccgtatacacacccacaacctcgctgtcggaaaagacgaagtacacttcggacgggaactgcctcccctatctgtggtgatctgtgcacgaaacgaatcggaaaacctacgccgcaacctgcccacgatcttgaaacaggattatccggactttgaagtaatcgtcattaatgatggctccacagacgaaagcgaagacttgctatcggcattggaggaagaatatcccaacctgtatcacagttttactccggacagtgcccggtacatcagccggaaaaaactggcattgacactgggaatcaaagccagcaaacacgactggctggtattcacagaagccgattgtgctccggtcagcaaccaatggctccggcgaatggcgcgtaatttcacatcgagtacagacatcgtactgggatatagcggctacgaacgaggaaaaggctggctgcacaagcgggcatctttcgactcgcttttcacctcgctccgctatctgggatttgccctggcaggtaaaccgtatatgggtatcggacgcaatctggcctaccggaaggagttgttcttcaaagtcaagggattctctacccatctgaatatgcagcgcggagaagacgatctgttcatcaaccaggttgccaatgaaaacaacacccgggtagagacctcaccggatgccgtgatacggatgcaacccgtggaacgctataaggactggaaagaagaaaaggtgagctacatggcaacttcccgattctataaaggctcgcaacgctggctcctgggattggaaaccggtacgcgactgctgttttatgccgcttgcctggcggggattgtattcggtatcctcagcttccactggttggttgtcgggttatccctgttactgtggttcgtccgctattcggtacaagcctacgtcatcaacaaaacagccggtgagatgggtgacaaccgttcttactactttacgctgccggtttttgacataatccgtccgttacagaccttgaagttgaagctttaccgcctctatcgcggaaagggtgatttcatgcgcagataa

SEQ ID NO: 4429 - DNA, 1038 bp, B.fragilis
tcggttttgttttcgtccgaacggaacaagacttttaaaacaaaaagaaaaatggcacaattgaattttggcggtgttacggaaaatgtagtaacccgtgaagaatttcctttggaaaaagctcgtgaggtattgaagaatgaaacaatcgctgttatcggttacggtgtgcagggaccgggtcaatcactgaacctgcgcgataatggcttcaatgtaatcgttggtcagcgtccgggaaaaacatatgaaaaagcagtggcagacggctgggttccgggtgaaacactgttcggcatcgaagaggcatgcgagaaaggtactattattatgtgtctgttgtcagatgcagccgtaatgtctgtatggcctactatcaaaccttacctgactgccgggaaagcactctatttctctcacggtttcgcaattacatggagcgatcgcaccggtgttgttccacagaaagatatcgatgtcattatggtcgctccgaagggttcgggtacttcactccgtacgatgttccttgaaggtcgcggactgaactcttcgtatgccatctatcaggatgctaccggcagagctatggagagaaccatcgcattgggtatcggcgtaggttccggatatctgtttgaaacgacttttgtccgtgaagctacttccgacctgacaggtgaacgtggttcgctgatgggagctatacaaggtttgctgttggctcagtatgaggttttgcgtgagaacggtcatactccatctgaggcatttaacgaaacggttgaggagttaactcagtcattgatgccgctgtttgctaagaatggtatggactggatgtatgccaactgctcgactacggctcagcgtggtgctcttgactggatgggcccgttccacgatgctattaaacccgttgttcagaaattatataatagtgtaaagaccggtaacgaggcacagatctctatcgactctaattcaaaaccggattatcgcgagaaactggaggccgaactgaagggcattgcgtga

SEQ ID NO: 4430 - DNA, 1935 bp, B.fragilis
ttcttagcatataacttacagccaatcaagatgaatgataataaaataaagtcttcttctccactcagtgatcttcagcatcagcaacttttgctacgcatggaatatgaatacgagaaagaagaattccgccggcagacagagacgatgggcattgcacggaaagtaaaacgagggctctgctggtatccggtcgggacgggacggagtttctacaattcactgaaccaattggtcatcgaaatagaaaggaaagaagataaagacatcgaacatgtattcgaattcggacgtccggtttgctttttcgaacagggatatgacggaaaaatacattatttcaattccatctgtacagtcagttatgccgacgaggaacgtatggtagtagctgtacccggtgccggatctctacttgaaatacaaggagcagaacgtctgggagtacaactctattttgatgaaacctcctatcgtaccatgttcgaagcgctggaagatgtgattcgcgccaaaggcaaccgccttgccgaactacgtgatatattgctaagcaagcaaccctcctgctggagggaaacctatccggtccgtttcccttggttgaacagcactcaggaagcagcagtcaacaaagtactttgcgccaaagacgtagccatcgttcacggtcctccggggaccggaaagaccaccactcttgtagaagccatctacgagaccctgcaccgcgaaaatcaagtcctagtctgtgcacaaagcaacacggccgtcgactggattgccgagaagctggtggaccgcggagtgcctgtattgcgtatcggcaatccgagccgggtaaatgacaagatgctttcatttacttacgaacgccgtttcgaggggcatccggcctataccgaactctggggaatacgtaaatcgatccgggaaatgggaaaccggatgcgcaaaagcagttactcggaacgggaagctgcacgcagccgcatcaatcatctgagggagcgtgccacggaactggaaatacaaatcaatgaagatctgttttcgggggcacgggtcattgcttccacattggtcagcagtaaccaccgtatcctgaccggccggcgatttaccacactctttatcgacgaggcagcacaagcccttgaggctgcctgttggatagccatccgaaaagcagaccgcgtcatctttgccggagaccattgtcagttgcctcccacaataaaatgcatagaagcgggccggaacgggttggaacaaacattaatggaaaaagtagcagccaacaagcaggaaacggtctcactcctgaaagttcagtaccgcatgcatcagtctattatgcaattctcctccgaatggttctaccaaggcgaactacaagccgcccccgaagtgaccaaccgggggatactcgatctggacctgcccatgagttggattgacacctccgaaatggagttccacgaagaatttataggagaaagcttcggccgcatcaataaaccggaagcaaacttattgttgcaagaacttgaagcatacatccgcaaaatcggcgagaagcgtgtattggaagagcgtatagacttcggccttatctccccttacaaagcgcaggtacagtatctgagaggaaaactcaaaggctgttcattcttccgccccttccgtagccagatcaccatccatacagtagatggttttcagggacaggagcgtgatgtcattttcatcagcctcgtccgcgctaacgaagatggacaaatcggttttctcaacgacttgcgccgaatgaacgtagccatcacccgcgcccgaatgaaactggttatattaggagatgcggtcacaatgagcaagcatgctttctataagaaattgatcggatatatccggcacatcagccaaggactctga

SEQ ID NO: 4431 - DNA, 1977 bp, B.fragilis
atcaagtttaatatatatctttgtgccctgatcaaacaacaaacaatattatatcatatgaaaaatcgtatttatacaatgaaagggatgctggctacattactgggtgcttttttactagggtatgcagtaacaggttgtattgatgaaaaagatcattataaaccggacgataaaacatcaggagtgcctaactcttttgattttgcgactactcaggatgtccaattggatctaaagtatgatgttcctgtgaaagattatcaggttttgtttgaactctattttgaaaatccgttgacgacagatgccgaagggcaggtggtgaaacgtactgatatcactcccaaggttacgagaatgactgatggaaccggaaaatatcgtgccaaggagacggtaccggcctatggggaggaggtttatatctatacttcttatatcggagtgccgatgttgtataagactaaaatagtagggaatacgattacagccgatataaattgggatacggcggcagaggagtctgttcagacacgtgccgaaggcgagtatcagacagtgcctcagggattttatactttaggaagttggaacgtgaagggacgccctaattatctggatagtgaaggggtaatagaattgacttcttcattttatcagacgattaatcaaacaattccggaaggtggaaattgtcctcggaaatatcggcaatcggctgacattgttatcaacgatgaattgggagctgaagtgaaggtgcgttttgttggaggtacaagtgctgcgtacagtgctttcggatattattgttatccggaaggagcggctaaaaaacagatagagaatgctaggaaatatgtggtctttcccaatacgaaaaccggagtcggcataaaaggcggagagtgtgtgaagctgcattatatcgatgaaaatggtgaagaccaagggactacttttccaaaaggaacaaagataggttggtttatcagtaatgatgcatttacgaaaaagggtgaaaagaccggcagtgttggtaaaggactcggaatgttttattcgaccactgccttgaattcggatggtcgtacccatacggctgcattcaagatcaatgattttatagttttatcatttgaagattggactgatcaggattacaatgatgtgatgtttaacatctggtctaatccgattgaagctattgctccggatgtaccttcggtagatccgatagatccggatgatgcgtcggttgcttatcgcatgacttataaaggtattttggcttttgaagacaattggccttctaagggtgattacgatttgaacgatgtaattgtgaaatatagctctatattagagttcaataccaagaatcaggtgctttccgctgaagatacgtttacggcaatgtggtccggagctctctttaagaatggctttgcctatcagttgaataccgatagaagcaatgtggaatgcagcatattggaaggaaagtcgggatgggacaaacaaggattagacaaagacttggagcaggccaccatttcggtgtttgccaatgcgattgaagagacgggagagaacactaagacttctacttttaagattcagaacaaatttaaacagccagtcgatcatgaaactttcggagtggcaccctacaatccttttatcttcttgcatcagaatacggacaagaaccgtacggaggtgcatttggtaaatcacggaccaacctctaaagaaaatatgaatctgttcaatacccagcaggatttgtcagataaagataaaggcatttattatgtgtccgatcagaattatccgtttgccattcatctgtcggatgtcgagtcattcagtacaacggagaaggaagctattgataagtcgtatcctcgttttgcttcatgggcacaatccggcggaacgacagataaggattggtatttgaagaaataa

SEQ ID NO: 4432 - DNA, 597 bp, B.fragilis
aatgtgattaaaatgaagaagattgtttttcttttgctgctctgtgttgcttgctgcatgaatgcacaggagtttcatctgattccgaaggtcggtttgaatctggcaaatactaccggagaggtggattctaaagtgcgtcccggactcaatatcggtctgggaggtgatgtcatgctgaccgaacggtttggaatagaaacaggagtgtattactccatgcagggaagcaaatataaagggggcggagtctcttatacggataaactggattatatcaatgttccggtatatgcgaaagagtttatatataaggggctgtatgtgtttggagggccgcagttcagtttcaatgtgaactcagagaacaaatcatcctccgactatggtaccacagtcataggcatgaatgtgattcgcaagtttgattgtggagtggggcttggagccggttatcagtttgaacgtggtctgctgatctctctaaactataacatcggactgattaacgtaaacaaatcttgggcaagcgactctaatcctaaagcaaacaatagtgtggtccagctaaatgtcggttggcgttttgcactgtaa

SEQ ID NO: 4433 - DNA, 744 bp, B.fragilis
atgagtaacaataagaagatagggagttataagtttattgcggagccttttcatgtagacttcaacggacgtttgacaatgggggtgcttggcaaccatctgttgaactgtgccggctttcatgccagtgaacgcggctttggaatcgctacattgaatgaggacaattatacatgggtattgtctcgtctggccatcgatctggaagagatgccttatcaatatgaagagtttactgtacagacatgggtggagaatgtatatcgtctttttactgatcgtaattttgccattatagacaaggacggcaagaagatcggatatgcccgttcggtatgggccatgattaatttaaatacccgcaagccggctgatttgctgacgttgcatggcggtagtattgtggactatgtatgtgacgaaccttgtccgatcgaaaagccttcgcgtatcaaagtggctactgaccaaccttgtgctaagttgacagctaaatacagcgatatcgacatcaatggtcatgtgaacagcattcgttatatagaacatatcctcgatttgtttccgatcgatttgtataaatcgaaacggattcagcgatttgaaatggcctatgtggcagaaagttattatggcgacgagctttctttttttgaagaggaagtaagtgagaatgaatatcacgtcgagattaagaaaaacggcagtgaagttgtatgccgggcaaaagtgaagtttgtgtag

SEQ ID NO: 4434 - DNA, 2373 bp, B.fragilis
cttctcacaaaatttcccgcaaagataacaattctgtttccgggttggaataaacatttcaatttgttaaacctttctttcatattattggttataataaatagaagaacagataaaaccgaaattgttatggtatatgatttgaatatgttgaagagcttctatgcttcctataaagggaagatggagcatgttcgtgcagccttgaaacgtcctttgacgttggctgaaaagattttgtatacacatttgtataatgtggcggatttaaaaaattatgaaaggggtgaagactatgtcaactttcgcccggaccgcgttgctatgcaggatgctactgctcagatggctctgttgcaatttatgaatgcgggtaaagaagcggtggcagtaccttccacggttcattgcgaccacctgatacaagcttatcggggggctgaacgcgatattgaaactgctacacaaaccaatcgggaggtgtacgattttctgcgtgatgtctcttcccgttatggcatcggtttctggaaaccgggagcgggtatcattcaccaggtagtacttgaaaattatgcttttccgggtgggatgatggtcggtacagactcacatactcccaatgcaggaggtctcggaatggtagctatcggtgtaggcggagccgatgctgtggatgtaatgacaggtatggagtgggagcttaagatgccaaaactgattggagtccgtttgacaggcgagttgaacggatggacagctccgaaagacgtgatactgaaactggcgggcatcttgaccgtgaagggtggaacgaatgccattatcgaatattttggcccgggtacagcttcgctatcggctacaggaaaggccaccatctgcaatatgggtgccgaagtgggggcaaccacttcactattcccgtatgatgaacggatggctgtttatctgaaagcaaccggacgtgaagaagtagctgcgatggctgacagtgtagctgccgacttgcgtgcagatgacgaagtgatggcacgaccgggcgatttttatgatcgggttattgagataaacctttccgaactggaaccttatattaatggtccgtttactccggacgctgctactcctatttcagagtttgcagagaaagtggtaacaaacggttatccccggaagatggaagtggggttgataggatcttgtaccaactcttcttatcaggatatcagccgtgccgcctctgttgcccggcaggtgaatgaaaagaatctgggagtggcggcaccgctgattgtgaatccgggatccgaacagattcgtgctacggccgagcgtgacggcatgatggatgtgttcgaaaagatgggagctacgattatggctaatgcctgtggtccctgtatcggacagtggaaacgccatacggacgatccgacccgtaaaaactcgatagtgacttcctttaaccgtaattttgccaaacgtgccgacggtaatccgaatacttttgcttttgtggcttctcctgaaattgttttggcattgactattgccggagatctttgtttcaatccgctgaaagaccgtttggtgaatcatgacggtgaaaaggtgaaactcagtgaacctcaaggtgacgaacttccatcagccggatttgtagccggtaatcaggggtatcaggctcccggcggtgagaaaaacgagatcagagtggctcccgattctcaacggttgcagttgttgactcctttccccgcgtgggatggcaatgattttctcaatatgccgttgcttatcaaagcacagggtaagtgtacgacagaccatatttcgatggcgggtccctggcttcggttccgggggcatctggagaatatatctgataatatgctgatgggagcggtgaatgctttcaatggcgaaacgaataaggtatggaatcgtttgaccaatacctatgaaactgtttcgggtacggctaaacagtataaggcggacggtatctcttccatcgttgtggccgaagaaaattacggtgaaggttccagtcgtgagcatgccgctatggaaccgcgtttccttcatgtaaaggtgatcctggctaagagttttgcccgtatccatgagactaatctgaaaaagcaaggtatgctggctgttacatttgcagacaaggccgattatgaccggattcgtgagcacgatttgatctcggtagtcggactgaaagagttttcacccggacgcaatctggaggtgatattgcaccacgaagatggtacggaagaacggttcgtagtacaacatacttacaatgaacaacagatcggctggttccgtgccggttctgctttgaatgcaaaatag

SEQ ID NO: 4435 - DNA, 462 bp, B.fragilis
agacgcctgaatgtttcggcttcatctatcaagggggtgcataaatatactattacggcttggaccgataaagatacgatagagaaggttgtcaaacagattgagaagaagatcgatgtgcttcaggcacattatttcactgaagatgaaatctattttcatgaaatagctctttataaggtgtctatgcccgaatttcagtcacagccggaagcttcgaaggtgattcgtcgctataatgcacggattgtggaagtgaatccggtatttgccatcgtcgagaaaaatggaatcagtgaagaaattacttctctctacgaagagttgagtgcattgaattgtgtgttgcaatttgtgcgttcgggacgtgtggcaatcactaccagttgctttgaacgtgtgaacgagtttctggcagatcgtgagaccaaatataacttaagcaagaaagaggaaaagtga

SEQ ID NO: 4436 - DNA, 909 bp, B.fragilis
atgagtaaaattaccaaacagcaaaatggagtattgtcagtgccggatgtaccgacaataccttttataacgggtgatggagtaggagcggaaataactccggccatgcaggcgatagtagatgcggcggtagacatgtcgtatggtggtgcccggcgtatcgaatggaaagaagtactggccggtgaacgtgctttccgggctaccggttcgtggttgccggacgaaacgatggaggttttcaaggagtatctgataggcatcaaaggaccgttgactactccggtaggaggaggaatacgttcgttgaacgtggctttgcgccagacactcgatttatatgtctgcctgcgtccggtacgttggttccgcggagtggtgtctccggtcaaagagcccgaaaaggtgaatatgtacatctttcgtgagaatacggaagatatctatgccggtatcgaatgggaagcaggcactccggaagctaagaagttctaccggttcttgcacgaagagatgggagtcagtaaagtacgtttccccgaaacctcttcttttggtgtgaaaccggtttcgcgtgaggggacggagcgtctggtacgcgctgcctgccgttatgcgttgcagcatgaattgccctcggtcaccttggtgcacaaaggtaatatcatgaaattcacagaaggaggttttaagaagtgggggtacgaattggctgagcgggagtttgcagatgctcttgcctcaggtaaactggtgatcaaagactgtatagccgatgcctttttgcagaacactcttttgattcctgaagaatattcggtcattgccactctgaatctgaacgtcttcaccacggggctggaaggatccgcgggtggcgttaagaaggatccgacgcggtggtgctat

SEQ ID NO: 4437 - DNA, 576 bp, B.fragilis
ttattgttacctttgcacactatttgtaaggaaatgaaagataccaagcaacaatttgaacatgtcattgctttatgccgtgacctattctctaaaaaactgcatgattacggtcctgcatggcgtattttgcgtcctgcttccgtgaccgaccaaatatttatcaaggccaatcgtattcgcagcattgaagtaaagggggtgactcttgtcgatgagggaatccgttctgagtttatcgctattgtcaactatggtattgtcgggttgatacagttggaactgggatatgcagagtctgctgatattacagtggaagaggcattggctctttatgacaagcatgcgaaggaagcattggaattgatgcttgccaagaatcacgattacgatgaagcatggcggagtatgcgcatcagctcatataccgatttgatattgatgaagatttaccgtaccaagcagattgagagtcttgccggtcagacattggtctcggaaggcattgatgccaattatatggatatgattaactattctgttttcggattgattaagatagaatttgaaggatag

SEQ ID NO: 4438 - DNA, 372 bp, B.fragilis
acattgtataccggacgaggcaaaccaccttctcctatagaacgtcctccaagattaaatgttccataccctccgactccagattttgctccggtcaaagaattaccgtctttacttccttcaactccttctcctgaagtagccgtacctttacttccccccatttgcgaacctttaccaaaagcaccggccactcgtttactggcagcttccgctgcagccttacgttcacgttccgccttttcctcggcaagctttttagcttcggcagctttttcttcgggagttttctcaggtttctttgccactttcggtttttccttcttaggttcggccttaggctttaccacaaccgtttcttcttcggtctga

SEQ ID NO: 4439 - DNA, 900 bp, B.fragilis
attgaattaacaagacgaatgaatttcaattgcattaaaacagtaatgattgccgctgcggctatgatcagcctgaattctttttctcaggatttgattgcccgtcaggcaccgattgacagaaaattaaaaagtgtagattcattagcattgcagaaacagatccgtgcagaacaatctgaatatcctgcgttgagtctatatcctaattggaacaaccagtacgtacatgcttacggaaaggatgctattattcccgattcttatacgatcgatctgaccggcttccatatgcctactccgagtacccgtattacatctcctttcggtccccgttggagaagaatgcacaacggacttgatatcaaagtgaatattggcgataccattgtcgcagcttttgacggaaaggtacgtattgtgaaatacgagcgtagaggatatggtaaatatgtcgttattcgtcatgacaatggtttggaaactgtatatggccacttatctaaacagttggtagaggaaaatcagttagtgaaagccggggagccgatcgctttgggtggaaacaccggtcgttcgacaggatctcacctccattttgaaacacgtttcttgggtattgccatcaatccggcattgatgtttgacttcccgaaacaggatattgttgcagatacatatacgtttagaaaaacaagaggttacgaacgtaacagagccggttctcacgatactaatatagcatcggacggtgaaatcagatattacaaggtgaagaaaggcgacagtttgtcccgaattgctaaattgcgtggcgtttccgtcagcacactttgtaagttgaatcgtattactacaaagaccacacttcgtccgggtcaagtattgcgctgttcataa

SEQ ID NO: 4440 - DNA, 555 bp, B.fragilis
attatgggaactgtttatgcatttttcgcagatggatttgaagaaattgaagcgcttactacaattgatacattgagacgcgcaggtttagatgtcgaaatagtatctgttactccggacgagattgtagtcggagcgcatgacgtatctgtgctttgcgataagaattttgaaaattgtgacttctttgatgctgagctgctgtttttacccggaggtatgccgggagctgccactttggacaaacatgaagggttgcgtaaattaattcttagttttgcagagaaaaacaagcctattgcagccatttgtgctgctccgatggtacttgggaaactgggactcctgaaaggacgcagagttacttgttaccccagtttcgaacaatatctggatggggcggactgcactaacgaaccggttgtaagagatggtaatattattaccgggatgggaccgggagctgccatggagtttgcattgactattgtggatacattgttgggcaaagaaaaagtgaacgaactggtagaggctatgtgcgtaagacgttaa

SEQ ID NO: 4441 - DNA, 501 bp, B.fragilis
ataaatgagcactttaaccttttgaaactgtacgttatgatggaaaaaacattagtcattctgaaaccttgtacccttcagcgggggctggttggcgagatcactcgtcgttttgagcgtaaaggattgcgtttggcaggaatgaagatggtgcagttgactgatgaagtgttaagtgagcattattcacaccttagttcgaaaccattctttcagcgagtgaaagattccatgatgacggctcccgttatcgtttgttgttttgaaggtgtggatgctattcaagccgttcgtgcattggcgggaccaaccaacggacgtctggcagcgccggggaccattcgcggagattacagtatgagttttcaagaaaacattgttcatacctctgattcgcctgaaaccgcagctgtcgaattaaacagattctttaaaccggaagaaatattcgattacaagcaggctacttttgattacctgtatgcgaatgacgaatattga

SEQ ID NO: 4442 - DNA, 933 bp, B.fragilis
gataacagcaataccgaaaaaaaatcccaaatttgcgacatactagaaacttttatcaacatgaaatttgccattttcggaaatacataccaagctaagaagtcttcacatgctgccaccctgttcaaattactcgagaaacatggagctgaaatctgcgtatgcagggagtttcatcgttttctgaagtccgatttaaaactgaacgttaaggcagatgatttgttcgatgaaaacaattttgatgccgacatggtgatcagcattggcggtgacggcacttttctgaaggcagcacgccgtgtaggcaataaaggaatccctattttaggcatcaataccggacgattagggtttctggcagatgtatctccggaagaaatggaagaaacgattgaagaggtttatcagaaccattatactgttgaggaacgaagtgtactccagttactttgcgacgataaacatttacaaaattcgccttatgctctcaatgaaatagccattctgaaacgagacagttcatcaatgatcagtatccgtacagcaatcaacggggcacatctcactacttatcaagcagacggtttgattattgctactccaacaggttctactgcctattcattaagcgtaggtggccctattatcgttccacactccaaaacgattgcaatcactcctgtcgccccacacagtttaaatgtaaggcctatagtaatctgtgatgactgggaaattactttagatgtagaaagccgtagtcataactttctggtagcaatagacggtagcagtgaaacctgtaaagagactactcgtctcactatccgtagagcagactatagcattaaggtggtgaaacgctttaaccacatctttttcgataccttgcgtaccaaaatgatgtggggggctgacagtagagtgtaa

SEQ ID NO: 4443 - DNA, 774 bp, B.fragilis
ccatcgatagacccacccgctgatccttccagccccgtggtgaagacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 4444 - DNA, 1335 bp, B.fragilis
aatttgaaggatagagaactacatattattcagaaagtatggactaacctgtgccgctttgcgctggcaggggtgtttatcttttcaggatttgcgaaggcggtcgatccattgggttcggagtataaaatacaagactaccttgatgctttcggtatggggacatggttcccggctttttttccattgctggcaggtattgttttatcagccattgaattttcggtaggtatctttttgttttttggcatccggaaaacgactgctacatggttggctttgttgctgatgatttttatgacaccgctgaccctgtatctggctttagctaatccggtgtctgactgcggctgttttggtgatgcatgggtcttgaccaactggcaaacgttctggaagaacattattttgttgatagctgcaatttccgtttttaggtggaagcatcagatgattcgctttatcagtgccaaaatggaatggctcgtatctctatatacttttctatatgtgtttgcgctttcgttttattgtttgggaaacttgccgatattagatttccgtccttataaaataggaaaaaacattccggaaggtatggatgttccggaaggagcaaagcctacggtgtacgagagtgtgtttgtactggaaaaaaatggcgagaagaaagaattttctttggagaattatccggatagtacctggaaattcattgaagcacggaccattgtaaaagaaaagggctatgaaccttctatccacgatttctcgatgaccaatcttgaaacgggtgaagatattacagaggaggtattgtctgataaaaactatacgttcttattggtggctcatcgcatagaagaggccgatgacagtaatatcgacctgatcaatgagatttacgactatgcggtggaacacggatatggcttttactgcctgacttcttcgttggatgatcagatagaacaatggaaagataaaacaggtgcggaataccctttctgcctgatggatgatattacgttgaaaacaatgatacgttccaaccccggactgatgttgattaaagaaggtactatccttaataaatggagtgatagtgagctgcccgacgaatatgctttgactgacaaactggagaatctggaattgggaaaacagaaagaagaaagtgatgtgcatacgattgggtatgtgctcctttggtttgctattcctttattgatggttctcggtgtcgatatattggtggtgaagcgtttggaaaagaggcggaaaagagctgctgaaaaagctgtcgaaaattcaaaatcctcttctgaggcgtag

SEQ ID NO: 4445 - DNA, 255 bp, B.fragilis
cggaggcattgcacgatggagtggatgtatagactgcacgggcaattcggtgcgacggacacggacgcgatgtgggtatcgggttgggggggtagtgcattgcaccgacgcttatgccgctgtctgatgtgctgcattggactagtcagtgatacgatccgtattcgtcctggtgggaatacgatcggtgtgtcatgtgaaggcgtatctatggacgcgaatggcatgagagcgagggcaggtatcgtgacggct

SEQ ID NO: 4446 - DNA, 672 bp, B.fragilis
gacgttaagcttatgtgtcggactgctttgattgtagccggagggaagggactccgtatggggagcgaacttcccaaacagtttcttcccatcggtggtaaacctgtattgatgcgtacgctggaagcttttcaccgtttcgatgaaaaaatgcagattattcttgtattacctcgggagcaacaggacttttggcgtgaactttgtgaagagcatggctttgacattaaacatctgattgccgatggaggtgaaacacgtttccattcggtcaagaatggattggctcttgtgaacggtatcggtgtagtaggaatacacgatggtgtccgtcctttcgtttcacaggaagtgattgcccgctgcttccgggaagcagtagtccgaaaagccgtcatacccgtcattgatgtggtagaaactgtgcgtcatctcaccgaatcgggcagtgaaaccgtaagccgtaatgactataaattagtgcagactccccaggtgttcgatgcagatctgctgaagagagcttatgaacaggaatttactcccttttttacagatgatgcttcggtggtagaagccatgggtgttcctgtctacctggtggaggggaatcgtgaaaatataaaaataactactccttttgatttgaaagtagcttcagccttgttgtaa

SEQ ID NO: 4447 - DNA, 804 bp, B.fragilis
atgaataatagaattgaaaatttattaacccttttaataaaaaacaaaatgagaaagaacattgttgcaggaaactggaaaatgaacaaaacccttcaggagggtattgctcttgcaaaagaactgaatgaagctttggctaacgaaaagcctaactgtgatgtcattatctgtactccgtttattcaccttgcttctgttactcctttggtagatgcagctaagatcggtgtaggtgctgagaactgtgctgacaaagaatccggagcttatacaggtgaagtatcggctgctatggtagcttctaccggtgctaaatacgttattctgggtcactcggaacgtcgtgcttactacggtgaaacggttgagatcctgaaggacaaagtgaaactggctttggcaaatggtctgactccgattttctgtatcggtgaggttctggaagaacgcgaggctaacaaacagaacgaggttgttgctgctcagttggcatctgtattcgatctttcggcagaagatttctctaagatcgttctggcttacgaaccggtttgggctatcggtaccggtaaaacagcttctcctgctcaggctcaggaaatccatgcgttcatccgttcggctgttgctgagaaatacggaaaagaaatcgctgacaacacttcaatcctttatggtggtagctgcaaaccttctaatgctaaagaactgtttgctaatcctgatgttgacggtggtctgatcggtggtgctgccctgaaagttgctgacttcaaaggtatcattgacgcattcaattaa

SEQ ID NO: 4448 - DNA, 2124 bp, B.fragilis
tttgaaagtagcttcagccttgttgtaatgttcgatttaactacacgagacataaagtacttatccggtgtcggcccgcagaaagctgcggttttgaataaagagctggagatttattcattgcatgacctgctctattatttcccttataaatatgtagaccggagtcgcatctattacattcatgaaatagatggaaatatgccgtatatacaattgaaagggaagatattaggattcgaaacatttggtgaaggacgtcagaggaggctgttggcgcatttttcggatggtacgggagtggttgacctggtatggtttcaaggtataaagtatgttaccaataaatataaacttcatgaagaatacattgttttcggtaagccaacggtgtttaacggaagaatcaatgtagcccatcccgatatagatagtcccgccgatctgaaattgtcgtcaatggggcttcagccctattataatacgacggagaagatgaagcgcagctttcttaactcccatgcgattgaaaaaatgatggcaaccgttatcggacagattcaggagcctttgtccgaaacactttcacctaaactgattgccgatcatcatttgatgtctttgacggatgcattgcggaatattcattttccttctaatccggaattgttgcgaaaagcacaatatcgtcttaagtttgaagaactcttctacgtacaactcaatattctgcggtatgccaaagaccggcaacgcaaatatcgcggctatgtttttgaaacggtaggagagatttttaatacgttctattcaaagaatctccctttcgaattgacaggcgctcaaaagagagttttaagggagatcagacaagacgtagggtgtggaaagcaaatgaaccggctattgcagggagatgttggaagtggaaaaacattggtggcattgatgagcatgttgatggcactggataatggatttcaggcttgcatgatggcacctaccgaaattttggctaaccaacattacgataccatcagagaactgttgtttgggatggatgtaagggtggagttgctgacaggctcggtaaaaggcaagaaacgggaagctattcttgcgggactcctgaccggagatgtacacatcttgataggtacccatgccgtgattgaagatactgtaaattttgcttcgctgggattggctgtcatcgacgaacaacaccgttttggagtggcacaacgtgcccgcctgtggagtaaaagtgttcagccacctcatgtgttggttatgactgctactccgatcccacgtacattggctatgacactttatggtgatctggatgtttcggttatagacgaattacctcccggccgtaagccgattgctacgattcaccagtttgataaccgtagagaaagtttgtattgttcggtacggaaacagatagaggaaggccgtcaggtttatattgtttatccactgattaaagagagtgaaaagattgatctaaagaatcttgaagaaggatatctgcatatctgtgaagagttccccgactgtaaggtctgcaaagtgcatggcaagatgaagcctgctgagaaggatgcacagatgcaactttttatttcgggtgatgcgcagatcatggtagccaccacagtaattgaagtcggtgtgaatgtgcccaatgcttcggtgatgattatcgagaatgccgaacgcttcggactatcccagttacatcagctacgtgggcgagtggggcgtggagctgatcagtcttattgtattttagttactacgtataaacttaccgaagagacccggaagcggcttgaaattatggtgcgcaccaatgacggatttgaaatagccgaggcagatcttaaactacgcggtcccggggacttggagggtacgcaacaaagtggcattgctttcgacctgaagatcgcggacatagcccgtgacggacagcttttgcaatatgtgcgcactattgctgaagaaataacagatgccgatcctggcggagtattaccggagaatgcgattttgtggcaacagttgagagcattgcgcaagacgaatgttaactgggctgctattagttga

SEQ ID NO: 4449 - DNA, 267 bp, B.fragilis; identical to SEQ ID NO: 2762

SEQ ID NO: 4450 - DNA, 882 bp, B.fragilis
aatggtgttggctacacgcccgccggaaacaaagaagaaatgaacataaaaagaaagagtgaatatataggggcgttgggtgcattgttggtgcatgtggctattattgctcttttgattctcgtaagttttgctatcccgcatccggacgaagaagccgggggagtacctgttatgatgggagatgtggatgctgcttatggaaactatgatccttctaccatggtggacgtggaggttttaccggaagaagtgccggctccgcagcccgaaccggaagtggagactgaacaggaaatgattactcagaccgaagaagaaacggttgtggtaaagcctaaggccgaacctaagaaggaaaaaccgaaagtggcaaagaaacctgagaaaactcccgaagaaaaagctgccgaagctaaaaagcttgccgaggaaaaggcggaacgtgaacgtaaggctgcagcggaagctgccagtaaacgagtggccggtgcttttggtaaaggttcgcaaatggggggaagtaaaggtacggctacttcaggagaaggagttgaaggaagtaaagacggtaattctttgaccggagcaaaatctggagtcggagggtatggaacatttaatcttggaggacgttctataggagaaggtggtttgcctcgtccggtatacaatgttcaggaagagggacgtgtcgttgtttctatcacggtaaaccctgccggtcatgtgattgctacgagcatcaaccgattgacaaatacggtaaattcgactttacgtaaggcagctgaagatgcggctaagaaggctcgttttaatgctgtggacggagtaaacaaccagacgggaacaattacttattattttaatttgaaataa

SEQ ID NO: 4451 - DNA, 636 bp, B.fragilis
aagctccgtattatattaagacatagaactatgactaaattaagtgtgaacataaacaaagtggctacccttcggaatgcccgtgggggaaatgttccgaacgtggttaaggtggcgttggattgtgagagtttcggtgctgacggaataacggttcacccccgtccggatgaacgccatatccgtcgttcggatgtgtatgatttgcgtccgttgcttcggaccgaatttaatattgaaggatatccttctcctgagtttattgacttggtgttgaaggtgaaacctcatcaggtgactttggtgccggatgatccttctcagataacttctaattcgggatgggataccaaggttaactttgatttcctgacagaagtattggatgaatttaacggggcaggtatccgtacatccgtatttgtggcacccgatgcggaaatgattgaatatgctgcgaaagcaggtgccgatcgggtagaattatataccgagccctatgctactgcctatccgaaagatccggctgcggctgctgctccttttgttgaagcggcaaaagcggcacgtacattggggatcggactgaatgccggtcatgacttgagtttattcgaatctgaattatttttataa

SEQ ID NO: 4452 - DNA, 450 bp, B.fragilis
cagattggcatcttgaagaattattttatggcattaaagcgtcgagcaaaaatatcacccaactttagtatggcatctatgacggatgtcatattcctgttgcttatcttttttatgataacctcaactgttgtgtcgcccaatgcgattaaagtgttgttgccacaggggaaacagcaaacttcggccaagccgttgacaagggttattattgataaggacctgaactattatgcagcgtttggtaatgaaaaagagcatgctttgggggtggaagagttaactccattcctccaaagttgtgcggataaagaacctgagatgtatgttgctctctatgcagatgaaactgtgccttatcgcgaaatcgttaaagtgctgaacatcgctaatgagaatcattttaaaatggtgttggctacacgcccgccggaaacaaagaagaaatga

SEQ ID NO: 4453 - DNA, 270 bp, B.fragilis
aacgtgttgatgggaatagaccagtacgatcatgcgtcatggggaatcacgcgccccgctttttttgaagccgccttagattatcgacggggacgcccccggagatgcatcatgatggggcgcacgatgaagaacccgcatggagaagggaacgggatgcaccaatgcagaaggacatatgaaggatggtcaatacttaacggaccatcacggagcgtcgtgcatcatgatcgatcgatgcgaagacggaggcgggacgtcgccagctga

SEQ ID NO: 4454 - DNA, 738 bp, B.fragilis
aaactgtcttcgctcatgaatgcaatgctactattagcccaagtggctaccaatctggctgactccgttgcatcggccaatcctgtattgactcctgtatctgcaccggcagaaatgaatatgcttgatatggctatcaagggtggatggattatgattgtactggccgtactgtctgttgtctgtttctacattctgttcgaacgtaactatatgattcggaaagccggtaaagaagatccgatgtttatggagaagattaaagattatatccatagtggggagataaaatcggccattaattactgtcgtacgataaatactccttcagcccgcatgattgagaaaggtatcagccgtttgggacgtccggtaaatgatgtgcaggttgctattgaaaatgtgggaaatatagaggtggccaagttagagaaaggactgacggtaatggctaccatttccggtggtgcaccgatgcttggcttcctgggtacggtaaccggtatggtgcgggcattttacgaaatggcgaatgccggaagcggtaacatagacataacattgctttcaggaggtatttatgaagccatgattactactgtgggtggtttgattgtgggtattattgctatgtttgcttacaactacctggtgatgttggtagaccgagtagtcaataagatggaatccagaactatggagtttatggatttgcttaatgaacctgcacaaaaataa

SEQ ID NO: 4455 - DNA, 558 bp, B.fragilis
aatccgtttttgattatgttagaagaaattcttgaattcaacaaaaagttcgttgagaacaggggatacgaaaagtatatcactaacaagtatcctgataagaaaatcgccatcctttcctgtatggatacccgcctgacagaactgttgcccgccgctttggggattcacaacggagacgtaaagattataaagaatgccggtgccgtcatttcccatcctttcggcagtgtcatccgtagtctgctggtggctatcatcgagttgggagtagaagaagtgatggtcattgcccattctgattgcggtgcttgccacatgaacagcgacgaaatgatagctcacatgaaaaagcggggaatcaagtccgaaacaatcgacatgatacgctactgcggggtcgattttaattcgtggctgggcggattcgacgatccggtgaagtccgtcaggggcacggttcgttccatagagaaccatccgcttattccgaaagatgtccgggtgcatggttttatcatcgattcactgaccggcgagttgacgagagtggaataa

SEQ ID NO: 4456 - DNA, 207 bp, B.fragilis
ggtaaatcatcggattgttttccgttttctttcttactgtgtgccatctatttatgcaaacgttttcattggaaaattctccgggatggagctcaaccgataaggagcacttttcgatgcaatcaggtgaacgtgacgtccggaaaaggagatgccgtcatagcttcggctacgcagcaccgtaacttcggctacgcagcaccgtaa

SEQ ID NO: 4457 - DNA, 225 bp, B.fragilis
  unsure (91): Identity of nucleotide sequences at the above locations are unknown.
tcatccgcatccggtcgcgcagcggttggttatgagttcaacgcagaagccgaaccagtccgttttcttccgctacccgtagcaggaaaangccatgcgttcgcgttccggacggatcacaataaatcaataaaattcatacgccgcgtgcctgttatgctcgctattatcaaatccggttcggtctatggaggagattccacaccagacaggtcgctccggtag

SEQ ID NO: 4458 - DNA, 1095 bp, B.fragilis
tggataccaccttcattcccggcacactcaaaccacaataaatacaacaaagtaaagatgaaaaacacattcctgttaacattcgcactgatactcctggcaggcagccccctgaaagcgcaggagaaagaagaggctgctacactgaataaagtggtcaacacactgaaagagcgaatcactctggccggatacgcgcagttgggatatacctatgacgatgcagcaaaaaaaatgaatacgttcgacatcaaacgaatcattttcatggctcacggaaagatcacggaccgctggacctgtgattttatgtacgacttttacaacggcggcatgctgctcgaagtttacaccgattaccggattctacccgggctgaaagtgcgtatcggcgaatttaaggttccttataccatcgaaaatgaattgtcgcccactaccgtagaactgatcaactgctattctcagtcagtctgctatctggcaggggtgagcggcagtgatgtcgcctgtggcatgacatcgggacgcgacatcggggccatggttcatggaggcctgctgaatgatctgctatgctacaaactagccataatgaatggacaaggacttaacatcaaggataaaaacaatcaaaaagatatcatcggcaacctgatggtgaatcccctgaaatggctgtcggtgggtggttcgtttatcaaagggaccggacacgccattgccgactccgaaataaccggcatccgggcaggagaaaactataccaaaaatcgctggagcataggaggcgtcatcacgacaacaccgttcagcctccgttccgaatatctggccggaaaggatggaggcgtgaagagtgatggtttttatgccaccggatgctaccggatgctacgcaatttcgaccttgtggcttcgtatgactatttcaatgcaaacaaagccgtcagtaggaaacagaccaattatatagccggactgcaatattggttctatcccaagtgcaggctgcaagcacaatacactttctgcgaccggaataaaggcaaagacagcaatctgtttcaggcgcaggtacaggtaagattctga

SEQ ID NO: 4459 - DNA, 1425 bp, B.fragilis
caagcccaaccctctttcatcaatcacaccatctctgcatacaacagtgtatttaccttcgggtatcgccagtttggcaggaacagaacgggcattaagtgccacgataatgttgtcccaagtatctccgttagcgcggtctttcaagcggaaagccaccagattaccaacatctaccgggaggaattccaggtgcttacgtaccatctcggcatctcccatacggaaagcgggatgggctttacgaatactgatcaaacgcttataataggcgaacacatcttcgtgagttgtctttcggttccaatcaatggcattaatagaatcgggactctcaaaactattatgcacccctttcttgtcacgcatcacctcttctccggcatagatgaacggaataccttgcgaagtcagcactgccgtctgcgccagtttgtcaagtcgtacgagttgttcgggtgtgatgccggggatactcgacttcaagcgatctaccaagcacatatcatcgtggcaggatacgtaactgatcatctgagtaggctgggaagcccagggagctttactgtaattcaccgaatcattgttgacttgagggtgactgacagctcctacaataccaaacttaatgctctcttcttccccggggatcccggcaaggaacgctcccttatgattatcattaaaaggaccacgcaacgcatcacgcatttcatcggaaaaggcggcaatacccggcattttacaagtattgaccttcattgccagcgaatcacccggatactgaggtgcttccgctgcccaaccttcaccataaataatgatagaaggatctacagcactgaccgccttacggatttcattcatcgtctcgatgtcgtgaatgcccatcaggtcgaagcggaaaccatcgatatggtattccttgatccagtgaagcacggattcaatcatatatttacgcatcataggccggttgcttgccgtctcgttaccacaagccgaaccattagccaacgaaccatccggcttctggcgataaaaatatccaggtaccgtacgttcgaagttactgccatcggtgttgtatgtatgattgtataccacatcgagcactacccgtataccggctttgtgcagtgcctgtaccatctgcttaaactcgcggatgcggacagccggatcgtaaggatcggtagcatacgaaccatcgggtacattgtaattctgcggatcatatccccagttgtatttattttcatccagcttggtttcgtctaccgaagcataatcataagacggaagcaaatggacgtgtgttactcccagctcgatcagatgatcaattccggtcagcaatttggcagagttcatcgtaccatgttctgtcaatgccaaaaattttcccttatgctgaatccctga

SEQ ID NO: 4460 - DNA, 1386 bp, B.fragilis
acgatgcagttcctctcttttagtttcctggccctgtttaccctctgtttcttcctctactatgcagtcaaaggccgtgcccgcaacctcatactactggtaaccagttgtattttcatcggatggtactatctgcctttcctgttgacggcagtagtggtagcactgttcaccttcttttgggcacaatggatggaaagcagggcaaaagccggaaaaaagaccaaacccgtctatatcgcaggaatcatcgccctgatcggcggatggctccttcttcatggcacggtcatagatgatatcatctttccacttgggatgtcattttacacatttcaagccatcagttatctgacagacgtgtactggcaagagcaacgcagcgaaagaaactgggtggatttcctgatctatatgcttttcttcatgaagtttctctccggccctatcgaacggggtggagacctgttgccacaattgaaagatccccgcccgttcatctactcaaacgcggtgaccggactgaaatatattttactcggactgatcaagaaactgctgatagccaatcagatctccccacaaacagatgtcatgtttcattcgattcatgacctctcgggtgtacaactgctaatgacttgcctactctaccctatcgaactgtatgccgatttttcgggttatacggatattgctatcggaggggcctatatgttcggcatcaagttgtctcctaacttcaaccgcccgtttgcagcacgctcgactgccgacttctggcgccgttggcacatgtcactctccttctgggtacgcgattatctctatgtaccgctaaccgccggtacccgtaactggggacagtggggaatctacttcagcctcctcatcacctttctcgcattgggtttgtggcatggggccggattgactttcgccatatacggcctgattcagggtgtccttatctgctgggaaatgaaaacagctgctttccgctataatctgccccaatatataggaaaatatgcggccgacagcttgctgattgtccggacttatctattgttcgcactctcgcttatattctttcgtgtacaatcgctgagcgatgcctggtatttcttacggaacatctcgttcgaggtacattcttcctggaaagaaatgaacatcggcatacgcgatcataattgcatcgtagcaggttcggccctattactagtattgatctacgaatattatgcatctaagtacaacctgatggaaacacttgaacgccaacccgcatggttacggtggagtgtctactatctgttggtattcgctctgctgatgttaggcaaatttgacacggaaactttcatctatttacaattttaa

SEQ ID NO: 4461 - DNA, 207 bp, B.fragilis
ctgaccactactacaaaaaataaagaaaggaataataatggagtatcaacggatatggcttttagttttgttctgtctttcctcttgggatatgcacgcacaacatttcgtaatcgaagggaaaaccaatggatatgttcccgacggctctattctctacctcggacgctggaacggaatgggagcaatgatttatttcacatctga

SEQ ID NO: 4462 - DNA, 1149 bp, B.fragilis
cttgtgtcaacaagttcggtctggcaaacggtgtatcttatgtttctacaggcggtggagcactgctcgaagcaatcgaaggaaaagttcttccgggtattgccgctatccaggaataagactgaagtgaatcactataagacagaaaaggcaaccccgctcggagttgccttttttaaaagccggaaatggggagagagcctccttttcagtatcctgttccttttctttctatcagcctgcacaggaaagaaagagaagcattccgctttgccggaactgcaaactctgactttcggactgatgccttctttcgatggactgccttctctggttgctgtccgtcagggtatttatgactcgctggatatcaaaatcgatttcattacttatgcttcggcaactgaccgcgatgccgcttttttatcggggaaactggatggtatgctcaccgactacccgggtgcaactctgttgcaggcaaaaggaagccgcttacgtctggttatggaaaccgatggcagcctcagtatgatagcaagtaaaaaaagcaatgttaggaatccggacgatttgaaagggaagaatatttctgtctccgccaatacctttgtagaatatgccacagacgaagtaatgaaacgggcctgcctgcaccccggagaagtgaacaaacctgaaataaacaatatccccttgaggctgatgatgttggaggacggacagatctccgcatctttcttacccggaccggcatcggcaattgccctgaacgatgggcatacagcattactgaacacaagacaaatgggactgcgttgcaccggaattgttttctcagaaaaagccatcacggaaaaagacgaagagatcaggcggtttatcaccggctacaatctcggcgtgaaatacttgcaaacccgtcctcaaaacgaatggacggaaattttagtaaaagaattcggactgcaggaaaaggcggccatgcagatagacttgccggactatcggcctgctacccgtccgtcttaccacgacatagaaaaaatcattgcctggctgaagagtaaaggggcaatccccgactattatccgggagaaaatttagtggataccaccttcattcccggcacactcaaaccacaataa

SEQ ID NO: 4463 - DNA, 1368 bp, B.fragilis
tttctgcaaaccttaaattgtatcgatatggccgattggaagtcagtaaaaagtatatctgataaatatggaatcagtgtagagagagtgatagcgtgggtacgtgaaagccaaatcaccacttccgttgtgggcagcgtggtgctgattgatgacgggagcgtgtgcgaattggtagagaaagaaaaacggttggcgcacctgaaaaccaattacgagcaactttgcgcgaagtttgagcagcgcatcgaggcggaactgcgtgcagacgaagatgccggactcaagatgcgtcttctggatgatttcctccccgttctgcaccgactactctgcgtgatgattgacaagctgaacaccgaagatcgaaaactgttcaacagtgccttcacagccgcccctctgtatcggatagctcgggaaatgggatttgagtctgtaaaagactacctcatagcgtacaggaaggtgaccaggaggctgcccgaaagctcggacgaacttatcaagcgtctccaaaccgaccttgaacgaagccgcgactcttttaaggaaatggagcatacgctgctgagagcaaggcagaaccatgaagacgctaatcggatgtgcagtgacctgcgcgacaaggagatatattacattgaacggtgcgaacggctgaaagagaaaaaccgggagaacgagaagcgcgtagagagactcaaaaaacgacttctcaaatgggaaaagtgcccaaacgtgggggaggccggaaacaccggagaggatgaaagcctgcaggaactgtcggacgaggtggggaatttgcatatccgtgaaatggaactgcgggctcagcgccgggaactgattacgagggtcgcccgtctggagagggaaatgtataaatacaatagcacggaaaatagcttcaaaagcagactgggcgaaaagggcgcttggaggaaaatcgagagcgaatttgaaaggtgtgcccgaacatattttggtagagacgtggaggtggtgtcgcggaaggaagcgcaggaaatacggcagctccagataaaagcgctggtagacgaaaactatgctcaaagcggggcgtggaaagagatgatggcggcgacggaggcgaagttcgcgatgtccggggagacaatgccggatgccgggaagctggaaaacgaagaggtcgaaaccggaactgagccggcggccaaagacgaagtggagatgataatagaaggtatagcgagcttagacgaaatgggggcatcgctggacagatataagaaagaaaccagcgagatgatcgaaaaatataaggcgaacgaggaaaaaacggagggcttctggaatagactccgttccatgttttgttaa

SEQ ID NO: 4464 - DNA, 1623 bp, B.fragilis
aacatgaaaacaataaaatttaaatatcttcttccctgtgcattgctgggaatgatgttaggagtagcgtcttgtgtgaacgacctcaatacggttccactggacaaagacgaattggtttccgacgttgttttcgggaacgagcccttggcttatgagcagagtcttgctaagatttatgcaggtatggccatcggtggtaacagcgggggtgattccgatcaggatgtggtaggcatcgatggcggtagccaggcttcctttctccgtgtattgtggaatatgcaggatttgccttcggacattgcacactgtgcatggaatgaccccggtatccctgagttcaaccatatctcctggggtgcatccagtccgtggatcaagggttcatactaccgcctgttctatcaaatcaatgtagccaacgcttatctgcgtgagactaccgaagataaactggatgcccgcggttgtgacgcatcactgaaagcctcgatcaagacatggcgtgccgaagcccgttttctgcgtgcattgagctatgaatatgcgctcgacttgtatcgcaatgtaccgtttgtagacgaaaacagcccgatcggaagtattccgccgaagcagatcatggctgccgatctgttcaactggatcgagaaagaactgactgaatgcgtagaggatatgttggagcccacagtgggatacagccaggactacgggcatgccaacaaagctgctgcgtgggcactcttgtcacgcctgtaccttaatgcggagacttacgttggccagaacaaatataccgaatgtatcacgtatgctaagaaagtgatcgaaacgggttatcagttggaacctgtttatgtagatatgttcaaggcagataaccacttgtccaacgaaatgattttcccggtacgctatgagggcgaccagacgatgacctggggtggtatgaccgccttcctttgctggggggctacggcgactcaggaagaagtcaatgccaaaggagcatggcagggtgtaagggcaaaatcgtcactctacaatctgttcctcaaagagagtggtagtgatgcggatacccgtaaggcaatgcttcgtaccgatttgacaaccagtcttgaaattattgacgaaaatacattccagaatatcggtattccagttaccaaatacttcaatgtaaataaggatggaacgctgcctccttcaaaggaagcttacgtagacttcccacttttccgtctgggtgaaatctacctgacgtatgccgaagctgtgcttagaggcggtcagggtggcgacagagctactgctctccgttatgtgaacgatctgcgtaagagagcgtacagtgataagacgctggctcctatctctgattccgatttgacattgaacttcatcattgacgagcggggccgtgaattcttctttgaaggacaacgccgtacagacctggtacgtttcggactgtttactactgccggttacgtatggccttggaagggtggtacagccaaaggtaaggctgttgagaacttctacaacgtgttcccgattccgtcagacgatatcggttctaacaccaatctcaagcagaatgaaggatactaa

SEQ ID NO: 4465 - DNA, 402 bp, B.fragilis
cgtttgcgaacgtttatctgttttggtgctgcaaatataatgtattattctgaaataattgctatgtttgcggaaataatcaacttaaagataaaaaatatgctgatatacaataccacttttcaggtggacgacgaagttcatgataattttttgatctggatcaaagagagttatattcctgaagtagagaaacacggcgctctccgtgctccgcgcatctgtcgtgtgttgagtcatcgtgacgaaggtacttcctattcgctccaatgggaggtggacgattctggtgtgctgcatcgctggcatcaggatcagggtgcgcggctcaaccaagagctggtgaagatatttaaggataaagtagtcggatttcccacattgatggaggtattggagtga

SEQ ID NO: 4466 - DNA, 453 bp, B.fragilis
aagaatacgacgatgacaaacaacgaatcggagcgcgagcttgtcctacaaaccttacgaacctggatggcattccgccaggccgttcagcgggtactcaaacgtcacaacgtggatatgaccttcgagatgctgcaagtaatgaactgcctgtggaacaaacaaggcatcagccagcaatccctggctgagaaaacagcaaaggacaaggcttgcctgaccaatctgattaataatctggaaaagaaaaactgggtgatacggaaagaaggcccctccgaccgccgaaaccgcctgattttcctgacgccccaaggcgaagaacttgccctcaccgtgaaacccctgatcaacgatatctatgcccaaaccggagcagagatggaggcaagccggataacggaatgcatcgaagacctgaagagactgcatgaagtgctcaatgagatctaa

SEQ ID NO: 4467 - DNA, 1080 bp, B.fragilis
aagaaatccgccatgtccacccgtcagataaagctaaaacaattgagaagactgaagttcaggaacatctttctcaacacagtatgcatcctgctggcattggcaggtatttcatggacagtaaactacttctggaaatacgcccgctacgagataaccaatgatgccgtagtggatcaatacatcgctccgctaaacatccggataccgggctatatcaaagaagtacgttttaccgaacaccagtatgttcatgccggcgacacgttactgatactggacgaccgggaataccggatccggctgaaagacgcggaagcggccttgatggatgccttgggatcaaaggaagtgttaaactccggcatccggacttcaggagtaaatgtagccgtgcaggaagccaacatagccgaaacactggcacacctttcacagcaagaagcggaactgaaccgatatacccggctcctgaaaaagcaggccgtcagccaacaggattatgaactggccaaagcgaacttcgaagcgacccgggcaagatacaacgccctgttgcgacaaaaagaagcggcccaatcgcagtattccgaaaccagcaaacgcagtacaggcgccgaagccaatatcctccggaaggaggccgacctggagatggcccgactaaacctgtcgtataccgttgtcaccgcaccctatgacggatacacgggacgacgtacacttgaaccgggacagttcgtacaaggcggacaaactctttcctacctggtacggggcaatgacaagtgggtgacagccaattataaagagactcaaatagcccatatctatatcgggcaaaaagtccgcatcaaagtagatgctttcagcggacgcacttttcacgggaccgtaaccgccatttccgaagccaccggatcgaaatactccctggtaccgaccgacaattcggcagggaacttcgtcaaagtgcagcaacgcattccggtccgcatcgatctcaatgacgcctcacccgaagagatggaatgtctccgtgcagggatgatggtagaaacggaagcggtccgcccttag

SEQ ID NO: 4468 - DNA, 1296 bp, B.fragilis; identical to SEQ ID NO: 845

SEQ ID NO: 4469 - DNA, 195 bp, B.fragilis
tcctatcttttaacattcacacgaggtccgtacggctcaatgaaggtatccccgacgttttctccaacgctgaaaacatttcatcagcgcctcctagctgacttcggtgatgcgataacgacggacaggaccggcatgcagtttatgataggaacaactacagtaacccgttatgataaaaaagagattcactaa

SEQ ID NO: 4470 - DNA, 201 bp, B.fragilis
ggttttccctataaaagtatatattgcttctggaaagctgttttttactttgatgcttctgtaggtgagggatttgggagaataatttccatgatctctttctccatgccggagtggtgcatggcatatcctttccagtatttttctattcgcccattgggtgctatcaatataaaacaagggatggattttattccgtag

SEQ ID NO: 4471 - DNA, 573 bp, B.fragilis
ctggcggtatattcaaataatgcaaagtatagatacatggaaaatttcagtgaactaataaaaaatcgccgcagcatgcggaaatttaccggagaagaactttctcaggaagatgtagtcgctttgctgaaagcggccctgatggctcctacttcaaagcgcagtaacagctggcagtttattgcagtcgatgataaaaagttgctcagtgaactttcacattgcaaagagcaggcttcggcctttattgccgacgcggcattggccattgtcgttactgccgatcccttggcgagcgatgtatggattgaggacgcttccattgcctctattatgattcagcttcaggccgaagacttgggattgggaagttgctgggtgcaggtgcgtgagcgatatactgccaccgggataccttccgatgaatttgtgcacggtgtgctcgacattcctttgcagttgcaggtgttgtccgtcatagcgatcgggcataaagggatggaacgtaaaccctttaatgaagaccatttgcaatgggaaaaaatccatattaataagttcggaggtaagtaa

SEQ ID NO: 4472 - DNA, 2865 bp, B.fragilis
tctatgaaatatttaacttttccgtttctgttcctcctgcttccgctgattggtttcggttgctcgtcggaagagaaagaaaccgattctctgattctttcttctgatagtgagattttttttgagcaaggcattgattttgccgctacttcgggaacccggaatctatcgttctcgtcaggacgtccatggcggatctcgctgaccaccgatacggatacacgcagagcggcagactggtgtacggtgtctccattttcgggaacagcgggcgatgcttctgtgactatcagtatacaggaaaatgctgattatgacagccgtagcgtcaagctgaccctggtggcgggaggaattgaaaaaagttttaccgtttcacaaaagcagaaagatgcactgacactgacagcttcccgtttcgaagtgggcaaggaaggaggaactgtgcaggtggaagtaaaagccaatataacatttgaggtcgaaattccggaagtggatcgtagttggatttcgcaggccaatacccgcggactggtggttaccaacttggcttttacggtggctcccaatgagggagtggccgggcgtgaaggagagattgtcatcaggagcggcagcctttcggaaaaaatccggatcacgcaggagggaagatgtgacgacggactgagtttccgacctgagactccggatgctgacaggcaattgacgctatattttaaagcgacgaaaacttccccgctctatggttatgcgggtgatgtgtatgtacatacgggagtggtgtcagaagggacctggatgtatgtgcctgcggagtggaatactaatgtggataaatgtaaaatggtccgggtggcagataatatctggagtattacgctggcaccttcgatccgtcaatggtttggttcgaacgaaacaccggttcggcaattgggtgtcgtgattcgcagtgccgacgggagcaagaaaggaatggacggagactcgtttgtctctgttaccgatcatctgtataaaccctttgaacccgcggctgtcagatatgcttctatgcctggcggtctgcaggaaggaatcaatctgatagacgcatccacagtcacgttggtgctgtatgataaagacaagaaagggggacataaggattttgcccatgtcgtgggtgatttcaatgactggaagttgagtaatgaaagcaacagccaaatgaaccgagatgatgctgcgggctgctggtggattacactgaccggacttcagcctacccgtgaatatgcttttcagtattatgtcggtacaagggccggggagattcttcgtctggctgatgcttatagccgtaagatactcgatccggataacgataaatacattccctcttctacctaccccgatgcgaaggagtatcccaagggtgctgtcggcattgcctctgtattcaaaatacaaagggattcttatgaatggaaggttaaaaacttccggatactcgataaaaataatctgatgatctatgaactgctgttgcgtgatttcactgccacaggcgatctgaacggtgctatggagaagataggctatctgaaaagtttaggtttcaatgccgttgagttgatgccggtgcaggagttcgatggcaatgacagctggggatacaatccttgtttctattttgctttggacaaggcttacggtaccgatcatatgtataaggcttttatcgataaatgccacgaagcgggtatggctgttctttttgatgttgtctacaaccatgccagtggttcgcatccttttgcccgtttgtattgggataccaaaaataaccgtacggcagccgataacccttggtttaatgtgaaagaacctcatccctacggtgtctttcatgatttcaatcatgactcgcctttggtacgtgcatttgtgaaacggaacctgaagttcctgctggaggaatatcgcatcgatggctttcgtttcgacatgacaaagggctttacacaaaacagcagtacggaggccactgccggaagttatgacgcttcgcgtattgccatcctgaaagattataacgagacagttcgtgaggtgaatccggaggcagtcgtcatcctggagcatttctgtgacgaaaaagaggagagcgaattggccgaagaaggcatgcaactttggcgtaacctgaataatgcttattgccagtcggcaatggggtatccgtcaaacagtgattttacaccattggttactttcggaacaacaatgccctacggagggtgggttggctttatggaaagccatgacgaagagcggacagcctttaagcagattgcttatggcgagggacctttaaaatcggatataaatgtccgtatgaaacagcttgctgcgaatgcctcattctttttcacggcacccggtcctaagatggtatggcagtttggtgaaatgggatacgatgtgtcgattgaagaagggggacggacaggtaggaaacctctgcactgggaatatctggacaatgaagctcggaaagggttgtgcaatacatatgcaaaactgttgaagttgaggcgggaacattctgaactctttaatccggggagcacgttctcctggttggtgaagacagccaactggaccggaggacgtttcctgactcttgcagcaaccaacggcaagaggttggtcgtagttggtaattttaccgctaagccgatagaggcaatcacttcttttccggtaacgggagtctggacaaactatctggatggtacgaaacttcatgtgacctcgataccgaccggtctgacgatacctgcccacgaatgtcgcgtctatatcaatttctga

SEQ ID NO: 4473 - DNA, 1209 bp, B.fragilis
ccactactacaaaaaataaagaaaggaataataatggagtatcaacggatatggcttttagttttgttctgtctttcctcttgggatatgcacgcacaacatttcgtaatcgaagggaaaaccaatggatatgttcccgacggctctattctctacctcggacgctggaacggaatgggagcaatgatttatttcacatctgacatgatccgtaacggcacctttcgtttggaaggcaaaagagaaaagactccggatattatctatttgtacggaacagaaaaggctatcggtacacttaacctacgtttgtgggtcggcgatgacaccataagagtatccgccaattcagaagtaccggaaacctggattgtggagaacaacatgccgcaacaagcagaagaagacttctatagacaactgaaaggcaaggacaatataataaagacaagtcggatgaacagcaggcaattatgggataggtcactcactccggacagtgtccgaatactaacgaatcaaatcatacagaatgacctaccagggcagatccgcatactcagccatctgcataaacagcctaaactgactgatacagggttggtgtactttttcttatcgagtggttatgcccattggatgaccaatccgaaacatctctgtatggggagagaaatttatggccaattaacaggaaagcaaaagcaaacctattatggtaagtttgccaaatcttatttttatcccgacaaaacacccgaaaaaggagactattatatagatgccaacctatttgatctgaaaggagattcttgcaaactgacagattatttaaataaagggaaatatattctgctggatttctgggatctatattgtgcaccttgcaagaagtcagtgcccggcttaaaggaactgttctcttcctgtgcggacaaactgacgattatcagtatcaatgtcggcagtcgcgaaagccaggtaaagggaagctctgattttctatgggaaaacctcagcgacgggcaaggcctgacggggattgcatcccgctacggaataaaatccatcccttgttttatattgatagcacccaatgggcgaatagaaaaatactggaaaggatatgccatgcaccactccggcatggagaaagagatcatggaaattattctcccaaatccctcacctacagaagcatcaaagtaa

SEQ ID NO: 4474 - DNA, 1014 bp, B.fragilis
tccataaaacatactatgtctgacgcatacaaaatcatacacaactttatggccttcatagccagtccggaccttaaaaataaagtgtggacatggcttcttgatccttccggcaaacaacggaaagaagaagcgcttcttcagatatgggacgaatatcgtcctgaagcagatgccggtacccggcattctttacgtaagtttcaaaaaagagcagggctttcttctgcccggccggcctatctacatcggtgggcgcatatagcagctattcttcttatcccgttaatatctattataacagcctatatatatgtggaacatcacacgcaggaagtccgttttgtagaatgtatcgttcccaagggagagcaaaaacagatcacgttaccggatggttcgatcatcaccctgaattcgggatccgtatttctatatcctacgcaatttgccggcgatacccgctctgtatatctttccggagaagggcactttgcggtagcccctaataagaaacttccttttgtggtggcaactaaccatctggacatttgtgtactgggtactcagtttaatttgcaggcatatccttttgatagaaggacaattactacattggagtccggttctgttgctgtaagaaagaaaaaccagccgaacagttttattaccttagaacccaatcagcagcttgattacgaaaatcggagtggtagattcaacaaaacagatatagatgcttctgtttattcgggttggacaaagggagagatgaactttatttcccagtcactcagggaaatcctgagaacactggaaagaagctatgcagtatctattcagttatcgtctgatctgatggagtcgaatcggatcaattcggacctttatacaataaagtttaagcgtcgtgatgatattttccatgttttggatattgtaacaaaaacagtaggaggtatcacctataaagtggagaaggacgaatccatatctatttgtccattaaagtaa

SEQ ID NO: 4475 - DNA, 1194 bp, B.fragilis
ccaatggaacacaaaatcagcgaacccaatgcccgtgtagacgtggccgatgtattgagaggactggctgtgatgggcatcatcatcctacacagtatcgaacatttcaacttctattcctttccggacactgttccctgcgaatggatgaaattcaccgacaaagttatctggaacggactcttttttgtcttcagcaacaaagcatacgccatatttgccctactgttcggctttagtttctatatacaagacaacaatcagcaacgccgcggcaaagactttcgtctccggttcatctggcgaatggcgctgctctttatcatcgggcagttcaatgcagctttctttaccggtgagatactgacgatgtacgccatgctcggtctgatacttcccctgtcctgtcgtctcagcgatcggagcatagctatcttcgccactctgctcatcatacaaccgatagactggtgcaaagtgatctatgccctttgcaatccggattatgtagccggtcccggtctggcttcccattacttcggaattgccttcgatgtacagaaaaacggcaccttcctcgaaacaatccgtatgaatctctgggaaggacaactcgccaacctgacctgggcactggaacatggacgtatcttgcagacccctgccctcttcctcttcggcatgcttgtgggacgtaagggattatttctttatagcgaacaaaacgaacagcactggctcaaagcattgggcatctcgttaatctgtttctttcctctgtatggactgaataatatgttgccggagtttatcacccgcaacgccatacgggtccctctgcaattgatcatcagctctctcagcaaccttagtttcatggtactgctggtcagcggactgcttatcactttttatcgcatcaaagaccgcagatttctgatgcgcttcacctcgtacggaaagatgagcctgacaaactatatcggacaatccgtcattgggtccctccttttctatcactggggcttcgaactaggacgtttcctgggaattacttatagtttcttttttggcatcctttttgtacttcttcaaatggcattttgttcctggtggctcagccacttcaaacacggcccctttgaaggtttatggaaacgccttacatggattggaaacaataaacggaagtaa

SEQ ID NO: 4476 - DNA, 1266 bp, B.fragilis
agtattatgcagacaattgacaatttcaattttgccggtaaaaaggcattcgttcgcgtggacttcaatgtacccttggacgaaaacttcaacattacagacgacactcgtatccgtgctgcacttcctaccctgaagaagattctggcagacggtggtagcatcatcatcggttctcacctgggccgtccgaaaggcgttgctgacaaattctctctgaaacacattgttaagcatgtatcagagttactgggcgttgaagttcagtttgccaacgactgtatgggcgaagaagctgctgtaaaagccgctgctctgcaaccgggcgaagtgctgttgcttgaaaaccttcgcttctacgctgaagaagaaggcaaaccaagaggattggctgaagacgcaaccgacgaagaaaaagccgcagccaagaaagccgtaaaagagagccagaaagaatttaccaagaaattggcttcgtatgcagactgctacgtaaacgacgcattcggtacagctcaccgtgctcatgcttctacagcactgatcgctaaatacttcgacaccaacaataagatgtttggctacctgatggaaaaagaagtgaaagccgttgataagatattgaacgacatcaagcgtccgtttactgccatcatgggtggatcaaaagtatcttctaagatcgaaatcatcgaaaacctgctgaacaaggtagacaacctgatcatcacaggcggtatgacttacactttcaccaaagcaatgggtggacagatcggtctgtctatctgcgaagatgacaaactggatctggctcgcgaactgatgcagaaagccaaagacaaaggtgtaaatctggtattagctgttgacgctaagattgctgacgctttctctaacgatgccaatactaaattctgcccggttaacgaaattcctgacggatgggaaggtcttgacatcggtccgaaatctgaagagatctttgccgaagtgatcaagaattctaagacaattctttggaatggtccgacaggtgtattcgaattcgaaaacttcactcacggctctcgttcagtaggcgaagctatcgttgaggctactaagaacggcgctttctcactcgttggcggtggcgactctgtagcttgtgtcaacaagttcggtctggcaaacggtgtatcttatgtttctacaggcggtggagcactgctcgaagcaatcgaaggaaaagttcttccgggtattgccgctatccaggaataa

SEQ ID NO: 4477 - DNA, 252 bp, B.fragilis; identical to SEQ ID NO: 860

SEQ ID NO: 4478 - DNA, 690 bp, B.fragilis
gaacaaactaagatgacaaagaaagaacgttatgaaaaagtaatcgcctggtttcaggaaaatgtgcccgtggccgaaacggaactgcattacaacaacccgtacgaactgctgatcgccgttatcctctccgcacagtgtacagacaagcgggtgaacatgatcacccctagaatttatcaggatttccccacaccggaagcactggctgctaccacaccggaggtgatattcgagtacatacgcagcgtatcttaccccaataacaagtcgaaacatctggtgggcatggcacgcatgctggtgaacgacttcaacagcgaagtacccgatactcttgaagaactgatcaagttgcccggtgtagggcgcaaaacggccaatgtcattcagtccgtcgtgttcaacaaagctgccatggcggtagacactcacgtcttccgcgtgagtcaccgcatcggactggtaagtaattcctgcaccaccccgttcagtgtagaaaaagaactgatgaagaacatccccgacgagctgattcccatcgctcaccactggctgatcctgcacggacgttacgtctgtcaggcccgcactcccaaatgtgaaacctgtggtttacaattgatgtgtaaatattactgtgagaagtataaagttagcaaagacacaccgaagaggaagaataaataa

SEQ ID NO: 4479 - DNA, 210 bp, B.fragilis
gtgatgaataaggataatcttttgctttacactgcggtgattttcctgtttattaagcgggataaatccgtcggcttggtattgctcggattgtggttggtgctgaacatcggcctgattgtttcgttgcttggttcgatgtccggttatctgctgcctttggctttattgataatcggaggtatattgtatttgatttcaacacgatga

SEQ ID NO: 4480 - DNA, 2169 bp, B.fragilis
ttaactcacaaaattatgaaattaaaaatcaaattaaggaatattctatccgtaaaaattcataaaatagttcttttacttctcgctttatgcatttataacactgcgtacgggcaaaatcagcggataagtgtgtatggcaacaatcagtctttgcaaaaagtattcgaacaaattgaggagcagactcaattgagtattacatacaatcagaccagactggatgtaaataggaagattaaaggaaactttgtagacaaggaactgtcttttgtaatggatgctcttttgaagaataccggttttacttgccgttatgaggctgagcatatagtcattactcctgttgagcagaagaaagagaaagctgctgccgggcaagctactcagatgaaaaagataacgggtaaagtgacgggtgttaccggcgaacctcttataggagcgaatgtgcttgccgtaggcggtaagcaggccacgattaccaatcttgagggagaattttcattggaggtctctgacaacagtaagttgcaggttacctatatcggttatttgcctcaggaggtcagtaccaatggaaaaactcatttcgtcattcagttgaaagaagattcacaattgatggatgaagtagtggttgtcggcttcggaacacaaaagaaggtcaatttgacgggagcagttacagcggttaatatacaggaaacattgggagatcgtccgataacaaatgttacggcagctttgcaaggggtggttccgggattaaaaatagagggaacgaccggtactccaggtgacaatctatcatacaatattcgaggaaccacttctatcaacggtggtggtccgctggtgttggtcaataatgtaccgatggatatcaatatgattgatccgcaggatatcgagtcggtttcggtcttgaaagatgccgcttctgcagctatctacggagcacgtgctgcgtttggagtaatcttgattaccaccaagcaaggtaaaaaggacatggctcctaaattcaattataataataatttctcgttttcgaaagcattggagctgccgcaaaaagccggtccgttggagtccatcttggcatataaagagatgggatggcccaatgacacgtatgtagacggtaagaatattcctcaatgggagacgtatatacgtgattatatggctaatccttcccaatatcccaatggatatgtattcgatgaagatgggaacctgtttctgatgagagagaacgatatgtttgccgatatgatggataattatggctttatgcaaaatcatagtttttcagtttcgggaggaagttcaagaacgaattatcgtatcggtttgggatacaccaatgaagacggaatccttattactgataaagacaggtatgagcgtgccaatctctcaagtttcctgagtgtggaggtcaacaaatggctgaccactcaattggatatacggtatgccaattctacccagaacaaagtggagcaaggcggtagaaacggaatttggggaagtgccatgcaacttccttcttatcagaatatatcgccttatgaagaggatggtattatttatccggctgaaacttccgctacttacatccgttatggggaaccacgcattgttaaaaagacggatctccgagctttgggacgtatcatcatttcgcctctgaaaaacttgaagataacaggtgaatatacgtacaaccgggtgacgaactacaaccgcatgtatgtgaaccagtataaatacatcggaatgaactttaccggtgtcctgaataacacggaaaatacacggtatgcgctgacacagggatttactaactataatgcaatcaatatatttgctaattacgacttttcaataggtaatcatcatataagtgttatgggtggattcaaccaggaagagaatcatgcggaatcacagtggacggaaaggaaagatgtattgttgagtaacctgccgtccatatcgggagctaccgggaccacaacggcaacggatacctttaacgaatatgccctcagaggactcttttaccgtgtgaattattcgtacaaggatcgctacatgcttgaagctaacggacgatatgacggaagtcttcaccacgaggctggaagggatccgggc

SEQ ID NO: 4481 - DNA, 1032 bp, B.fragilis
ttcactaacaataaacttttaaacaaaatggttaattacaaagatttaggtctggtaaacactagagatatgtttgctaaggctatcaagggtggatatgcaatccctgcattcaacttcaacaatatggaacagatgcaggctatcatcaaggctgctgtagaaactaagtctccggttattttgcaggtatcaaaaggtgctcgtcagtatgctaacgctacattgttgcgttacatggctcagggtgctgtagaatatgcaaaagaactcggctgcaaaaatcctgaaatcgttttgcacctcgaccacggagatactttcgaaacttgcaaaagctgtatcgactcaggcttctcttctgtaatgatcgacggttctcaccttccttacgacgaaaacgttgctctgactaagaaagttgttgaatacgctcaccagttcgatgtaactgtagaaggtgaacttggcgtattggcaggtgtagaagacgaagtttcttctgaccaccacacatatactgaaccggacgaagtagttgatttcgttaccaagacaggttgcgattcattggctatctctatcggtacttctcacggtgcttacaaatttactccggaacagtgccacatcgatccgaagacaggccgtatggttcctcctccgttggcattcgacgtattggacggtgtaatgaaagaacttccgggattccctatcgttcttcacggatcatcttcagttcctgaagaagaggttgcaactatcaaccagtttggtggtgcactgaaagctgctatcggtattcctgaagaggagctgcgtaaagccgctaagtctgctgtttgcaaaatcaacatcgactcagactctcgcctggctatgactgctgctatccgtaaggtattcgcagaaaaaccggctgagttcgacccgcgtaaatatctgggaccggctcgcgacaatatggaaaaactctacaagcacaaaattatcaacgtgctgggttctgacaacaagttagctgaataa

SEQ ID NO: 4482 - DNA, 2034 bp, B.fragilis
gtagataacaatatatataatatagagaaaaacatgaaaatgaactatcttgcctttatcggagtgacagcggctacagctgtagtgagttgtactcccgccaagaaagaatatgcgtcttacgaattatatccggtacgttcgggtagcctcacggagatggaatattcaccggagtctaccaagtttaccctttgggcgcctactgccgatgaagtccgtctgatgttgttcgactcgggtgaaggtgggcatgcttacgaaaccattcctatggaaccgggtgaagaaggcacttggatggcaacggtcagcaaggatctgatggggaagttctacacattcaatgtcaaggtaaacgataaatggatgggtgatacacccggtatcaatgccaaagcggtaggggtgaacggaaaacgtgcggccattatcaacttgaagtccaccgatccacaaggttgggagacagatcagcgaccgccgttgaaatcaccggctgatgcgatcatttatgaaatgcaccatcgtgatttttcagtagattctacatcagggattcagcataagggaaaatttttggcattgacagaacatggtacgatgaactctgccaaattgctgaccggaattgatcatctgatcgagctgggagtaacacacgtccatttgcttccgtcttatgattatgcttcggtagacgaaaccaagctggatgaaaataaatacaactggggatatgatccgcagaattacaatgtacccgatggttcgtatgctaccgatccttacgatccggctgtccgcatccgcgagtttaagcagatggtacaggcactgcacaaagccggtatacgggtagtgctcgatgtggtatacaatcatacatacaacaccgatggcagtaacttcgaacgtacggtacctggatatttttatcgccagaagccggatggttcgttggctaatggttcggcttgtggtaacgagacggcaagcaaccggcctatgatgcgtaaatatatgattgaatccgtgcttcactggatcaaggaataccatatcgatggtttccgcttcgacctgatgggcattcacgacatcgagacgatgaatgaaatccgtaaggcggtcagtgctgtagatccttctatcattatttatggtgaaggttgggcagcggaagcacctcagtatccgggtgattcgctggcaatgaaggtcaatacttgtaaaatgccgggtattgccgccttttccgatgaaatgcgtgatgcgttgcgtggtccttttaatgataatcataagggagcgttccttgccgggatccccggggaagaagagagcattaagtttggtattgtaggagctgtcagtcaccctcaagtcaacaatgattcggtgaattacagtaaagctccctgggcttcccagcctactcagatgatcagttacgtatcctgccacgatgatatgtgcttggtagatcgcttgaagtcgagtatccccggcatcacacccgaacaactcgtacgacttgacaaactggcgcagacggcagtgctgacttcgcaaggtattccgttcatctatgccggagaagaggtgatgcgtgacaagaaaggggtgcataatagttttgagagtcccgattctattaatgccattgattggaaccgaaagacaactcacgaagatgtgttcgcctattataagcgtttgatcagtattcgtaaagcccatcccgctttccgtatgggagatgccgagatggtacgtaagcacctggaattcctcccggtagatgttggtaatctggtggctttccgcttgaaagaccgcgctaacggagatacttgggacaacattatcgtggcacttaatgcccgttctgttcctgccaaactggcgatacccgaaggtaaatacactgttgtatgcagagatggtgtgattgatgaaagagggttgggcttgttatacggacctgaggtgacggttccggcacagtctgcactgatcattcatcagtag

SEQ ID NO: 4483 - DNA, 1359 bp, B.fragilis
cttgcggacaataaaacaatacgtcctatgagaacaagaacaatgaaaccactcttccttattttctgtctttgcctcagtcccctactgatgggccagaatcaaaacaaaattcaggaagcaatggcaaactatgactacgagactgccgttgaactgataaacaaggaacctcccaccatcccactgttaatgcagaaagcaaaagccctgaaaggaatcggcagcaatgcggaagctctacgttccatccgccaagtgatagcggaagactccaccaaccaacaggcacacatcgaagcagcggaatgctgtaaagcaatggccaagtacaacgatgcgctggactactaccggaaagccatcagcctgaatcccaaaaacaagtatgcccgtttgcaattcatcaacctgctttgcaacaccaaaaactatgctgaggcttttggagaaagttcaatgatgtccgaaacggacagttcggccgtagtgctccacctacaggctcaaagccttgaagggatgcaacagatactaccggctatcggttgctatgaagtcattcaggataaatatccggacgattatctggctgcggccaaactcggaaacctgaacattgtggctggatatcccgaatatgccatccaagctaccgaacgctatagggaacgggactccaccaacctgattgtcaaccagcaaaacgctctcgcctactgccacgccgaacaatatccgacagccatcaagcgctatgaaaagctgtgccaacagggggacagcagtacacagaccttatactacctgggagtcagctattacgcagatgaatattattacgaagcgcacgcgtgtttcagcaaactgcaaaaagagatggaagaaaatcccaatctgctctattatctgggacgttgctgcgccaagacttcctggaaaaaagaaggcatcgaacacctggagaaagctatcgaactaaccattcccaaagacagcaccatgatccgactttacaaaggcttggtggattgttgtaaactggctcaggatactccaaagcaaatccaggctctcagagaactgtacaaatatgacaagacgaaccataaacttctttatgacatcgcctggaactattcatatcaactcaaagacaacaaatcggccgaacgttatctgcaggctttcttaaaaacccgaaaggcgaatgccaggaaagaagaaccggtgagtgagaaaggagaacttgtactcggacttgaaaattattacaacgctgccgaaaattggctgaaagacttacagaaagaaaagttcttcaaagaaggaataccgttagaaagtcagaaacaatag

SEQ ID NO: 4484 - DNA, 396 bp, B.fragilis
attatgaaaaagattttattattgctatccgtctgtatttcattttcatcatgctgtacattattcagcagttccaaacaagatatcacctttacgggaatgaatggaaccaaaatctacgaagcatcgaccaaacagaaaatagcggaaatcaaagaagacaatagtgtcactgtacaaatcaaaaagaaaagggaagacaaacaactagtagccaaaaaggaagggtaccaaacgactccctttgtcctggaatctacatttaacaatgcctgcctgtggaacattctattttggccgggctttctggtagatttgggtacgcaaaagatgaacaaatgggataacacaattatcaatatcgaaatggagaaagaaaatacagaaaacaaatga

SEQ ID NO: 4485 - DNA, 504 bp, B.fragilis
ttgcagaaaaatttctttattaaacaagaattgattttctttgtgctgttttataccattccgaaaagacgattaataccaaaatttaaaaatatagttatgaagatttcacacattgaacatttgggcattgccgtaaaaagtatcgaagaagcccttccgtattatgaaaacgttttaggtttgaaatgctacaacatcgaaactgtagaagatcaaaaagtaagaacagccttcctgaaagtaggtgataccaaaatcgaattactggaacccacatgtccggaaagtaccatcgcgaaattcattgaaaacaaaggtgcaggtgttcatcacgtagcattcgccattgaagacggcgtagccaatgccctggccgaagccgaaagcaaagagatccgcctgatcgacaaagctccgcgcaaaggtgccgaaggcctgaacattgctttccttcacccgaaatcaactctgggcgtactgacagaactctgcgaacactaa

SEQ ID NO: 4486 - DNA, 1278 bp, B.fragilis
aaagtcagaaacaatagaatctatcccctcatgaaacattggatactcctcctctatctgggcttcagcgtaatgctgcgagcccagaacaccgcctccgttcaagaagcaatggcaaactatgactataaaacggtgatcagactgattgatgaagaaagtgcatcaccacagttactcatacagaaagccaaagctttaaaaggtttagggcgtaccgccgaagccctgtccactttgcaacatatcattatcgagctgcccgaaaatcagcaggcattggtagaggcagcagaatgttgcaggcaattgagcaaatttaacgaggccttggggtattatcggaaggtgatggaactcaatcccgaacatatttacgcacacttgcaatacacccgcttgttatacaactatcagcgatacggcgatgcattgcgtgagagtatcgcattggccaggaaagacagttccgccaccgtattgcgactgatggcggaaagcatggaaggagccggcatgccggtagaaagtatgttttgctatctttccatcatcaggaaatatccctccgactatctctcggtagctaaactgggcagtatcttcaatacaatgaaagattacgaaggggcaattgccctgacagaggcataccgccggacggacagcaccaatgtagaagtgaaccgtcaaaacgcactggcgtattgtctgcgcaaagaatatcccaccgccatcaaacgttatcaggatctgaccgcccggggagacagcacactgctgacatgttattacctgggagtcagctactacgctacgaaagaatactataaagcgcgcgattggctactcaaagcaaaatcatgccagtcacccggcgccaacctactctactatttgggacgttcgtgctccaagacattatggaaacaagagggaataggatatctgaaccaggctatcgccctgactatccccgccgacagtatcatggagcgcttatactcaggcttggcagactgctacaggcaaaccaagcaaacccgggaccaaatcaaggctaccaaagaacaatacaaatatgcccctgacaagcatattttactttataacttggcgttcttatcggacaaaattgaagatactaaagccacagagcattacttgcaggcttttctgcgaacaaaatccaaacaaaatgcagtactacagcagccggatgatgacgaagaagaacccgcaccctacatagattactacaaaagtgccaccaattaa

SEQ ID NO: 4487 - DNA, 1332 bp, B.fragilis
aggagttcgaagcggcctattaaattttactgccgcagacatgaacacagagtctcacagggttttcttaaaattaaaaagaggctctttgtgagactttgtgttactctgcggtccaatcaaaaccaccatactatgtccaaagataggcttgtcacccccagctatgttctgatactggcagcaaacttccttttatactttgccttctatctgattctgcctgtattgcctttctatctgactgaaattttccaaaccggaaatgcagccgtaggggtcattttatcctgctacaccgtagcttcactctgtatccgccccttctcgggctatctgctggacacgctggcacgcaagccactctacctgatcgcctacttcctgttcatcaccgtctttgccggatacatccttgccggggtgctgtcactgttcatcatgctccgggtggtgcatggactggctttcggaatggtgaccgtagcgggtaataccatcgtaatcgacatcactccttcttcccgccgcggagaagcggtaggctactacggactgatgaacaacacggccatgagcttcggaccgatgatcggactttttatgcacgacacctgttcgttcgagaccatcttcctgtgttcactcctctccggtacagtggggtttgcggctgcctgcctggtaaagacacctgttaaggaaccggtaaaacgtgaaccgatttcactggaccggttcgtattaattaaaggtatacctgcgggagtggcattgctcctactctccattccctacggcatgacgagtacttatatagccatgtatgccaaggagatcgggatcacactcagctccgggctgttcttcacctttatggcagtgggcatggctgtctcacgcatgttttccggacgtcaggtggacaaaggacgtatcacacaagtcatcaccctgggactctatctggtgtgtgcctgctttttcacactggcagcctgcggcaaattgatgtcgctgagtcccgaactgacagatgtgcttttctttatggtggctctgttgctgggagtcggattcggcaccatgtttccggccttcaataccctgtttgtcaatctggcccctaatagccaacgcggcacggccacttccacctacctgacttcatgggatgtaggcatcggcatcggcctgatactgggcggatatatcgcccaactgacttcgttcgacatggcttacttcttcggagcttgcctgacggtggtttccaccttttatttcaacctgaaagtcgcaccccattatcataagaacaaactaagatga

SEQ ID NO: 4488 - DNA, 1050 bp, B.fragilis
cgaaaatcgaataacaataaatcgcaagatatgatagctaagattaatcaacttcttgaagaggtgggggccttgaaagccgccaatgccgaagaactcgaagttctgcgcatcaaatacctcagcaagaaaggagccatcaatgacttgatggcagatttccgcaatgtggctgccgaacagaaaaaagaagtcggcatgaagctcaacgagctgaaaacaaaagcacaagaaaaaatcaacgcactgaaagaacagttcgacaaccaggacaacggacaggacgatctcgacctgacccgttcggcttatcccgtggagctgggcacacgccatccgctttccattgtgcgcaacgaaatcattgacatctttgcccgtctgggattcaacattgccgaaggtccggaaatagaagatgactggcatgtgttctccgcactcaactttgccgaagaccatccggcacgagacatgcaagacacattcttcatcgaatcccatcccgacgtactactgcgcacacacacctcatcggtacagagccgtgtgatggaggtttcgcaaccacctatccgtatcatctgtccgggacgcgtttaccgtaacgaagctatcagctatcgtgcacactgtttcttccaccaggtagaagcgctgtacgtagaccgcaatgtatctttcaccgacctgaaacaagtgttgctactcttcgccaaagagatgttcggtgccgatacgaagattcgcctgcgtccgtcgtacttcccgttcacagaacccagcgccgaaatggatatcagctgtaacatctgcggcggaaaaggctgccccttctgcaaacacaccggctgggtcgaaatcttgggttgcggaatggtagacccgaacgtacttgatgccaacggaatagacagcaaagtgtatagcggatatgctctgggtatgggtatcgaacgcatcacaaacctgaaatatcaggtgaaagacctccgcatgttctccgaaaacgatacacgtttcctgaaggagttcgaagcggcctattaa

SEQ ID NO: 4489 - DNA, 294 bp, B.fragilis
tttttgtgtgatcaatcatcggggaacaacaataataaaaccatcgtcgtgcttccggaaaaaattgttagttgggcagtcaccaacccgccaggattgtggggattcttggaaattctcctacatggagcatgttccgggtccaaagttttgatagtgatgctaaatgaaaggcctcggtggcctccattgacgcccccttcggatactaattttagcaagcagatgctgacgatggaaggcacattggtgtcccagggttttgagttcagcctccatgcccatctgttttga

SEQ ID NO: 4490 - DNA, 183 bp, B.fragilis
cactatcgccttcgttttttgtcctgtttcgtatatagtgttgtataccggtatactctgtggcaaatcctggaaaaaacaaaatggggaagtcctcacggatttccccactttaatgatgaaatatttactatttttattaattgggtgtggagagtatcggactcgaaccgatcaccttaa

SEQ ID NO: 4491 - DNA, 2202 bp, B.fragilis
attatgaacgaacaacttatcaatgaacaatatcaatatattctccgactgatcgggcaaaaacgcctgaaggaagcattaactcaattggaatcattcctatggaagtgccccgaatggtcgctccgtacccgtctggaacaaatacagacttcgtacagctacatgttgcaatacatgcgccagggcatagaagacccggaacgtagaaagctgtatcagaaactgctgaccgacacactcgagattaccgaccaggcgcgtattacgttgctggacagcgtatcgaaccattactatcaccagtaccgtacccgcctttccgaagaggtatcccccctcactctggagatgctgatgcatacgctcgaatcgttcaatgacgatcttgccgtaagcggattcgtctcagaccaaaacatggaggaagtgctgaaacgccatgaagacagtttgaagactttgtttttgcaaacctggacccatactaactggactgcggaagaagtggcggccgcacaagccatgcttcagtccgaactgcttccagtgaacgatctttgcctcttcacaagcgccgttaccctcagtgtgatggagtgtttcgacctcaagaaactcttgtggctgatagatgcttaccgtcatcccaatgtacaggtcagccaacgagccctggtaggaattacttttatcctgcatgcctattcgccacgcatctctttctatccggagatcaatctgcgcatcacagcgctgatggaagaaactgcatttgaaagagacttgttacgcatacatatccagatactgctcagccaggagacggaaaaaatcgacaagaaaatgcgtgaggagatcatccccgaaatgctgaaaagcatgtcgcctatgcgcaacatgaaattcggcttcgaagagtccgacgaagagaaagatgacaccaatcctgactgggcagatgccatcgagaagtcggggctaggtgacaagttgcgtgaaatgaacgaattgcaactagaaggagccgacgtatatatgagcactttctcacaactcaagagttatccattcttcagagatatctccaactggttctatcctttcgacaagcagcaatcggatgtgatcaaagagttccgtcatcggggaaaagagggaggaagcctattggaaatcatcctgcaatcgggtttcttctgcaacagcgataagtactcacttttcttcacgatgcagcaattgccacaatcgcagcgggacatgatgctgaatcagcttacggatcagcagatagaagaattagcagaccagtcgaaagccgaaacgctaaagaagttctccgaacgtcccgatacggtaagcaaccaatatctgcacgatctgtaccgcttctttaaactctatgcccggagactggaatttcgtgacttattcaaagagtccatctgcctctacaacgaaccggatttgatagatattctattcaatccggaagccatggaagccatagctaattttcacttcaagaagaagcactgggaagaagccgccgaagcctacgatacgatagttgatatgcttatggatgaagaagaagcagaaatctgccagaagcagggctactccttgcagaaactaaaacgatatgacgaagccatcaaggcctaccggaaagcagatatcctgaaatcgaacaatgtatggaccaaccatcatctgggcacttgctatcgcctcaacaggcaattcaaagaggccttgaaatattatcggaaagtggaagaagtgttgccggaagatacgaaagtgattttttacataggtagttgtctggcggaaatgtggaattttgaagaagcgttgaactacttctttaaacttgattttctggagagtaactgcgtcaaagcctggcgtgccatcggttggtgttcgttcatgatcgctaaacgcgaacaggccatgaagtattatgataaagtgattgatcaaagcccaatgccggtagattacctgaacgccggtcatgtagcatggtctttgggaaacgtggaaaaaaccctctctctatataccaaagccgcagaactatatggcagcaaagagctgttccttgaagtgttccgtaaagacgaggagattatcacaagcaaaggagtcaccccggatgacattcccttggttctcgatctgatttaa

SEQ ID NO: 4492 - DNA, 1527 bp, B.fragilis
aaactaatggatatgacaacatcttcccagaaggatattatcaatgatattctttccgccatgcaatgttatcccgaaaacgaagcattcattattgacgataaacattatacttatgcccaactcggtgaaataacagcttctatcacccattcgctatcagaaataaaagatgaaaaaatcggaatcgtagcggaaaaccggattgaaacctatgctgctattctggcagtactggccggtggaaagacctatgttatcctgcatcctgcctacccggaagagcgtaatctcaaaatagccgctctggccggactgcgtactttgctctgtacaagtgacactgaccggtcagcattcggcaccggacacttcagaatcatcgatacggaccggctaccgggaaaaacactgtcagaacagcagtctcattcatcggacgaagaagggaatgcttatatcatttttacatcgggaagcacaggcgagcccaaaggagtgcccatcacacgggctaacttgaacgccttttaccgggcatacagttcgctcgactggaatctggatgaacatgatcgcatgttgcaaatgttcgaacttacattcgatgtatccgtcgtatccttactgtatcctcttactttaggtgctgccgtttatacggtaggccatcaggatgtaaagcacttcaaggtgtttgaacttctggagaagtatcaactgacctttgccactgtcactccctcactgctacaactcctttcaccctacttcgacgaaatcaatctgccctctctgaaatatctgggagtatcggcagaagcatcgcaaatcgagctgttggagcgattcagaaaatcggcacccaacgcaacgttcatcaacctatacggaccgaccgaagctacgatttactgcacctgttaccgtattccggcttcggacaaatgcaagcattacaacggaatggtggctatcggaaaaccatttcccggcatccgcgccatcattgccgacgaagaaggaaacgagctacctcaaggagagacgggagaactttgggtatccggccggcaggtaatgaaaggttatctggacgacccggaaaaatcggcattggttctgatacaccgtcccgacggacaaatctattaccggaccggagacttgtgtattctggatggcgacggggatattatttattgcggacgtaaagactatcaggtgaaaatacagggtttcaggatagaactgagtgaaatagaatatactgcccagtcgtttttcaagactccctgcagcgtggctgccgttccgttgctctgcgacggaatctgtaacgaattgcacctagccgtcgagacaactgaatgtactcaaagcgcattgatagaatatctgaaagaaaaactgcccaaatacatgctgccgaagcagattcattgtatttcccaatttccggtgaccaatagtaataaaacagaccgtaaaaagattgccgaactgataaaagagaagaaactctaa

SEQ ID NO: 4493 - DNA, 522 bp, B.fragilis
acaataaaggatatgaaaacaattacatttttcaaaagagtattagcttctgctgcattagtttcagtatgcggattcgcatgtgcaaccaacaatggaaaacagtttatccataacgatacgatggaaggaggaaagttggtttgccgtgaaatatatgcaatgaacgatgccgcctcaggcatactgaatccggtaaagatgtataaatacagctacgataccgatcaacagaaaacagtgaaatccacctatgcatggaacatattcaagaacacttgggaaacagaatcgaggaccgtaatctcccggtacgagaccgaaacatcggtggagtattctgtatggaataaagaaaaaggatcattcgatctatcaaaaaaatatatatacataactgacaataacaatcaactgattgcccaatatgcatacaaaatgaactcccgcaccaatcaatggatattagagaaagacgccttgacacccatttacgagaacatctacgcaacaacccgttaa

SEQ ID NO: 4494 - DNA, 219 bp, B.fragilis
actggtggctgtcaggaacatggcgagtaccatgaagccatatccgatgatggatttatgcagaaagagtggtttcaggctgacaaagggtttgccttgtgtacgctgccgatggatgaagagagctatcaggagcgggatgacgaatacatatactctgatcttcggggatgcgaaccaatcgagtgttttcccgtaggtaaatgtatagagcgttag

SEQ ID NO: 4495 - DNA, 183 bp, B.fragilis
ccttttttgcttttcctgctactttacgaggataggaggggagattcgggagggtttctgttgtttgctgtaaatgaactaaaaatattagttgcaaacctaattttgatagttaataaactaaaatggatcgtttttggggagcagtttcctttgcggagtggctttagggcaaaaaaataa

SEQ ID NO: 4496 - DNA, 858 bp, B.fragilis
ttatggcttcggaagacggataacccgttgcgcgactgcttgctgccatccgcaaaagcatccgcatattttctcccgcttttatcaaacgctgcgaaatctattgcaccggccgaatatttgataacggaagccgacaaggaaaggatattcggcgaaatgctggagcacctcaccacggaggctttgcggaactcgtttctaatagaattccgcaatctggagaacgccatgttcggctacaaatatttccggtccaacagatacttccctgtcaactggctgcgggtacgaaactcgcttcacggcatcgaaaacgccgaacagcgtttcagcccctcccgtatccgccagatcaaaaaaggcctgaaaaacggagcaaaagtagacgaggcacgtacggtagaagagatacgcgaattttcgaatatgctgaggcatctctattcgtcccgcatccgtaaacattttcccaacatcatctttttccaacacatggacacccggctgattcacagccggcaggcaaagattttcatcgtccgctacaaagacaaaattatcggaggctctgcctgtatctattcgggaaacgatgcctatctctggttttcgggaggtatgcgaaagacctatgccttgcaatacccgggtatactggctgtatggaaagccctccaggatgcccatcaaaacggattccgtcacatggagttcatggacgccggactcccatttaagaagcacggctatcgggacttcgtgctccgcttcggtggcaagcaaagcagcacccggcgatggttccgtttccgctggcaatggctgaacgacctgctgatcaaaatatacgtctga

SEQ ID NO: 4497 - DNA, 741 bp, B.fragilis
acacaggaccggacctggaatgtcggcgataacatctcttataataagaataagatcaccaagatgactttcaacgacgacccgaactatgccggtgtcatccatggcggcatcgatggcggtacaggatacaatgccctgatccatcgggtaggtgaggcgttcaattccttctatgtgttcgagcagatttatggtcctgacggtaaacctatcgaaggtgcttatgtagatcagaatggagataaccagattaacgacgccgacttgatctgcttcaaaaaagctgctcccgatgtgttcatgggactgacctcacaactttcttataagaactgggatttttcatttgctttgcgcggcagcttcggtaactatgtttacaataatgtgcagtccaaccgtgaggcatacgaaggcgccaatatgtatgaccagaccggattcctgaaaaatcgtctgacctctgcccgcagcactgatttcaagaacgctcaataccgttccagctattacgttcagaatgcttcgttcgtgcgcatggacaacatctctttgggatatacgttcaataaactcttcaatgataagcagagtgcacgcgtatatgctacggtacagaatccgtttgtcattactaagtacaagggactggatccggaaatcagtggtgaaggaatcgataacaacatctatcctcgtccccgtgtattcatgatcggccttaatctcaacttttaa

SEQ ID NO: 4498 - DNA, 294 bp, B.fragilis
aaagattgccgaactgataaaagagaagaaactctaaaaacaataataaatatgaatcgagaagaagtattaaaacaactacaaagcattttccgtaatatcttaaaaaaggacaacgtatgtatcgacgaatcatctacctcaaaagatgtagatggctgggactcgctaacccacatgcaaattatagctcaaatcgagaaacatttcggagtacgtttcaatttcagggaggtcattaagttcaagaatgtcggcgatttgtgcagtgccttattaaccaaaatggaataa

SEQ ID NO: 4499 - DNA, 1623 bp, B.fragilis
aaacggaagcggtccgcccttaggcttatggtgaagctcaatctgcctacccgtccctgggtgcctcaatggttgggcatcgtgaccatgtttattgtcatctttcccatcaccctgctcaacggtgcctacacaggaagtatggtcgaagtatcgaacacgctgggagtattgagcgaagatattaccatggcttactattcagcttcggtagggatggctgttgcctatcccatcgtaccgaaaatacgcaccatagccactccgaaaaccttactgcttaccgacctgctgctacaaatattcttcagcctggtatgcgccaaaaccggtagtatggatgtcatcatggtatgcagtttctgtatgggatttctcaaagccttcgtcatgttggagttcatcatcctgatccgcccgctcttcagtccgaaaaacgtacgaagtgaattctatgcctacttctaccccatcgttttctccggaggtcagctatcgatggctatcaccgctcaactggcctatcactaccaatggcagcacatgtactattttgtcaccatcctcttgctgatcgccattctgttcgtcatctgtttcttccgctatgcaaggcgtcccatgcacattccgttcaaagagatggacggaagaagcatgttcatcatcgccaccgctttcctgctaacgctctatacatttacctacgggaaaacactcgattggttcgcatccccgaagatcagagtatatgtattcgtcatcccgctcctgatagctctcttcatccatcggcagcgtacacaaggcaaaccctttgtcagcctgaaaccactctttctgcataaatccatcatcggatatggcttcatggtactcgccatgttcctgacagccaccagttcactggtaaccaactatatgaacagcatcatccgggtagacagcatacacgccaattcgctgagcctgtggctattgcccggatatgtggtaggggccgtcatttgcttctggtggttccgatggcaacgatggcggtttcgcttcctcatttcaggaggtatgttctgctacgtcatctatctggctatcctctactttggtatcaccccttatggaacttatgaaatgctctacctccccatcctgttccggggagtggggatgatggtcatattcattgcgttcggtgtgtttgttgtcgaagatttagacccgcgcctgacgttgtccaatgccttcttcctgatttcattccgctcagtattagctccggtcctgtccgcttcgttctttaacaacatgctttactatctgcaggcaaaggggatgaacattctttcggaaaacatgacgctgaccaatccgctggccgaacaaaaatacaatcaggcattgagcaatgccctggcgcaagggcacgaattcagcgaggccggacaattggcagccaacagtctgtactccactttgcagcagcaatccctgctgcttgccctgaaaaccctaatcggctatgtactgatactggcactggtgattgctgtcatcgcagcgttcattcctttccataaaacgctgaaggtggctgttgtgaagacgggtgacgatatggtataa

SEQ ID NO: 4500 - DNA, 933 bp, B.fragilis
atccgtcggcttggtattgctcggattgtggttggtgctgaacatcggcctgattgtttcgttgcttggttcgatgtccggttatctgctgcctttggctttattgataatcggaggtatattgtatttgatttcaacacgatgaaaagaagtatagaagatacgccgatcgtatttatcggtgccggaaatcttgccactaatctggcaaaagccttatatcggaaaggttttcgtatcgtacaggtgtatagccgtacggaagagtcggcccgcgagctggcacagaaagtggaagccgaatatacgacagacctcgcagaggtgaacccgtatgcgaagctgtatattgtttcactgaaagattccgcctttgccgaacttcttcagggcattgtcgaaggtaagcgggaagaggcattgatggtgcatacggcaggtagcatcccgatgaatgtctgggaaggacatgtctcgcattacggtgtgttctatcccatgcagactttcagcaagcagagggaggtagattttaaggagattcctttcttcatagaggcttcttcgacagaagatgccgcgtttctgaaagccattgcctctacactgtccaaccgtgtgtacgatgccgactcggagcagcgtaaaagtctccacttggctgccgtgtttacatgtaatttcaccaatcacatgtatgcccttgctgccgagttgcttaagaaatacaatctgccgtttgacgtgatgttgccgttgattgatgaaaccgcccgtaaggtgcacgaactggaacctaagacggcccagaccgggccggccatccgttatgacgagaatgtgatcggcaatcacttgcggatgcttgccgatgatcctgccatgcagcggttatacgagttgcttagccgaagcattcacgaaagacaataa

SEQ ID NO: 4501 - DNA, 528 bp, B.fragilis
ataaaaatgagcacaatcaattacgaccttacccggataaaagcacttgtttttgatgtagacggagtgctgagcgccaatgtcatccctttgcatccgtcgggtgaaccgatgcgtacggtaaatgtaaaagacggttatgccatccaattggccgtaaaaaaagggcttcgtatcgctattattacaggtgggcggagcgatgtcgtgcggaaacgttttatcgggttgggggtatccgatctgtacttcggctctgcggtgaagatacacgattatcgtggtttccgtgacaaacacggacttacggacgaggagatactctacatgggcgatgacgttcccgatatggaagtgatgcgtgagtgcggattgccttgttgtcccaaagatgcggttcccgaggtgaaagcgattgcccgttacatttcgtatgccgatggaggatacggctgtggacgcgatgtggtggagcaggtgcttaaagcacaaggccaatggttgtccgatgatgctttcggatggtga

SEQ ID NO: 4502 - DNA, 192 bp, B.fragilis
caggaaagcggtggcgatgatgaacatgcttcttccgtccatctctttgaacggaatgtgcatgggacgccttgcatagcggaagaaacagatgacgaacagaatggcgatcagcaagaggatggtgacaaaatagtacatgtgctgccattggtagtgataggccagttgagcggtgatagccatcgatag

SEQ ID NO: 4503 - DNA, 1875 bp, B.fragilis
ttttctatgggaaaacctcagcgacgggcaaggcctgacggggattgcatcccgctacggaataaaatccatcccttgttttatattgatagcacccaatgggcgaatagaaaaatactggaaaggatatgccatgcaccactccggcatggagaaagagatcatggaaattattctcccaaatccctcacctacagaagcatcaaagtaaaaaacagctttccagaagcaatatatacttttatagggaaaaccctatggcacaataggagaaaaaacagcgctgtaggaaacttctttcgtatcttcgtaacatctaatcataaattcactaaaaaagatacgactatgaaacgactgactatcctatttatgctctttctgacctcgtgcatcctctatgccaaagaccggaaaggaaatgacctcagcggtcccattgcactgaaaggcgaactgaccgaaaagtaccaaaactacacgaaaggtactcctgtcgtcatccggggagtacgaaaaatgcgcatttcacccgatgaaacggcaggcatcacctatgccgtggaaatagacgggctgcaatatcctgtcggggcagaagaagccggtaagatcatccggctgaaaccggcgacagtccttgaatactggcaaggcgtttatttgtcacaaggaatgtatgattactacaatcggaaaggttatcgttacaagatgcgacaggaactggacgaggagtgcctggactatctggataaactcaacgaaatagcctacaaagacgcctacattcaagactatgtacaggccatttttgccaaagtcaatcccggcgaaatagatacgaaccgtccggaacgactgaatgtacgcatcattcagtcacccgaaccggatgcctatatgctacccaacggggccatgctggtaagcaccggacttctctgtaccatcgattcggaagaagaactggaagctattatcgccaacgaaatggttcatttcatcctcgatcatcaggtggataatgtgtcacgtgccgaaacccgcgccaaacgggccgctttctgggcggatgtattggggacagtagccatggcagccgacgataccaactggatgtatggatatgacgaacgggtgggtgccatcgagttggcagccagcatcggaaccattgccgctctgatcaacgtgcgtacagtgaatcgcctgggtatggattacagcagcaaacaggagctgcaagccgaccggattgcccgcgattaccttgccttcaaagggatgaaccccaatgctctctcttctgccatcaataaaataaaagagttttatggctcagtccatcgctacgacaacctgacacgctacggcagctacggtctgttgaaggagcgccttgccaaactgggagaaaccgaaggcatacacagccatatgtttgagaaaatgacctcggacatcgtgactttcaatgctgccatgtatcagggagacaaacgctataaaatggcggaacaactggctcagaagaacatagacaatcgggtggcctccgatcatgactacgtgattctggtcaaagcacgtatggcccaggagaataccccggagagcaacgaagcttgtatgaaactattggaaaaggcccgggaaattgccaccgcacgcaatctggatatcaacaaacaggagattctgttgctgatgcgcatgaacaaacaggcaaaagccgccgacaagctgaaagagtatctggacctgctggccgaatataaacagcaaaacgacatgaacacccaggaatccgaatggatcggagaagaactggactgggctagcaaaatgctttcaaaaatcagtctgctatag

SEQ ID NO: 4504 - DNA, 186 bp, B.fragilis
tgcactttcttcatcaatcagtctgatcaccgttttatagtcatagtttgccattgcttcttgaacggaggcggtgttctgggctcgcagcattacgctgaagcccagatagaggaggagtatccaatgtttcatgaggggatagattctattgtttctgactttctaacggtattccttctttga

SEQ ID NO: 4505 - DNA, 1863 bp, B.fragilis
  unsure (1100),(1146): Identity of nucleotide sequences at the above locations are unknown.
cgagctaatatcatgaaaaaattattgttactcttaggttcattcctactgtcattaaccacttatgcagccatgaacatatccaaaatcgatccgcccttctggttcaccggtatgaacaatccggaactccagttaatggtatacggtgaaggcatcggccaggcatccgtatcagtaaattatcccggtgtatcgctcagcagcgtcgtgaaactggaaagcaacaattacctgcttgtctacctacatctcgataaagaagtaaagccgggcaagatgcccatcacatttacggtcggaaagaagaaattggtgaaagagtacgaattgaaagcacgcagcaaagccggagtcgatcacaaaggttttgacgcatcggatgcattatatctgctgatgccggaccgtttcgccaatggcaatccggataacgaccggatagaaggcatggccgaatataaagtggaccgcaacgacccgaacgcacgtcacggaggcgacctggccggtatcgaacaaaatctggactattttaccgacttgggagtgaccgcactctggttcaccccggtactcgaaaataatatgaaaggcggctcatatcacggatatgcaacaaccgattattacaaggtagacccacgtttcggcactaacgaggaatatcgctcactgatagcgaaagcccacaaccggggcattaaggtcgtgatggacatgatcttcaatcattgcggagtagaacatccctggatcaaggacatgccttcaaaggactggttcaaccatgcggacttcaagaacaactttgtgcaaacttcctacaaactgactccacatgtagatccgtatgcctcggagtacgatttcgaccagatgaacaacggctggttcgtggaagccatgcctgacctcaaccaaaagaaccctcacgtatacaaatacctcttgcagaacagcctgtggtggattgagtacgccgatatcgacggcatccggatggacacctacccgtatgccgattacgatgccatgagcaactggatgaaagaactgaacgaagatacccccactacaacacggtgggcgaaacctgngttaccgaaaccgcctatacagcctggtggcagaaaagaacttcanaactttcgcccgggcaacaagtacttgaaaacaagcatgaatttcaacttctccgacaaagtcaacaccgccaagaatgaacaaaccgacacctggttcaaaggatggaaccgtgtctacaacaattttgtatacgattatctgtatcccaatccggcttccgtactggctttcatcgagaatcatgacaccgaccgtttcttgggtgaaggcgaaaacctcgatatgctgaaacaggcctccacccttttattgaccacccgacgcatcccgcaactctattatggaacggaggtgatgatgaacggagtaaagagtaaaagcgacggctatgtacgaaaggacttcccgggcggatggacggacgataaagagaatgccctgactcccgagggacgtacccgattgcagaatgaaagctataacttctaccgcaacctgctgaactggcgtaagggcaacgatgtgatcgccaaaggcagcatgaaacagttcatggtgcagcacggcgtatatgcttatgcacgccaatataaagggaaaacggtattcgtcctgttgaacggtacggataaagaggtgaaacttcccctgaaatactatgccgaagtgctgaaagacaagactcaaggaaaagacgtcattagcggaaaagtaacggcactcaatgaagaactgacaatggcaccccgccaatcgatggttatagagctttaa

SEQ ID NO: 4506 - DNA, 267 bp, B.fragilis
aaaacgaatattaaaatgaaaaaaggtcttcatcctgaatcataccgtccggtagtattcaaagatatgtcaaacggtgatatgtttttgtctaaatcaactgtagctacaaaagagaccatcgaattcgaaggtgaaacttatccgttactgaaaatcgaaatctctaacacttctcacccgttctatacaggtaaatctacattggtagatacagccggacgtgttgacaagttcatgagccgctacggtaaccgtaagaaataa

SEQ ID NO: 4507 - DNA, 573 bp, B.fragilis
attatctgtataatgaaattcataaggaagtttccggtgaccgatgcggatagtctggaaagtccccaaaagtttgagggcttctttcttgattattatccccgggtcaaaggattcattaatggcttgttacaggatgctgaagaggcggaagatctttcgcaggatatatttatgtcattgtggcagaaccggggaaatctgaagcagatagacaacttggatgcatacctgttccgtatagcccggaatgcggttttccggtacatcgagcgctctttgttatttaaaaattatcaatccaggcagttatcggatgataactccgatctgtatgaaatagaatcggaactgaacgcgaaagaattagaactgattatagccatcgctgttgaaagaatgccctctcaaagaagaaagatttatcagatgagccgcgaacaggggcttagtaatgaaaatatagctcgtgaactgaacattagcaagcgtactgttgagaatcatctgacccaggctttggctgatatacgtaagatattgttttgggtcatcatggctactttcgtataa

SEQ ID NO: 4508 - DNA, 852 bp, B.fragilis
aatcttagtattatgaaaagatttcttgtcttatcatgcagtgttgccatatcggcacttttcttccatgcttgttcgtcttctgatgattcaatgatcgatgcgcctctgacaagggcggatgcagtttcggagaagatcgttttccaagatgatttcaaccaggcagatagtattcctgatagaaataaatggagtttgtgtaagaagggaagcccggcctggagcaaatatttatccgaaagctatgatcaggcttatgtacacgatggaaaattagtgttggttgccgaaaaagtgaacggagtatataagacaggaggagtgcaatcattgggtaaagcggaatttcaatatggtaagatagagatatgcgcccgtttcaccaagacggcaaagggcggatggcctgccatctggatgatgcctgccaaacccgtttacagtggatggcctgcttgcggtgaaatagatattatggaacagttgaatcatgatggcattgtatatcagacaattcacagtcattataaaaatgatctgggattcactaagcctgttccgacaaaaacagtgtcttacaataaagggcaattcaatatatttggtatcgagtggactcccgaagctcttacttttaaggtgaatggagctgctactttagtttatcctaacttgcacttggctgatgagagtgtcaaaaagcagtggccgttcgacacctctttttatttgattttaaattatgccttgggtggtcccggaacttggcccggtactataacggatagtgaattgcctgcaaagatggagattgactgggtaaaagtgagtcagcctacgggacgttaa

SEQ ID NO: 4509 - DNA, 1563 bp, B.fragilis
gaaaaactcatgagtaaccagcttgaaaaagtaaaagagcttattgaacttcgtgctcaggctcgtttaggtggtggcgaaaaggctattgaaaaacaacacgccaaaggcaaatatacagcccgcgagcgtattgcacagttgcttgacgaaggtagtttcgaagaactggatatgtttgttcaacacagatgtaccaatttcggacaagagaaaaaacatttcctcggcgacggtgtggtaaccggttatggaacgatagaaggtagattagtatatgttttcgcacaagatttcacagtattcggtggttcactgtcggaaaccatggcacaaaagatctgtaaagtaatggatatggccatgaagatgggtgcccctgttatcggtatcaacgactcgggtggcgcacgtattcaggaaggcatcaacgccctgtccggttatgctgaaatcttccagcgcaacatcatggcttcgggtgtcatcccacagatttcaggtattttcggtccgtgtgccggcggtgcggtttactctcccgccctgacggacttcacgctgatgacggaaggtacatcttacatgttcctcaccggaccggctgttgtgaaaacagtaacgggtgaagacgtgtctcaggaagatctgggtggtgcaagcgtacatgccagcaagtccggtgtaactcacttcactgccgaaaccggtgaagaaggtctggcgattattcgcaagcttctcagctttattccgcaaaacaacctggaagaagctccattggtgaactgtaccgaccccatcgaccgtatggacgacctgctgaacgagatcatccccgacagcccgaacaaaccgtacgatatgtacgaagtgatcggcgccatcatcgataacggagaattcctggaagtacagaaagactatgcgaaaaatcttattatcggttttgcccgtatgaacggacaatcggtaggtgtggttgccaatcagcctaaatacctcgccggagtactcgacagcaatgcttcacgcaaaggtgcacgcttcgttcgcttctgcgacgcattcaacattccgctggtgacattggtagacgttccgggattccttccgggtacgggtcaggaatataatggtgtaatccttcacggagccaagttgctgtacgcttatggtgaagccactgtgcccaaggtaactgttaccctgcgtaaatcttacggtggttcgcacatcgtaatgagttgcaagcaactccgcggcgacatgaactatgcatggccgacagccgaaatcgccgtaatgggcggtgccggtgcagtagcggtattgtatgccaaagaagccaaagatcaggaaaaccctgctcaattcctggcagacaaggaagccgagtacactaaactgttcgccaacccgtacaatgcagccaaatacggttacatcgacgatgttatcgaaccgagaaacactcgtttccgcgtgatccgcgccctgcaacagctgcagaccaaaaaattaaccaaccctgctaaaaagcacggtaatattccattgtaa

SEQ ID NO: 4510 - DNA, 441 bp, B.fragilis
aatgaagcaatgaaacaatataaatataaaatcaacggcaacctttacaacgttacagtgaacgatgtagaagataacatagccaacgttgaagtgaacggaacctcttataaagtagagttggacaagcccgtcaaagccgctccgaaaccggtgacccgtccggcagccgctccgaaaacggaaacaggtgctccggtagtaaccaaacaaccgacagcttccaaaaaagacggtgtgaaatctccgcttccgggcgttatcctcgacataaaagtgaaagaaggggataccgtgaagagaggccagacgatcatcatccttgaggctatgaagatggaaaacaacatcaatgccaataaagacggaaaagtagcagaaattaaagttaataaaggagattctgtacttgaaggtacagacctcgtaatcattgaataa

SEQ ID NO: 4511 - DNA, 1059 bp, B.fragilis
ccgaaaccctttacgcgcatgctacatcattcatcgagaatctcccccaagacacgtttttgcctgaagttgcttttactgatcctgccgctgatcccgatagtggttgtctattttatgtttgatccttatagggtattacacccctacaaacgattcgacgactctcccatgctactcaacgaagcccatgtgggatggcagaattatctgcagaatcgcgattcgatagcctataactcctttatactcggcaactcctgtaccatggcattcctgacaggagaatgggaaaaatacctggataagaacgaccatgccgtacgcttctatgacaacggagaaagcctgggcggcgtccgtcaaaagcttcagctgctcgactctgtaggtgcacccctgaaaaatatactgatcgttctggataaaaaatcactggacaaaaacgctcctttatcgggcaacaatcatctgttttcggccgaagcagccggcatcagccaattgggattccagttgagattcctgcaggagttcctttatccggacagaatgattccttacatagattatctgatccgacataagtatgctccttatatgaaaggggttataaatccgggagatcccgtcagggagccttacacgaacaattttatcaatcccagagaaaaagagatcgcgcaagatggcgaaatatactggagccgtcatgaaaaagaattcaagaagcgaacgaatgcgggtatggaagaacttcctgttatatttgccagccagattcaggtacttcgctccatcaaaaaaatctgcgataagcaccacacgaacctgaagttcgtcatcggtccggattactatcagaaaaaagccagccgggaagacataaaaatattgaaggctatactgggtgattccgctgtctgggatttcacgggaatcaacgaatacacagccgacatacatcattattacgaacccggccattatcgtccgctgctgggagcacgcttactgaaagccatttatcaggatcaagacacctgccacaggcaataa

SEQ ID NO: 4512 - DNA, 1617 bp, B.fragilis
aaacaacgaattaagattatgaaaaaaatatatttctatacactgttgttaggacttctggcctttacggcttgcgaagatgagaagtcgcccgtcatggagttgcagaaagcctctgcttttgagcctttctctcaaagcgactttactttcaacgatgaaaatgctgcggctgagtttcccgagatcaagtggacggcagcagactatggagtgaaggcagtggtgaattatgacgttacactgacgaatgatgcgaatgcgaaaactgtcttattgggtgaaactggaactaccagcctgaagtttaccaatggacagatgaacactatgatggctaaggtgggggcttatccgggacagacttataactttacgattacgctgacttctaaagcgtatgacatgactgctgatccagcttcgaactcgattacttttaaggcgactctttttgatccgaatgcggttgactggaagttcgcttatgtggccgtgggctatccggactgggactatacgaatgcttacctgttgggcgatcccgatggtgacggggtataccagggatatgccaacttcgatgcggatggcgtttcgtatgctattatagacggaagtgatcttaccaagattctggcaaaggatcagacggctgctaaaaaaggattctacgggatcaaagtagatgccgaaggtaaggtggaacagaccgaaccccttgtatggggagtggtgggagacgctacttccggtggttgggataaggacacacaaatggactatgacgccaccacccgcttatggacggttactacttcattgcttgacaaagagtttaaattcaggtcgaacaataactgggattccgataattacggagcggtatccggtaaggagtccgaacttgaaggcgaactggtggcagggcctaataattttaaggtgttgaaagccagtccatacgtgatcactatgaatctgacaaatgccggtaaatattcttatagcatggtagaaactaccattgaattgtcgagtgcggaaatggcattgccgggaagctatcagggatgggacgctactaaagatgattgttacaaagtgcaatctgctgcccgcgactttatctataccggaacattttattttgatgccgataccaaatttaaattctgggatgccggggtatggatcggtatgatgggccctatcagttgggatgaagctaagaacatagggacatttgttctgatgcccagcgacggcgataatatcaagattgaaacagccggatactatcgggtaggtgccgatatgaagaagctgacagcctcgttgaccaagaccggttgggagataattggtgatgccactcccggtggatgggacaaaggaactgtgatgaattatgatccggcaactaaactctggtcggtagacgtcactctggtagccggtgagataaaattcagatgggacggtgcttggactgtcaatctgggtggcagcctgggggcactgactcaggatggtgctaatatgaaagtgacagccggagcctataccattgtattgaatccggatgctaaaacggcgaccatgactaaaaaataa

SEQ ID NO: 4513 - DNA, 633 bp, B.fragilis
tgctttcggatggtgatttccagtatataccttatttatttatttatcagtatgcttgctaacttagatcgttataaaatcgtattggcctctaattctccgcgtcgcaaagaactgatgacgggcttgggtgtcgattatgtagtaaaaactttgccggatgtggacgaatcttatcccgatacgttgcaaggtgaagagattcctcttttcatagcccgtgagaaggcagccgcctatcagtcgatgatcggaccggaagagcttttgatcacagccgataccattgtctggcatgaaggcaaagcgctcggcaaacctgttggaaggcaggatgccatagagatgttgcggagcctctccggtaaatcgcaccaagtgattaccggtgtgtgtctcactacccgagaatggcaaaaatgtttcgctgccgtgacggatgtccgttttgcgattcttgatgaagatgaaatcgcttattatgtcgatcactatcagcccatggacaaagccggttcgtatggtgtgcaggagtggatcggttttgtcggagtagaatccatatccggcagctacttcaatgtaatgggacttcccattcagaaattatacagggaattgaaacaactatag

SEQ ID NO: 4514 - DNA, 603 bp, B.fragilis
agtagtcggatttcccacattgatggaggtattggagtgattcagccggtaaaagaaaagattattctgggcattgatcccggtactacgatcatgggatacggagtgctccgtgtttgcgggacaagacccgagatgatcgctatggggatcatcgatttgcggaagttcggcaatcattacctcaaacttcgtcatatccacgaacgggtgcttagtattatcgaaagttacttgcccgatgaactggcgattgaagctccttttttcgggaaaaacgtgcagtcgatgctgaagcttggacgtgctcagggagtagcgatggcggctgcgttgagccgtgatattcctattactgaatatgccccgctgaaaataaagatggccatcaccggcaacgggcaggcctctaaagaacaagtggcggatatgttgcaacgcatgctgcattttgccaaagaggatatgcctgtttttatggatgctaccgacggattggcagctgcttattgccatttcctgcagatggggcgtccggtaatggagaaagggtatagcggttggaaagattttatagccaaaaatcccgaaagagtaaagtag

SEQ ID NO: 4515 - DNA, 357 bp, B.fragilis
aagtttattgttagtgaattaaaaattctatgcaaaagtaagaataatcctttgaatagagaaaccctcgggcggaaatatccgtttgaggagcgtaattcaattctatttcaaattatttcccatcctttaagagctgtttgtaatgtctacgtagcaaataaaggttttttattgtttcctcatatatataatggtaggcaaatgatcgctgtaaccatccaaccacactctgccaccatatgtacgcaggggtgcacccttatatttaccatcctgctgaaacaggtaatcgcgcatgaaaacttcattgtgatcatatttcaatccttttgttgcttgaagcagagtggatga

SEQ ID NO: 4516 - DNA, 927 bp, B.fragilis
acatcgattgttatgaataagaaaagaatcgggatatttatcgctctgctggcaatggtttgcatggggctcagggcgcaaagtgccaccagtctgagaatcaatgaggttttggtcgtcaacgaccagaactatcaggatgactacggactgcacaatgcgtggatagagatattcaacacctctttcgcttctgtaaatctggaaggttgctttctgacgaacgataaaaacaatccgaccaaatatcctattcccaaaggcgacgtgctgactctgatcaagccgcgccaacatgctttgttctgggcagacggaatgcctaaccggggtacgttccacgtgaactttacgcttgacccgaacaaagagaattacattgctttgtatgactctaacggtaaaactctgattgacgaagtaaccatacccgccggtcagcttgccgaccgttcatacgctcgcgaaaaagacggaagtgccaactgggtagtaaaaggtgaaggagaacacagctatgtcactccgagcaccaacaatatgactatcgacaaaaacccgaagatcgagaacttcaagaaacacgactctatcggtatcggtatggccatcatcgccatgtcggtcgtattcataggtttggtactcttgtatctttcattcaaggcggtaggtaacgtagctgtcagattgggtaagaaaaacgcgatgaaagccaccggtatcaccgacaagacggaagcgaaggaaaagaacctgggtagccacacaggtgaagaaaccgccgcaatcgccatggctttgcatgaatacctgaatgacgctcacgacgttgaagacatgattttgaccatcaacaaagtgaaacgcacctactcaccctggagttcgaagatctacacactgcgtcagactccgaaaagataa

SEQ ID NO: 4517 - DNA, 315 bp, B.fragilis
tcagcattttcctgtatactgatagtcacagaagcatcgcccgctgttcccgaaaatggagacaccgtacaccagtctgccgctctgcgtgtatccgtatcggtggtcagcgagatccgccatggacgtcctgacgagaacgatagattccgggttcccgaagtagcggcaaaatcaatgccttgctcaaaaaaaatctcactatcagaagaaagaatcagagaatcggtttctttctcttccgacgagcaaccgaaaccaatcagcggaagcaggaggaacagaaacggaaaagttaaatatttcatagattaa

SEQ ID NO: 4518 - DNA, 1092 bp, B.fragilis
agatttatttcattggaaattgaagaatctgtgctaatccgtgtaatctgtggtgaactcaaaaataaatatatgaagaaactaattattgcattcaactttttattgttgctggcggtcggtggccgggcacaggatcatgcggacgggctgtacagcgtagctttttacaatcttgagaatctgtttgataccattcatgatacgggaaaaaacgattatgaatatcttccggatgcggcaaaggggtggaactcggagaaatattgttcgaaactgaagaatctgtccaaggtgctgggtgaactttcgcgtgataaagtaccggcaggacctgctgcaatcggtgtggcggaggtggagaactggcgcgtgcttgacgatctgattcgccaacccgaactggctgccggaggttatcgatacatacattatgaaggacctgacaaacggggcatcgactgtgcgttgctgtatgaccccaaacaattcactccccatgcgactgcattggtgctttccactcctttcgagggagataccatccataaaacccgtggattcctgattgtaggcggcgagctggcgggtgataaagtctgcctgatagtcaaccactggccctctcggggggcggcggaaccggtacgcgtgcacgctgccatgcaggtgaaagcattgaaggactcgctgatgcgtacggacccggacttgaaactgattatcatgggcgacctcaacgatgatccgatggacttgagccttgccgtactgggggcaaagaaacacgtcgaagatatgactgaagatgacctttacaacccctggtgggtgacgctggaagataagggagtgggcactttgctctatcgcggcaaatggaatctgtttgatcagatcatcctttcatccactctgcttcaagcaacaaaaggattgaaatatgatcacaatgaagttttcatgcgcgattacctgtttcagcaggatggtaaatataagggtgcacccctgcgtacatatggtggcagagtgtggttggatggttacagcgatcatttgcctaccattatatatatgaggaaacaataa

SEQ ID NO: 4519 - DNA, 1062 bp, B.fragilis
tcggtctcttctttatctaccttgcccgtagccaaagaatttgaaccgatgctgctgatccccattggcttcggtattctgatcggtaatattccattcaatatggaagccggattaaaagtgggtatttacgaagaaggttcggtactgaacatcctttatcaaggagtaacctccggctggtatccgccgctcattttcctgggtatcggagccatgacggacttctcggcgctgatctccaaccccaaattgatgctgatcggagctgccgcgcaattcggtatcttcggcgcgtatatcattgccctgctcattggattcgaacccaaccaggcgggtgctatcggtatcattggcggtgccgacggaccgacggccatcttcctttcgtccaaactggctcccaacctgatgggtgccatcgctgtgtcagcctattcttacatggcgctggtgccggtgatacagccacctatcatgcgtgcgctaaccaccaaacacgagcgtctgatccgcatgaaaccaccgagaatcgtatcgcatacggaaaaagtaatcttccccatcgtgggtctgttgcttacatgcttcctggttccttcgggtctgcctttgctgggtatgctgttcttcggtaatcttctgaaagaaagtggagtaacccgtcgtttggcaaatacggccagtggtccgttgatcgatgtgatcactatcctgttgggactgactgtgggagcttctacccaagcttcacaattcctcacctgggattctatcttgatctttatcctcggtgcattctctttcatcatcgcaacagcgtcaggtgtcatgtttgtcaaattcttcaatctattcttgaagaaaggcaataagatcaatccgctgattggtaatgcaggtgtatccgccgtacccgactcggcacgtatttcacaggtaatcggtttggaatatgatccgaccaactatctgctgatgcacgccatgggtcctaacgtagcgggggttatcggttcggctgtagctgccggtatcctgctcggattcctcatgtaa

SEQ ID NO: 4520 - DNA, 585 bp, B.fragilis
tcaatgtggcccctgttcattcacgagggcgataatgagatagctatggtggtgagtaaccggagcggggcaggtggtctgctcaagggagtccgtttaaaacaggagttcgaggtgatcaagaagctgaactgggaagtttccaccgatctcggaggaatctgtcaggactggaatttgggaacgggaagcacagagggctggtctgttgtgaagttatcagccgattatcctttggtgcgtaaaggagagctaaccggaacagtcgatggcggacgggatgcattgcttacctggtatcgtctcgaattcaatatgccccggaaaaatccttcggtatggattccctggaagctgattgtaaatgctaccggaacgggatatatgtggttgaacggacacaatatcggacgctattgggaagaggggccgcaacgagagttctatcttccggagtgttggttacgtgccggagaaaagaatgtgataatacttggattacgtcagtccgaaacgaaaggtgcctgcctgtttggtgctgaggtggctccttatacagaggatgtcgaatgtatggaacaataa

SEQ ID NO: 4521 - DNA, 252 bp, B.fragilis
actgatagaacactttaccgctaccgaccctcggggcgagattgtgattgtacttgcaggaatagacgattaataataacttcatttaaaaacgtaaaatgtaatcgtatgaaaaagttagcaattttattagtatgcgcagctatgttggcttcgtgtaacggcctgggtggtggaagtaaagacatgaaggccaaaaaattgattctttttttgatggagtttgacccacaagaacgccgaattggatga

SEQ ID NO: 4522 - DNA, 753 bp, B.fragilis
tggagtttgacccacaagaacgccgaattggatgaaatgatgggtactttcaatgaggttcaggaaggattccgtaaaataaatgcagccgagagtcgcgtagatttgactcgtggaactatctctgagaactctgctactgcaaaacagcaaatagcatctgatatcgaattcatcacaaaacagatggaagagaacaaggcacagatcgctaaattgcaggctatgttgaagagtagtaagaataattcggcacagctgaagaaggctgttgagtctttgactcaggaattggttgccaaaactcaacgtattgaggaacttcaggctgaattggcttctaagaatatccgtattcaggaattggatgccgctgtaaccggtctgactgctgataaagaatcgttggctgccgagaacgaagcaaaagccaagaccgtagctgagcaggataaagcaattaatagcgcatggtttgtgttcggtaccaagtcggaacttaagactcagaagattcttgaaaaaggagatgtgctgaaaagtgccgattttaacaaggattattttactcagattgacatccgtactactaaggagattaagttatattcaaaacgtgctgagttactcaccactcatcctgccaaatcttatgaactggttaaagatgataagggccagttgactctgaagatcacaaacccgaaagaattctggagtgtatctaagtatttggttatccaagttaagtaa

SEQ ID NO: 4523 - DNA, 246 bp, B.fragilis
gaaagaagtgctcttgcaggatacacagagttaccgtatctttgcagccgttttaaaaaaagaataattatggaacttcctgaagatccgatgatgctgtttagcgtcatcaacatgaaacttcgcgattgctatgcatcgctcgacgaactctgtgaagatatgaatatcagcaaggacatactgatcggaaaactggaatcgatcgggttcgaatacaatgccgaacaaaataagttctggtaa

SEQ ID NO: 4524 - DNA, 2352 bp, B.fragilis
ggagagaaagccatgaaatataggatacttgttttaaccgccatcctgtttaccgcatgcaacttacttcatgcacaagtgcagacaggaaaattaagcggagtcatcatagatgccaataatgaagaaacactggtgggggccaatatatacgtagagtcactgaaaaaagggacttccaccgataagaacggtgaattttcaatagaagtccctgcgggacactatcgaattgttatctcctatatgggatatcgtacccgacaagaagaggtcagaatctccgaattgaaaaccaagaagttagtgattcgtctagaaccggaaactcagtcgttgggtgaagttgtcgtcacagccaaaagcgaagcccgccaactgcgcgaacaggctatgcccatgtcagtgataagtatgcaacagttgcagggaacagtcagtaatgttcaggatgttctgtcgaaaacggtaggtgtaactatccgcaacacaggaggggtaggcagttcatcccgtgtttccgtacgtgggttagagggaaaacgcatcggctttttcatagacggtagcccgatgaatgacaattcagacttcatcgatatcaatgacataccggtagacatgatcgaccgaatcgaaatctacaaaggagtggtaccggccaggtttggcggctcttctgtggggggagccgtaaatattgtcatcagagagtatccgcctaaatacctcgatgccagttacagtatcgaaagttttaacacacacaaactttcgttagtaaccaaacgcaacatcgctaccaaaggattagaattcggaggcggaggattttatacttactctgacaataactataagatggaatctccttttgaagaagggcttatcattaagcgcaaccatgacaaattcaagaaactggctgttgcaggtagcctgaaggctcgtaaatggtggttcgatttggcagagttcgaacctgtctttatacacactttcaaagagatacaaggtattgaatataatattgagaaagcccacacttactcagacgccttcattttcgccaacaaactggaaaaagaaaacttcctgacagaagggctcgatatggaatcgaatctggcctatgcctacacggtattccacatggtggataccgctgcttaccgatacaactgggacggtacgacttatcctgctgtatccgaatatggaggagagataggcaaatgggcctcgaatgccagaaacgagaaacacaccatcacccacaagttgcatctgaactatgtgatcaataataatcattctatcaacttgaactcactgttcagtttcgcatccggacacccgaaagatgacctgaaaaataaagttgttggttataaaaccaatttcagaagtacgatggcaagctggattgccggactgggatacgatttccgcaccgacaatgatatcttcctgaattcgctcaacgtgaaatattatatgtatggtatgaatactcacatgagcagtatcatgtcttcggaagccgagaaagtggatatgttgaaacgggattttggcatcagcaacgctctacgctatagatttactccggatttcatgggtaaactctcggtaggatatgacgtacgcctgccggccgaaagcgaacttttgggtgacggatatacagtcgccccttccggaaacctgcttcctgaacgcaatacaagcgtaaacctgggttttcttttagaccgcaccgaaaaggatgccagcaacttacaggtagaagtaaataccttctatggatatcttgagaatatgatccggtttacaggaggatatctccagtctcaatatcaaaacttcggaaaaatgcgtacccttggagttgaagtagaggtcaaggcggacttgactcattggctttacggctactgcaacatgacctaccaggacttacgggatgtgcggaaatttgaaccgaatacccatataaccaacccgaccaaaggtagtcggatgcctaacattccctaccttctggcaaatgccggactagaatatcataaagagaatctgttcggaggcaagggacagaacacccgtatctttacagacggttcttttgttgaagaatatttctacgattttgaacaaagccggtttcaggaacggagaattccacgcaccttctcggccaatatcggaatagaacacagctttatgaacggacggttcatcatttcggcacgaatgaataatctgactgatgcccgaatgatgtctgagttcaatcgtcccctacccggacgtaactggggagtaaggttaagatatgtattgaaatga

SEQ ID NO: 4525 - DNA, 762 bp, B.fragilis
ctgataagggcacggattgcacagcaagtagtccgtgccttctttttgaactgtacccgatactttaatatgaaatataagaacctgttttttgatttggatgatactctttgggccttttcccaaaatgcgtatgatacgtttgaggaagtttatgacaaatatagactgggacagtatttcgattcgttctctcatttttattctctttaccaaagacggaatacggagctgtgggttgagtacggaaacggacaggtgactaaagaggaactgaaccgacagcgttttttatatcctttacaagctgttggtatagataatgaaatgcttgcaaaacgttattctgatgattttttctcgatcattcctactaaaagtcggttaatgccgtatgcagaagaggtactttcgtatttggcacccaaatataatctatatattctttcaaatggctttagagagttgcaatcccgcaagatgcgttcgtcaggtatcgatacctattttaataaaataattctttcggaggatctgggggtgatgaagccttggccggaaatattttattttgctttgtcggctacacagtccgaactgcgtgaatcgctaatgataggtgatagttgggaagcggatattacaggtgccaatggcatagggatgcatcaggcctattataatgtgtccgggcgtgccgattttccgttccgtcctacttatttagtgactgatttgaaagagttgatggaactattgtaa

SEQ ID NO: 4526 - DNA, 201 bp, B.fragilis
gcgatctcgtacaataagatgcagtccgtgcgggcacgtccccaccgtcatatccgtccgggacgtgaggtcctccgtatgaaccatctctccgacggaatcctccgaggccttttacatgtgcccattaaatcgttaaaaagtgggtggggggaaaaaaaaaaactccttgtggatgaattgtcgacccgcggtcgataa

SEQ ID NO: 4527 - DNA, 2169 bp, B.fragilis
tcatattataagatagttagcacatactacagttctgcaaagactttgcagatttcgtacatcggaatgcagactgctgaggtagcaattgcaccggtaatcaaagtgatattaaagactgatgctaaggcacttgacgaagttgtagtaacagcaatgggtatctcaaaagagaaaaaagcgttaggatatgctgtgcaggatgttaaaggagataagctgactcaggcttcaagcagcaacctttccagcgctttgcaaggtaaggtttcaggagtggaaatatctccgtcatcaggtatgccgggtgcttcttctaaaatgactattcgcggttcacgttcatttacaggagataatactccattgtacgtagtagatggtatgcctatctcatcatctactgacttggacactttcaactctgttacaggctccgactatgcgaaccgtgcggtagatatcgacccgaatgacattgagagcatcaacatcctgaaaggccaggctgcttctgctctgtatggtatgcgtgcatcaaacggtgtggtagtaatcaccaccaaaagcggtaaaggcgcacgtaaaggtaaaccggaagttacaatcaatacaggtctttcattcgataaggtctctaccatgcccgatttccaaaaagaattcgcacaaggattcaacggtgcttttagcccgtctgactcccgttcatggggacctctgatttcagaacttgccaatgaccctaaatatggtggtaacacagacaacagttacactcagaaattcggaaagcatcagggacaatattatgtagaccaacgtgccaaggcaggactggacccatgggctactccccgtgcatacgacaatgctaaagatttcttcaatacaggtgttacctggaacagcagtgcaaacgtagcacaaagccttgataaaggaagttattctttgtcattaggcagcactacagcaaacggtattgtaccttcaaccggtatggatcgttataatgcaaaactgactgcacaagctcaactgagcaagaattggtcaactggtttcaacggaaacttcgtttattctaaaatcaaaaaacagaccggtgccaacaatggtatcatggcaacggtatacggtgcaccgtcaagctatgatttaggcggtattccttcacacatagacggagatccttatactcaaaatacataccgttctacaggcggtttcgacggtgcttattgggcagttgaaaacaactcttttaaagaacgtactcaacgtttcttcggaaatgcgttcgctaagtattctaccgatttcggtacagaaaatcataaactggatgtaaaataccagttaggtaccgatgcttataccactaactataccgacacatggggatatggacactccaacggaacaggtagcattgaagagcaaagcgttacaaacaatgaaataaattcattgttaactgttacttatgactggaaaatcactccggaacttgatttaaacgtgttatatggtaatgaattagtcgataattcttcaaaatacaaatacaatctcggaagtaacttcaatttcccgggatggaaccatatagctaacgcatcaatctattcatctacaggaacctatcatcgcgagcgtaccgttggtaattttggtaacatttcattagcataccgtaacatgttgtatttgaatgcaactgtccgcaatgatattgtttcgtctatgccacgcaacaaccgttcattcacttatccttcagtttcactcggtttcatttttaccgaactggaagcattgaagaacgatgttttgacttatggtaaaatccgtgcttcttatgcagaagtaggtcaggcaggtacctattatccttcttactatagaacaccggtttacggcggcggattctcatcaggtactcctatacaatatcctatcggatcaatcagctcatatatcccatactacaagatttatgatccgaatctgaaaccccaaaacaccaaatcatacgaaatcggtgcagacttcagtttctggaatggtttgatctcactgaattacacctattcttgccagaatgtgaaagttcaaatttttcaaagtacccttgggctactttttacggatattagggattga

SEQ ID NO: 4528 - DNA, 222 bp, B.fragilis
tatgtattaaagtcacctccgatgttgctaaatgcggttgctgtgattacatccgccaaaatgaatttggcaggaacactggttgtatggtctttgtctttattgatgttgtccattgtgtcttccgagcaggaagcaaatgcaacggaaatcaatgccacagacaagataccttttgataaattaaatattgatttcatttttgtcctttttagaatttaa

SEQ ID NO: 4529 - DNA, 864 bp, B.fragilis
tcttctgaaaataataccatgctgatgtatgttataattgcttgcaaaagtaatagttttattggcttctcagtgttttttcattatttatttctacatttgccaagtcattcaaagagaaattcagatgtagatatgcaagcattgctgaacgacatagagctggatattcaggagcttaagtacctgatggaaatcatttcacgcgaaccggattccgttttgcgcggagtggcacgaagaaatattgtgcaaatgcgaggacgattggatgcattattggagctgttggatgcaaagcctgtgatagcggccgacgcttctgaaagtccggagaacagacctgtaacggaaacaatagaggttgtggaaatcccggctttaaaagaaactgtggctgacattccagaaaaaaacgaagaagccgcagtagcagaagactcccaggaggcagtcgagcctgggccgttgagtttgtctgaagcggttatcgaacagctacctactgtggaacttgatcctgtggctgatgaaaaagaagaagtattcgaatcggtatcggttccacaatcagaggaaccgactgtgaaagttgagactagagtggcttcttcacccatcttggccgaacgtatcaaaactgcaggtgatttgcgtcgttcgatcagcttgaatgattcgtttcgcttctcccgtgaattgttcggaggaagtatggaacagatgaataatgtgttgcatcagattggtgaaatgagttcattggatgcagctcttgtttttctgtcttcaaagatcaaggtcgatgaagaaaatgaagctatgaatgattttgtagagcttctcaggaaacattttatataa

SEQ ID NO: 4530 - DNA, 660 bp, B.fragilis
aaaaacactgagaagccaataaaactattacttttgcaagcaattataacatacatcagcatggtattattttcagaagatcatatacaagagactagaagaagaggaagaatcgaagtaatttgcggctctatgttttccggaaaaacggaagagttgattcgccgcatgaagcgggctaagttcgctcgtcaacgtgtagagatattcaaacctgccattgacacccgctattcggaaggcgacgttgtttcacacgacagtaattccatttcctccacacccattgactcttctgcaagcattttgctctttacatccgaaatagatgtagtaggcatcgacgaggcacagttcttcgacagtggattgatagatgtatgcaatcaactggccaataacggagtgcgtgtcattatagccggattggacatggatttcaaaggagttccttttggcccgatgcccgctctatgcgctattgccgacgaagtttcgaaagtacatgccatctgcgtgaaatgcggacagttggcttctttttcacaccgtaccgtaaagaatgacaaacaagttttactgggggaaacagcccaatacgagccgctctgtcgggaatgttaccaacgcgctttacaagaagatcgagaaaaatcataa

SEQ ID NO: 4531 - DNA, 2844 bp, B.fragilis
tataattgtagttctgcaaagactttgcagatttcatatattggtatgcagactgttgaagtagcaattaagcctgttgtgaagattacgctgaagcctgatactgaagtattagacgaagtagttgtaacaggatatggtaactttaaaaagtcatctttcacgggagcagcatcgagtattacaacggaaaaacttcaagacgttccttctttgagtgtacaggataaacttgcaggttcagttgccggtgtacagattacatctacttccggacaaccgggtgctgtggaatctgtgcgtatccgtggaatgggatcaatcaatgccggtaatgatccgttgtatgtgattgacggagtacctgtaatgaccggtgacgccagtgaatttacttactctcagtctggtaacagcttactgtctactattaacagtaatgatatcgagtcaatgacagtaattaaagatgcagcggctgcttcgctttacggttcgcgtgctgcaaatggtgttattgtaattactacgaaaaaaggggcttcaggaaaattgaaactcaatgtaagggctgactggggattctctaacaaggctattgattatcgtcctattctgaatggtgaagacagacgtgacattttgtatatgggtttaaagaactatgctctaaattcaggtaaggatgaaacttatgccgtgaactatgcagataataatattgataaatatgctgcaaaaccttggagtggatatactgattgggaagatgttcttttcagaaatggttctcatcagaattatgaagtgaatgcccaaggaggaaatgagcggactaagttttatacttcattcggatatactaaacaggaaggtattacacttcagtccggttacgagcgtattacgggacgtgcaaatatgagccataaggcggatcgcgttacaatcgaggcaagtacgatgtttacgaattcaactcagaacgtaaactcggaaggaacaagtttctcaagccctatcatgtgtctggccatgacagcttctccttctacattcccatataacgaagacggtacattcagcacgagtttccctgctttgaatggtgccaatccccttcaaactgcaacatataattatgatcgcagtacaattgtacgtaccctgaacacactgtccgcaacgtggaatatttgggataacttgaatattaaagaaactttaggttatgattttaaccaaacaaataatcgtgtgtggtgggatccgcgttctaatgatggacgttcttcaaaaggagtatttcagcgctatatgatgaacagaagcaaattgaatactcaaactcagctgacttataacaagacatttgcggaacaccacaatatcgatgtattgttaggtttcgaaactgaagattataagtacgattatacctatactaatggtaatacttatccatcttacttaccggaaattacgaatgcaggcgtttctagaggtgccagtaacattaacagttatcgaatgacctcctacttgggacgtttaaattatgattatgccggcaaatattatgtaagtggtagtttccgtcgtgatggtagctcacgtttatcgagagacagccgttggggtaatttctggtcagtatcaggttcgtggagactttcacaagaagcatttatggagtcattatctaatgttattactgatgctaaaatacgtgcttcttacggtgtaaatggtacacaacccaaagactactatggatatatgggggtatatgagtttggatataattataatgggaatggtggttcgtcagaggcacgtttctataatcccagtctgaaatgggaaaagaactatgctacaaacattggtattgaccttacattattcaatagattgactgtttctgcagagtggtataatcgtgaaacaaaagacttgttaatggataaaccgatttctgcagcagtaggtgttatcaatagttcgggtgttgctaatatgctcgttaacgttggttcaatgagaaaccgtggttttgaattggaattgaagtccactaacattcaaaacaaagaccttctttggactacttctttgaacataggacacaacaagaataaactgaccaaactggatggtgaacaacaggaaattatcagtggagtttctatccatcgtgtaggtcaaccatattactcaatctatgcgtatgagtatgcaggtgtcgatcctcagacaggtaaagaactgtattatataaatggtgaagatggcagtcgtgaaacaacaacaaattctgctgccgctaataaaacaatcattggttctatcgaacctaaagtacaaggcggattgaccaattatgttagttggaaatttattgatttcaacttgaccctgacttattcactgggtggacatgcttatgattacgccacctggctgcaatctaatggaggtacctatcattatttaggtaatgttccggcttattataaaatggaagatacttggcagaaaacaggtgataatgccaaactgccgcaatttgcatacggtaatgccaataaagcttcttctcgctggttgatgtctaccgatcatttacgtgtaaagaatatgaccttgggattcactttacctcaaagttggtcgtctaaagccggtataagtaagttaagagcttatgtctcaggaaacaacctgttgacttggaagaaaaagagcttgtacgttgatccggaagttcctgttgacggattgtgtacattcgaaactccggctctccggactgttacatttggtcttgaaatcggtttttaa

SEQ ID NO: 4532 - DNA, 1614 bp, B.fragilis
attctaaaaaggacaaaaatgaaatcaatatttaatttatcaaaaggtatcttgtctgtggcattgatttccgttgcatttgcttcctgctcggaagacacaatggacaacatcaataaagacaaagaccatacaaccagtgttcctgccaaattcattttggcggatgtaatcacagcaaccgcatttagcaacatcggaggtgactttaatacatattattctacttatgtagaacatatggttggagtggataaccaattggcaaatgcggagaaacgtaacggagagccctcggcatcctctacttttaacaatgtatggggtaatttatactctacactgaagaatgcacgtatcgctattaatatcagttctaatgaagtcacgggcaattatacgacaaaaggtatcggtgaagtattggcagcaattaatgccggactgatcgcagactcattcggtgacactcctttcagccaggctgcccttcccgaattagcaaacggacaacctcagtttctgactccggaattagacaaacaggaagcaatttatactgctattatggaatatctggatgctgcaattaccgatcttcccaaaggcgataaaagtgatgaaattggagaatatgactttatatataaaggtgatggcgaagcatggctaaagctcgcttatggattgaaagcacgttatacaatgcgactattagcccgttcctcctcaaaagatgccgatttgcaaaaaattctggaatatgtagacaaatcatatacatctattgaagaacaggctgctttctctatctatagtgcaacaaacttaaatcctctatttgacttccaatggagtcgcgacggattggctgcaagtaaaagttacgctgacaagctaatagaacgcaatgacccgagattacgccgcatcttctgtatcggacaaggtaagttaactgaaaacgaaaatgctgtatctatccaagttacaggtgctgatgatccgagattcctgatggcagacaatggtacggcagagtctgttaaatacgaatataacactcctatcttcgtatactcacaaacatgcccgaccttacttatgagctatcatgagttactcttcctgaaagctgaagcattagctcggttaaatagaaaggacgaggcggccaatgctttaaaagatgctgtagtagcagccattgcaaatgccgaaacaggagtttcagctgcattcaacgcccctacagtaaaaagttatggaggtgttaaagaaactactaaagcgattacagctactgaagcagaagagtatttcacaaacaatgtaaaaccattgttcgatgccaatccggtaaaagaggtaatggtacagaaatatattgcattccttggagctttcggcgaaacaacagaatgttacaacgatgtacgtcgtttgaaagcaatgggtgaagagtacatcaaactagacaatccctataaattcccgcttcgtgcaccttatggagcagatgacgtaagtgcaaacccgaacgtagaagcagccttcggaaacggtcagtatgtatataccgatccagtttggtgggcccgtggtagccgctaa

SEQ ID NO: 4533 - DNA, 720 bp, B.fragilis
agcttctcaggaaacattttatataatgaatatttgaagagagatatgggaaaactatatgtggtaccgacaccggtcggaaatttggaggatatgacattcagagctattaaagttctgaaggaggccgacttgattctggctgaagatacccgtacttccggaatcttgctgaaacactttgaaattaaaaatgtaatgcaatcccaccataagtttaatgaacataaaacggtggagagtgttgttaatagaataaaggcaggcgaaacaatcgctttgatttcggatgctggaacgccgggaatctctgatccgggctttcttgtggttcgtgaatgtgtacgtaacggtatcgaggtgcaatgtttgccgggtgctacagcttttgttccggcattggttgcgtcgggattgccaaacgagaaattttgtttcgaaggctttttgcctcagaagaaggggcgcatgacaaagttaaaatcactggtagatgaacacaggacgatggtattttatgaatcaccccatcgtttgttgaagacgttgacacagtttgccgaatatttcgggcctgagcgccaagtgtctgtatctcgtgagatttcaaagattcacgaagaaacggttcgcggcactttgagtgaactgatagaacactttaccgctaccgaccctcggggcgagattgtgattgtacttgcaggaatagacgattaa

SEQ ID NO: 4534 - DNA, 1524 bp, B.fragilis
aaacaatttatgaaaaaagaatttatgaaaaagatatataaatcaataacactggttgctgctattttaagtttgtcttcctgcgggaatgattggctggatagaaaacctgccgacgggattccatcagaagatgctatcactaactataatgacgctctgactgcacgtacaggtatgtatgatggcattcagggaaactccaatgctaccagctattatggtgcccgtatgttttattacggcgatgttcgtgctgacgatatgcaggcaagaactcaaggtatgcgttcatcatcgtgctatgagatgctctacactgtagatgacgctcctaacatgtggaatataccttataatgtaatccgtcgtgccaaccgtttgatcgaagcgatcaatgaaaaaaaggtaaccgatgcaacggaagcacaaattggtaaaatatattcagaagcattggttgtcagggcattggttcattttgacttggtaagaatctatggtatgccttatacggccgacaacggagcttctttgggggtaccggttatcgtgaaacctttggaaagaaatgatttgccctccagaaatacagtggcagaagtttatacacaagttatcacagacctgactgatgctattaactcaggttatcttgctaaagatcagactccgggatatattaatgaatgggcagcaaaagccttgcttaccagggtttatctgactaaaggtgataatgagaatgcactcaaagttgctgaagatattataaccaattctccatataagctttggactaacgaggaatatgtaaatgcatggtataaaagcaatggagcgcatacaaacgaaatgatttttgaagttgtaaatgcaagtaatgatgactggactgaccgtaatggtattgcttatttgctgaatgagaacggatatgcggatgcaatagtgacaaagagctttatgaatatgttgagtcaggatcctaaagatgttcgtataggtatggtactgcctgctcaatatgataaggatcttcaagaagaatatggcgatgcgaaaatcttcattaataaatttccggcggataaagacgatgtaggtgaaatgcgtttaaataatctgccattacttcgtctttcggaagtttatctgagtgctgcagaagcggcagctaaacttggagggcatcaggataaagcagccaaatatctgaatgaaattgttcagagagcaaatccggaggccaaagccatttcggaagcagatgctacagtagaaagaattattcttgaaaggagaaaagaaatgattggtgaagggcaacgttactttgatgcattgcgcaataatgaaacaatcgttcgctataaagatgaaggtgataagggatatcattattcattgattaaagaatcgcaaagctttgaccgtacctacttcagagctatacttccgatacctgttgatgaaaccaatgtgaatcctaatttgagagctcaacaaaatcccggatattaa

SEQ ID NO: 4535 - DNA, 1257 bp, B.fragilis
aacaagattatttattttaaaaacccaaaaactatgaagattagaaatttgatgctggcacttgccggcactgcactcgtattttctgcatgcgaaaaagatccgaaccctaaagtcccgaccaccgatgccaacatcgctctggcaaccatcctgcccaatcccgacggaatgacaggagcagcttacctgcaactgatccgtgacgagtttccacaaaatacaaataacaacaacggaattcccattccgtacggaggatcatacccgattatcgaagggaacgatattttcgtttttccgggatacatgggcgatagcaagaacgagttagtgaaatatacacggaacaacgggcagctgtcaagaacgggaacaatgaaattgccacccaactcttccgccaccaatatcgtttttgcgtctaccggcaaagcttatctatccatggcaggattaggcaagatcgctatcttcgatcccactaccatgacacagcaaggagagatagacctgacttcattaggagtatccgacagcaatccggatccatccgccatgttactgcgcgacggactcctattcgtaggcctcagccagatggtgggtggatggattcccccacaggatcgcccgtacagcgacattgccatcattgacacccaaacggataagttgctgaaaatgataacagacaagaccagcggcatctctatgccaacccgcccaatcgaccgctattccatcttcatggacgagaagaaagacatctacatttcgtgtatgggaggctttggtatggtcaaagggcataatgccggagttctgcgtatcaaagccggagaaacggagttcgacccgacttatcaatggacaatcacaggagccgccatcagcggagaagaaaagactgccggatttatctccgccatccggtatgtaggtaatggaaaagcgtatgcttacatcaatatgccgggttactacaaaccgggagaacaaggacacacagccatcgccgatcttgcagtggaaatagatctgtacaataaaaccatgaaaaaagtgcaaggacttgacttgtccaacggtttcggggttatgctttccctttataaagggagtatgttgataggtaactcatcggctaaagcaaaaggtatctactcactggatatacagacaggtgaagtgtctaaagaaccgatactgaccacggtaggcaatccgatattatgttactattttgaaaaataa

SEQ ID NO: 4536 - DNA, 1185 bp, B.fragilis
agccaagtcataccgatgaggtcgcacatcaaatatcaggttatcatggaaaggaaaaaaattacatttgatagtttcatacgcggttctatctgctgtgcgctcattgtgggattactcatactttttaaaaggctcagcggtgtattgctaccttttttcgtagcatggctcatcgcttatatgatttacccactcgtcaaattcttccagtacaaattacgtttcaaaagtagaatcatttctattttctgcgcgttgttcagtattaccatagtgggtatttcccttttctatctgctggtgcctcccatgcttgccgaaatgggacgcatgaacgatctactggtaacctatctgaccaatggtacctacagttccggcactgtccctcctactctttcggagtttatccacaagcacattgaccttcaggcactcaaccgtatcctgagtgaagagaatataatgaataccattaaagaaacggtccctaaactctgggcccttgtcgcggaatccatcaatatcctgtttagtgtctttgcttctttcattattctattatatgtagtttttattctgctcgactatgagtctatagccgaaggctggctacacttgcttccaggtaaataccgtactttcgcttccaatctggtgaatgatattcaggatggcatgaaccgttatttccgtgggcaagcctttgttgctttttgtgtagggattttgttcagcattggattcctgatcattgatttcccgatggccattgctctagggctatttatcggagcactcaacatggtaccctacctacaaatcatcggcttcctgcccaccatcgtacttgccatccttaaggctgctgataccggtgaaaacttctgggtaattctggcaggtgctcttattgtattcatcgttgtccaagccattcaagacggtttccttgtccctcgaattatgggaaagatcacaggactcaaccctgctattattctcttatccctttccatttggggatctttactcggaatgctaggcatgatcatagcactcccactcaccactttgatgttgtcctattatcagcgtttcattatcaacaaagaaaaaataaaatatgacagacacgaagtcactgataatcaatcagcagaggaaaatactaaaaaataa

SEQ ID NO: 4537 - DNA, 588 bp, B.fragilis
gtcggcgtaatggggaattttgttaagcggggtttaaaggacaagctggacaattcttttttggtttccggggttttaccaaaaggcgttaagaagatcattcccttttccaagacccgggggcatgctcagggatcccgtccgatggaggatttaagcgaagtcaagcaggccggtttcggacgcaggcagacaggtattcagcctattgaagaatggtttgtaaaatctgtcggaacggacgagccccgtttgatgcccgctgtatttgctgaagatgcggggtgggaaaaaattctgctcgatcagcaaacgattgataacctggctaccttgcaaattgccggattggagaaaccgaaatggcctgctgcctggattttacaggagaaagccggttgtgccgtctatcgtacatgtatccgctggacaccagaaatgattcgtgaagggatgactgtccttgaatttggttgtatagatgatgccggaaccttatgggtgaatggtgtggaagtaggtacgcacgaagagtgggataaaccttatgtaatcaatgtggcccctgttcattcacgagggcgataa

SEQ ID NO: 4538 - DNA, 1632 bp, B.fragilis
ggtggctccttatacagaggatgtcgaatgtatggaacaataagagctgtcatgaaaaaatatttgtatgtattgattgcatggatgttgcctttatgtagcatccatgcacaagctccggtctggaatccggataatggaaatgggacgtttactaatcctattatgtggggtgactggcctgatccggatgtgatccgggtgggcgatgacttctattttgtctccacaagtatgcattatgttcccggttgtcccattgccacatcgaaagatttggtgaattggaagatggcaggatatgctgtcgaccgatacgatgaagatgcacgctatgatttgaaggggggcgatcgttatctgcgtggatcatgggctgccactatccgtcatcataacggtaaattctatgttggcttttgcactccttcttgggaaggagagggccccgggcacttttccatttgcattgccgatgatgtgaaaggcccttgggaacggactatctttccggaatacctgtatgatccgggattactgttcgatgacgatggcaaagtatatgttttccacggacaagggacactgtatgttacagagctggcttccgatgctaaatctgtgaagggagagaaagtgaagatatgggataagcgatttaagaatgcccatgaattcggaggaggctatggcatggaaggtgcccatgcttataagatcaacgggaagtattatctcacttgtccggccggtggaaccgaaggctggcaaatatgtctgcgttccgataacatctatggaccctacgaacataaactgatcatgaatgattccggttcttatcctcccaacggtttgcatcaggggggaatggtgcagttgaagaatggtgactggtggtttattatcatgcaagacagaggccctatcgggcgtgtacctcatttggtaccggtgaaatgggtagatggatggccgatgcttggcagtggtggtaaagacattattacctatccgaaacctgaggtcggaaagacctatccgttcgcttctcctgccacaacggatgaattcaatacatcttcgctcggacttcaatggcagtggaaccataatccggacaatagccgttggtccctgaaggaacggaaaggacatatgcgactgaaagcctcgtatgccgaatcgttgaagacagcccgcaatacattgacccagagggtacagggaccttcttccgaagcaacagtcgaactggatgtctccggactgaaagacggaaatgtagccggtttcggtgtatttgaattcccctatgcctatgtggctgtagagcagactaatggtgaaaagaaaattgtaatgtgtaatgatggtcaaacgattgaaacaatcgatcgttttgaagggaacaaaatatggatacgtgcccgtgtgatggatgtaggtttccgtgccgttttctattacagtaccgatggcaagtatttccttcccatcggtaatgaacttagtatggggcttgggctggtctggactgccaatcgttttgccttattcaattttagtaaggagaaagcgggagaagacggatataccgattttaattggttccgtttcaccaataaataa

SEQ ID NO: 4539 - DNA, 1020 bp, B.fragilis
cttaaaggaataatgatggttactcggttaatgaaacatgatttgtgtgaaatggtgttggaatggcccatgccgaacatcgtaaaaggaaaacggacggaaaaaaataactaccggattgacaatacgtatttgaaagcgacatttgaagagatatctactccgttgttttcgattatggatcaacatatatccagtgaagaacctattaaaatatatactcgggctgacgactatcatgccgtttggttttgtgccacttttgcagggcatgctacctgttgttataattctgtaatccgaagtgaggagtggaataaaggagatgccaatttgttaaaatgtgacggggtagactcttgtgttcactttcctaaaaacacgccattccatatgatggaaatcatgctgtcacatgattatctccgtgaacttgccatacactatcccgatttgttgggcggtaaagattttgaaaccgtcctttgtgatggtcagtacagggcgtaccggaaaaatcgtccgtttggtccgggtgtttataaagcgttacacgatatcagattttcacagctcaatggcaatatggcatctatgtatgcagatgctaagatacgggagatcctttcactttttttggccgggcaggaagaagaaaattatcttcattgctcatgtactatcgggataacatgtgataaaattcatcatgctagggccattattgagcaggaatatctaaatcctccgtcacttcaccagctggcattgcgggtgggtaccaatgaatgtacgcttaagcgaggatttaagacagtatttggtacaaccgtatttggtcacatctttgagtatcgcatgaagatggcttgtcgctatctattggacagcagtaagacgatacaggagattggggcgtgtgtcggttatgaatatcatgctcatttctctactgctttcaagcgaaagttcggacttactcctttggaatacagatgtagccgattgtccggttcttga

SEQ ID NO: 4540 - DNA, 216 bp, B.fragilis
tcggagcctgtaacagagttgaaagtgtccaagtcagtagatgatgagataggcataccatctactacgtacaatggagtattatctcctgtaaatgaacgtgaaccgcgaatagtcattttagaagaagcacccggcatacctgatgacggagatatttccactcctgaaaccttaccttgcaaagcgctggaaaggttgctgcttgaagcctga

SEQ ID NO: 4541 - DNA, 729 bp, B.fragilis
tttgaaagagttgatggaactattgtaacatttatagatatattgtatttttgcgttcaatatagaacgcataaaaatacaactatggacactctcttacctttcgctttactctgttttacctctttctttacgttgactaaccccttgggaacaatgcctgtctttttgaccatgacccatggtatgactgataaggagcgacaagctgttgttcgccgtgctactttcgtttcgtttatcactttaatggtatttgtttttgccggacaattcctttttaagttctttggtatttctaccaatgggttccgtattgcaggtggggttatcatttttaagattggttttgatatgttgcaggcccggtatactccaatgaaattgaaagacgaagagattaaaacttatgcggatgatatttcgattactccacttgccataccgatgctttgtggtccgggcgcaatagcaaatgctatcgtgctaatggaagatgcccatacgattgagatgaagggaacgctaattggcattattgctttgatttattttattacttttctgatattgcgcgcttctacccgattggtcaaagtgttgggcgaaacgggaaacaatgtgatgatgcgtttgatggggcttatcctgatggtgattgcagtcgagtgttttgttagtggattacacccgatattggtaggtatcttgaaagaggggctgctttaa

SEQ ID NO: 4542 - DNA, 570 bp, B.fragilis
tgcaacacattattcatctgttccatacttcctccgaacaattcacgggagaagcgaaacgaatcattcaagctgatcgaacgacgcaaatcacctgcagttttgatacgttcggccaagatgggtgaagaagccactctagtctcaactttcacagtcggttcctctgattgtggaaccgataccgattcgaatacttcttctttttcatcagccacaggatcaagttccacagtaggtagctgttcgataaccgcttcagacaaactcaacggcccaggctcgactgcctcctgggagtcttctgctactgcggcttcttcgtttttttctggaatgtcagccacagtttcttttaaagccgggatttccacaacctctattgtttccgttacaggtctgttctccggactttcagaagcgtcggccgctatcacaggctttgcatccaacagctccaataatgcatccaatcgtcctcgcatttgcacaatatttcttcgtgccactccgcgcaaaacggaatccggttcgcgtgaaatgatttccatcaggtacttaagctcctga

SEQ ID NO: 4543 - DNA, 762 bp, B.fragilis
gatctcgcatttaacttctcaaaaatcgataactacgttgataaactggcgcccggtgtatcaagcatcatgttaggaggttttgttgatccgcaggtacgtttgagcgcaggagacaaattcccggttatctatggtacaagctatcaaagaaacgaggaaggccagattgttgtagatgaaaacggtatgccgacattaggtgaaaacagagtattaggaaatgtatctccggacttcagaatgggcttcaatacaacatttgaattctacaaattccgtctttcggccgtactcgattggaaacaaggtggatgcatgtatgccggatccgtttcaacactcgattattacggtgttactcagaaatcagcaaactatcgtaaagcagatcacttctactttgagaaaccggccgttaaacaattagccgacggttcttatgcacccaacgatattaagatcagcggtgaaaatgcttataactatttcgacagactgagtacaatctctgaggccggagtatatggttcttcattcctgaaactacgtgaaatcgccctcagctatccggtactgaataaatcttatttaggagttacagtgaatgtctttgcacgtaacctgttgctttggtcagaaatggataatggtattgaccccgaatcatcacagggaaacaacaacatggccggtgcctttgagcgtttctctcttccgggaacatcaagctatggttttggtattacagttaaattctaa

SEQ ID NO: 4544 - DNA, 4083 bp, B.fragilis
tgcattatatctaacatgaaatacatttatcgaacatacttgtcactactgtattttctttgcttactattttgcctgcctttgaaggttcatgcatacagtttgagacaattttccaatagagatggtctttcaaatagtgctattctctctctttatcaggatgatcggggcatcatttggatcggctcttgcgatggcatgaatatctttgatggaaccgacatacatttgtataccccaataaactcttccaaaaccttactttccggaaacttgataaatcaaatcatcgaatcggagaaggatatattatgggtgcagactaattatggattgaatcgcttagataccaagcaacagaccagtcagagtttcactgaattcaaagggcaatactttatggctaacaataaggatgacatgctttttattctgaaagatgatggctatctttattattatcagcgagaagcacaatctttcaatagattggaaattcccaatcttgaatttagccatgtactctctatgactgtagattcaaacgatattttatggatatttacctccaatgaagagactcaaagttatcgtattgagaatacaaaacaggggctgacattaacccgtaagaatctttttacgcattcgtgtaaattataccatgcctttgccgagaaagatatggcttactttattgacgaaacctacgctctttacgaatatgattttaataaccggcaagcatactatatagctgacctaagaggtcagattgaagtgcatggggaagtatcttccatcatcaagcaaaaaaacgattactacatcggtttcaaaaacagtggtctcattgttctaaaatatatgtcctctcaaaagatgaaatatcagatacagaaaacagaaatacattccggtattttctgtctgatgaaagataaatttcaagatattgtatggataggaacagacggacaaggtgtatacatgtattataatgacaccttttctattaccaatactcttttagacactcctgtatatcaaataagtaatccggttagggctctttactacgatcaggagcaaacgctttggataggaaccaaaggaagtgggatactccgcattaaaaagtatactccggataacagtatgcctatgtcgtctgatcggattacaccatataatagtgcgctggcagataattccgtctattgttttgctcccggatacaaagataaattgtggatcggaaccgaaaatggaattaattattattcgtacttaagcaggcaattaaaagaactgcctatcattgccaatggagaaaaagtgaagtatgtgcattctataaaacaaccgaatgatacgaccttatgggtatctacggtaggtgaaggcattgtaaaagttatctttgatgcttctactgctactcctactgtaaaatctgcttcccgtactgttattgataacgggcgtatggcttcgaactatttctttacttcttaccaggaaaacgactccatactttggtttggcaatcgtggttgcggtgcataccgcatgaatgtagagacaggggaaatgattccgcatcgttttgacagtattgtaagcagtcagacagctaacgacatttttgctatttacaaaaacgcaaaaggttattggttaggaactagctcggggttgttgcatcttgaacaagatgattccttatgtacgaaagcggacttatttttaaataacactgtacacggagttttagaggaccaccaaggcgatctttggttgagtaccaaccagggattgatacgcttcaaccccgagactcgtacagggcaaacctataacagtggaaatggattggaaatcaccgagttcagtgatggtgctttctataaagatgtcgtttcggaaacactgttttttggaggtacaaatggttttatttccattcagacaaatgactgtatcaccgaagagtatatgccgcaaatcaccctgaaaggactgtctatctttggcaaagaacacaatattcataagtttctttatgaaaaggaaggtaaaacaattcttcaactggattacagtcaaaacttctttcagctaaattttatggctattgattacatcaatggcaacaactattctttttattataagcttgaagaaatgagcaaccaatggatagaaaacggaacatccaccagcgctattttctctaatcttgctccgggtgaatattctttattagtaaaatacaaaaacaatataaacgggcaagaaagccaaacacaatccgtcattatccgtatcactccgccgtggtatctcagtccgctggcctatatggtatatttcattctatttgcactgttgtgcactgcagggatatataggctcatttatatataccgtcgcaaacaacaccgtatgttggacaagatgaaccgggagaagaaagaagaaatctacgaatcaaaattgcgttttttcactaatatcactcatgaattctgtacgccactgaccttgatttatggtccttgtgagaagatacttgccaatccggagattgacgcatacactcagaagtatgcaaagatgatacaacaaaatactgaaaaactgaataatctgattttagagttacttgaatttcgcagattggaaactggcaataaagtactttctattcaacagttatccgtgtcggaaaaggttagaagcatagcggaatctttcgaagaactggctgaaaataaagaaatgaattatcagttgcatatttctccgggcattgaatggaatacggatatcagttgctttaataagattgtcagcaatttaatatccaacgcttttaagtacacgcccgacaaaggaattatcacaatagagttgaaagtggaaaaccagtcgttaattttttgtatatccaattctggaaaagggatagccaaagaaaatttatccaaaatattcgatcgttataaaatattggattctgttgagatgaacggtaagaattctcgtacaggacttggattagctatttgtaagagcatgattacgcagttgaatggggaaatcagcgtaaatagtgttctctatgaaatgactacattcaccgttaccttgcccaatcttcccataactgaacgggacactacacaaactacttatgaaaccagactattacatacggctacggaggaacctattgttttagaaaagactgccatagagtttgatatgggtaaacggaccatcatggttattgatgatgataattccatgttatggttcgtttcagaactttttgcagacaaatacaatgtgcgctcttttgataatgcaaaagatgcattgagcagtctggagcagaagcaacccgacttaattatttcagacgtcatgatgcccggtatcgatggactatcgtttgctcagaagataaagcaacacaaattatggagtcatattccactgatcctcctttccgccctacatcacgaagacgatcaggtaaagggcatcgagtcaggagcagaagcctatgttaccaaaccttttaacgtgaagtatctggagaaaatcgtttatcgtctcatcaaacgggaggcagacttgaaagaatattatagctctattttcagttccttcactatggaacatggcaattgtatacataaagaagatcaggagttcctggataaaatgctcgagattatagagaagaatattgcaaatcccgatttacaagtggaattgctaagtagtgagatggggtatagtacccgccagttctaccggaaactaaaaccgataaccgaacagtctcctgctgatatcattaaggaataccgtctaacaatggcagaacgactgttaatagccaagaatcttactattgaagagattatggaccagaccggattcaacaaccgcggaacattctataaactgttctcgaaaaggtatggcatgcctccgcgacagtatagagagcaacaaaaggaaaatgtaaagaaggagaagatatcgggcatatcagacgaatag

SEQ ID NO: 4545 - DNA, 666 bp, B.fragilis
ttcgtcaaatcaataaatctgaaaattatgatccggctggtagcttttgatctggatggtacgataggagatactattccgctatgtttagcagcattcagagaggcgactactccttatgtagatcatgaactatcagatgacgagatagcgcggaccttcggattaaatgaagaaggtatgatcaatcaagtggtttccggtaatagtcgggagaaggcattaaatgatttctatgtaatttatgaagaaatgcatgccattttatgtcccaagccatttgaagggatgaaaacattgatcgggcaattacatgaaagaaatgtaatagtagttcttattacggggaaaggtataagaagttgtgatattacattgaaacaatttggtatggatgggtgttttgaccgaatagaaaccggctcttctgaaaagaacagaaaatcagaagcaatgaaggccatatcattatattatggctttaagtcgaatgaaatgatatatgtaggagatgcggtttctgatatcgaggcatgcaattccgtaaagatacagtgtttgtcagcggcatgggctgcatcgacagactgtgagcagttagaaaaatataattccggttatgtctttagttcagttcggttattacgggattttctactttgttga

SEQ ID NO: 4546 - DNA, 477 bp, B.fragilis
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgtgtcttcaccacggggctggaaggatccacgcgtgggtcagcaa

SEQ ID NO: 4547 - DNA, 1296 bp, B.fragilis; identical to SEQ ID NO: 845

SEQ ID NO: 4548 - DNA, 567 bp, B.fragilis
gttttattttatttgtcttcaatcgtatcattgggttatatttataatttaccttttacaaaattagctatattggataacggaacaaataaaaaacaagctatttttgccttatcaatcaagttattacaattcatcatggaaaaagactttcaaataccgactctggaagccatagagtctttgatgggaaaaggactttatcaaatatggaatgctctctgtcttttaattgagcataagtatgagatggaacgattgtggaacagtggtgggagaaaatggaactatgaatataagtatcgaagaggtggaaaaactctctgtgctttatacgctaaagaaaattcctttggctttatggttatattaggtaaaggagaacgtgataaatttgaaatgtcacgagaactgttctcaaaagaagtacaaagattgtatgatgaagcaactgtttatcatgacggtaagtggattatgtttgagttgagaaataccggattgtttagtgatatagaacgccttttagaaatcaaaaggctaccaaacagaaaatcattatcttaa

SEQ ID NO: 4549 - DNA, 1503 bp, B.fragilis
cttaaatttctaaactatatgcaaataaagaagttatttatagctttaggtatagttttgcccctgcacatgcaggggcaaaacttcctcattaaagatgctccggaagtaatcgagtcttacgtcaatcaattcaatcgtgaagataatgaattgtataaacaagatatccctaactgtggtgcatctgattttttaagaaagaatattccattttttgagtgtccggataaggagctggagaaaacatattattttcgatggtggacttatagaaagcatataaagaagactcctgacgggttcgttattactgaattcttgccggatgttccttgggccggaaagtataataccatcagttgtgcggctaaccatcatttctacgagggccggtggctgagaaacgctgaaattttatctgattatgcttctttctggttttctggtagcgggagtccgaggctatacagctttggggctgcagacgctatctacaattactatttaattcacaatgataaaatgctactggccgatttgtatcccaagctaaaagataactttgcaaagtgggaagaagaaaagcgggattcgactggaatgttctggcaggttgacgacagggatggaatggagatgtctgtttccggacatttgtcagaaggtggacgtggttatcgccctaccattaacagctatatgtacggtgaggctgttgcgttggcaaaaatagcttcaatagtagatcgtgacatggaagcccggacctatcagaagaaggctgataagttaaaaggaataataaaccggaggctatgggataaacaggctgatttctataaggttatacctctaaatggcaagatggaattctcttatgcacgtgaacttcttggatacattccctggttctataatataccgccggatgactattccatagcatggaaacaactatttgattccaagggatttgaagcagcctatggcccaactactgtagaacagcgttgcactgatttcaagatttcatacgaaggacacgaatgtcaatggaatggtcccagctggccctatttgacttccatgacactgacagcaatggctaactatttcaatagttatgattctcccatcatcactaaaaaagattatttaagtcttttgaacatatacagtaatagtcatcgtattttatcagtcaataacgatacgatttgttggattgatgaaaatatcaatccctatacgggagactggatatcgaggactcgcctgaaatcatggaaaaacggaacttgggatgattctaaaggtggtgtagaaagagggaaagattataaccactcttctttttgtaatttgattatttcaggattaatgggagttcgtccgcaggaagatggaagtattatcataaaccctcttgttcctgatggatgttgggactatttttgtttggataatgtatattgccaaggcaaaaccattatcccttaa

SEQ ID NO: 4550 - DNA, 906 bp, B.fragilis
gtctattattatgtattacttttcgttatatcggtaaaattacgttttttagactatatttgtcttatgaaaagagaaaacttacatcaaccgtttgagattagtttcagtgagtttgacgagtcaatgctaaaagaacacgaccatactttttttgagttggtctacatcttatcgggtacaggtatccaatggattaacaataataaattttcttatcacgacggacacctatttatgataactcccggagactcacattcatttgaaatacattccactactaagtttatcaatattaagttcaatgatatctacattcattccgctgttttcggtacagaaaacataaaacgattagaatttatcttacagcatgccaaccaccaacctggctgtattttacgaaatcgaacagacaaactactcgtaaaacctatgattgaagccatcatcagggaatacgtcaatagaaacttatatagcaaagaaatcataacgcaactgataaacaccataataatagtcgttgcacgcaatatcgccatgtttctgcctgaacaagtcaatgaatgctccgaagagaaatcactcggtatactgcaatatatccagacctacatttatcaatccgagaaaatcaaaacgaaagctatcagtcaacatttcggcatttcagagaattatttgggacgttactttaaaaaacacacaaacgaaacaatgcaacagtacatactgaattataaactgaaactggtagaaaacagattattgcatagtgaaatgagaatcagtgagattgtagcagaattaggtttcaccgatgaaagccatttaaataaactatttaaaaaatacagaggttgcagccccacaaatttcagaaagaataatgcagtatag

SEQ ID NO: 4551 - DNA, 1398 bp, B.fragilis
ataactttgtattctaattatttgaaattcatgctgaatacagaaaacatacaaccactcattgatagcggagagggctacaatgtagaatttaaagttcgtgtcccttcaaaagttcgtgaacttacagaggaaatatgtgctttcgccaatgcagacggaggatatttgcttattggagtagataataacgggcaagtaatagatattaatttagaaaacgataagcgttctgccattcaaggttctatcagcgaaatatctcctgcactccactgtgaattgtatcccgtaaatgttggaaataaaactgtttgggtgattgatgttccgtctggcaaggataaaccttatatattttccggttctatctatgtgcgtgagggagcgaactcgcagaaacttcgcacagccgaagaaatgcgcagcttctttcaggagtgtaacaaaatcttcttcgaccatatcccctgccattggttcaatatctacacggatgcagatgaacagatgataaaggatttccgaacggaagccaaactaagttcgtccacacccgacaaacaaatttttgagaacttggaactatttaccgagaacggaacggcaaagaatggagcagcgatgttcttcggaaaacaacctgaacgaaagtttccacacgctgttacaagatgtgttcttttcaagggaacaaataaagtctatattatagatgataaaactttcggaggttcattgtaccaacagtatttacaagctatgtcttggctggaaagcaaactgcaagtagcttataaaatagagggagcaggaccaagagaggaaatttgggaaatccctctgaccgtatttaaagaagctattataaacgccctgtcgcaccgtgattactacgaacaaggcgcaagcattatgatagaaatgtttgacgaccgggtagagatttccaatcctggaggacttttgcctattgtagctaaaaatttcgggcataaaagcatgacacgtaacccactaatattcgggttatttacccgtatacacttggttgaaagagttgcatccggtattcctcgtatgcaggaagccatgagagaagcgaatctgcccgaaccggaatttcatacggaggggatgtttacggtagtatttaaaagagctatcagcatcaaacatgatactgtaaatgatactgtaaatgataccataaactcaaaagaaaaagaagttctaaaaattatcaaacaatatccgggactcaattcgtctaagatagcggagttaataaataaaagtgttcctactgctaaacgctatttaaattctttagttagattagatttgatagagtttaaaggggcacagaaaacaggtggttactatttaaaaatataa

SEQ ID NO: 4552 - DNA, 252 bp, B.fragilis; identical to SEQ ID NO: 860

SEQ ID NO: 4553 - DNA, 252 bp, B.fragilis; identical to SEQ ID NO: 860

SEQ ID NO: 4554 - DNA, 678 bp, B.fragilis
ataaagttaaattatagtgttgcggaattaagggtatctaaaatatcaaaagaagatagtttggttttaatatctgcagtttcaccaatcagaaacaattataatgaaaattgcattctactaacaaatgatgcagattttaattcatggtacgaacaagctaaagataaaatagataatgtgttcactgaaaagtctatgcctaaacctcatttgaagcacataaaatcagcacaactatttgacaagcaatttaatttcacagataataaattagatattacaggatttgaagtatatgccaataagtgtattctttcattattaaaaaatcggctcaaagatttttatatcggaaaatcatttactccttatggggcttgtcctccacagacattcgcctttaaagcagaaaaaggagtttatctacacaatcaaaaatatgtaacaataataggaaaagatcttaattttattctaacgacgaacaagcagattgatttttggcataaaaatgcaaaaatagatgatcaaggtatcctagtttcagtaagaaatcaaatatattcttttatctttcctttgtcagcagacattttgccagatgatattgacgctatatttcatttaatacagactgaaggacattttgttttctatcatcccgattcattataa

SEQ ID NO: 4555 - DNA, 1050 bp, B.fragilis
tatccatacctttgtttttccctgtctgtagggagggggaaaagcaaaggtaaaaaacagaaaatgaatatgaagaaaaatgtaattcagacattgattagccttaccgtcatcatcggaatttgtagttgcactacctccccaaagaaaacaatacaaaaagaggaggccacaggaaaatgggtaaaatatgaaaataatcctgtcttgggtggtggcgatttaggtacggtattcgatatttgtgtactgaaagatagtgactcttataagatgtacagttcttggcgcccccaaaaaagtattgcattgtccacaagtaaagatggaaaaaattggagtgcgccgcaaatagttttgccacctgttgaaggcagtagttgggaggctgacatgaatcgtccggttgttgtttacaaagacggactgtatcacatgtggtatacgggacaaaatgacggtaagtcatggattggatatgctataagtaaagacggctataactttgaacggcaaagcaaagaaccggtcttgtcagcggaacagccttgggagaaagttgcggtcatgtgtcctcatgtaatttgggataaacacgagaatatttttaaaatgtggtattccggaggagaacaatatgaacccgatgctatcggttatgcaacgagtaaagacgggttacattggactaaatgggacaaaaatccgatatttaaagccgatcctgcacaaagttgggaacagcataaggttaccgcatgtcaggtgatagaacgcgaaaatgattatttaatgttttatatcggtttctatgacattaattttgcgcagataggaatggcacgttccaaagacggaatcaatgattgggaaagatactccgaaaacccgatcatttctcctacggaaggtgggtgggatgccagtgccacttacaagccatttgccattcaagagaaagactgctggatgctttggtacaatgggcggaatgaacatttggaacagattggtttggctatttatgacaatcatgacttaaatttctaa

SEQ ID NO: 4556 - DNA, 216 bp, B.fragilis
tcctatctcgatctttatccaatccggactggttgcatcatttctctccttttatattgctttgcagggagaagttgtggagcaagtccggattcggatactattttgatagaaatggcaatctcttcgggagaaaacatttatcatgcacttgagaattatttgtccggcatgtattatctttgtgaacccactaatgcattatatctaacatga

SEQ ID NO: 4557 - DNA, 1173 bp, B.fragilis
agaagtatttttctttattatcatacttttgaatttaaaatgagcaagagatattgtcaaagttgcggtatgccacttcgttttgatatggaagaatggctgggaactaatttggatggttctaaaagcgatacattctgttactactgtctgaaagacgggaaatatacagttgacgtgtcgatgcacgagatgattgatatttggcttaaatacgtaaataaatacaatatgtatgcccatacagtttattctcccgaagaattgaaaatgatattggagaaaagactgccgacactcaatcggtggaaacaaaaacaagatacgaagaatgttcataaccaagctattcaaagtatagttaattatattagcaatcatctgtttgaagattttgatataattacattgtgccaaaagtgcggaatgtcagaatatcattttagaagggtattcaaatttattgtcggtgaaaatataggaaattacatacaacgacttagattggaatatgctgcacacttattgacttcaaccgaatatacattatcccggatagcggaactggcaggttatcaaaacaaatacagtattgcaaaagcattcaagaagcattttggagtttcaacatccttatttaaagaaagatttacacctcgaaaacgaaatgcacatacatcgctaactcccagaataataatgattaataaaatgtttgtttcttgtttggaagtggggaaagcatacgaaaataagtttcaatataagatggtatgggataaactgttgtattatgcaaggttcaataggatagacaaaaaacacacgaactttgtcagtttaagtttggataatccggcaataacaccggaagataaatgccgtttctatgtaggtataattatgaatgatataccggatgccaaattgaatactgtacaaatccctaatggacgatatgctatattccggcatataggtagttatgatttcttatgtgatttatatagaataatttatgaagaatggtttcctgatagtcagtactatccccaaaacacatttagttttgaggtgtatataaattctccatgtgatacagatgtaccggaattgataactgacatatatatacctgtcttaaagaaaaaaatattcactgatattaaataa

SEQ ID NO: 4558 - DNA, 357 bp, B.fragilis
accgttatcagggaaaggacgaaactttcaagacattgtatattcaaggagcataacgacaactgtcgaaagctaatcggaacggactatgccaacatcaccgtaagacattacgataattgccttaaacatctcatgaaactggttaaacgtgactacaaggtagatgatatgctactgcgtgaggtaaacggggaactggtgtatatcctttttgtcatgttcctttcggataaagtctgccagtccattaagaaactcggtcagtttgcccggctttcgctttatcacgtcctcatgcttttggtaacaatcgcctatcttgatattgaacagccattcaacccctttggataa

SEQ ID NO: 4559 - DNA, 339 bp, B.fragilis
aaacgattcggcatgtcgttcttcatcaagcgtagcaaactgttaaaaaacggggaagcatccgtgtgtgtgcgtgtcacttatgaccgcctatacgtggaacttcaactaaagcggagcataaaagtcccactttggctgcaggaaaaagagaaatcgacaggcaaagacctaaattcagtagaacttaactattacattgacgtcctgcgtgtgaaattctatcagatttacaaaaacctggaaccggagggaaagattatctccgcacgtgccatagtgaaccgttatcagggaaaggacgaaactttcaagacattgtatattcaaggagcataa

SEQ ID NO: 4560 - DNA, 474 bp, B.fragilis
tatagtatgggaaagatttcagaaatcgcactgtttcaacaatctgaaacgtatgcattagttgtggaaatacgtactactgtaaaagaaatagctatggttattggcagaagctttatggaaatagaaacgttgtttaaagaacaaaatgctgtaatggcagatgttccttttgtggaatatcttaattttgaatccatgtcagaaggtattcacatgattattggattcaaatcagctaaagtcctgtgtggaaaggggaacataagagcgattaccattccgggcagaaaaatagtatcttgcttacataaggggaactatactgaattagcttctttgtatcgtgagatgcaggaatggattgcggctaaaggttataaatcttcaggggcatcgatagaatattattatagtaagccgggaacttcagaagaagaactggttactaaggttgaaatgccagttttgtag

SEQ ID NO: 4561 - DNA, 1977 bp, B.fragilis
aaacgaaagggtatgaaaaacaaatgtatgctagttgtaattttactgatcttgtcaggtacagcatttgcaaaaatagtgctgccacctattttctctgataatatggtgttgcagcaacaaaccaatgcccccatttggggtgaagcgcagcctatgaaaactgtaaaagtaaccacctcatgggatgggaagacgtatgcggttcaggctgataaagcaggaaaatggaaagtaactgttcacacgcctgttgccggaggaccatacgagattgccttgacagatggtaagaaagtaaatttaaaaaatgtgatgattggcgaagtatggatatgttcgggacaatcgaatatggaaatgccattagggggatggggaaagattacaaattaccagaaagaaattgcagaagccggacactctaatatacgactcctgcaaatagaacaaatcaacagtacccaaccggaaacgaatataaaagtccgcaatgacagttggcaggtttgttcaccgataaccatccctgagttttctgctacggcttatttctttggcagagaaatctcagagaaacaaaatgttccggttggcttgatacatacttcttggggaggcacaaacgttgaatcctggataagtggagaagtcttgaaggagatgccggaatttgtgaaaacagtggagtccattcagaagatgccgggtgataagaaaatactcaaagcagaatatttaaaggagctcactgcctggaataaccgtgtggacgaaggttttgctgaaggaaaaccggtaagagctgctgcatcattagatgacaaagattgggaaagtatgaatttcccgggtgaagtgggtccacaattggccggctttgatggagttatgtgggttagaaaagaaatcgaaattcccgctagttgggcaggtaaagatgtacaactatccctgggggctattgatgataatgatattacttattggaatggaatagaaataggccgtacagatgggccgactcttcaacgcaaatacatcattccggaaaaaatggtaaaggctggaaaagcaatattagccattcgagtattggatacaggtggtaactgtggcatttggggagacctttatcttcgctctacaaatgatgaacagattagtctgtccggtgattggaaatatcaggttgctgcggatactcataaggtaggggcacttccggtagacagatccgtagatcccaatttaccgacttccctttataatgcaatgattcatccactgatatcttatggtattcgaggagcaatttggtatcagggtgagaataattcttccagagcctatcagtatcgggaacttttcccattggtaatagagaattggcgccgggattggaaacaggattttccattctattttgtgcaactggccaattttatgcatgaagtttcccaaccggcagaatcagagtgggcagagcttcgtgaagcacaaatgcgtgcattggcagtaggcaataccggtatggctgtaataatagacagaggtgacgccaacgacattcaccctaaagataaacaaaccgtaggacatcgactggctttgattgcccgtgccaaaacatatggggaaaaagtgccttattccggcccgatctatcgctcccatcagattgtaggaaataagataattctttcttttgatcataccgatggtggattgaaaagtagcgatggcaaggagttgaaaggctttgctatagccgggcgcaatcatgaattccattgggccaaagctgagatagacggagacaaaattatagtcagtgcacctgaagcggtaccttatccggttgctgtgcgatatgcttgggccaataatccggtctgcaatttgtataatggagcaggacttccggcttcacctttccgaacagatgactggagaggaattacacaaaaggattaa

SEQ ID NO: 4562 - DNA, 1545 bp, B.fragilis
aaatataatattatgtataaaattacattgaaaaacataaaagcaattactaatttagaatttcattttcctgaaaaaaatggtgtatatttgttaacaggaacaaatggttgtggtaaaacaacacttcttattgcattaaatagattaggtgacaatctagcattcagcagaaatcttagaacaagttctgccggctttgattctttcaaagatgctcagattatttatagtacacaaaatgaatctgttacttatcatcgaacaggaattagatgggttccaacccccaaaagtaaaagcaatttaattaagactttcccttgccaaaatatattatatttgagtacatctggtttaagattttatgcacaagaaccaaaagatttaaaagactatcatcataatacagttagtgatgaaataataaatcctttaaatgatatattacagactgaaaaatttcgcaatcttaaatatataaaagtaaaaaatataaaagggaaacaacgccgtttacatagaaacaataaattgtatgttataaaagattctcagagtaattattactctgaacaaaattttagcttaggggaaagacttctattaaatacacttgattttattgaggcaattaaagaaaaaagccttcttcttattgatgaaatagaattagctttacatccaattgcgcaagttaaattttacaattacttagaacatatagctaaagataaaaaactaatagttatcatatcaactcattctagttcgcttataaagcatgccaaacaaagaatctatcttgaaaataataatggacagatttctgttttaaacaactgttatccagcttatatactccgagaaattgctacagaagaagattttaaaccagattttatcttctttgtagaagatattatggcacaaaggtatatgcattatttattatctaaatatttaaaagaaaaaaatagcaaccttatatgtaaagtcattcctgttggagggtatagacaagttgtcgaacttatggaaaaatatccaacgttatcttaccctataaacaaaatgcaatcaatgcttgacgcagacgtcaaagatacttacagagaaatattaagaaaatctgaaaaaacagatgctgatgtagcatttatcgacttgtttagaagaaataaaaaaaatatcagtttcttatccattacgccagaacttggtacttgggaatggctgacttccaattctaatatcttgcaacaaaatatagaaagtaaatatgggagattatcttttaatttaacaacaaaaatacaaacagttgaaagagaagaagctggaaacaaaaatggcaatttgcgtaattgggcaaaaggctgttttaaaaacttagcatcccaaatatgtccattaattgtagattttcaagaaacagatttatttaaatgtatttttgaaagttatatagaggattttacatctgattcaaccaatatgaataaaatcaaggcttttttgggtaaaatattaaaccgaaaataa

SEQ ID NO: 4563 - DNA, 213 bp, B.fragilis
cgatcgaatattttggataaattttctttggctatcccttttccagaattggatatacaaaaaattaacgactggttttccactttcaactctattgtgataattcctttgtcgggcgtgtacttaaaagcgttggatattaaattgctgacaatcttattaaagcaactgatatccgtattccattcaatgcccggagaaatatgcaactga

SEQ ID NO: 4564 - DNA, 249 bp, B.fragilis
tattctgatatgaaaaatttattagaacagagatttttccggctattgtcggaatgctcgcagcgcaaagtttctgttttcgagttggcagaagctattgaggaattggctatgcatgtagccaattttggtatcaacgaacaggattacagcgttttactccgatatttttcctttggtttacatcgtcttaaatcgtaccgtatgcggtttgagcaagaaaaaaatgccctatttgcatttaattga

SEQ ID NO: 4565 - DNA, 225 bp, B.fragilis
acaatgaaaattgcaaagaagttgttattggtgatttcttatataatatatcttctttcttttgtaaaaagaagaaaagaaattatctttgtcctcagtattctccatgagcgaactaccgcaaaagctcatagcaaattaatgagaaaattcatggaatatgctgaaataaaagaatataaagctttaaatattagcgtggtaactttacaaggagaattctag

SEQ ID NO: 4566 - DNA, 663 bp, B.fragilis
aattgttactttcttataaatccgcatgggagggaacgaatgaaaacagagatggagaaatgcttggccggtgaatggtatgattgccatgctccggtttttctagaactaaaaggaaaaactcaccgtttgttgatgagatacaattcactgtcttatgaacaaaaagaagaaaaatatgcgattctgaaagaaatgttcggtagtatcggaacagaggtttccgtaggacattcttttctctgcgattatggatgtaatattcatattggtgataatgttacggtaaatatgggctgtgtgtttgtcgattgcaataagattacagttggtaataatgtactgattgctcctaatgtccagatttatacggcaacgcatcccattgatttgaatgaacggttaacacctgttgaggcaccggagggagttcgatatgtccgtcatacatttgcccttccggtcactgttgaagatggttgctggatcggtggtggagttattatattgcccggggttactattggtaagggaagtgttattggtgccggaagtgttgttaccacaaatgttcctgcaaacagtctggctgttggaaacccatgtagggtgattcgtcaaatcaataaatctgaaaattatgatccggctggtagcttttga

SEQ ID NO: 4567 - DNA, 513 bp, B.fragilis
gatatgaactttttagaacttacaaaaaaacgtttctcggtgagaaattataagtcagacagggtcgaacaggataaaatcgactatatcattgaatgtgcccgtttagctccttctgcagttaattatcagccttggcatttcatggtggtggtcagtgaagaacaaaaacagaatttacggcaatgttataatagagaatggttcgcacgggcaccggtatacattgttgtttgtgccgataaatcgatagcatgggtacgtaaatccgataacaaaaatcatgcggatatcgatgctgctatcgctacagagcatatctgtttagccgcagccgaaatagggctgggaagttgttgggtgtgcaactttgatccggaattgtttaaagctaatttcaggctgtcgtccgaaagatatccggtagctattgtatcattgggatatatccaagagcaacctgatcattttactatccgaaaggacaaggatgaaattgttactttcttataa

SEQ ID NO: 4568 - DNA, 783 bp, B.fragilis
tctcgcaccgtcgtgaagacgaaggatacaacggttgtgttcataaagccgaatattaccctttccggtgtagagaagtgttccacaggatatgaattggccaaaggtgctgatcccgatgccaacgaacaggagaccatttcgggaagtatcaaaggaagtatcatttttcgctatgctgaagcactgctgatttatgcagaggcaagagccgaactgggtaacatcacacagaatgatttagacattaccattaataaactgcgtgatagggtaggtatgccacatctcacactttccgtaggttataccgatccgaagggagactttacggcagcaagaggttatgagggggtaccggtttccaatctgctacaggagattcgacgtgaacgccgtatagaattagcatgtgaaggttaccgccacgatgacttaaagcgttggcgtgcccaccacttatggaatcacgatagaatacagggggcaaacgctgctcagtttgaaaacctggattggttagtgaagtatttccaaaacgacttccacattcccgccgcaatcaataaggcagatttcatggaaaaggtggggcattggagtcccgaacgtaatcaggacaactactgggtggacagtgaaggttattttgaaccttatcaacgccacattccggacggacattttcatttcgacccaacaaaagcgtatcttcagccgattcctactgaacaattggtgttgaatcctgacttgaaacaaaatcccggctgggaaaaatag

SEQ ID NO: 4569 - DNA, 525 bp, B.fragilis
ccaattttggtatcaacgaacaggattacagcgttttactccgatatttttcctttggtttacatcgtcttaaatcgtaccgtatgcggtttgagcaagaaaaaaatgccctatttgcatttaattgatgaagcgataggacttctaaacaccgaaatacgccttatcgaatggcgtatcaaatacacggaacaactacaacaacgtgctaataagcaattcctttcccctctttttctcgctgacaaaacaacccttatcaacattatggaaatggtaagcggtctgttcctctccaaaagcatcatatatcagaacggaaagcctgcctattgggtggacttatccaaaggggttgaatggctgttcaatatcaagataggcgattgttaccaaaagcatgaggacgtgataaagcgaaagccgggcaaactgaccgagtttcttaatggactggcagactttatccgaaaggaacatgacaaaaaggatatacaccagttccccgtttacctcacgcagtag

SEQ ID NO: 4570 - DNA, 1965 bp, B.fragilis
aacacatcatttagtatgaaaaaacaattactgctgctattaatttttagtatttctttgtatattcagggacagaacatacacaagctggcttcgccggatgggaatattcagatttcagtgaatctctcagataaaatctactacgatgtcatttgccggaatgagacattgttaaagcagtgtcaccttgcaatggaaatcggtgaccaggaattgggaacgaatcctaaaatgactaaagtaagccataagaatatagacgagtctttaaagcctgttattccattgaaattttcgtctgtaagtaatcggtacaaccaacttcttctagacttcaaaggaggttattccgtagagtttcgtgccttcaatgacggaattgcctaccgttttataaccaataagaaaggaatgatcaatgtgaagaatgagaccctccaagtgaacttccctgataattatttgctacacatgcaacagtccggaagttttaaaacggcttatgaagaagaatatacccatttgtatagcaaagaatggaaatcatctgcctcaatggctttattgccaattctgattgatactcaaaaaggaagtaagatattaatcagtgaaacatcactaaccgattatccggctgtttttttgaaaagtaatggcagcaatggtatggtttctgtatttcccagagtacctcttgaatttggagaagacggtgatcggagtgtcaaaatactgaaagaagccgactatatagcacaaaccagtggaaagcgtaatttcccttggcgctattttgtcattagtacagaagatagccaactcattgagaatacgatgtcttatagattggccgaaaagaacatattggaagatacttcctggattaagcccggattggcaagctgggaatggtggaacggtgctactccctacggaccggatgttaattttgtagcaggatgcaatctcgatacttacaaatattttattgattttgctgctaattatggtataccatatattattatggacgagggctgggctatgagtacccgtgatccctatacaccaaatcctgcggtagatgtgcatgaactcattcgttatggcaaagaaaaaaatgtaggcattgtgctttggttgacatggctcactgtagaaaacaatttcgggctgtttgagactttcgagaaatggggtgtgaagggagtcaaaatcgacttcatggacagaagtgaccagtggatggtgaattattatgaaagagtagcccgagaggctgccaagcaccatctgtttgtcgattttcatggggcatttaagcctgccggattggaatataagtatccgaatgtattgtcttatgagggcgtaagaggaatggaacaaatgggtggatgtcgaccggacaacagcatatatctgccttttatgagaaatgcggttggtgcaatggactatacgccgggtgccatgcttagtatgcaaccggaaatttattgttccgaacgtcctaattcagccagtataggtacacgagcttaccaaatggctttatttgttattttcgaaagtgggttgcagatgatggcggacaatcctacactttactatcgcaatgacgaatgtacccgatatattactcaagtcccgcagacatgggatgaaaccattgctttgaaagctaaggctggggaatatgtgattgtggcaaaacgtaaaggagataagtggtatatcggtggcatgactaacaaccgacagcaagagagaacctttgaattggattttgacttcctgaaagaaggacaatcttatcggatgacttcttttgaggatggggttaatgctaaccgacaagctatggattacagaaaaaaagaatatactcttaaaaaaggagataaaataatagtgcgtctggcacgtaacggaggatttgcctctgtcattgagtga

SEQ ID NO: 4571 - DNA, 357 bp, B.fragilis
aaaatccggacgcactgcaccgaggatattatgcgtgctgtcaaagcagcgcctttcaggaacaggcccgtccgcagattgaactttgctgcctggtgttctgctattgctgcaaccctgcttctcggtttatgggtggcagaggcagttgctgtcgatccgattctatcctcagaggtgactcgtataccgaagccctatcaagagcaaacactcaccgatgagcgaaactatgagagattgatgacaggagagaagcgggagatcttcttttccgcgtcccgaagccggaaaaagaagatgtttaaacgggaacggctttatacccggtacgaacagataatgaagaatgaataa

SEQ ID NO: 4572 - DNA, 297 bp, B.fragilis
gaaaggagggcatccgggcaaccagatgctctctttttttgttatattttatatgcgaacccttcaaatgttaatagtatgaaacatctccggatcatctgtataccgacattgacttttgcccggcttctgatgtttactccctctatcttgcaggcgcaggataagcctgtttttcccattgattcacttattacagtaggatatgcttccggaaataagaaaaatatttccggttcagtagaaaaaattacggagttgggcatgaataaagatcagataaccgatccgctgtag

SEQ ID NO: 4573 - DNA, 2367 bp, B.fragilis
  unsure (2344): Identity of nucleotide sequences at the above locations are unknown.
actttaaattttgaatgcatgaaacaagtaaatcttagaatctatcaaactattctgactttattagtaggactgtttctttcggcaggtgcttacgcacagcagatctctgtgaggggaatagtaaaagatcagatgggggaacctgtgatcggtgccaatgttctcgtgaaaggaacttctaatggagttattacagacatagatggtaagtttgcattgtcggctgccaaaaatgatatcttgattatcagttttgtcggttttatgagtcaggaaatcccggtaacgggaaaagatttgatggtaactttgaaagaagataccggacttctggacgaggtggttgttttgggatatggcgcgaatgcccggaaacaagacttgtcagcggctgtgggtgtattgagtaacacggatgacttgacggtgcgtccggttagctctacggaaagtttattgcaaggtcagttagcgggtgttacggtacaatctaatggcggtgatcctacatccactccttctattgttattcgtggacaaggttctcaaaatggtgacaacgtactttgggtagttgacggcgttccgggtgctcctattgcttcaatgagtgatattgaatctattgtcgtattgaaagatgccgcgtctgctgctatttatggtgcgcaatcaggtgcgggcggcgttatcctggttactaccaaaaaagctaaagcgggtattcctactcttagctatgaaggtacttacggcattcgccaggctacaaatttgccggaaccgttaaatgccgaggaagagttggagatgcgtaaacgctcttatgccaacgcgaatgtgactttacctgacggttggaatatagaaaagaatccatggatcggtactacccgtacaaactggatggatgagatttttcgtacagctttctatcagcgtcataatattgctttaaatgtaggtaccgacaactattccagtcgcttatctttttcatttgataacgatgaaggtgtattgattaatacttataataagaattatgcaattcgttataatggcaagtttgatttgaataagtgggtatctattagtgaggatttggtatggaagaatactgagaatcgttcaaaagatacaaacgacgcttatacaggtcctgttttatctgcaatttatatgccggcaagtgctactgtctataatccgttggatggtacttggggaggtactactacggaggatcctgaatacatagctaaatatggaagcaatttcgccggtgctcatggtgatgcggtcaatccggtacgtttactgagagctgaaaaccgttttaatagaaccagcgatgtgtggagcactaccagtttgcagatagccaatataatacagggcttgaagtttaccagccgttttacttataatctgaaaaccaataattataagaacttccgtcccattcaagatgaaccgggtaaacctaataattcaaatagcctggatgtaaccaactaccgtacagatgcttggaaaacggagaatactctaacttatgataatagtttcggaaaccatacagttggtgccttattctctactacagccgaccattataatgtacgcggactgaaagtaaatggtaagaattttgctgatgaaagtccgtatctgcagtatctggcatatgcaggaactacttctgctacagattatttgacagggcctgatgccaacgtttcattagtagctcgtctcgcttactcttatgatgatcgttattttgtgacggcatcttggcgtcgtgactatgccggtcgtttaccgaaagagaataactttggtgatttccccgcagctaccttagcttggaagatttctaatgaaaagttctttaaaaagagtgatttcatcggtatgttgaagttgcgcgcttcttgggggcgtgtaggtaatttgggttctattgactataattacaagtcactcttattaggaacatcatactggcaagaacaagctcaatatggtgtgataaataatgcaacctggaataattttgtatataattccactgcaatgaataggaacttgacatgggagacttctgaacagtgggatttaggtttagatgttgaactgttcaaaaatcgtttggcattgtcttttgattactttgataaacgtacctttaacttgattcagaagcaaacaatgatttggccaagttctatcggattggacacgttgttgattaataaaggtgagattcgtaatcgtggtattgaaaacaagctaactggaaccgatcgggttaataagatttttcctacttcgnggccgggaatttttcatatctga

SEQ ID NO: 4574 - DNA, 1794 bp, B.fragilis
aaccaaacgtatatattaataaataatagtattgaaagaatgaagaaactaccttattttgtatcatttgcagctgcctggctatttatagcagtggcttctgcgcaagagaatccggtagattatgtaaatccgttcgtcggaacgacgaattacggaacaacgaaccccggagctatctgtccgcagggaatgatgtcggttgttccttttaatgtgatgggggacaaatccgttggtaataaaatagataaagacagccagtggtggtctacaccttatgaacataccaatacctatttcaccggattctcacatgttaatctgagtggagtaggatgtccggagctgggctccttacttttgatgcccacaaccggaaaattgaacgttgattatttacaatacggaagtgcctataaagacgagaaagccactccgggttattactcaaatgttctgactaaatatgggattaagaatgaggtttcggctactttgcgtaccggaatcagtcgttttacttttcccaaaggagaaagtaatatccttttgaatctgggtgaaggattgaccaatgaaaccggggctaccgttcgttttgtcagtgacaccgagatagaggggagtaagctgctcggtacattctgttataatccgcaggccgtatttcccatttattttgtgatgcgtattaacaaaactcctcgtgcacgtggctattggaagaagatgcgtccgatgacggtggaagcgcagtgggataatacttccggtaaaaataagctgtatactgcttataccaaagagatgagtggtgatgatatcggtacttggtttacgtttgataccgacgaaggtgaaacgatcgaagtcagtatgggagtgtcgtttgtcagcatagccaatgcccgtctgaatttagagaaagagcaggccggaaagggatttgatcagattcgtgccgaagcgcgtgccatgtggcagaatgatctttcacggattcttgtagaaggtggtaccgaagagcagaaaagagtattctataccgccatgtatcatttgttgattcatccgaatattttgcaggacgtgaacggacaatacccggctatggaaggtagcgagattcttacgacaaaaggcaaccgttatactgtattctcgctttgggatacctaccgtaatgtacatcagttgatgacactgcttttccccgatcggcagttggatatggttcgtacaatggtagatatgtacaaggagcacggatggttgcccaaatgggagctttacgggcgtgagacacttaccatggagggtgatccgagtattcccgttatcgcggatacctggatgaaagggttgcgtgactttgatgtacaagcagcctatgaagctatgtataagtctgctacgacacctggcaaagataatttaatgcgtcccgacatagatgattacattgcgaaaggatatgtgcccctgacagagcagtatgataattctgtatcgtatgcactggaatattatatagccgattatgcgctctcacgtttttgccccaggcgctgggaaagaaagaagatgcgaagttattctacgaccgttcgctgggatataaacattactactgcaaggagttcggtacattacgtcccattttacccgacggaacattctattctccattcgatccgatggaaggagccaattttgctccgagtcccggttttcatgaggggaactcctggaattatacattttatgttccccatgatattgcaggcttga

SEQ ID NO: 4575 - DNA, 567 bp, B.fragilis
gctatggaacagaatgagatacaggtattggtagaaaagagcaggaggcaagatgcaagtgcatttgctttgcttgtggcggaatatcagactttcgtttttcgcttggctttccgtctgttgtgcgatgaagaagaagcccgggatatggtgcaggagacttttttacgtgtctggctttcattggataagtaccggccggaattccgtttctccacctggctttacagggtagcatgtaatatctgttatgatcgtctgcgggctttgcagcattctccggccggtgcgctctctgatattacatttgccgaactgcctgtctgttccgatgataatattgaagccacgttagtcaaccgggagctgaaagcccatatcctgtacttcatgcaccaagtgacccctaagcaaaagcttgtatttccattgcgggatatcgaggagttggaaatcaaggaaattgagaagatcaccggatttacatctgtccagatcaaggccaatctctatcttgcacgaaaaagtatccgtaagaagttgaacgaaataaataaagaaagatga

SEQ ID NO: 4576 - DNA, 1080 bp, B.fragilis
aaacagatgcatatgaaaacgaatagacttttatcgatattgctgttggcggtttcaatggtgtcttgcaccacttattatcaggtgaagacccggattcatcctgatggttcggcccatagggaagtatatgcttttgccgattctgcattcatggccggagatccgatgaaaaacccttttatgttttctttggattccggttgggtagtgacacgtttcgattctgtccgtactcacaattattttggagaagagggaaagattaacgtatgtgccggcagggaagagccttctgtcagcatgtttgcggagcaggttcatcctaaagatccgatataccgtcccttggtgactcctcaggagacactgaccaaacattttcgttggttctacacctattatacctataccggcatctatccggaattggcagataaaggccccgtacctctaaagaactacctgaatgaatcggaacagaagctttggttccagggtgacgacacagcctatcgcggaatgaacggattggagatgaaagaattgctcgatcggttggaaaagaaattttacgactggtacaaccgaagtctttatgaattaagtttcgaagttatccggccttttatcgctgagatagatcgggggaagtatatgtcccgtctggatgaagttaaggattcattgtatctcggctatcaacctaaagatgatgatccggatcctgatccggaactcatttgccaattgctcgatacgcattatcataccgactgtttttctctgctttataaggaaaagcaacaggaagtagataaacgctttgacgaagagacacgtccgattgaattgttcggagccgtgattcaatatgaacttaaaatgcccggacaaatgatctcagccaatacaactttcagagatcgcgaatatctggtttggaaagtggatgcttaccgtcttttggcgggtgaatattccttgacggcccgatcacgggtacccaatgtctgggcctttatccttaccggtgtactgattcttttgggaataggcttttggataaaaaagcgatga

SEQ ID NO: 4577 - DNA, 2520 bp, B.fragilis
  unsure (204): Identity of nucleotide sequences at the above locations are unknown.
aataaaaacaaatcaatcatgaacaagaaaatcaaaattgcatttgcttcgatgctcgctgtgccgctgttggcgtgtgcgcaagtccgtacggaacaaacctttgagaagggatggaagttcactcgtgaggatagtaaagactttagtaactctacgtatgatgatgcgaagtggcaatctgtgaccgttccgcatgattgngctatttacggaccattcagtattaataatgataaacagaacgtagccatttctcaggatggacagaaagaggcgatggagcatgccggacgtaccgggggacttccttttgtcggtgtgggatggtataggctcaattttgatgctccttcattcagtaagggcaaaaaggctactctggttttcgatggagccatgagtcatgcacatgtctatatcaacggacaagaggccggttattggccttacggttacaatagtttttatgtggatgccactccttatttgaaaccgggtgaaaagaacacattggcggttcgtcttgaaaacgagaacgaatcttcacgttggtatcccggtgccggattgtatcgcaatgtacatctggtagtgaacgaagatgcccatattcctacttggggtactcagctgactactcctgtagtgaaagatgaatttgcaaaggtaaacctgaaaacaaaactcgatgtaccagccggaaaagcattcgaaggatatcgtattgttaccgaactgaaggataaggatggtaaagtggtggcagccaacgaaaagaagggaggtccgttcgatgacaatgttttcgaacaagatttcgtagtgacttctccggctttgtggactccggatactccgcatctttatagtgccgtttctaaagtatatgaggggaatactctgaaggatgaatatactacttcattcggtattcgttccattgagattattccgaataaaggtttcttcctgaatggaaagaaaaccatgttcaaaggtgtgtgcaatcaccatgatctcgtaccgttggtaggtattgccaatgatgccggtattcgccgtcagattcgtatcctgaaagacatgggctgcaatgccatccgtacttcacataatatgcctgctcccgaattgattaaagcttgtgatgaaatgggcatgatgataatggccgagtcatttgacgagtggaaagcagccaaagtacagaatggttatcacaaagtgtttgatgaatgggtagagaaagatctggtgaatctgattcatcagtatcgcaataatccgagcgtggttatgtggtgtatcggtaatgaggtgcccgaccagtggaacggtgaccgtggaccgaaactgtcgcgcttcttgcaggatatctgccatcgtgaagatcctacacgtcctgttactcagggtatggatgctcccgatgcagtagtcaataataatatggcggctgtgatggacgtagccggttttaattaccgtcctcacaaatatcaggaaaactataagaaacttccgcaacagatcatcctgggtagcgagacagcttctaccgttagttcacgtggcgtttataaattccctgttgtccgtcgtgcgatgcagaagtatgacgatcatcagtcttcatcatatgatgtagagcattgcggttggtccaatcttcctgaagacgattttatccagcatgaggatttgccttattgcattggtgagttcgtatggaccggattcgattatttaggcgaaccgactccgtactataccgattggcccagccactcttcgttgtttggaattatagacctgccgggacttccgaaagaccgttattatctctatcgcagtcattggaataaagataaggaaacgctgcatatcttgcctcactggaattgggaaggacgtgagggtgaagttaccccggtatttgtatataccaattatccttcggctgaactgtttattaacggcaaaagtcagggtaagcgtacaaaggatctctccgttacggtaaacaatagcggtgactctacttctgtggccaacttcaaacgtcagcaacgttatcgcctgatgtggatggatacgaaatacgagccgggtactgtaaaagtggttgcttacgataaagatggcaaagccgttgctgagaaggaaattcatacagccggaaagcccgatcacattgagttggtggcagaccgtagcgtgattgacgccaatggtaaagacctctcatttgtgacagtgaaggtagtcgataaagagggtaatctttgtccgctggcagacaatgagatcagtttcaaggtgaagggagcaggtacttatcgtgcaggagccaatggtaatccggcttctcttgagtcattccagaccccgaaaatgaaagtattcagcggtatgatgacagcgattgtgcagtctactgaaaaagcaggaaagatcacacttgaagcaacaggaaaaggcttgaaaaaaggtacattgctgatcgaaagcaaataa

SEQ ID NO: 4578 - DNA, 879 bp, B.fragilis
aaacctttaaatggatatgctatgaaactgtcaattgatttaggaggaacaaatgttcgaattgcccaagtggagaatggtatctgtttgaacaagatgtctgtaccttgtcttgcgcaacaagatgcttcagcggtacttgatcagctttttcaacttattacgggtatgatgaacgtccaggtggatggtattggtatcggtgtcccttcaattgtagatgtggaaaaaggtatcgtgtataatgtggcgaatatatcttcttggaaaaaaatacatttgaaagatatattggaaaagcgatttatggtgccggttgctattaacaatgactctaattgtttcactttaggcgaaagtatgttcggcgaggggaagccttatgcccatatggtgggagttactattgggacaggtataggtgcgggtgttatcattaatcatcggttgtattgtggtcaatatatgggggctggtgaaataggctcgcttccttatctggattctgattttgaacattattgcagtagttctttctttaagcgacatgacacgacaggtgtagtggtagccgaaaaagcagaacggggagatggggctgcgctggaaatctggagggaatttgggacgcatctgggtaatttgatgaaagtaattctcttttcttatgctcctcaagctattattttgggcggaagtatagtatcggcttttcacttttttaaggatactatgaaggacgctatgcaagatttcccttataaaatactattggacaatgtgaaaataattacttcatatttgaaggatgctagcttattaggagcttccgctttgtttgagaaacaatatttaccaatatctattataaacaattaa

SEQ ID NO: 4579 - DNA, 1704 bp, B.fragilis
cacattcctgatagttcgttattcactaaaaatgtctacctttgtcaccgcgttattttgataataaataaattaaggaataataatagaatgattacagtttctaacgtttcggtacagtttggtaaaagagtcttgtttaatgatgtaaatctgaagtttacaagtggaaattgttatggtatcatcggtgctaacggtgccggtaaatctacttttctgcgcacgatttacggtgacctcgatcctacaaccggaaacattacattaggtccgggcgaacgcctttcggtgttgagtcaggaccactttaaatgggacgcttttacggtaatggataccgtaatgatggggcacacagtgttatgggacatcatgaaacagcgcgaagccctttatgctaaagaagattttacggacgaagacggtttgaaagtttccgaactgaaagagaagtttgccgaactcgacggatggaatgccgaaagcgatgcggcgatgttgctgagcggtttaggtgtgaaagaagacaaacattatacattgatgggtgaattgagcggtaaagagaaagtgcgtgtgatgttggcacaggcattatacggaaatcccgataacatgctgctcgacgagcctaccaatgacttggatatggagaccgttacctggttggaggagtatctctccaacttcgaacataccgtgttggttgtgagccacgaccgtcacttcctcgattctgtatgtacacataccgtcgatatagattacggaaaaatcaatctttttgccggtaattacagtttctggtacgaatccagccagttggctcttcgtcaacagcagaaccagaaggccaaagctgaagagaaaaagaaagagttggaagagttcatccgtcgtttcagtgccaatgttgccaagagtaagcagactaccagccgtaagaagatgctcgaaaagttgaatgtcgaggaaatcaaaccgtcatcccgcaaatatccgggtatcatctttactccggaacgtgagccgggcaatcagattctggaagtttccggtttgagtaagaagaccgaagatggagttgtgctgttcaacgacgtgaatttcaacgtggagaaaggagataagattgtatttatttcacgtaatccgcgtgctatgaccgctttctttgagatcatcaacgggcatatgaaacccgatgccgggcatttcaactggggagtgacgattactaccgcttatcttcctttggacaataccgaatatttcaataccgatctgaatctggtcgactggctgagccaatatggcgaaggcaacgaggtgtatatgaaaggttttctggggcgtatgcttttctccggtgaggaagtactgaaaaaagttagtgttctttcgggaggagagaagatgcgttgtatgattgcccgtatgcagttgcgcaatgccaactgtctgattctcgatactccgaccaatcatctcgacttggagtctattcaggcattcaataacaatctgaagacttacaaaggtaatatcctcttctcttcgcatgaccacgaatttattcagaccgttgctaatcgtgtgattgaattgactccgaatggtatcatcgacaagatgatggaatatgacgaatacattacttccgaccacatcaaagagctgagagccaagatgtataagtaa

SEQ ID NO: 4580 - DNA, 207 bp, B.fragilis
ggaagtgatgagttcccgctcgggagcatggccaagaggttcggggaattagttcgtcagccacataaagtagtgaagtcggaggctgtggtttttagaaactacgcatggaatggggaagccaaagatcgatacatcggctatcaggctcatgccgtagaagagtttgaaggctgggtgtttaccaacaaaatcgttgtagaataa

SEQ ID NO: 4581 - DNA, 1188 bp, B.fragilis
aatatggcagaaaaaagagattattacgaagtgctggaagtcacgaaagagtcaacagtcgaagaaataaagaaagcataccggaaaaaagccatccaatatcatccggacaaaaatccgggtgacaaggaagcggaagaaaagtttaaagaagcagccgaagcttacgacgtactgagcaacccggataaacgtgcccgctacgaccagtttggtcatgcaggaatgagcggagcagccggaaacggtggaccattcggcggattcagcggcggaatgtctatggatgacattttctctatgttcggtgatatttttggcggccatagcggcggcggattcggtggtggtttcggaggctttggcggatttggaggcggaggttctcaacagagaaaattccgtggctcggacctcagagtgaaagtaaagctgaatttgaaagaaatctctacaggagttgaaaagaaatttaagctgaaaaaatatgtgccttgttcgcattgccatggaaccggggcggaaggaaacagcggttctgagacttgcccgacctgcaaaggaagcggatcggtcatccgcaaccaacagacgatcttgggaactatgcagacgcgtaccacatgtccgacttgtaatggtgaaggtaagatcattaaagacaagtgtaaggtttgtggaggagaaggcatcgaatatggcgaagaagtagtaaccgtaaagattcctgccggagtagcagaaggtatgcaactctctatggggggtaaaggaaatgccggaaagcacaacggtataccgggtgatctgctgattctggtagaagaagaaccacatccggaactgatccgtgatgaaaatgacctggtgtacaacctattgctaagcttccccacagcagccatcggaggtgcggtagaaataccgaccattgacggcaaagtaaaagtgaaaatagaagcaggtacacaaccgggtaaagtgctccgcctgcgtggcaaaggtctgccaagcgtaaacggctatggtacaggagatttattggtcaacgttagtgtatatgtgcccgaaacgttgagcaaagaggaaaaaagcactctggagaaactggaggaatcaaagaactttaaaccgagtacttcaatcaaagaaaagatattcaagaagttcagaagcctctttgactaa

SEQ ID NO: 4582 - DNA, 1635 bp, B.fragilis
gttatgaaaagtcgttatatatgtatgttcgcctgtctttggggactcggttttctgttttcatgtgatggttttctgaatgagaatcctaaagataagattcctgaggaagatgcttataagaatctaacagatttatattataatgcagtggcctccttgtacaataacatcggaggttacagtgatagccagggtttgcaggggaccggcagaggaatttacgatctgaatacttttaccactgatgaggctattatgcctacacgtggcggtgactggtacgatggcgggttctggcaaggacttttcctgcatcggtggggagtggataatgatgccattcaagccacgtgggaatatttatataaggtggtcagtctttgcaatcagtcactcgaacggatcgatacgtaccagcagacccataacgatgaagaactgcctgtctatcgggcggaggtccgcgctttccgtgctttgtattattatcatttaatggatttgtttgcccgtgtccctttggttctttcatcatccactcctttgaaagaagtgaagcagaacagtcgcaaagaagttttcgattttgtagtgaaagagctgcaggagtctgaacccttgctggaaacggcatatagcaatcgttccggcaattattacggacgcattacacgtcccgtagcctgttttttacttgctaaacttgccttgaatgctgaaatatatacggataataattggaccgacggtcaatttcccgatggaaaagatatttattttgaagtagatggcgagcggctcaatgcctggcagacggtagaggcttattgtgatgccatcactgcaatgggatatcggctggaagataattatgaagcgaactttgctgtttacaatgaatcctctgttgagaatattttcaccatcccgatgagcaagactctgtataccaatcagatgcaatatctttttcgctcccgtcactacaatcatgccaaggcctatgggttgggaggagagaatggttcaagtgctactgtggaagtccttcgtacgtttggatacgatacagaggcagtcgatcctcgttttgacaaatgttattttgccggtattgtatatgacctcaaaggaaaagtcgtcacactcgatgacggtacccagctggaatatttcccctggaaggtggatgtcgatatatctaatactccttatgaaaagactgccggagcgcggatgaaaaagtatgcgattgatgaaactgccaccaaagacggtaaactgatggaaaatgatattgtactctatcgttatgccgatgtattactcatgaaaagcgaagccaaggtgcgtaatggagaaaatggagatgaagaattgaaccttgtccgttctcgtgtgaatgctcctttccggacggctacattagctaatctattggccgaacgtcagttggagtttgcatgggaagggtggcgcaggcaagatttgatccggtttcgtcaatatacccgcacttatacgggcagacctcaactttcgggtgagaagaatggttatactacggtatttcccattccggaaaaggttcggttaatgaaccccaatctgacacagaatccggggtattga

SEQ ID NO: 4583 - DNA, 252 bp, B.fragilis
tttatacagagagtaccctataaaatgttgcccggacttacatctcctgatgttgcccgggcaattttatatctgaacaaaagaactatttacctgataaatagacttttctgctataatgatggattatcttacgatttagagacagccgcttccaacttcccgtccttgttagctcaataccccggattctgtgtcagattggggttcattaaccgaaccttttccggaatgggaaataccgtagtataa

SEQ ID NO: 4584 - DNA, 2526 bp, B.fragilis
gcgattcgcggacgtgttcccggacttaccatacaaaaaggaaccaacggaccggcagctttggatgccgtacgtttgcggggaactacttcattgaccagtggtaacgaccctttgatcattgccgatggtgtatttggtgacctcagtatgctcacttctatttatcctaccgatatagagagtttcaccattctcaaagatgcttccgagacagctcaatatggctcccgcggtgcttccggtgttattgaaatcacgacaaagaaaggaatccggggtaaaaccagggttagctacaatgggagttttggtatctcttctgtctacaaaaatctggaaatgctctccggaaatgaatttcgtaatctggcccggcagcaaggtgttgccatactcgacaaaggaaatgaaacggattttctgaaagagatagaacagactggtttgcagcagaatcatcatgttgcattttatggcgggacggatgcttccagttatcgtgtttcgttgggctttatggatcgtcaaggtatcattctgaatgaagatatgaaaaacttcacttcgaatatgaatatgacccaacatgtgtttgacgattttttagtctgtgaactgggtatgtttggctctattcaaaagaatcataatttgtttgaccttcaaaaaacgttctattcggctgctacttttaatcctacttatcccaatcaccgaaatccggagactgattcctgggatcagattaccaatgccagccagatcactaatccactggcttggatggaagtgaaagatcatgatgctacatcacatatcagtacccatgcccggctgacttttaatttatttcgtgaactgaaactgattcttttcggttcttatacctataatattgtagaaaactcccaatatctgcctacggctgtgtgggctcatggacaagcatacaaagggaccagaaaaatggagtcactgcttggcaatctgatgctgacttacaaaaagaaatggaacaagcattattttgatgtactggcactggccgaactgcaaaaagaaacttatagcggcttttatactactgtgaccaatttcaataccgatcagtttggttacaataatcttcaggcaggtgccatacgactttgggaaggaacaaattcttattttgaacagcctcgactggcatcttttctcggacgtttcaactatacgtttgccgaccggtatatcttcacggtgaatgcacgtaccgatgcttcttctaaatttggtgccaatcataaatggggattttccccatccgtatcgggtgcctgggttgtcagtgaggaaaagttcatgaagcgtattccgttggtcgataatttgaaacttcgcattggctacggtttagccggcaatcagagtggcattgactcctatacgacacttaatttggtgaaacccaatggagtggtacctgtcggtagttcacaagtggtgactttgggtaatatgcgtaataccaatcccgatttgaagtgggaagtaaaacgcactttcaatgcgggagtagatcttggtatgtttggcaaccggcttcttttctctcttaattattataattccaaaacctctgatatgctctatctgtacaacgtcagtgtaccgcctttcacctataacactcttttggccaatattggttccatgcgtaatagcggtacggagatagctgtcggcctcacccccttgaagactcaggatatggaactgaatgttaatgtcaatgttacttttcagcaaaacaagttactctctttaagtgggatgtacggtggagaaaatatctcggcgcctgaatacaaaagtttggcaagtctcgacggagccggatttcatggtggatacaaccatattgtctatcaaatggtaggtcaacctttaggtgttttctatctgccccattgcaagggacttattgccgatggaaatggcggatatacctatgacattgctgacctgaatgggggaggggtaagtcttgaagatggtgaggatcgttatgtagcaggacaggctgtccctaaaactttactcggttccaatatcagtttccgctataagcgtttcgatctgtcggtacaggtgaacggcgcattcggtcataaaatctataacggcacttcactgacctatatgaatatgaatatttttcccgattacaatgtgatgaagaaagctcccggacgcaatatcaaagatcagactgctacagactactggctggaaaagggagactacatcaattttgattacgttactgtcggatggaatgttccggtaacgaagtggaaaaagtatgtgcaatctttccgtctcgcgttcactgtcaacaatctggctactatcacaggctactccggtctgtcacccatgatcaacagttctacagtcaattctaccttgggtgtggatgataaacgggcttatcctttggcgcgtacctatactctcggtttaagtattaatttttaa

SEQ ID NO: 4585 - DNA, 1044 bp, B.fragilis
tctactatgggacggaagtatttgcaatccttttatgtattggccttgattatatcggcattgttctttcctgctttttctggagataataatattaaaactgccggtgccaatatgagctatggcaatagacttgtaatgcagacaggacataaatctgcaaatcttgtttccggtgtagaaaaagttgagtggatgaaggtacttcaagatacgcttcctgtctgtaagatatctattcccggcacgcatgatagtggttctaccaagggaggatgtatgctgaagacgcaaactgcggatattcccgctcagttacagaaagggattcgggcatttgacatccgtttgaaggagaagaatggtaaattaggagtattccatagtcatgcttttcaggatatatattgggaagaagatgtattgttggctttcatcagtttcttgcaagcgcatccttctgagactttaattgtgtcactgaaaaaagagggaggggagataaaggattatgcctctttattatctgcgtctttgaatacgcctgcatatcagcgttattttattgcggatttccatccggaactgacattgaaaagttgccgtggtaagatactttttttgcatagagatcatgcgatggataattacccgggagccgcctgcatcggttgggatgataatactacttgcctgttgacccttcgtaataaagatggtaaagaagctactgtttttcttcaggatgaataccaatacaactcgggcaaagaagcgggcaaaaagattgcggcttgtattcgtaattttgatagaatatgtgaagaacaaactttttcacgccggtgggggatctcttttgtgagtgctaccggactgcattcgggaataccgctggttttcgcgaataaggttaataaaccagtggcggattatctgaaggagaaccgtaaacgaaattgtggcattgtattcattgattttatagaaagttcgggaggacaaaaattagtggaatatctcattggaggtaatatctattga

SEQ ID NO: 4586 - DNA, 258 bp, B.fragilis
ttaatggaggggcatttggttttgaaggttcgttggtttgtaccgtattggcaacactttttacactattcattatctggtggttcgaacattcatcacaggggatgcggaggtattaaggttattgcttggatacttttctttttccgcatttggaaatacgaaatgacaattgttaaatttcagctctctgtcttgtacggattggcatcggcaaatgatattttgaaagagttattgcatatttgcgcaaaatga

SEQ ID NO: 4587 - DNA, 1062 bp, B.fragilis
acatttatcataaatatgaaaataaaacatctgtttataggaatagcccttactgccaatctatttgcagctacggcacaagaagttaagaaaacgtatttcgtcagcaaaccgggaacattgatttcgatgatgacggaagaggaagcgaaccaggtcacccacctgaccctgaccggaaagatcaatgcagtggacttcagacatctgcgcgacgaatttaaaaacttacaagtgctcgacatagctaatgcgagcatcagcatgtactcgggtaaagaaggtacctatccggataagttctatatttatatgccgaattttgttccggcatacgctttctgtaagatggaaaacggcactgccaaaggaaaatccactctgaaaaagatcattctttcggaaaagatcaaaaacattgaagatgcggcttttatgggctgcgaaaatctgaatatatgccagattaaaaagaaaactcctcctaacctactgccggaagcattggcagacagcatcactgctatctttgtaccactgggagcaagtgatgaataccggctgaaaaaccgttgggataactttgcattcatcgaaggcgaaccactggaagctaaaatagaggtaggagcactaagcacgctggaaaatgaaattcagaaagcaggactacagccgaaagaaatcaacttcctgaccatcgaaggtaagctggatgcagccgacttcaagttgatacgggattatatgccgaatctggtagctgtagacattgaaaaaaccaatgcaacggccatccccgactttactttctcacaaaaaaaatatctgctccgcatccgtctgccacatggactaaaaagcatcggacaacgggctttcagcaattgcggccgtctctgtggaacggtagaactaccggaaagcattactgctatcgaatatggagctttcatgggatgcgacaggttgcggtacgtagttgctcatggagacaaaatcacaacgataggagataacctttttggagaaggaaaaaataagttgatttataaacgataa

SEQ ID NO: 4588 - DNA, 879 bp, B.fragilis
attaacaaaatggaacaacaggatcacgaatcattcttttctccgaaagggattccggcatttgcaagcattattatctttttggtaagcttctttatcgtcatgtccctattccattccgttctgaatcttttttcggtagtaagagggtacggaatgggttatttttttattggagaggggattatgttgttgagcgtatttattgtaacctttctgatgatgcgatttctggatcgccgtcccttctccgatttaggattcagcctgaaagggcgtggcaaagatattctctacggtttcctggtggcagtgctcatttatgccattggttttggtgtttgcctgctgaccgggcagattgaggttgtcagtgtccatttgcattggagcgatttgctcttaagcgggttgtttttcgccatggttgccattgtcgaagaaactatgatgcgcggatatgttctggggcgtttgttgcgtacgcgtctcaataaatttatttctcttctcatctcttcccttttgtttgcgttgcttcatctgatgaatcccaatgtggcttttttacccatgctcaatctggtgttgggaggtttgttactgggagcttcctatctttacacccgtaatctttggtttcctgtttcgcttcatttcttttggaactggattcaagggcccgtacttggctatgaagtcagtggcaatcgtttctgtgaaaccttgttttcacttcgcctgcctgcaaataatctgattaatggaggggcatttggttttgaaggttcgttggtttgtaccgtattggcaacactttttacactattcattatctggtggttcgaacattcatcacaggggatgcggaggtattaa

SEQ ID NO: 4589 - DNA, 786 bp, B.fragilis
ttctgtatcgtatgcactggaatattatatagccgattatgcgctctcacgtttttgccccaggcgctgggaaagaaagaagatgcgaagttattctacgaccgttcgctgggatataaacattactactgcaaggagttcggtacattacgtcccattttacccgacggaacattctattctccattcgatccgatggaaggagccaattttgctccgagtcccggttttcatgaggggaactcctggaattatacattttatgttccccatgatattgcaggcttgacccgattgatgggaggtaagaagaagtttgtggataaactgcagaaagtatttgatgaaggcttgtatgatcctgccaacgaaccggatattgcctatccttatttattcagttacttcaaaggagaagaatggcgtacccagaaacaggtgaagcgtttgcttgccgaatatttcactgaccggcctgacggtattcccggtaatgatgataccggtacgatgtcagcatgggctattttcagtatgatcggtttgtatcctgattgtccgggaatgcctgattatacgctgactacacctacgtttgacaaagtaaccattcagttggatccgaaatattataaagaaaaagagctggtcattactgctgtccgtccgggagataatgccgatctgattaaggaggtaaaattgaatggaaagaaacatgcaggttatcgtatcagtcatgaggagttggtacatgccgggaagatagaatttatattaaaataa

SEQ ID NO: 4590 - DNA, 768 bp, B.fragilis
acatttttagtgaataacgaactatcaggaatgtgtcaatctgacataaaagtattacctttgctgcgttttttggcaaaacagacaaactggcaaagtttttgctgcaaagccagtacatcaaaatgccgtattgacatgaaactaaatccgtttaacaagaataaaaacagaatagatatggatccgaaagaaaagaaaaccaagcaagaagaagagttgaaagtagacgatattcaggataccgttgaaggacagtcgcaaaacgaagaagcaactgaagcaaccgaaccgctgaccgcagaggaaaagttggaaaaagagctaaaagaagctcaggctcaaatcgaagatcaaaaagacaaatacctccggctctcggctgaatttgacaactaccgcaaacgtaccgtcaaagaaaaagccgaattaattctgaatggtggtgagaaaagtatcaaaagcattctgccggtaatcgacgatatggaacgtgcgctgacaactatggaaacagccacagacgtaaatgccgtgaaagagggtgttgagcttatatacaataaattcctgtctatcctgtcacaggatggagtgaaggtgattgaaaccaaagaccagccgttggatacagactaccacgaagccattgctgtgattcctgccccgacagaagaacagaaaggtaaaatattggattgtgtacagaccggatatacactgaacggtaaagtaatccgccatgcaaaagtagttgtgggagaataa

SEQ ID NO: 4591 - DNA, 894 bp, B.fragilis
catatttgttcttttcatgccattaaccgttttttatcttccgtcatcaagtatccccaaattttatcgtctctttccctaatttacatttacgttcacccaaagaacgagatggagcgtgagttcaacaacgatatgctgaacagggccgaagccatccgctgtatccgggtacagtcactaatcaataagaagttcgatttcttagacaagcacaaaatgaaagcagacttcattgactacttcgcaaaaatgatgcaaatcaaagatcagaaatggaaaatggtctacgctcatttctcaaactttgtacagggcaaatgtaattttggtgaagtaaatgtggatctctgtaaacgctttcgggcttacctattaaatgccaaacagctaaaacatactacacgcaaagtatcgctcaactcggcagcaggctactactccaccttcagaggtttgtcgaaaatcgcctatcgtgataaattgctccgtgagaacatcaacgactttttagagaagattgagtatgaagacgtaaaaaaagagtatctaacattggacgaggtaaaacaattagcagccaccccctgcgacatccctgttctaaaagcggtctctctgttctcctgcctaacaggatttcgtatcagtgacataatgaatctgcaatggtcagacttcggtattgcccccgatcaaggctactgtattcgcatccgtactcaaaagaccaaaaccggagccacactccccatcagccacgaggcttttgaactatgcggagaggttggaacaggtaaagtatttaaggggcttggccgaagtatgataaattatccattgaaaaactggctaaagcaaactaagatattgaaacatatcatatttcattga

SEQ ID NO: 4592 - DNA, 1722 bp, B.fragilis
gtccgattatcaataggtctacatacaaaaagctgttacaagacaagtgcttgtgacggccttttttcgtttgaaccaattttaactcttcgtttgaaaccaagctatctcttagttgttgtacactgcaacggtataacggacagagatatgtttgggaaatcagatgatttaaaggatatgaggaaatggcgggtatggaagctgaagctgatagatgctcgtctttattttgtcagtatattcgtaggactgttgacaggactggttgctgttccttatcattatctgctacaattgtttttcaatacccgtagagatttttttgattcacatccacattggtattggcatattcctattttcttgtccttatggggaatacttttgtttgttatgtggctggtgaaaaaaatgcctttaatcaccggtgggggcatccctcaaacccgtggggttattaatggacgtatctcttacaaacatccttttattgaattggtgtctaaatttgtgggaggagtgctggctttgagtgcgggattgtctttagggcgtgaaggaccttccgtccagataggttcttatgtggggtgccttgtatcgaagtggggaagagtattggccggtgaacgaaaacaactgctggcagccggtgccggtgccggattggctgctgcttttgccgctcctttggcttcatctttactggttattgagtctatcgaacgttttgatgcccccaagactgctataactactttgcttgcgggagtggtggccggcggtgtggcaagtatgatttttcctatcaatccttattttcagattgatgccatttctcccggactgacttttttttcacaagttaaactgttcttattattggctgcagtgatttccgtatccggtaagatttattcggttattactgtttggtttaagcgactttatcccgcaatcaagcatccggcctatgttaagatgctctatctcttgtttatagcttacttaatatcgcttactgaggtgaatttaaccggtggaggtgagcaattcttgttgggacaggcgatgcatgccgatactcatattatgtggattgtggggatgatgattctgcactttgtttttagcgtactttcattttcatccggattgccgggaggaagtttcattcccactttagttaccggagggttgatcgggcagatagtcgctttgattctggtacgtcaggggatcatcggatacgaaaatatcagttatgttatgttgatatgtatgtctgcctttctagttgctgtgatccggactcctctgacagccattgtcttgattacggaaatcaccggacatttggaagttttctatccttctatcgtcgtgggtggactgacctattattttacggaaatgttgcagatacaaccgtttaatgtgacactttatgatgatatgattaattctcctgaatttcaggaagagaaacgttatacactctctgtggaagtgatgagtggttcgtattttgatgggaaaacagtcaatgaaatacagttgccggaacgttgtgaaattatcaatatacaccgggacaggaaagatatacccccggcaaagcagaaacttgttccgggggatcaggtgcagatcgagatggatgcacaagatattgaaaaattatacgagcctttggtaagtatggccaatatttattga

SEQ ID NO: 4593 - DNA, 183 bp, B.fragilis
tgtgttatgttcgctatggaatcagcttgctctcttggtaatttctgtgccggtcgttctgaatttctgttgatacggagtcggttatgtagaataactcacgttaattctataggtaggatcctaaagtactttcatcggtatatggagattatattcgattttaacttcattgtaagttag

SEQ ID NO: 4594 - DNA, 243 bp, B.fragilis
tgcttttctacggaaacaactatatataattcatatttaacatttgaagatatacttttcaaataccttaatcttttatatactaaagtatatatgaatatacttggtgttaatcaagtaagcttattttttacctatgcatccattactttgctatttctaggagttttttcgatagctgatacattgagagttcgggcattaaagataaatgctacaggcaagacggtatttcaaaactaa

SEQ ID NO: 4595 - DNA, 915 bp, B.fragilis
actctgtctacagaaagcaactggaataataatttagcgatgaacagagaacaaaagatattatctctattagatcagttcaaagggctggggatagatcaacagatagactataacaagttctatctatactctattattacccattcaactgctattgagggttcaactgttactgagattgaaaaccaacttttgtttgatgagggtataagtgccaaaggtcgttcgatgactgagcaactgatgaacttagatctgaaagcggcatacgaacaatcgatagtctttgcaaagagccatagcgatatttctgttgatatgcttaaaaagctatcttccattgttttgaagaatacaggtactatatacaatactccattgggggaattttcgtcagcgaatggtgatctgcgattgctgaatgtaacggcaggcaccggagggtgttcttatacaaattactcgaaggtacctactaaactggcagaactttgcgagaatataaaccaaagacgaaagtctctttcaaaaacagatattattgagtgttacaagctaagctttgatactcacttccatttggcaacgatccacccatgggctgacggaaatgggagaatgtctcgtttgctgatgaatcggctacagtttgaacttgacattattcctttcaacatcaataaagaccataaaactgaatacattgaggcttttattgctactcgtgaaaatgatgatatagaactattccgtggttttatgtttgatgaacatatacgcaatctggaacagacaatccgtaattatcgggactccccatccgattgtgtaaataaaaaactacaggatttctctcgtagctttctacttacactatattttgagcacttcttattaaaccaaactatatga

SEQ ID NO: 4596 - DNA, 249 bp, B.fragilis
aagactactacgaactctatcagattttatctgctaatcagtatgatgtatcagtataatgtaaaggcactaaaaaaggctataaagcggacttttggaaatcgccacaccgaatacaaaatcgatactatgttctttagagcagaatatcccgacaatgccggaatgcaaatcagatggaaaggtttcattcataagattacaagcagaagcgagttgtctttttcagatgtagttcgctacctgtaa

SEQ ID NO: 4597 - DNA, 264 bp, B.fragilis
aagcaagataccaatgacatgactgtttttctgtcatttcgggcctttcgtttgtattcatctatttcttattttgttaaactcaccatcgaagcaaccatcgcagctatagaagcaatggagctactcatgccaactgctcctgccgtagtcattttcttccgttctcctttgctgggcacaattatttcacacccgggttcaatggcatttgccgtatttcttctcaatcgggagactgtaccattcatatatacaacataa

SEQ ID NO: 4598 - DNA, 1644 bp, B.fragilis
gtttgtgcgactcaattaatatgcaatccgatgaagatttatcataaattctttttatatcagaataaattattgcagccttacgtacgacttttgttacgattaatggcaatcatcacctatctggcctccattatgctgatagtgggagtgatctatgaacatggctttacgctctctgcacatgaagttacgaaaatacatcttctctataagacggtctggattatattcttgattgacgtcaccctgcatatattacttgaatacagggatacgaaaaagaatttccggaaacttgcctggatactgagttggttgttatatctgactctgataccggtcatttttcatcgtcccgaagaaggaggggctatcttgcatttgtgggagttcctacacggctacttttatcacattgtcctgctgttacttttttctcttttgaatttatcgaacggattggtacgccttttaggaaggcggacgaatccttctctgattttggctgccagctttctggtgattattttaatcggagcgggattgttgatgttgcctcgttgtacagtagacggtgttacattatcgtgggtcgatgcactgtttacttctaccagtgccgtatgtgtaacagggctggtgcctgttgatgtgtctgccacctttactccggcgggactgacagtgatcatattgctgattcagatcggcggtttgggagtcatgactctgaccagtttctttgctatgttcttcatgggaaatacttctctgtacaatcagttagtggtacgtgatatggtaagttccaattcgttggggtcattactttctaccttattatatattttaggtttcactctggtgattgagggagtcggtatgctttctatctggttcagtattcatggtacactggggatggatgtacaggatgaactggctttttctgccttccactctatttctgctttctgtaatgccggattttctacattgccgggtaatttgggtaatccgatggtaatgactaatcataattggctttatataaccgtgtcgctcctgatcatttttgggggaatcggtttcccgattcttgttaatttcaaagatattattgtttaccatgcccgtcgcttctggcgtttgattcgtacccgtcaatgggacaatcaccgggtgcaccatttatttaacctgaataccaagattgttctgataatgactgtcttattgcttgttttcggcacggtggccattgcaatttttgagtggaatcattcgtttgccggtatgtcgattgctgataagtggacacaggctttctttaatgccacttgtccccgaacggccggattcagcagtgtcgatttgacttcactcagtatacagaccattatgctttatattgttctgatgtggattggtggtgcggcacagtctacggccggtggtgtgaaagtaaatgcgtttgccgtggcctcactcaacttgattgcggttttgagaggaacagagagagtagaggttttcggtcgtgaattgtcgcacgattctattcgtcgctccaatgcggctgtggttgtttcatccttaattccgcaacactataatttaactttatttataagttcctga

SEQ ID NO: 4599 - DNA, 627 bp, B.fragilis
tataaaatcgcaagtaaaatgaagaatatgaccctgcaagagctttatgactatctgaatagtccggagtttcagaatgtgaaaagtggaaatattttctacaattattatatataccagtatcctgcaaccaaggagtatgaaatgcgacgtcaaattctggtgttcaagcaaaatctggagcgccctagcagttttataaatgccatgttgctcgatctgtttcaagtgttttgcgactatctgaaagcagaaaagtttggtatggattcgttgttcgatcttacattggaggatgacaaagttcaacccgatatagttactactgaattgaccaacgaagccaattccgatcactttattcagtatgtacatcggcgaatagacgaatacatgcaagtaaacgatgggctaaacaaaccatacatctttattcatggcattggtaaaatgttcccgtaccttcgtaccaacaggttccttactcgttatgagaagtataatgatacttctctctacaagatcatactcttctatcccggacatcaagaaggcaattctttctcattgttcgatacattggaagattcgcatacgtaccgtgccacattattagtaaacaaataa

SEQ ID NO: 4600 - DNA, 231 bp, B.fragilis
tgttggctagctgctccaaagtggcatatataccacgacgaatacagaccatattaccttgacggcatattcaaatattttgtagtatgctccacggcccttctccttgacttcagaagaagtgacgaatcgattcctattttcagttatgtccatatcaaacgttatttatctaatgtactacaagatgttgaaagtgtagtgcttttctacggaaacaactatatataa

SEQ ID NO: 4601 - DNA, 207 bp, B.fragilis
aaggaaggagctcttatgtatgcatacgaacgcttatctgctcatcctacattggatattaatttcttaggagctaacatcaataattatggtgaaataataatcagtgcattcaaagagatttgtgctatgccttgcgaagaggataagaatagtgtaaacttcgacctttctcatattactgcacaaaacataactgaattctaa

SEQ ID NO: 4602 - DNA, 1296 bp, B.fragilis; identical to SEQ ID NO: 845

SEQ ID NO: 4603 - DNA, 585 bp, B.fragilis
ttttgccattttaatgctggggtgatatgtgttttgtatatggatgatatgtatttgtttaggtttaaaaatagcgaatataccagtgctgctagatgtggtggtgcacgcgaaacagaagctcttatattgttgaatagcgtgtttgtagcctatgcctctgtttttgacattatggctaaaatcgccatagaacaatttgagtttactaagtacaattttggtaattatagaaaaatgaagagcgcagatactatttacaaaaagagtttgaataatattgatccttctttaaaaactgagggtatgctattttcagagccgccaataataagaaaaataggaacattcagaaatgaatttgtacataatggaccttgggatttgagatgtagtgtttataatactgccgtagatggcaaacctgcagatgttatcatttacagcccagatatggatgaaataggtaatatcatcagttcgggttcacgtaataaattctattctcaagcaaatcgtatcaatattcaactaccaaatatgatacaagaagctactattgtactgaaaaatacgattgaataa

SEQ ID NO: 4604 - DNA, 3597 bp, B.fragilis
tataataatttcgtaagaagaaacaaaatggaaacaaacagattgaaacgtttcgcttccgaagcacgcaacatattgatgagtggcgtaaagcaacgcctctccgcacttggttttcagacagatggctctctctccaccaagctaccagaattaatgggtggcggctccgtctttatgggcgaagtacagagtgaggatttttaccataaatggatgtctttataccaacgcattcaatcccattcttatcgggaggtggcagaagaagcagcttatacatggttcaaccgattgatggccattcgcattatggtaaagaatgaactggtaccggcagtattggaatacgaaagtgacgaggtgcgtattccgcttttggtaagcgaagcccggcaacgacgtttcccgcagatgaatgaagaaagccggcagaaattggaggtcctattaaacaatgatgcgctgaccgacgagcagtttgcggtacttattgtggcatattgtcatagtaatcccatcattcataaatgctttggaactatttctgattatacagagttgttgttaccaagtaatatattggcaaaagacggttttattgataaactgaatgcggatgaatacatcagtgacgaggattatcgttcgcccgaacttatcggttggctttatcaattctatatttccgaacgtaaggatgaggtctttgccaagaaaggcaagtttgaagccgatgagatacctgctgctacgcagatattcacacctaattggattgtgaagtatatggtacagaacactgtggggcgtatctatctcgacaataatccgtatactgacatcaaaaaggagatgcagtatctggtagaacccgccgagccaaccccagccgatgccatctatcagtttgacaatattcatgacctgacgtgtgcagacttagcttgcggttcagggcacattctgaatgaatgtttcgacctgctctatcagatttatattgaagagggatacaatagaaggaaggccatcgaagatattttccagtataatctcacggggattgacattgacacacgtgccaagcagttagcgacttttgcgttgctgatgaaagcttgtcaaaaagacaatagtttcagcgatgcacattgtatgccgagagtactggatatgccaataccttatgccgaagcagttggcaagacatttgataatacggatgaagagcgaacttttaccaagactctgttatcggaatatatcatgggaggaaacgcagaggtgctggatgaattgacggatgctgtgttactgatgaatgatgctcagacgttaggtagcatcatgaagtttactatttcggagcgtactcgcaatgtgattgcggtaagaacagctgaatatgaacagcaggaggttctgccagaagatattcggaagatgttgccttatatgcagattattcttacgctaacacagaactatgcgaccttggtgatgaatccaccatatatgggaggtggaaatatgaatgaggtgctgagtaggtatgtgaaggataattatgaagattcaaaagcagacttgttctctgtctttatggagcttgctattgaccgtctgaagcaggaaggtaaatatggtatgatcaatatgcagagttggatgtttctctcttcatttgagaagcttcggaaaaaggttcttgataattatcagattgattccatgctgcatctcggcccacgcacatttgatgaattaagtggtgaagtggtacaaaacacagcatttgttatcagcagaaaccataaagaggatgttaatggaatatacttccgtttggttgaggggaaaagttgcaaagagaaagaacagatgttcttaaattatagtgagcaaggagcaaaaatatattatcctgctattcctcaatccaatttcgagaagattccgggatgtccgattgggtattgggtgagtgaaaatgtactaaaaacttttaatcagaaaaatctcatatcagaaaaatctatagctcgttcaggcttttctacaggaaataatgaaagatatgttagacaatggtatgaagttccattagaaaaaataggatttagtttatcctcaaatgatgattttctaagctctaattacaaatacgtaccttttacaaaaggaggaactttcagacgttggtatggtaatcttgagtctgttgtggattggactaatccaaatacaatgcatcggcctcgtaccacttatatgaatctgtattataaacctgcaataacatggaatgcaatctgttcaggaaaactaagctgtaggttttatgatagaggatttctattcgaacacgcagcagcgagtttatttgttaataacgactaccaattcgaatcttttcttgcatatttaaatactcctgtatttcaatttatactaagtattcttaatcctactttaaatactggagctgaagttgtttcttcaatacctattattattccatcttcaggtattcatcaaaaaatccatcaaaacatctctatttcaaaacaagactgggatgctcacgaaactagttgggacttccaaaccaatgaattaattcaactttcgattgatggtgttggacatattcaagctaccataaatgaaaaaactattcaagattattatagtattgaattacttttgacggagtataagacaaaatgggaagatctattcaatcgccttcatgccaatgaagaagaactcaatcgccaattcatagaaatctatggcttacaagacgaactcacttccgatgtacctttgaacgaaattaccatcctccaacaaggagaaatctctatcgaaggagataaactgcgatggaacgacgacgtattaatgaagcaactcatcagctatgccgtaggctgtatgatgggacgctacagcattgaccgccccgggcttatccttgccaatcaaggcgatagtcagaaagagtacgaagccctcgtacctaatagccgctttgccattgatgatgatggtatcattccgcttatgtcagccaacacggaatttacagacaacatcacactgcgcttcaaaacctggctcggcattacctttggcgaggaatcattgatggataatctgaattttatagaacgatcactcggcaaacgtctggacgattactttgtaaaagacttttggaaagaccataagaagatgtatcagaaccgtcccatctattggttgtttagctcaaaaaaaggtagcttccagtgcattgcttatatgcaccgtatgaatgcttatactgcagagaagatacgtgccaattatctgctacctcatatcgaatggctattcaataaacaaaacgagatgcaagccaacgctgccaatctctctacccgtgagcgaaaagaactagacagcatcggcaagcaaattgaagaatgtcgcgagtatcacgaccgcctgcacgtagtagcagatcaacaaatcggattcgacttggatgatggtgtagtagtgaactatgctaaatttggtgatgtattggctaaattgaaataa

SEQ ID NO: 4605 - DNA, 1473 bp, B.fragilis
aatcaaaattatatggaaaataaaaaactcacagcagctaatggtcgtcctatcgccgacaaccaaaacagccagacagcaggacctcgcgggcctattatgttacaagacccatggttgattgaaaaacttgctcatttcgaccgtgaagttatccctgaacgccgtatgcatgccaaaggctccggagcttacggtacatttaccgtcacacatgatatcaccaagtacacacgagcagctattttcagtcaagtaggcaagcaaacagaatgttttgtacgtttctccactgtagcaggagaacgcggagctgctgatgcagaacgcgatatccggggatttgccatgaagttttatacagaagaaggaaactgggatttggtaggtaacaatactcccgtcttcttcttacgcgacccgctaaaatttcctgatttaaatcatgctgtaaaacgcgatccacgcaacaacatgcgtagcgctaacaataattgggatttctggacgctgttacccgaggctcttcatcaggtaactatcaccatgagtccgcgtggcattccggcttcctatcgccacatgcacggattcggcagccatacttacagtttcctaaacgcagaaaacaaacgaatttgggttaagtttcatctaaagactatgcagggcattaaaaacctgactgatcaggaagctgaagcaatcatcgccaaagatcgtgaatcgcatcaacgtgacctatacgaaagcatcgaacggggtgatttcccaaaatggaagttccagattcagttgatgactgaagaagaagcagataactatcgtatcaatccgttcgaccttaccaaggtttggccacacaaagatttcccattgcaagatgtaggtattcttgaattgaaccgtaatccggaaaactattttgcagaagtagaacaatcggctttcaatccgatgaatattgttgaaggtatcggcttctctcccgacaagatgttgcaaggacgattattttcttatggtgatgcacaacgttaccgattgggtgtaaactcagagcagataccggtaaacaagccacgttgtccgttccacgctttccatcgtgacggagcaatgcgagtggacggaaactatggttcagccaaaggttatgaaccgaatagttatggcgaatggcaagactcgcctgagaaaaaagaaccgcctttaaaagttcacggagatgtattcaactataacgaacgtgaatatgatgacgattactacagtcagccgggtgatttgttccgactgatgcctgcggatgaacaacaattattgtttgaaaataccgcacgcgccatgggtgacgcagaattgttcatcaaacaacggcatgtacgcaactgctacaaagctgatccggcttatggcacaggagtagctcaagcattaggtattgatctggaagaagccttgaaagaataa

SEQ ID NO: 4606 - DNA, 3504 bp, B.fragilis
aatgtaatctacatgactgaaaacaccaattatattttcgaagaactgctgaaggctgtacagcccaatcgcggcctgtttgtgattccgttgcctactggtgctggtaaaacttacaattcctgcctgatgatggctgaggagttgaagaaggaagatgctagacgtattatttatgtgactgatgccaagaaacagttggatgctactatcgaggatattgaaaagaacctaaagaaaactggtctcaaactcaagatgtatgacatcctacgtgtgtactcacaagaggagcagtgggaacgtgccttcactgatcctgatatacgtatgaggatggaggcgagcaagctgtttcaaggtgaaagggcgtttacaaacctaaagcgtttgtactcgtacaccgatgttacggacgaggtagctgaggagattagtaagaaccgcctacgtctgatggagaaagtgcgcaaagaggtgtttacccctattcgacagacatacaagaaggagagtgatgaggtgatagcctctcatatagtcacagaatatcctattctggaggaattatatccagaactgttattctacaagagcaagattattgtgctgactgcttcaaagctgcataccacagcatcgccaaagttggttcgtaaaggcacgcaaccttattggaaacacatagaaaattcgttggtgattgttgatgagtcggatcgtgtgaaagaggctgcaatgaagcgtttgtttgattgtgagtgtggccgcagaagacgttttaacttttggggattgtgctacttcatttgcctgcactaccaagaagtgatggatatgcagaagatgcctgaatgggcagaccacaagatgaacattcaagacatgttgaaggcaatccggacgaaaaaagaagagttgatcgatgacattgatcctcaaaaaatattgtgcggacttgaactgaaggaaaatgtaaatcgtggtaattttattttctacgatgaggaccaaactttctctgctgaaaatgttgttctctctgttcataataataaggaggaatatacatcttacctacttcaaagtaagaaaaccaaagaccaaaatgataaaaccttatcattcgtggctaaccgtataatgctctttttgaagggctttgtacaaattgtggataagcatgcagaagtgtatgcttcaatagaaaacgagttgcgtaagaaaaaaggcacagacacaacagttgatcttgaaggcgagttggcattttaccacataattaaatatatgggcgtgaatgaaggcaatacagagtatcgctcagcattgcaggaattacgcaacagaaccactttccagactccacgctctaataacagtgaggaaaccgatggcaagtctatctatgacaaaggtatcagttttattgagatatattctcatgacaacgaccgctattcgtgctgcttcgattatcatgaaatgaggtgcatgcctgaaaatgtactgttggacatggtcaatcacaatcgtgtgataatgtgtagtgctaccgctgactgccagacacctatacacaactatgacttcaattatatagccaagcagggcgtgaaggtggagaagatgggcaatgatgctttgcataagattgaaaaatatattgctctcaactatgcaaacccaaaggtggagttttctctctacaacgaagaagaaactgagccaaaggaaatattggaggactaccttggtaagtgcagcttagcactgaaagattgtttggacttcgtgatggatggtaaaaacaagtttaacaagaacaactctgcccgaatagtaaatatgttgaatcattacatggatttcatgaagaaacctgaagccaaagcatggttatacttccagccattctcatatacaggtaatagcagtataggaataaagaaggtgttgaatatcctacagcaggcaagagtgacaaaacgtggcgaggtatatgaagtcagtgtcatggatccgtatgtcattgacgatggaacaaccagcaggcgtgcggatatctatcctaaacttaatgtctgtttcttaagtggtgagtatttcaaggatgacttagaggctgtagagaagctgttggctgaacagccagaactaaagatgttctgctttgtatgttatcagtctggtgctgtgggtgttaattatctgtttgatactgatgccaagtaccgaaagaaatgctgtttgaaagctccgaatacaaaagaccgcaaggacactcgctgcaactttgatggtattattatggataagcctacgaattttatccctctgttggatgtgaatgactacctcaaagcttgcatctcgttgagtattctaggtactgacaatcagttgacactgaaagagaagtctgatttccaacgtgacttgctccgcagaaggcatcattgcataactgatgacctgaatgaattaaaaaatagagaaatacaaataaaagcagtactgaaaggcacacctgcctatgatgccttctgtctaaaatgggcagtacaggcactggggcgtatcactcgatcgacagtatttaacaagatcatccatgtggctatagggaaggacatggcatactctatgattatcgccagaaaaccggaggttcagacagaactactgaaatatgtactccagtcaatagataaagatccgtgtatacttgatcggattaatggcaaagaatcagaagttaatattgcattcaaaaatggagagcaccgtagagaacgacatatcagtgaattgataggtattagtttcaagggtactgacaaatatgcccgtcaggctcgtaatagggtgcataaaattcgcgagtatgtgatgaagcatcctgaatttggcaacagggaggacattgagacttctatgcgtatgtattatgtgcaggcagaggaggtaaagaagatgaacctgaactatacagactcgtgcgttcatatggatgctatcatgagacagcggttcatacgaaactactttgaaaagaatggctattgcaccgcatggaagggcaaggcatgggtcatctcaccacagattattcagcaggtttatactggttactttggcgaacaagtgttcaaggctatattggaaaacgcaggttgtaccataacctcactaaaagaggagatttgggaaagggcagactgggtggtaaacaaccagctgtatgtagatgtaaaatatatggtggatggtgacttcaacagacatgtgaaatcacaggcttgggaacgcaagataaaagattgtggtggcgactatgtcatagtcaatgtacctcgatatgttggcaactactcatactcacattcactcccactcgaaagtggtactcagctaccagtcataaatggtctgatagatgttgagacaggtgccatcatcgacaataacgtgcaaaatattcttaatatattagcagtttaa

SEQ ID NO: 4607 - DNA, 1005 bp, B.fragilis
atgaaacactaccgactgtttttactattaataggattgttagttttggcctttctggcagatatcgccatcggaagcgttagcttgtctatacgtgacgtatggaatacttttatcggtagcaacgataaccttatctaccgggaaatcatcttgaaccaccgactccctaaagcactgacagccattttggcaggagcctcactctccgttgccggagtgttaatgcaaactctgtttcacaacccactggctggtcccgatgtgttgggagtaacttccggtgccagcttaggagtagccttactgactctcggcacctcttctcttccgttgtggctcattacaggttggggacaagtgactgctgctattattggagctataggggttttattattggttattattgtctctatcaaaattcctcaaaccatctcgttactgattataggtatgatgtttggtaactttgccggtgccatcgtgagtatcctgcaaagtatgagtaatccggataccctgaagctattcatcacctggacttttggaagtctttcttcagtaggctgggaacagatgagcgtgatggcacctgtcattgcctgtggaattctgactgcattactattacaaaaacaactcaacatcttgctgctgggaaaaaactacgccaacggattaggggtctccgttcctcggctgcggctttggattatcctggctacagcactcctggcaggaacctccactgcttttaccggtcccatagcctttatcggcatcacgatgcctcacgtagcccgtggcttattcggcagccccaaccaccgcatcattcttccagcctccatgctctgtggtgccatcacactgttagtctgcgatttaatttcccaactacccggaatgcaaggtaccctacctatcaacgcggttactgccttgtttggatcccctattatcgtatggatcatactacggaattcatatatcaataaatag

SEQ ID NO: 4608 - DNA, 1386 bp, B.fragilis
tcaaataactacaatattatgagcgacaagaaaaaaaggtacatgctgcctgaagaagaaattccacactattggtacaacatacaagccgacatggtgaacaaaccgatgcctccgttgcatccgggaaccaaacagccattaaaggcagaagacctgtatccgatcttcgcagaagaactttgccgtcaggagctgaaccagactgaccaatggatcgaaataccggaagaagttcgtgaaatgtataaatattaccgtagtactccattggttcgtgcctatggtttggaaaaagcattgggtacgccggcacatatctatttcaagaatgaaagtgtcagcccgatgggttcacacaaattaaattccgccatccctcaagcttattattgcaaaaaagaaggcgtacaaaacgtaacaactgaaaccggagcaggacaatggggagcctctttggcctatgccgctaaactcttcggtctggaagcagccgtctatcaggtaaagatcagctatgaacagaaaccttaccgccgcagtatcatgcagacttatggtgcccaagtgaccccatccccttcaatgtcaacccgtgcaggaaaagatatcctgactgcacaccccaatcatcagggatcattagggaccgccatctccgaggcaatcgaactggcacaaaccactcctaactgcaaatatacattaggttccgttttgagccatgtcacccttcaccagacagtgatcggtctggaagccgaaaagcagatggcaatggctggcgaatatcctgatatggtgattgcctgctttggtggcggctccaacttcggtggtatcgcattccctttcatgcgtcacaacatacttgaaggtaaaaagacacgtttcatcgctgccgaaccggcatcttgcccgaaacttacccgaggcaagttccagtacgacttcggtgatgaagccggatatactccactgttgcctatgttcacattaggacataactttgccccggccaatatccatgcaggcggacttcgttatcacggtgccggagtaatcgtttcgcaactcctgaaagacaaactgatggaagcagtagatatcagtcagttggaatcattcgaagcaggatgcctgttcgcacaagttgagggaatcatccctgctccggaatcatgtcacgccattgcagccaccatccgtgaagccaataagtgcaaagaaagcggagaagagaaagtaatactgttcaatctgtccggccacggactgatcgatatggcttcatatgacaaatatctgtccggcgacttggtaaactattcgcttacagacgatgatatccaaaagaatctggacgaaataggaaacttagcttaa

SEQ ID NO: 4609 - DNA, 612 bp, B.fragilis
atctttttatatctttgcaacctgtgtaataaatattgcttctttagcttacaacaggataatagtatgaaaaaagacggtttctctgaaatttatgatatttattttccgaagttgctgcgttttaccaggacgtatctgatttcggaagatgaatcggagaatattgtccaagaaatctttatttatttgtgggaacacagagatatcattgagactcttcagaatctgaatgcctatctgtttacgttagcaaaaaatcgttgtatagactattttcgtaaggagatggtccgtgaagttcgtaaaggttcgctttcggaaatagagaacagagaacttcaattgaaactgtattcattggaagcatttgataatgatcgtctttcggatgccgatattgaagaaatactgaataatgccatcaatcgtttaccggagaggtgccgtgaaatatttattatgagccgtttgcaaaatctccgttataaagagatagctgaaaagttgaatgtttctccaaatacggttgaaaatcagattgtcatagcgttgcgtaaattaaaagaagacttgaaagactactttcccctctttgttttcattatctga

SEQ ID NO: 4610 - DNA, 837 bp, B.fragilis
atacaattatatataatgggaaaaacagtaacgacatatctaatcgatggagatccaaaaggaagtcagtatgtattcatcagcaacaagatttgccagatgtttgtaatccctcgtgcaagcctttcaatactcaatgaacgtaaggatctgcaaactcccgcattttatattttgctcggagaagatgagaatataaagcccaaagcatatatcggagaaaccgaaaatttcagagaacgtgtaaaaagtcatgatagcaaaaaatctttttggcaaaaagccttgatcttcatctctaaagatgcagcaatgacaaaggcagacgtgcaatatcttgaacatcgtgcaattgcagatgcaaagaaagcgaatgtttttatgctggatgaaaacaaacagatccctaaatcaccaaaccttccggaatatcaaaaagattcaatggatgagttttatgatgacattaaattcttgacatccttcattggatgtaacatatttgaaatcattgaacctaaagataagccaatattccaaattgtcagcaaaaaatgtgatgccaaaggtttttatgacacatctggatttacagtactaaaaggcagtagaatcagtgacaaatcaaccgattctttaagttggagagataagcgaactaaattgatagaagaatatgctaacaataaaaatttcgtcatcaatgaagatattactttttcaagccctagtaaagctgccgatttttgcttaggcagtagtagcaatggctggattatgtggaaaacagaaagaggacaaacattagactctgtctacagaaagcaactggaataa

SEQ ID NO: 4611 - DNA, 918 bp, B.fragilis
gtgattacatatattgttatggggcaaaacatatattgttatggaaatgttatctttgcagacaaatcaaagaaaagaattatgaaatatatcggagcacatgtcagtgcatcgggaggagtagagtttgctcctgttaatgcacatgagatcggggccaatgcgttcgccctcttcacaaaaaatcaacgccagtgggtcagtaagcctctaactgaagatagtattcgtctattcaaagaaaattgtgagaagttcggttttgcccccgaatacattctcccacatgacagttatctgatcaatctgggacatcctgaggaagaaggattaactaaaagtagggctgctttccttgacgaaatgcaacgctgcgaacaactggaattaaaattactgaacttccatccgggaagccatctcaacaagatatcggtagaggaatgtctggaccgaattgcagaaagtatcaatctggctttggaaaagaccaaaggagtaaccgctgttattgaaaacacggcaggacagggaagtaacctgggaaatgaattctggcagttgaaatacatcatcgaccgcgtggaagataaaagccgtgtaggagtgtgcctggacacctgccacacctttacagccggttatgactttctgaatgattatgatgacgtattcggagaattcggtgaagtggtcggatttgaatatctgcggggaatgcatctcaacgattcaaaaaaagaattgggaagtcgtgtagaccgtcacgacagcatcggtaagggattaatcggtttcgctttctttgagaagctaatgaaagatccccgtttcgacaacatgccgttgattctggagactatcgacgaaacactgtggcccgaagaaatagcctggctgagagaacaaactcaataa

SEQ ID NO: 4612 - DNA, 2568 bp, B.fragilis
agtaatgaatatatgaatacatcacaacaaaaaatatataactattttgagcgggaaccggaattgaaggtgctattcatcttcaatgacgtttttctggcagatgagctttcggtagttgaatggaaagccggctatcggtatgttgatttcaaaggggattggtttactaccaaatataagctcgatacggaatgggccgatgagaaagtgattctctatttccatcagccatctcccttgcaaataaaatcgctgcaagaaaagtttcccttgctcgacttgctcgtagccaacatggaatatcaccatcaggactatgccgcctatatgcaacagtatggcctgccttccaacatgaccctatttgtggagaagaatattcagcaactacaatcagaccggatgctccggctacttcaatcgcattatgccgatggtagtatttctatagacgtagcagtaagagcatttctttcctcttactttcagcaacaacgagtgctggattgggattacattatcctgagaatcttactacaaggatgtagtagcgaacgcagcagacaaacggatttttacagcaggctaaaagttgctccaatggtgaaagcggcattggacgaacgactgaaaagtatttttggttgtacggtcgatctgaatacagaagccaaggttgagaaactgatacaggtactcaagtacaactccatcgtgcagaatctggcaccggtgaatgcagacaactataaaacgaatagaatcgcagattcactggccctgcaacagatgaaccgtattttggagttggcattaagctcgtccaagaccgcagcagctttacaggaagttatgattgaattgggtagtgatatccatgatgatgaattgatcaaatggtatggaacagaagccgattactacttcttacccgaccaactttgtataccaattctgcgcactttaatggaacattctattgccacagagccacaaaaggtgataaacagactggaagaactgataataaagcacagcggaaatgaagatttgaatatagtgatggactataacttacttgtagctcgattctatgaaggtgctttatcgttaggatcgcttacgctaaacacaccggatgaatatctggagtgctatcgaaatgtgtattatttgactgatcagctttatcgattgtcgattgaaaactattacaagattagcccttctatcgtactttatgagactattcagaaggtgaaatatgcattagacatctattatgccaaactatgcaaccgtatcaatctggaatggatacattgcgtgaaggaatcaggtggactgtcttccgtacacgctcttcgccaggaaaatttctacgagaatcagattaagcctatccaaaagaaagtagtagtcatcataagtgatgctttgcgttatgaagtggcgcaagaattaataggagcattggctagaagaaagcatattgctcacctgaacacagccattgccatgttacctacggagactaaattttgtaaaccagcgctactaccccatcgtgaattacgattgtatagcgaagtggatggagagcagaatatgggtgtagacaatcggatactcaattctaccgtcaaacggacagagcaggttaatgcttaccgaaccggagctatctgcatagattatgatgaagtggcaaaatacgaccaagttaaaaacagagaaatcttcaagcatccgctggtctatgtaatgcacgataccattgacgacaagagtcatggagcaacagccaaagaggtggtaaacagttgtcgtgatgcgattaatgaattggagatgctggttcataaaatacatgaaacctataatgtaaccgaagtatatatcacagcagatcatggcttcctcttcaacgaccaacagtttgaagagaaagacaaacacaaggttacagaaccggcactggaaaacaaaactcgctattatctaactaccactgggaataaagtagccgatatagcaaaatttccgttagcagaagtctcagggatgaatgccgaaaatatctacgtggctgtaccggaaggaacaaaccgcttggctgccaaatcaggagggtatatgtttactcatggtggagcatccttacaagaaataattatacctgttattataagtcgccaagagcgagaggacgtaaagcaacctgttggcgtaatggtgctagaccgcaacttatccattcaagcatcccgtctgcgctttaagctactgcaaacagatgctgtaagtatggatatgaaagcacgtatcattcatgtagctctttacaataatgacaaagcggtgacacccgtaaaagaatttatcttggatagtacagatgtgcttttagataaccgaaaagtactggtcgacctgacactgaatcaaaatgtagatgcaaaagtacttcaactgaaagtatacgatataaccgatgagttgaaccctcttatcaaagagaatgtgacaaataacacactcattggcaatgattttgacttttaa

SEQ ID NO: 4613 - DNA, 252 bp, B.fragilis
gtagtcttgtactccagtgaaaatagtctattcgtgtacttctatttattgatatatgaattccgtagtatgatccatacgataataggggatccaaacaaggcagtaaccgcgttgataggtagggtaccttgcattccgggtagttgggaaattaaatcgcagactaacagtgtgatggcaccacagagcatggaggctggaagaatgatgcggtggttggggctgccgaataagccacgggctacgtga

SEQ ID NO: 4614 - DNA, 858 bp, B.fragilis
tttttatatcttcgcatatatttaaaaaatcaaaggatgaatcgtatgaaaataaaacatatatatgtcgaaggatataaggttttccacaactttgatatagacttcactgagggtgaaaaaactcagaatctaattgtaataaccggtgtcaacggcaacggaaagactacattgctcagagatattattgcagatacaaatgcaaccaaaaagcctaaatgtgccataacaatacaggatgacaaaggtctgaatacttttttactgcctttacaatcagagaatgaacgatatgaagaagcattctcaaaagtcagtttttaccaaacaagagataatagttccgtagaaaaactgcagaaggatatagtcagctatgttgacaaggttgtatatgagattgggaaaaccagctttgatgcttatgtggaaatacaacgtatgcttgatgatatattctgtggattcaatttacagatacgtttcaaaagcctaaacagagaaaagaaactgattttcaccaatacgagacaagaagaatttggaattgatgggctatcaagtggagaactacagatattatctaaagtttttgtcttgtttactgacgatatgaaaggacacgtgatcctgattgatgaaccggagagctctttacatccctcatggcaaactagaatccttccagtacttcgccattgctcagaaacgaatgactgtcagattatcgttgcaacacaatctccactagtaattgattcagcgtataaagatgaaatacgtttcctcacccgagacaatgagggatatgtcaaggcagagatcgcgtcagtaaccctttcggctgaacagtag

SEQ ID NO: 4615 - DNA, 585 bp, B.fragilis
aatatgaatctaaatgataactatattttcaccctttcttttcccgaagccaaaagtatagtggcttcgggcgatatccatggagacttcattcaactagtgttcaaactctgtgtgcaataccaaatgaaagacactattctgattgtggcaggcgattgtggttttggttttgaaaagaaagaaagctacgagaatatggtgaaacagaatgtcaaacgtatgaacgaagctaacaactggatagtattcattcgtggtaatcatgacaatccggcatattttgatggttacaccttcaaatataagagatttatagccatacccgactatactattcttcaagcacgttctcatactgtattatgtgtgggtggaggcatttccatcgatcgtcagtatcgcttgcaagcatgggagaagaaacaggtacgatcagtttctgagagttcaacggataaactggcaagaaatgtgtatcggagcactgaagcaccggtgttcgacaaggagaagatggttacgattagtgccaaatatactgttgatgcagccattacgcataccgctccgtcgttctgctaa

SEQ ID NO: 4616 - DNA, 486 bp, B.fragilis
atatgccgtcaaggtaatatggtctgtattcgtcgtggtatatatgccactttggagcagctagccaacactatgatagaccttgaagttgcggtgccagatggtattttgtgcttattttcagcatggaatatccatggactcacgacatccttacctcaagcttatcatgtagcgataaaaagggggaagaaaattcgccttccggaatatccacctattgcacttcacttccttgccgaatctattctagaacttggtgcagaagagaaggttgtcagtaactatgagattaaagtatataatgtcgaactctctgtttgcgatgccatcaaattccgaaataagattggaatcgatgtttgttctaaagtagtcaacaattatctggcacttcccaatcgagacctaaccctattgatggacaatgcaaacaaactacgtatagcaaagacccttgaaaaatatcttgaaataaaactataa

SEQ ID NO: 4617 - DNA, 198 bp, B.fragilis
actgagacacaagataaacatctttctacatatgaagattgtacaggatgccgctttctcattgtggatgtatatagtaaatttatagggttttattggtgggtgtggtttgcttgtatcacgggtaaagatagaattaatgatacgcaattgatatattatggcttgagattagttgttagattatttgctttgtaa

SEQ ID NO: 4618 - DNA, 249 bp, B.fragilis
gagggaaaacattatatttgcacatatatatcaagaatgtataacatggaaaagaaagacatgaatcgtctaaaagtagtgcttgctgaaaagaagcgtacgaacaaatggcttgcagagcaattgaggaaagatccggctactgtctctaaatggtgtacaaatagtgcacaacccaatcttgaaaatctgatagaaatagctaagtgtcttgaagtaagtgtgaatgagttaattagaaatgaataa

SEQ ID NO: 4619 - DNA, 252 bp, B.fragilis; identical to SEQ ID NO: 860

SEQ ID NO: 4620 - DNA, 375 bp, B.fragilis
ctattgattaatatgacagctaagaaaaccgactacattattatatatactttcttatgtgcatcaatattgagtattgctgtgctagtccgtatgtttgcagtagcagagcttaaaatggatgagttctcagcttttatggcctttttcgtgacttgccttttgctcggtggtatctattttagtttccaatccatattgaacgattgccttttacctattatggagcggattttcagtaagaagcacctgcacatagaaccggagctaaaggttacacttattgcagagactctacaggaaaaaccctcaatacctaaatacggagaatataaacaaaccgcacaagataaattggcacaaaagcaagcataa

SEQ ID NO: 4621 - DNA, 213 bp, B.fragilis
aatctcaataaaacattcttattatcaatacattatagtccaaaagatgtgtttttaaacgtacgtttaaaaacacatcaaaaacgagtgatttattacgagaaaggatacataaaaatgaaaagagaaaatataaaccctaacaactatcacctatttgagaatgaggttatttcaattaaaatagaagtaaaaaacaagtctttttattaa

SEQ ID NO: 4622 - DNA, 2550 bp, B.fragilis
cataaatacaacatgaaacatttaacagtctattttttattggcattgcaaggagttctgttcagtttttcgctttcggccgcaactccccaaaatgcaatagcctatcatgatggtaacgtgcgttttagcgtccttacagatggggtaatccgtatggagtggagtccttcgggttcgtttaccgacgatccctcttttgtagcaatccaccgcaatctacctattcccaagtacacagtacaaaataaaaatgctacggtagtgatcagtaccgcccgaatgaaactaaaatataagaaaggtcaaggcccctttacgaaagataatttaacgatcacatcagctaaagggatgttcccctttcaatggacacccggaacaatacaaaaaggaaatttgaaagggacagaccgtacattggatggttttgaaggagaccacaatatatacagccaccaagatatgaagctggaagacggtcttctatcgacagacggatggaccttgattgatgattcaaagaatttcttatttgacaattcggaatgggcctgggtaaaagcacgtgaacacaaagacggacaagactggtattttatggcttacgggcatgattacaaagctgccttaaaagattttactgtatttgccggtaaagtacctcttccaccccgttatgcattcggttattggtggtcaagatattggagctactcagacaaagaaatgcgccaattagtagataatttccacacttataatatccccttggatgtattggtagtagacatggactggcattataccgatccgggcttcggcggatggacaggctggacttggaaccgcaggctatttcccaatcccgccaaatttctgggttatctgaaaagcaatgacctgaaaatcacactaaacctgcatcctgccgatggtgtagctccatatgaagaaaaatatccggaaatggcacaatggatgggagtagatacagctaaacaggaacgtattccctgggtggtttcggacaaacgctttataaacggtatgttcaacaaggtactccgcccaatggaaaaacagggagtggacttctggtggctcgattggcaacaatggatgtatgataaaaaagtagacagcctcagcaatacctggtggatcaattatgttttcttctcagacatggaacgcaaccgtgacactcgcccgatgctctaccaccgctggggaggactgggcaatcaccgctatcagattggcttctcgggagatgccgtcatctcttggaaatcactcgaattccaaccttactttaccaactgcgcttccaatgtgctatacggctactggagtcatgacatcggaggccacatgttcaagggaggagacaaagaaatactcgacccggaactctttacccgttggatgcaatatggtgccttaacacctgtaatgcgcacacactctacaaagaattctgttctaaataaagaattatggaatttcaagggagattatttcgaagcattacgcaactccattctattccgttatcaactggctccttatatctatacaatggcgcgtgaaacttatgacaacggtatttctatctgtcgtccaatgtactatgattatccggaagccaaagaggcatacgatttcaagagtgaatacatgtttggcgatcaaattctggtagcacctatcaccacccccatgcagaacggactttctactgtaaaggtatggttacccgaaggaaacgactggtttgaatggaccaccggaaccctattgaaaggcggacagataatagaacgttcgtttaccctaaccgaatatccggtttacgtaaaagccggttccgtactgccactttacaaccgtgtgaagaatcttaatagtaatagcgaagagattatcgtaaacatattccctggagaaaatggttcatttaccttttatgaagataatggtaatgataaatattatgccaatgaatatgctcgtacccggatgtacactgaacggaaagagaaccacttaactgtaacggtaggtcctcgccaaggtaagtatcgcaatatgccaaccgaccgccaatttaaaatcaaagttttgggttctgccattccggagacaatcactattaatggtaatagagctgaatatgagtatatcggcgatgaattagccttattgatcaccatccctcaaacagcatgtgatcaggaaaaaacaatagaaatccaatactcgacctccattccggaattaaacgacggtatcgtttcacagttcaaacgattcagcaaagcaatcactgctttaaaataccgggacgccggaattgtattgacgcctgctatgggagcaaccgaagctaccagcattgcattaacctactcgccggaacgttttaacgaactgatagaaacgtttaaaagaaactacagtcaaatgccggagatgctcaaagaacagaaactgaacgaagccaatagccaatggtttatgaaggcaatcggctggaagaaataa

SEQ ID NO: 4623 - DNA, 2889 bp, B.fragilis
aaaaacaacaaagtattaaccttattacattgcaaaagtatgaaaaaaaacttattgctgttatcttatgcaattaaacaacgtgaaattattcaaatcttgcgaattatgaaatgcacagtcttgctgttatttttgcttattcttcaggcacatgccagcgtaagctcacaaaatgcaagggtaaacatgtctcgaaatcaacttccgttaaaggagtttatggcggagattgaaaaacaaaccgattatctgtttatctatagtgatgcagaaatcaatgcctctcgccaggtaactgtaaagaagggaacacatagagtggccgatttactaagagaggtactctctaaaaataatatttcttataattttgcagataattatatttctcttcatgtacgcaaagaggctgacgtacagtctttggcggtatctccccaacaaaaaaagaatacggttttggtttcgggaactatcgtagataccgcaggcgagcctataatcggtgctaacatcaaattgaaaggtgctcagggaaccggaacgattacggatgtggaaggtaactttaaattggaagtgcctaccaatggtgtactgatcgtctcttttatcggatatcagcagcaggaagtggcggtgaacggaaaaaccatgttgaaaattaagatggcggaagatgctgaaatgatagacgaagtggttgtaactgctttgggaatcaagcgggaagaaaaggcattgggatatgccgttcagaaagtgggcggaagtaagctgtctactgtgaagcccgttaatattgctacttcactgactggtaaagttgccggtttgaatgtaaccaacagtacggagttcaatacagccccaactctcaaattgcgtggtgaaactccattgctggtagtagatggtgtgccatatagcaatatctctctgaatgatattgcagcagacgatatcgaatctgttgacgtgttgaagggggctaccgcatcggccctgtatggtgcccgcggaggttcgggagctattatggtgactacgaagaaaggtagtcaggagggacttaatatttcggtaaacagcagtacgatgttcaatgccggttatctggtattgccggaagtacaacatggatacagtaccggtcagggaggtaaatataccgctgccgacttcgtttggggtgataaactggacatcggccgtacagctgtacagtatgatccgtatacttatgaatggaaagagatgccattggtatcgaaaggtaaagacaactttaagaatttcctggagacaggtttcattaccaataataacatcagcatcagccagaccggtaaatatggaagcttccgttcttctctgtcgcatgtttataataaaggacagtatcccaatcagagattgaataagattacttactcggtaggtggggatatgaagttcggcaaactgagttttgaaggtggtgccatttataacaagcgtttctatccgaatggagaaggagccggctatggtggcggtggatacatctacaacctgttggtatggacgggtaccgattatgatgtacgcgactataaaaactattggagaaagaaagacgaagagcagaactggatgaacgatgtgtggtatgataatccttattatctggctcatgaaatgacttcatccaatgactacgataaagtaaacacttacttgtccggtaaatatgacatcatgccttggttgaacttttcgatgagagccggtgccgatgcttatgccagccgtacggaaaagaaaaacgcaatgagcgcccgcggcggatgggacaagaacggatacttctatacatccaaatccaccggattcagtttcaatggtgacgctttgctgtctgccaatcacagcttctttgattttgctatcgacggttttgtcggaggtacgaggtactattattatgatgacgctatttcatcgaatacccgtaacggattgagtattccgggatattattcattaaaagcatcggttgacccaattgcctcttcaagttcatacaagcagaaacaggtaaactctatttatggaaaattctcagcttcatggaagagtactgtgtttgtggatgtaacggcacgtaatgactggtcgtctactttgccttcggagactcgttcttacttttatccggctgtatcgggaagtatcattatgtcgcagttactaaagatgcccgaatggctgaacttctggaaactcaagggtgcctggacagtaacgaacagcgacttgggtatttatgatacgaaccaggcttacagtgtaagcacgaatgtgtgggatggaatgaatacagccgtgtacccggaaatgatccgcagtacaacgcttgaaccgaccgctgcacgttcttatgaaatcggtactgccttcaatgtatgggacaaccgtttgcgttttgatatctcttactacaataaactgaaatacaatctgacacgtgaagccactatcagcggttcgtccggttttactaaaacattggtgaactatgatgaagagcaggttcgtagaggagtggaggtttctttgactgcttctctgattcagacgaaagactggaattgggaagtgaatgccaactgggcccgtgaccgctatttctatgcgaaagtcgatcctgtatattctacacagaaaccttgggtagctgccggcaagcgttgggactggtatggtatctacgattgggaacgtgacccccagggaaatattatccatgaaaacggatatccggtacaaagtaaatatcagtcagtgatgggtaatgaatatccggactggatctggggactcagtactaccttgcgttattaa

SEQ ID NO: 4624 - DNA, 978 bp, B.fragilis
aatatcctaaaaatgagtgaactgatagataaatattttgcaggagagatgacctgtgaagagaaaaaagatctcttcgaccggatagaaagtgatgaggctctgaagaaagaatttcttcggatgcaaaatgtagtggcgttgacccaaatactctcccgccaggatgattcggagaccagccgtaaagggaaacagcattttatgcaacttcttttccgtaaaagattaaagcgcgcgataacggtttctttgaaatatgctgctgttttcgcggtattagtggtaggaactttctatactgcgaagttgtatttatctgaggaattcggaaaaagttataccatagttacggctcccaagggacagcgtgtaaaaatagaattacctgatggaaccattgcctggctaagcccctgtagtcgtcttcgttttgcggcctctttcaatgaaacggaccgtaaaatagagttggacggtgctacctattttgatgtggcaaagaatcccgagaagccatttgttgtttcggctaaaggttaccgtatccgagtacttggaactaaattcaatatatcggcttataaaaatagtaaagagtttgagaccgatcttgtggaaggttgcgtacatatctatgatccggcggatataaggaacgaagtgtttctacagcctaaagaaaaggcagtgttgtggggagaccggttgatgaagcgggagtctgactttgataatgaagaatatctgaagaacggagttgtcagttttctgtccgagccgttcgggagagtactgaatagtgtcgctttatggaatgatgtgaatattaaaatagaacggtcagtcaacgcgacgcagcggatctccggaaaattcaggcaaagcgattctttggagagtatattaaaagccttgcaaggcgctatgcctttcaagtataaaatagttagtgaagaagaaataattatttattga

SEQ ID NO: 4625 - DNA, 963 bp, B.fragilis
attccactaaaattattattcatacctttgtggatcgtattacaaagaacccaatcatatatgcaaaaaagacttatacatttatccattatcttctttctgctatgtcctgccctggtagttgcgcagaacagtcctcttgaaactcaactcaagaaagccatagaagggaaaaaagccgaaataggaattgcagtcattatcgacgggcaagatacgataacagtcaataatgatattcattatcctatgatgagtgttttcaaatttcatcaggcattggcattggccgattacatgcatcatcaaaagcaacctttggaaacccggttattgattaaaaagtcggatttaaagccggacacctatagtccgcttcgagaaacatacccgcagggaggaatcgaaatgagcattgccgatctactgaaatatacgcttcagcaaagtgacaataatgcctgcgatattctttttaattatcaaggtggtccggatgccgtgaataagtatcttcattcattgggaattcgtgaatgtgctgtcatccatacagaaaacgatatgcatgagaatctggagttctgttaccaaaactggactactccattggcagccgccaaattactggaaatatttcgcaatgaaaacctttttgacaaagaatacaagaatttcatttatcaaacaatggtggaatgtcagacaggacaagaccgcctgattgctccactgctcgataaaaaagtaacaatggggcataaaaccggaacaggcgaccgtaatgcgaaagggcaacagatcggttgcaatgacatcgggtttattcttcttcccgacggacatgcctatagcatagccgtcttcgtgaaagattccgaagcagataacagggaaaacagtgagattatcgcagaaatttcgcgcatcgtttacgaatacgtaacgcaacagatagattaa

SEQ ID NO: 4626 - DNA, 525 bp, B.fragilis
atgaatacaaacgaaaggcccgaaatgacagaaaaacagtcatgtcattggtatcttgcttttactgcttctcgggcagagcaacgcgtgaagcaagaactggatcagcggaaagtccgaaactatcttccactacgtaaaattacttatcaatggcagggacgttccaaggaggcattatgtccacaaatagctcgttgcgtccttatttggacgtcattgtccgacattcggcagttatccggaatatcaggattgattattcctcaaaacatctgggattatcgtgttccggaatggcaggtggaaagttatcaactattgttttctcaaatggataccgctgtggaatggatacccgattgcttggaatccgccacaatggttcgtgtaacaggaggtcctttgactgggttagtgggcgaactggatacttcggacacagggtttcggataaggatccgttttcattctatgggatgttttcgtgttgctgtacctgaagaatggattgaaaaattttaa

SEQ ID NO: 4627 - DNA, 1269 bp, B.fragilis
acaatgaaaaagctactggtatatgctgactttgattggctgaaagatattgaacttatcggagagctaagctacgaatcgcttcgtggttcagatagctatgcttttaaattcaatgatgaatggctgaagctatatggtaacctatttattagtgcggacttgaataactacaaaggactacaatatacacaaccggagaaagatattttcggatgcttctccgatgccttgcccgaccgctggggacgtactctacttaatcgtagagagcagatcttggcttccgaagagaaacgaccggtccgtcggttatcctcgtttgattatctgttgggaattgatgattcatcttgcatgggtgggtttcggtttaaagaaacacctgatggcgattttatcaactcaagtaatacgctgcgcataccaccattaaccagcatccgtgaattgattcatgccagtggagagattgaaaaaagcgaagaggaaaacaaaatacctgataagaagtggcttactcaattattacaacccggcttttcattaggtggagccagaccgaaagccagcatagtcgatacgaacaaagtgttgtatgttaccaaatttccgtctcgcaaagatgattacaatacagggctttgggaacacttctgccatctattggctaaaaaagcaggaatcaatgcagcatctacgcgagtaatttccacaagcgacaagtaccacactctcttatcacgtcgttttgatagaaaagatgacggcaaacggatacattttgcctctgccatgacattacttggactctcggacggtgctaacgcaagcaccggaaatggctacttagatatggtggactttatacttcagaattgcactgaggtaaacaaaaaccttcaagaactataccgtcgtgtagcttttaacatttgcgtcggtaattcggacgatcacttccgcaatcacggctttctgctcacatctaaaggttggactctatcccctgcttacgatatgaatccaacgctgaatgaatatcagagtctacttatttctaactcttccaacaaagcagacttaacaattctattagatgcttgtgaagactatatgctaccttgggacgtagcctcaaagattatctctgaagttgtaatagccataagagattggaaaatattggctaccaaattgggaataacgaacagcgaaatggaattatttggaagtaccattagtaatagaattaaagaacacatctaa

SEQ ID NO: 4628 - DNA, 642 bp, B.fragilis
ttagaaatgaataagaagaatagtccatatacagctacaataaccggatgcgcatttctctataatgagtatttgcgtatactaccattattgatgtccgaaaacgcaactgaactactgaaagatgaagttaaaaccaaccaaatcttgcaagtaaattcacagaaggcccggcaaacctttatcacggaatttaaacgcagatataatgctgttcccgctaccttttgggtgaattttcagacaatgactgaacaagcccaacgtgctggtttactttatgccatcctaaaagcttataaattagcttttgatttccatttcaatgtaacggtcaagcggtggaactccgtggagcaaacactaaaaaagaacgacattatgatggaatttaatgagttatctgccagagatgagtttgtagacagttggactgataacacaaaagaccgttgtgccagccagtatctgaccatcttgcgccaagcaggcttattaaacagtaagacagatgaactgaaaccaattcatcttgaaccatccgactacacattttatatccgtagcggcgaagagtggtttttggaagcttgcttgctttatccatacgaagtgaatgatataaaatcgcaagtaaaatga

SEQ ID NO: 4629 - DNA, 210 bp, B.fragilis
cgaagtagtgaaacggaaaaagaaattatgttggccaagggtgtgaaaatagtatcgggtaaagttgaattcaacccaaccgggaagaatggtgagcgaatccacgggtggtttgccccaaatggacactcaggttttcctatgaaaggttttattaagaaataccaatcccttggccagggtggtaaggtttacccaaaccgggattga

SEQ ID NO: 4630 - DNA, 3648 bp, B.fragilis
atccaatacgatatgaaatttaaagacttatatgaaaaagggcttgaccgaaaagttaatcctgccgtatcagcctccgacctcagtgaagatactgtactcaccgaaatagttgaatacgtctttacacaagagattattgtaaacctctatcatattcttatcaatatcaagataaatcaaggtagtcatgtcggtatatggatcaatggttattatggttccggaaagtctcacttcctgaaatacgccagctattgcttatccaacaaatatagtgaaatggcttttattcgtttgatagaagccacacaagagatgatgcttggcgaaaaagatgtcactgcacttgaacaagcaggggtgtctctttctgagctaagagctcttcagagttggtatgttaataaagcggatgtagagatggtgatattcaacattggcgatgtacacgatgccaatgccgatcaagccaccacattcactactattttctggaaccagtttaatgcaaagcgtggttataactcattcaacctcgccatggcccaatatttggagaaagcattggacgatgatggaaaattccaagagtttaaggactatgtaaagagcaaagggtatgattgggaacgaaacatttctcgttttgccgcaggtcgcctggaccttgccctacagatggcaaaagaagtagatcccgcattggctatcgatgtgatccgcgaacgtattttgaagaatgatgtgaatgtttcggtagaagcctttgcggctgagatgaaggaatatctggatcataaaaacaatcgaaatttccgcattctatttttcatcgacgaggttagccagttcatcggagagcatcgcgacctattgttgcaactccaatcacttgtaaagcggctggatgaagtctgtgaatctcaggtttggatttcgtgtacggcacaacagactctggaggaggtggtaaccaaagtcggtggtagcatttctaatccggaagatgaagtgggcaaaattttaggacgctttgaggtgcgtgcttcccttcaaggcaccagtcccgaatacattacccaaaaacgaattctggataagaaaggagaagtagaattgcaactttcggaactctttgaaaaaaagaaagccatgctcgatgcgcaattcattctgccaagtacgtaccaagcctataaaaacaaagaagattttgctgctttctacccattcgtcccctatcagttccaattgattatgaaggtgctcgactcctttgtaaacatgaactatgtggataagcaagtgaagggtaatgagcgttcactgctgaacatcacgttctctattgccaaagagactgcagaatgcgaggtaggcgaatttattccgttcgaccggttctttggggcaatgttccaaggttccatgcagcacatcggccagcgcgctatggcaaatgcccgtgaagcactcgatatggtgacggatgaagataaacaaactttctatcgccgagtggtatatgtgcttttcatggtatgtaatctttcagaagtagacaaacagagtttctctgctactatcgacaatatcgtcaccctgctgatgacgaaagtagacgccaacaaagcagctatcaaagaagaagtatctcaagtcctttctttcttgatggataaggctgtcattcgtaaaataaagacggataatggaactgaagtttatgagttctacaccgaggaggaatctaaggtcgcgcaaattatcaaaaaccaaaaggtagataataacacatataccgaagaactttataagattatcagcgaccattttagcttcagtgcatctaccaataaggaaacatttataacccgctccttcaatattggtggaaatgtagatggtagaaacattctttccaataatccggatgtcgtagtcgacttccttaccactgcaagtaccgattcccccgaacagtacgcattcaccaatcaacctaatcacttggcgttcttcctctttccattgtttaagaataatgcggaacttcgacagaactttctggagtattgccgagtccaatgtttcgcacaagagcaagctatcagtgaggagcgccaacgcacaaagcgtatcttttccgaccgtgcaaaagagttgtataaaaacgaaattaagccacagttccaacaaatgttggatgcttgccctgtgatttccggtcagaatatactatctccttctgttcttggttcagctaagaataaggaaagatataaggccgcactgaccaaccatttgaagaacctatatgattctgcccatctggtaaatggctctgaatacccgaaaagtcaaagtgagctttcggataaaatacttcgtccggtagaagcgacattggtagacctgccgcttaccacagccgaaaagaaggtaaaggattatttggaccgtgcgccccacgatgtgactgtagccgatgtggtacgtcaatttgccaaagttccctatggttgggcggactgctgtagcatctatgtagtcaatgagctggtacgcagacatctgtatgctttcaattacaacaacaatcctaatgttagccgtgaagacactgctcgcaacattatgcgcgatgccaatcggttcacgattgaaccggcaaaggctatctcgcaagatatcctgaacgaatttatcgaagcctggaaacatatctttaacgtagtcaccctcaaaggaagcaatgactccactgagctttatcgcaactgcaaagagaccgacgacagtgctctgaaccgattattgagtaattatcgtaaattatccagaaagataaatggatgtccgtttgaatccgtcattgatgaagccattactttgatggagaaatggaccaatatacgcgaccataaagaattctttctcaccatcacagaggccaaagaaagtgcagctaccttatttgatcgctgtaaaaacatcaatacattcgtcaacgatcagtttgaagggtatcaaaaggtaaagctgtttattcaggaaaaccgggacaattttgctttcctgccgaaagatcaggaagaggcacagaatcggttgtgtgccatccataacgatatggaaccgtgggacaatatgcctgcctacctgaagatgatgcgtaatttaagtggacgtttagaggaatgcaaggcaacccttattaaaactatcaatactaattataataaggcatttgatgaattggaggaatatgctgtcagtatgaaagtgggcagagacaaatttgccaaacgtgatattacaatcagtcagaaaatcaacacaggcaatttctatgcactccaagccaatgcagtcattgctggcttctatgaggaacaaatgaagaagatcaatgaggctgtaccgaagccggttgatccgaaaccttacacaccggttgctgacggagggggaagtgttgttaaagaaccgattgctacacctcgtgcccgtaaaatggtacatctccatacgcataccactcagcctatacaaaccgaagctgatatagatcgctatctgcaaaagctgaaagccgaactcatgcaacatatcggtggagattatgatataataatttcgtaa

SEQ ID NO: 4631 - DNA, 2187 bp, B.fragilis
gcaactatggaaaagataagaaccaatcatatcagagtggaatttctctggaaagagtttctggaagattacgacttcttcaagatagaatatggtgatgttgatttcgacaacattacaggtatttactgcaaactggaaggcttgtgtccgaacagtgctatctgtgctttcaacaaaatggctaagaatgcacaaccaggcgaatcatccaagcaccgtatcttcctatttgcttcatccaagaaagagaaagtaacagtggcacagctacaggaatgcatgaagaaggttaatgttaaaattaagcagattacttattgtcctgctcacaatgaaggtatttatacttacaatatgctgaatctattgttatcaatgattccaaatcgtaataagactttgagctatgctcatggtaaactgatttgtggcacttgcagcagcatatataataaagggagaagtgctggtgaggagttgggcttgcatataagtttcgattacgataatctcttgactgctcacacattgacttttgctgaggaagatagggtcgaacagaagaaaaagaagggctcgtcggtatatcatttggagtttgatgaaaaacgaatctatttctcttccaagaaaaaaaaaggaacgcaggaatactataaccatccgtcttttcttagaaaagataataagaatcgtattccttttctgggattcggtgatgtagaacattttgaggagtcgcaggcatatattattcgcactgtactacaggagtttcttacaacctattcgaagtacatatctgttgatcctatagagtataaaaagccaatgttgttgaaagcacaggatgctgagtttaagaaagaagacgaactgttgcgtgatatgctctcgacatcatggattgatatagtctgccatacttccgaagcaggtgtggaagagttacgaaatttgatagagcagaagtcaagggagtatatcaaaaagctgtttagcaataactttgagggttgttatgagaaggacaagagtaagaagcaaatctgcattcgtatcgttggcgacaaataccaggagggagaactttctgatagtaaacgcaaagctttggatcatagacgtttgaaagagaaggtagatctgatagaaaagaaaattcctactcaagatgtgatgattaaatcagagattgagatggcaactatcaagaatatcttccgtcagatactgattaaggactattgtataaaggagacactgcctcaatatatgatagatcgtttcaaaggatgcgtcatcacgtatgcagagaaaaagacaaatgatctgtattactttgtacaacttaccattggcaaagatggattgataatttacaaggtcgaagaacctcgattgtctcacgatgacgtgattacggttatgggagagaattttgaatcgtacgaatatcatattcctgcatttaagaagggatataacaagaactttatttattgcattgagaaggatggtatcacatacaacatttatgacacttgtgagtttgttttccctgaaatggaggaaatacaccaggcactcgtggaattaaagaatgtacaagtaccagttgtgatataccatgacctcatggatatggtgcaaagagatgagtcgaaggtattatgcaaacagcgtattcgtgaatatgcagataatgtgccccatgacttgttctattcagatattaagaaactgggcaaggaagctccactggaagagaaacttacccggaaactgatgcgatttgtaactagtaagtataatatcaagaaagggcaagatttcagaacagcaggccgcagtgaggaaacgttggctgcatgcgttaatgtacactactggaaacaggatgcgaagttgtggaagtattgcgcaggtccgaatacaaaaggtaaatttgattctatcaaccacaaagtgtatgtacgcgaactggtcagcgacatgacacctaacgaggcctttgttaacgaactgatatattcgttgggggacggttggaataagataaatgagttctccgttcacccttcaatattcaaatttctcaaggaacgtttggaaatatataaagctcaagaacaattgaatgaattaacaaaaaagttaaagtataaatactttttgggatga

SEQ ID NO: 4632 - DNA, 2040 bp, B.fragilis
acgaccatggaattgcatgataaagtaatgaatgcctttataggcaaagtggtaagaaaagacttggctttcctcgtgaaaggaggattgccggttccgacatacgtactggaatatctattggggcaatattgtgccagcgatgacgaagaggtgatagctgaagggctagagaaggtgaaacaagtcattcagcataattatgttcatcgtgcggatgcagaatctataaaaggcatcattcgtgaaaatggacatcatcgtatcattgataaggtgacagtagtactcaatgaaaaagcagatgaatatcatgcttcttttgccaatcttggattgggtagcgtgcctatcggaacggaatatgtgcggaagaatccgaaactgctaagtggaaacggagtttggtgtatcgttactgttggctatatatcgggagaggacgtcaaggtgagatgggaaattcaaagtctcaaacccattcaaatcagcaatgtcgatgtacaggagtacattgatcaacgtcagcaattctccactgatgagtggattgattttctgatacatactatcggattaaacccagagaagctgaatagacgtgaaaaattcatttctctggctcgcctgttaccccatgtggaaaataacttcaacttcatggagctaggaccgaaaggaacaggaaaatctcatgtctttcaagaattatcaccatcaggcgtactcgtctccggtggcgatgtgacgagcgcccgcctttttgtaaaaatgagtggtaacagagaaatactcggactggtaggctactgggatgtagtggcatgggatgagtttgaacagcaaaaaggccgtgctgtggatgctgtaatgattgacaccatgcaaaactatcttgccaacaaatctttcaaccgcggtaaaggaacacacgaagcatccgcttctatggttttcgtaggaaacaccaaacataccattcctttcatgttgaataacagccatctgttcgagagtatacctacttcctttatcaaaggagcgttccttgatcgtattcacctatataatcccgggtgggagattagaatgctgaaaaaagaatctttctcgaaaggatatggactgataacagactatatagctgccgtgcttcatgaactgagaaacagggacttttccagtaacctgaattcttttgtaaagttcagtggtacactatcagaacgtgaccatttggctatccgtaaaacgttctcgggaatggtcaagttactctatccggacagtaattataccgacgaagaggcacttgaaataattgaatttgcagccgaatgtcgtaaacgtgtgaaagaccagctttatatcattgatgagactttcagggcagaaccagctaagtttgaatatctcattctcaaaaccggagaaacaaaacaggttgaaacgcttgaacgaatagaaaatcctgcaataatagaggatattcaaacagaggagcctatagaggttgcatcagaaccagccacaaccacttctaatccaagcatacgtccacgcattccccaacttgcttcaaaacaagttgatattcgtatgaatcaacgaggagtgtcttacaaatctcttttcggcgattatatacgaactgcgaaaaaaataaccatcgtcgacccattcataagagtcggtcatcaaatagataatctgattgagttcatacaaatggctcgtgaagtatgcctaactcctgaagaactggaaatagaactgcacacacagaatgaagaggataagattcctgaagtgattgatatcttcaatgaattgcaagaagagctttcgtcgtacggagtgactttcaatttcatgttcgatgccggacatgacagaaaaatagatcttgataatggctggataatcaatttaggacgtggactggatatattcgaaaaattctcccgtttctcattaagtaatagccgacaagagaatcgccgttgcaaagagtttagtgtgacttatatgtataagtaa

SEQ ID NO: 4633 - DNA, 297 bp, B.fragilis
attctaagactaccatggcatcagattgagcattgcagttcaaaggataccatcacacaggcaatgactatggatattgggttcggcgacgtggttactcctaaaacaatacctcttgattattcgctcttacttaagcatcttcctattgccaatattttggtttattctatagagacagttattgccgagaaaatgcataccgtagttgacttggcagaccaaagtagccgtatgaaagactactacgaactctatcagattttatctgctaatcagtatgatgtatcagtataa

SEQ ID NO: 4634 - DNA, 291 bp, B.fragilis
gcgttcgtatgcatacataagagctccttcctttcaaataaaattgttcctatagcgggtttgaaatacgataaagcagtcgctctcggaaatagcgtgttagtatcgtttggaaaaaactttttcctgtttggctacgttgagcaagcgatctctaatagattttccgtagtcctttatatcatcacttatagttttatttcaagatatttttcaagggtctttgctatacgtagtttgtttgcattgtccatcaatagggttaggtctcgattgggaagtgccagataa

SEQ ID NO: 4635 - DNA, 270 bp, B.fragilis
actttggaacgagtacttgcctatacaagtcagcaacttgctctctatatgaaagaaaaccagttcaaccaactctatgagcatattcggatgtttcagtatgtcacagaagaggagtgtcagctgattcaaaaccctgtaacaatagattctcagataaagtcaatcgatttgatgcactttggttggaatataggcaatgcatttggcaaaccacgtttacaaacagccacatttatcaaaaaagttttcgctcattactctccctga

SEQ ID NO: 4636 - DNA, 1110 bp, B.fragilis
attaaaagaagacttgaaagactactttcccctctttgttttcattatctgagaaatattccctatttttgtcaaattattatttatttttatattcaaaacacaacaatgaaacacttagttatttgcatcgctctgttgacagtcggtgcttgctgctttgctcagcaaaagaaagtggcttctcataaagccacaagtgggaaccctgtatttcaaggatggtatgctgatccggaaggcatcatttatgatgatacttattggatttttccaacttggagtgatctttacgaaaatcagacttttttcgattgtttctcttccaaagatcttgtgaattggacgaaacatgcttcagttttggacactactgccgtaaaatgggctaagaaagcgatgtgggctccttcggtaatcagaaagaatgggaaatattatatcttctttggagcgaatgacgttcatgaaggagagattggcggtattggcgtagcagttagcgatcgtcctgaaggaccttataaagatttattgggtaagccgttgattaatgaaatagtgaatggagcgcaaccgatcgatcagtttgtatacaatgataatggacattattatatgtattatggtggttgggggcattgcaatgttgtacagttgaacgatgattttacagggctcgttccttttgaagatggcactgtctataaagaagtgactccggagaactatgttgaaggtccgtttatgttcaagaaagacggtaaatactattttatgtggagtgaaggtggttggggaggtcccgattactctgtagcttatgctatttccgattctccgttcggaccttttaaacgggtagctaagattctgcaacaagatacttcggtagctaccagtgccggtcatcattcattactgcatgctcccggaacagatgattattatatagtctatcatcgtcgtccactgaatgataatgcacgcgatcatcgtgtgacatgcattgataaaatgacgtttgataaggatggatttattaatcctgtaaagatgactttcgaaggagtgcctgcacaaaagattaagaagtctaaaaagaaatag

SEQ ID NO: 4637 - DNA, 219 bp, B.fragilis
tacattgagagttcgggcattaaagataaatgctacaggcaagacggtatttcaaaactaactgagatttgccgtttttttgatttacccgacttaaagcacatataccttgagaaaaaagatatcgccacaatcgccaatttcgcagccaatcaaatactatttgcaagccaatgtttttttttagttcatagtctatatctattttatattatttag

SEQ ID NO: 4638 - DNA, 384 bp, B.fragilis
atgatgaccggcactggtagctaccgaagtatcttgttgcagaatcttagctacccgtttaaaaggtccgaacggagaatcggaaatagcataagctacagagtaatcgggacctccccaaccaccttcactccacataaaatagtatttaccgtctttcttgaacataaacggaccttcaacatagttctccggagtcacttctttatagacagtgccatcttcaaaaggaacgagccctgtaaaatcatcgttcaactgtacaacattgcaatgcccccaaccaccataatacatataataatgtccattatcattgtatacaaactgatcgatcggttgcgctccattcactatttcattaatcaacggcttacccaataa

SEQ ID NO: 4639 - DNA, 1983 bp, B.fragilis
agggggtgcgggaacaaccggacaaaagaaactgaaataataataaataaaagaataacgatcatgggaaaaattattggtattgacttaggaactacaaactcttgtgtttctgtatttgaaggaaacgaacctgtagtaattgcaaatagtgaaggtaaacgtacgactccttctattgtggcatttgtagatggcggagaacgtaaagtcggtgatcctgcaaaacgtcaggctatcacgaaccctacccgtacaattttctctatcaaacgtttcatgggtgagaattgggatcaggtacaaaaagaaatagcacgcgttccttataaagtagtgaaaggtgataacaacactccacgtgtggatattgacggacgcctgtatactccacaggaaatttcagcaatgattctgcagaagatgaagaaaacagctgaggattatctgggacaagaagtaacagaagctgtgattaccgttcctgcatatttctctgattcgcagcgtcaggcaactaaagaagccggacagattgccggtttggaggttaaacgtattgtaaacgaaccgacagcggctgcgttggcttatggtcttgataaggctcataaagatatgaagattgccgtattcgacttaggtggaggtacattcgatatttctatcttggagttcggtggcggcgtattcgaggtgctttctacaaatggtgacacccatttgggtggtgatgactttgaccaggttattatcgattggctggttcaggaatttaagaacgatgaaggtgccgacctgactcaggatccgatggctatgcagcgtttgaaagaagctgctgaaaaagcgaagattgaattgtcttcttctacaagcactgaaatcaacttgccgtatattatgccggtaggtggtgtacctaagcacttggttaagacgctgactcgcgctaaatttgaatctttggctcacaacttgattcaggcttgtcttgaaccctgtaaaaaagcaatgcaggatgcaggtttgagtaactcggatattgatgaagtaatcctcgtaggtggttcttctcgtattccggctgtacagaagctggttgaagatttctttggtaaaactccttcaaagggggttaatccggatgaagttgtagctgtaggtgctgctgttcagggtgctgtgctgactgatgaaatcaaaggtgtggtattgttggatgttactccgttgtcaatgggtatcgaaacactgggtggtgtgatgactaaattgattgacgctaatactacaatccctgcacgtaagagcgaaacattctctactgctgccgacaatcagacagaagttaccattcacgttctgcaaggtgaacgtccgatggctgcacaaaataaatcaatcggtcagttcaatctgactggaattgctccggcacgtcgtggcgttcctcaaattgaggtaactttcgatatcgatgccaacggtattctgaaagtatctgcaaaggataaggctactggtaaagaacaggctatccgtatcgaggcttccagcggtttgagcaaagaggaaatcgaaaaaatgaaggctgaagctgaggctaatgcagaggctgataagaaagaacgtgagaagattgataaactgaatcaggctgacagtttgatcttccagactgagactcagttgaaggaattgggtgataagttaccggcagataagaaagctccgatcgaggctgctctccagaaactgaaagatgctcacaaggctcaggatatgacaactatcgatagcgctatggctgaactgaatactgcattccaggctgcaagtgccgaaatgtacgctcagagcggtgcacaaggtggtgcacaggccggtccggatatgaacgcaggtcagtcaaatgccggacaaaataatggcaaacaagacgataatgttcaggatgctgattttgaggaagtgaagtaa

SEQ ID NO: 4640 - DNA, 591 bp, B.fragilis
attatagttatgccaagtagtagtgttttaattccaagaatctgtgaatattgtgataaaccctttatggcaagaagtgtaaatactcgtttttgtagcacgatatgcaataataagagtttacgtgaaaggaaaaagagggaaaaagaagagcagaggcaaataagtcttttagatacaaagaaaaataaaattgctgatattcagactagaccatatatttcagtttcggaagctgctcaattaatcggtgtttctaaaagtacaattaggagaatgctttgtagggggatgcttgctggtgcaaatttaggaatccgattgacaagaattgatcgtactcaattagaacaattgtttacttctattattgtgccagaagaacaaataaagccgaaattctatgaattggacaaatgttatactattggagaatgcttgaaaaaatataatattccggagtgtagattagaaagcataattagggcttttaatatacctaaacgtaaggtcggaaattatgtttatattccaaggatagagattgatagggtattgaataaaatagatggaaatatggagaatgcataa

SEQ ID NO: 4641 - DNA, 957 bp, B.fragilis
cttatatgtataagtaaagcaaaagagaatatgccatatccgatagaaaacaaattagttatcgcagtagcatcaagtgcgctgtttaacttgatagaatctgacagtgttttcaagacacagggagaatcaatttacagagagtatcaagaaaatcgtcttgatattccttttgaaaaaggagttgcatttccttttataaaacggcttttatcattaaatcaatctttccctgaggaacaacctattgaagtggtactactttcaaggaatagtcccgaaactggattaagagtgtttaggtctatccaaagttacggattaaatatctcacgtgcttatttctcttcaggacaaaacaattttcaatatttacccgcttttaatgcttccttatttttatcagcaaattcgaacgacaccagatcagctattgaaaatggatttgcagcaggaactgtattaaacaaagtagtggttgatgatgacgatgatatggaactaagaattggattcgactttgatggtgtattggcagatgatgcatcagaacaagtttacaagaaagcgaatggcaatatgaatgagtactttgaacatgagaaagaacatgctgctgatcctttggctaaaggtcctataggaaacttattacaaaagatttccttctttcagaaaatggaaaagaaaagagctaaggcagatccagcttatcgcagagtattaaaaacagctatcataacagctagaaatgctcctgcacacgaacgtgttatcacaactctaaaaaactgggaagtcgaagtagacgacgctttcttcctaggagggatagacaaggctagagtcttgaatatattaaagccacatatattctttgatgaccaaatggtacacttgaatcatattgataaaattcctgcagtacatattccttttggaattgcgaataaataa

SEQ ID NO: 4642 - DNA, 189 bp, B.fragilis
tccgatagtatgtatcagaaaatcaatccactcatcagtggagaattgctgacgttgatcaatgtactcctgtacatcgacattgctgatttgaatgggtttgagactttgaatttcccatctcaccttgacgtcctctcccgatatatagccaacagtaacgatacaccaaactccgtttccacttag

SEQ ID NO: 4643 - DNA, 288 bp, B.fragilis
ttgcggattttaggttcattaggaatcttgtttgtatttatatttattttaagtatactggagcctaagatgtctatcatgactctgacctttgaatgtgtgtcggctctcagtacggttggttccagtctgaatgcgactcctttgctgtgtgatgaaagtaaattgctggtatcattgcttatgtttatcggccgtgtgggatttattacactggtactgggcattgtgaaacagaaaaagaatacgaaataccgttatccgagcgataacattatcataaactaa

SEQ ID NO: 4644 - DNA, 1191 bp, B.fragilis
tccggaataatcttgtatttttgcgccacgactattcaaaattcagatatgatgacccgattttcttttgtccttttcgcattaatctcacttctgctaaccgcttgccaagataagcagaaagtagtttccaacaccgaaaacgggacttccgttccactttcatacgcccaaggatttggtataacacattcctccggatacaccacaattacagtatacaatccctggaaaccaggagaaatttatgatacctactatctggtgaaaaacgaaggtcaggcagttcctactgacggactaaaagtagtaattcctctaaagagtataatgaccaactcagccactcatctgggattcctcgaacttcttggagaactggacaaagtcacgggagtctgcaactcaaattacatttataaccctactatccttcaaggtgtaaaagatggaacaataaaggatttaggtgacgctttcaatctggacatagaaaacctacttctactacatccacaggccgtaatgacgtctgcctacaatgccgaggatgaaaacggccggcgtatgaaacaaacaggattacccattttgtataatatcgaatggcaggagaagtccatcttgggacgtgcagagtggattaagttcataggagcttttttcgataaagaaaagcttgctgacagtatctttagtcagatagcagaacaatacaatgaaatcaaaaagaaggctgaaaaattatcatactctccttccattctttccggacaagattataggggaacttggtccatgccaagtggaagaagctacaatgcgcaactctttcgcgatgcaggtgccaactactattatgccaatgacaccacagtttccggaagtatatccagtagtatcgaagaagctttgatacacttcaaccaagctgatatctgggtaggtgtacaagccaacacactcgaagatttgggaaagatggatcccaaatacaaactatttaaatcctataaaaatggtaatgtatatcatataaacaaacggacaaacattaccggaggaaacgattattgggaaagtggagtagcccgcccggatctgttattgaatgatatgattaaaatcgttcatccgagcctattaccggagtacgaattgacctacatggataaattaaagagtaaatga

SEQ ID NO: 4645 - DNA, 1611 bp, B.fragilis
aagggaataatgacagcagaagatatactaaagttaagagacctcggtgaggtaagcaagatgcagttcaaagagcggcttcttgacaaatatgatattggatgcgaaatcgttgcattcagtaacacccatggcggacaattaatagtgggcatcaatgataaaacgggtaaaatcaatccgctgtcattccaagaagttcaagaaacaaccaatcttttaagcaatatagcctctgaaaatgtagtaccgggcattcttctcaccatagataccgtttcgatagaaggtggaacaatcattgtgactactatcaaagaaggattgaataatccttaccatgataacaaaggcatcgtctgggtaaagaatggagccgataaacgtaaagtattcgacaatgcagaacttgcagagatgatgtcagagtgtggtagttttattccggatgaagctgcagtgaatgatgccactattgatgatctggacgaaaagacactcaaactgtttcttagtaataagtttgagactgccctgaaaacgaaagggatgacgggcgatagactccgtgaagcctcattggatgaggtatgcagtactattgttcaaggccatgataaacaaaagctactacgcaatctgcatttcatccgtcccgatggaaaactgactattgccgccattctcctatttgccaaatatccacaacgctggttaccggtgatgactgccaagtgtatcagctttgtaggtaattccataggaggaacacaattccgcgataaagtgaatgacaccgatatggaaggtaatctacttcatcagtttgaaaccattatgagcttcttcacccgcaacctaagaacggtacaagtgaaaaaggagttcaattcaatgggtgaactggagataccctatacttgtctggtagagcttgttgtaaatgctttagttcaccgctcactcaataggaaagcacccatccgtattttcatctttgacaacagagtagagatacatagccccgggacactacctaatggattgtctgtggatgatattatagcaggaacctccatgccacgcaacaattttctctttgccaatgctatttatatgttgccttatacaggtgcaggaagtggcattcagcgtgcattgagtcaagataagaaattatcattctctaataatgagtcgttgcatgagtttgtgataacaattgagagagatggtgtcatagttggtgctgacttagacacttctctgcaaaactctgacgctaacctagacactttgcagcaagacttagacactcaacaggctattccaagcactgacttagacacttcacagctagacttagacactcagcaggctacctctaacacttctatgcgcattaaattaagtaacaaacaaaaagatattgttaactattgtagtgtaccacgaagtagcaaagagatactagaaagagctggaataagtaatcatagcaaaaatcgtgaaaagtatgttacctttttagtggaagcaggttatttggaaatgacaaatccggaaaatccaactgccagtaatcagaagtatcgtaagaaactaaagtaa

SEQ ID NO: 4646 - DNA, 183 bp, B.fragilis
acggatagaataacagatacatctatctgcatatcaagaatatactctgaatcggacttgccaaatcgaggatggaagatgaaagatgaaggtggaagatggaagatcgaaatgcatttttcgtatgagagactgcaaggctcgtttgaaaagaaaacagctcctgcaccggatgctgaataa

SEQ ID NO: 4647 - DNA, 2175 bp, B.fragilis
gttagaaagatgggcaagaaagtattagtctttttactgttgctatcatttatcggatggacaaaggctcaacaggaagagttacaaaatggtacggagcagagtaaacaactccaggtttttggacgcaatatatttgccagccggaatttgtcatttgagccaaatttaaatattcctactccggaaaattataggttggggccgggggatgaagtgattatcgatgtatggggaacttcggaaaatacggtacgagagactatttctccggaaggtaatatcatggtggagaatatcggtcctatctacctgagtggtatgaatatggaggaggctgaacggtatttgcggcatgaatttagtaagatttatgcagctatctccggagaatcggcacatatcaaggtgacgttaggaaaaatacgttccattatggtcaatgtgatgggagaggtcgaagttcccggtacgtatcggttatcggcttttgcatcggtgtttcatgctttgtatcgtgccggaggagttaatcgtataggcagtttacgaaccattcaagtcgtacgaagtggtatgaaagtagctgatgtggatgtgtatgagtatattatgaaaggaaaacttacagatgatatacgtttgtcggaaggagatgtgattttggtatccccttatgaaaatttggttggtatatcgggaaaggtgaagagaccgatgatctatgaaatgaaacatggagaaagtttagctactttgattggttatacgggtggatttaccggagatgcttatcggaatacggtccgtctggtgcgtcgtagcggaagggagaagcaaatatataatgtggaccaacaggattacgataactttattctgactgataacgatgaagtgtccgttgaggcggtattgggacgtttttcaaataaagtagaaattcatggagcggtttatcgtgcaggcatgtatcagttggatagtgtgacggggactataaagcggctgatacaacaggcggaaggtcttcgtggagatgcttttcttaatagagccttgttgaggcgggagcgtgaagatttgtctcatgaaatgattcctgttgatctgaaaaaacttatggaaggaactgcacccgatttacctctgcaaaagaatgatgtactctatatctcaagtataaaggaattggaagaagaaggagttctcttcatttatggtgacgtggcaaaaccgggctattttccctttgcgcggaatatgagtgttcaggacttgattttaaaagctggcggattattggaatcggcttcgactgttcgtatcgatgtgtcacgacgaattaaagatcctaaaagtgtttcttcttctactgtgatagggaaaagctttacagtagaattgaaaaatggactgttgataggagagagcaatacactgaaattggaaccttatgatatggtgtttgtacgtagaagtccagggtatcaaaagcaggcaaatgtgacggtcaatggggaagttacatttacaggaaactatgcgctgactaaaaagaatgaacggctgagtgacttgatagcaaaagccggagggttatcgaagagcgcctatgcgaaaggtgcgcgtctgatgcgcaggatgacggcggatgaaatccggcaaaagcaagatgcagttcggtttgcaacaaagggaaccggaaaagattcggtctctttatcttctttggaagtggatcagacttactactctgtcggtattgaacttgaaaaagctctggcaaagccgaaatcggatgaagatctggtattacgggagggcgacgtactttttgttcctaaatatgtcagtaccgtgactgttaacggtgctgtgatgtaccccaatactgtgctttatcagaaaggaagtggaattgattattatataggacaagccggtggttttggaaaccgggccttgaaacggcgtgcttatgttgtatatatgaatggtacagtctcccgattgagaagaaatacggcaaatgccattgaacccgggtgtgaaataattgtgcccagcaaaggagaacggaagaaaatgactacggcaggagcagttggcatgagtagctccattgcttctatagctgcgatggttgcttcgatggtgagtttaacaaaataa

SEQ ID NO: 4648 - DNA, 237 bp, B.fragilis
aggaatatttcatatctttataaccaaataaatgaacatcaatatttaattgatatgaactgtataacagaaacttttgaaataaaaatcatagaaaaaacatggttcgtggagaagattggcaaaagttttagatacactaaaaccgatgcctgcaactactgtcaccccggcttagagcaactttccgaaatcgctaaaatattgttggtagagcctcaaaagttatatatctaa

SEQ ID NO: 4649 - DNA, 702 bp, B.fragilis
tcagttgaattcattatgaaatacattattattggtcttggaaattacggtcatgtgttggccgaagaactttctaccttagggcacgaggtgataggggctgatttggatgaagggcgggtagatagcataaaagataagattgccaccgcttttgtgatcgatgcgacggacgagcagtctctttccgtcctgcctctcaacagtgttgatatggtgattgtcgctatcggtgaaaatttcggagcttcaattcgtgtggtggctatgttgaagcaaaagcaggtaaagcatatttatgcacgtgccattgacggggttcacaaagcggtacttgaggcttttgggttggagaagattttgactccggaggaagacgcggctcgaagtttggtgcagctattggattttggtacaaagatggaaacctttcgggtagactcggaatattatgtggttaagttcaatgttcccgagaagtttgtcggctattttgttaacgagttgaatttagatgaagaattcaatttgaagttgatcggattgaagcgttccaatacgatcaagaattgcctgggcatttctttggtggagcacaaggttgtaaacgaattgccggaagatgccaagatacgtccggatgacgtattggtgtgctatggtaaatatagtgattttcagaaattgtggaaggcgttgtga

SEQ ID NO: 4650 - DNA, 255 bp, B.fragilis
aaagaaatgttagtaaccaacaccatggaagctacagcttccactaccgacagttgccaggtcagtgaacctgtaacagcaacacaggaaactcccaggaccatcgccacttacaccgccacaacaccggccatgcaccggaaatcatttaaagagcaagaaccggctattttttccattatcggattcgccgttgcctatattgctgccctgattatcaaccgcatcatcaagacgagaaaaactcaccattaa

SEQ ID NO: 4651 - DNA, 1347 bp, B.fragilis
  unsure (1259): Identity of nucleotide sequences at the above locations are unknown.
tataaagtgttaatgaataagctgttaataactctttgccttgcagcgtcgtttatgctttccggttgttacaattccggtgagccccgcgaaaaggtattgaaaatttataactgggccgattacatcggtgacggagtgctggaagatttccaggcatattataaggagcagacaggcgaggatattcgtattgtctatcaaactttcgatatcaacgaaatcatgttgaccaagatcgaaaaagggcacgaagattttgatgtggtatgcccttcggaatacatcatcgagcggatgttgaagaaagacttgctgttgcccatcgacaccgtttttccccattcgcccgactacatgaatgacgtgtctccttatatccgggaacagatcgataagttgagtcaacccggacgcgttgccagtcattatgccgtgtgttacatgtggggaacggccgggatactgtataacaaggcttttgttcccgatgcggatgccgaaagttggagttgcctttgggatcggaaatatgccggcaagatattgatgaaagacagttaccgcgatgcgtacgggacggccatcatttacgcacatgcccgtgatctggccggaggcaaggtgacagtagaggatctgatgaacgactattctccccgtgcaatggagattgccgaaaaatacctcaaggcgatgaaacccaatatagccggttgggaggcagacttcggtaaagagatgatgaccaaaaataaagcatggctcaatatgacctggagcggagatgccaaatgggccatcgaagaagcggatgcggtaggagtggacctggactatgtagtgcctcgggaaggaagcaacatctggtatgacggctgggtgattcctaagtatgccggtaatccggaagctgccagctatttcatcaactttatgtgccgtcccgacattgctttgcggaatatggaagcgagcggttatgtaagtgctgtggcttcgcctgaaatcatggaggcgaagacagacaccaccctgacttattattcggatttgagctatttcttcggaccgggagcagacagcctgcagattgacaagatacagtacccggaccgtaaggtggtagaacgttgtgccatgattcgtgatttcggcgataagacgaaagatgttcttgaaatctggtcgcgcattaagggagacaatctgggagtgggcattacgatcctgatcttcatagtagtaggtttgatgancggctggatgatttataacgggatacagcgttttaaccccaagagattgcagaggcgccggagccgtaggcgaaagaaacagaggtga

SEQ ID NO: 4652 - DNA, 3210 bp, B.fragilis
tacttttgtacacgatcaaacaaacataaatactttttcatcaaagatatgaccctcttcacaaacatcaaatccttcgacaaatcatttttgttgaagttatggctatctcttattctctaccagttgtccgtatgccccgtatctgcacaaaaagacacgatggatatcaaagactacatcttaatcattaatacatataccgaatcattcccttggagtaaccgcttgatctcaacagcaaccaacttcgtaaaagacgaccccaaactggctgtatacaccgaacatatgaacatgataatgatagataatgacagcattctggaccaattcaaagacagtcttttcgacagatacggttcccaccgcccacgtatgctgctgttattaggcaactcttctctcatattgaaagatgatcttagaaaaatgtggggtgacattccaatggttctctgtgccggaaaagactataccgggcctgagcactattatctgacgaaacaacccattcctctttccgaacgtgtaccattggcagaattgtcccaatcctgcaatctcacctacctctatgccaatctctatatccacgagaatgtagaaatgatgttccgtacactcccccggatgaaaagattcatctacgtgggcgacgaacgctttgtcaaccaagtcaacagtcaggagattcaagaaattctacggaccaaacatccggatgtacactataccttcctgtcttcccgtgacataaagaaaaccaaccaactgatcgattcactcaactttgtcgatccccggaccacgggtattctgttttccagctggttccacaaacggcagtttgccggcaacatgatgttgacaatgatcctgcctgaaatcgtttccaccgtatcccctccaatattcgctctcaatatgattgaactgaatgacaaagagagtggaatggtgggtggttacacctacgaccagaatcacttcaatgaaaagctgtccaacatgttttcggaaatcctcagcgggaaatctccacgggatcttccacattatctgcccacagacggtacaccactcatcaactatcaggtattggtccgcaaaggtttgtctcccgacgagtggcccgctcacacccgttttctgaacaaacctatcaccttttgggacaaatataaatatttcctgccgggaacaaccgtttgcatcgccctgctcgtctggtttttcctctatcgtatccgtacgctcacgcatctcagacagatccagttgaaagaaatcgaggctatggctaattataaaaatctgatcgataacatgcctttgctctacatgcaggagaaactaatcgtaaacgaacaaggtgtagccgacgacttgatctacctgaacgtaaatccccatttcgaaaaacattttttccgtagagaggatgtcgtcggtaagcgggccagtgaactgtttcctgaatctctacctgaatttctacacttcatccagatctccctgaaggagaaccgtgccatcacattcccttattacttcaaaaagatagacagattctacgacatcgtattaaaaggtgcacatcaggagaatgtcatcgacatcttctgcgtagacagcactgaacttcatcgtgcacagcagaagttgaacgccacaaaccataaactatctatggcgctggaagtagccgacatcattccctggaaatgggacttactcagcaaaaccattctttgcgacatcaataagcccattgaactcagtgcacaaggtaataacgtaagcgaagaacagttggctgtacccgactcacaatacttctcgaaaatatataaggaggaccgcatacgagtggaacaagcttataaagacctgatagaaggacgcttggaaaaagtaaaagaagagtatcgggtgatcaacatccggaatcacactcacaaaatagagtgggtagaagcccaagctgcagtggaaacccgcgacgaaaacggaactccggtgacactggtcggttcttcacaggtaatcaccggacgtaaaaagatggaaatggaactgacttcggccaaagaccgggccgaagaatccaatcgtcttaaatctgcctttcttgccaacatgagtcacgaaatccgtactccgctcaatgccatcgtcggattttcgggaatactggcatccaccgaggaagaagaggagaaacaagaatacgtcagcatcattgagaacaacaatgcattattgttacaactcatcagtgacatcctcgacctgtcgaaaatagaagccggtacactcgagttccagtactccgacatcgaactcaacaccgagcttaaaaaactggaaagcaccctgaaactgaaattaaagtcggacgacgtacaactggaatttgttcccggcctccctgcgtgcccggtgtgtaccgaaaagaaccggctctcacaactgatcatcaatttggtgaccaatgccatcaagttcacttcccggggaagtatccgcttcggttacgaacaccgtggcaaagaactctatttctatgtcaccgataccggatgtggcatccctaaggacaaacaggaaagcatcttcggacgttttgtcaaactgaacagtttcgcacagggaacaggcctgggactctccatctgccgtaccctcgtcgagcacatgggcggacatatcggtgtagattcggaagaaggcaaaggttccacgttctggttctccctcccttataaagcggcaagcacttccgccggaacaatgcaaaaaaccgagattcagcccatctcagtagaaaaagacaaactgactatcctaatcgctgaagacaatgaaagcaactaccgcctcttcgaatcgatcctcgggcacgactatcatctgattcatgcctgggacggacgcgaagccgtcgaaagattcaaaagagaaaatccacagattattttgatggatatcaatatgccggttatggacggatacgaagccacgcaggaaatccgtaaatactcagccaaagttcctatcatagcagttacggcctttgcctacgcttcggacgagcaacgggtgatggaaaacggattcgacggatatatgcccaaaccgatcaatgcacggcaattaaaagcacaaatcacggagattatgcaaaaacggatcattttgttatga

SEQ ID NO: 4653 - DNA, 198 bp, B.fragilis
gtgacatacacaaaagtgatccccagagatttgtgcatctccttcaactccatctgcatgtctttacgcattttcaggtcgagagctgccaagggctcgtcaagcagcaacacttccggttcgttgacgatggcacgggcaatggccacacgctgctgctgtccgccggacagcgaatctacatcacgatattcgtaa

SEQ ID NO: 4654 - DNA, 1188 bp, B.fragilis
tctaatataacagagaaattctatccggaattaaaaaaacacctatctttgcataaatatttattcactaaacatactaaagcaatgaaaaagttaacttatctggctgttgcagcagttgctctcggagtggcatcttgtaacaccaacaaacccggttatgtaataacaggtactgtggaaggcgctgccgacggagatactgtatttatccaggaacgtgtgaacagacagttcaacaaactggacacagctatcatcgctaacggaacatttacattcgaaggcgcacaggattccgtagtgaaccgctacatcacttattctaaagacggcgacggagtctatgtggatttcttcctcgaaaacggtaaaatcaaggtaaacctgtctaaagacgataaatcggcaaccggtactccgaacaacgatgcttatcaggagatacggaacaagataaatgcaatcgaccagaaacaagccgctatctatcaggctatgggtgacagcacattgaccgatgaccagaagatggctaaacaaaaagaattttcagaactggaagaggcgtacagccaggctatcaaagaaggcgtacagaagaatatcaccaatccggtaggtatcatgttgttcaaacaaagcttctatgaaaactctaccgaggataacgacgctctgctgaaacaaattcccgccaactatcagaatgacgaaacgattgtgaaaatcaaggatatcactgaaaagcagaaagctactgccgccggacagaaattcatcgacttcgaaatgctgacccctgacggaaaaccggtgaaactgtctgactatgtaggcaaaggcaaagtggtattggttgacttctgggcaagctggtgtggcccatgccgccgcgaaatgcctaacattgtagaagcttatgctaaatataaaggcaaaaacttcgaaatcgtaggtgtatctctggatcaggatgccgataaatggaaagatgccatcaagaagctgaacatcacatggcctcagatgtccgacctgaaaggctggcaaaatgaaggtgcacagttgtatgctgtaaacagtatcccccacaccatgttggtggacgctgacggaacgatcctggcacgcggcctgcacggcgaaaagcttcagaccaaactggaagaagtgctgaataagtaa

SEQ ID NO: 4655 - DNA, 615 bp, B.fragilis
aacagatcaacaatgaatattatatcagacattttatattggatttctacaggactactcgttcctgacatcgtattgcttatcgtattattcggccgtgcacttctgctggtcggcagtttctacggacaatatctctcaatacgcaaaaccgaggcactactccgtaacgaactgaatgcactcactcctgccaccgttatggaactggcagacaagcttccggaaaaatcatcatcattagtcatatcgtacatacgccaggtgctccaggcacatgaaagcccggcacagatacagagactgcttgccaactttgagatagccgccgataaagatctggctatctctaaaactctgacaaagctcggacctatcctcggtttgatgggtacgcttatcccgatgggacctgcccttgccggactggcaagcggcgacattgcttcaatggcctataacatgcagattgcttttgccacgaccgttgtcggactggtagcaggcgccgtaggtttcttgacccagcaggtgaaacaacgctggtatcttcaggacatgaccaacctggaattcctttctgaattgttgaacgaaaaacgtgcggcccgatga

SEQ ID NO: 4656 - DNA, 1794 bp, B.fragilis
tactgccaaactcggataaataaactaaaaaaatatatggcaacaaaaggaactgttagtggcgttattgccaacatggtgaccctcgtcgttgatgggccggtagctcagaatgagatctgttatatctcaaccggcggagacaaattaatggcggaggtgattaaggtcgtaggtacacatgtatatgtccaggtgttcgaaagtactcgtggactgaaagtgggagccgaggccgaatttaccggacacatgcttgaagtgactttaggtcccggtatgttatcaaagaattatgatggtctgcaaaacgaccttgataagatggatggagtattcctgaagagaggacaatatacttatccgttggataaaggaagtgtatggcattttgttccccttgtcagtgtgggggataaagtggaagcatctgcctggttaggacaggtggacgagaacttccagccattgaagattatggtgcctttcactcagaaaggtgtttgcacggtgaagtcgattgttcccgaaggcgattacaagattgaagatgtggttgcagttttggtggacgaagaaggaaataccgttgaagtgaatatgatccagaaatggccggtgaagcgggctatgacgaattataaagaaaaaccgcgtccgttcaagttgcttgaaaccggtgtgcgtgtgatcgatactgtcaatccgatagtggaaggcggtaccggatttattcccggtccgttcggtacgggtaagacggtacttcagcatgccatttcaaaacaggccgaagccgatatcgtgattatcgctgcttgtggggagcgtgcaaatgaagttgtggaaatctttaccgaatttccggaattggtggacccgcacacgggacgtaagctgatggagcgtaccattattatcgcaaatacatcgaacatgccggtagcagcgcgtgaagcttctgtgtatacggccatgacgattgccgaatactatcgtgccatgggattgaaagtcctgctgatggcagactccacttcccgttgggcgcaggcattgcgtgagatgtcgaaccgtatggaggagttgcccggaccggatgcattcccgatggacttgtcctcaatcatttctaacttctatggccgtgcaggctacgtgaaactgaataacggcgagagcggttctattacctttatcggtacagtatcacctgccggtggtaacttgaaggagccggtgacagagaacaccaagaaggtagcccgttgtttctatgctctggagcaggatcgtgccgataagaagcgttatccggctgtaaatccgatcgattcttattccaagtatatcgaatatcctgaatttgaagcatacattgccgagcatatcaatgatgagtggatcggtaaggtgaacgaaatcaaaactcgcttgcaacgcggtaaggagattgccgagcagatcaatatcctgggtgatgacggtgtaccggtagagtatcacgtaatcttctggaagtccgagttgatagacttcgttatcttgcagcaggatgcgttcgacgagattgatgccgtgactccgatggagcgtcaggaggctatcttgaatatggtgatagacatctgtcatacggaatttgagtttgataactttaatgaggttatggattacttcaagaagatgattaacatctgcaagcaaatgaactattcgaagttcaagtcggaacaatatgaaggtttccagaagcaattggaggagttggttgccgagagaagtgtcaaatag

SEQ ID NO: 4657 - DNA, 597 bp, B.fragilis
cgcctgtctgcttatcatctgtatagcgatcggcctttcaatgacccttttaatcaccggaatcagcactttatgatgaatatagattttataacagccaccgtactcgacggtgcattcgccgccgtagccgctatcggatttgctattatatcgaatccaccacgaaaagccatattgatctctgctttcctcgcggctgtaggtcacggattacgttactttctgatgcatgcacatctgtttacgatggacattgctacggcttcattctttgcagctgtttccatcggtttattagccatcccttttgccaaagcgattcactgcccggcagaggttttctcgtttccgtctctcttgcccatgattccgggaatgtttgcttataaaagtatccttgcactgacaaagttcatgcagactaaagatgaaaccgattcactgcgatacctggtagatttttgccacaatggcagtaccaccatcttcgttttatttgccttggtcgtaggggcagccgtaccggtattcatcttccaccgccaatcattcacagctacccgtttactgaaaaagttggtaaaaaaaggatga

SEQ ID NO: 4658 - DNA, 891 bp, B.fragilis
agcattcctgcgtcctcagttggtagaaatgttattctaaagggatgcgttatgagtaaatattattacttggtagccggtttgccggaactcacacttgaggacagcaagctgagctatacagtagctgattttaaaacggaaatttacacgggcttgtcagtttcagatcagagattgattgatctgttttatttgaagtttgacaatgccaatgtgctgaagttcttgaaagataaggaagccgctattgatactcggggaaatttttccgcggaagaactggcggaatatatttctacccttaaagagggaggagaagtcagtgccaaggagtttcccgcttatcttgctactttcatttccgcttattttaatactccggcagagaatgctgttttattgggagatcatctggctgcactttattatgattatgcgatgaagtgtggaaataagtttgtggcttcctggttcgaatttaatctcactattaacaatattctcgtagcattgactgcgcgtaaatataaatgggatattgcctgcaatattgtgggtgatacggagatctgtgaggcattgcggacttccggagccagagatttcggactgtcgggcgaagtggactttcttgaccagttggtgaaaatcagcgaaataacagaactggtggaacgtgagaaaaagctggatgctttgcggtggaactggatggaagatgctatcttcttcgattatttcacaatcgaacgtatttttgcttttctgttgaaactggaaatgattgaacgttggatctctctggataaggaaagaggcaatcaattgttccgaagtatcatagagtcactgaagaatgaagtgcagattcctgctgaattcaggtaa

SEQ ID NO: 4659 - DNA, 600 bp, B.fragilis
gacaaagcagccgaattgacccggcttgcttgtgaggctgccaagcgtcatggagtgacggtgtcggtcgacctgaactttcgtaaaaaactatggacgaaggagaaggcgcagtccatcatgaaacctttgatgaagtatgtagacgtatgtattggtaatgaggaggatgcggaactctgtctgggatttaaacctgatgcggatgtggaaggcggacatacagatgcagagggctataagggaatttttcggcagatgatggatgagtttgggttcagctatgtgatctcgacgttgcgagaatctttctcagcatcacataatggttggaaagccatgatttataatggtgaggaattctatgtttccagacattacgatattgatccgattattgaccgtgtgggagggggggattctttctccggcggtgtcatacacggcctgcttacaaagcgaacccagggtgaggctcttgaatttgcagtggcagcatcggcattgaagcataccattaatggtgacttcaatcttgtttctgtggcggaggtcgaagcgcttgtcggaggagatgcgagcggacgtgtacaaagataa

SEQ ID NO: 4660 - DNA, 1407 bp, B.fragilis
atgcatgaagcggttagcgttaatctttatattgtcgatgcaaaattaccgtttttctccctatcattcactatctttgcacctcaaaattttaagaactattcaatgataaacgaagaaaagatacataaaagcacttccggatggtgggcactcagccctttatttgtattcttgtgtctctatttggtcacttctatcctggtgaacgatttctacaaagtacctataacggtagccttcctgatttcatcatgctacgccattgccatcacgcggggactgaatctggaacaacgggtctatcaattttcagtaggagcttccaataaaaacatcatgctgatggtgtggatatttatcctggcaggagcctttgcacaaagtgccaagcaaatgggagccattgacgctacggtaaacctgacactccatattttgccggataaccttttattggcaggcatctttctggcctcttgcttcatttcgctatccatcggtaccagtgtaggcactatcgtggctctgactcctgtcgctatcgggttggcagagaaaaccggaatcgatctgcccttcatggtagcagtggtagtgggcggctcctttttcggtgacaatctatcgtttatctccgatacaaccattgcttcgaccaagactcaaggatgcgtcatgcgcgataagtttcgggtcaactccatgattgtggtacctgccgcactggtcgtattgggtatctatatctttcaggggctttcagtctctgccccgccactggtgcaggagattgaatgggtcaaagtgatcccctaccttatcgtattgggaacggccatagccggaatgaatgttatgctggttttgataataggtatctttaccagcggtgttatcggtattgctacaggcagcctcggattcttcgactggtttggtgctatggggacggggatcaccggaatgggcgaactgattattattaccttactggcaggcggaatgcttgagacgatccgttacaatggaggaatagatttcattatccgcaaattgacccgccacgtaaacggaaagcggggagcggaactcagtattgccgctttggtaagcatcgccaatctttgtacggctaataatacgattgccatcatcactaccggaccgattgccaaagatattgcaaaaaaatttcaattggaccggagaaaaacggcaagtatcctcgacacattctcgtgcctgatacaaggcatcatcccttatggagcacaaatgctgattgctgccggactggcacagatttccccgctcagcatcatcgggaatctgtattatccgtttacaatgggtatttgcgcactattggccatcctattccggtatccgagaaagtattcctga

SEQ ID NO: 4661 - DNA, 915 bp, B.fragilis
tcgagcatggcacattctcacgaacatcatcacgagcacgtccacgaactgacgtcgctcaataaatcttttataattggcattacgctgaatattctgtttgtcctcgttgagttcggcatcggtttctattatgattctttggggttgctttccgatgccgggcacaacttgggagatgtggcaagccttgtgcttgccatgcttgctttccggttggcaaaggtgcatcccaacagtcgttatacatacggttataaaaagagtacggtactggtatctctgctcaatgccgttattcttctggttgccgtcggcattatcatcaccgagagtatagagaagttgttccatcccgttccggttgaaggtgctgccattgcctggacggcaggtgtgggagtggttatcaatgccgttacagccaggctttttatgaaagataaggaaaaagaccttaacgtgaaaggagcttatctgcatatggctgccgatacgttggtatcggtgggagtggtcatttcgggtattatcatcatgtacaccggttggacacttgtcgatccgatcatcggcctggtgattgccgtcatcattgtcatctcaacctggagcttactgcacgacagcctccgcctttcgctcgacggagtcccggtgggaatagatagtgaaaagatcgggcgggttatcctggagcaacccggtgtggagagttatcaccatctgcatatctgggcattgagcactaccgaaacagcattgactgcccatatcgtgataggcgatctccgccgtatggaagaggtaaagcgcgaggttaagcatgaactggaacatgtcgggatcactcatgccactttagaatttgagtataaaggagcatgttgcgaaggggaggattgtatttcttaa

SEQ ID NO: 4662 - DNA, 228 bp, B.fragilis
tttatttattattcacctcaatgctgtgaagaggagtggttatatccttttctaaagtattggtatctcgcatattgtcctttgtctgtccaatggcaggcaaccggtgtcttgtatgcgaatggaaaaaacagtatgggaatacgtttaaaagatttaagtaaactgggatatagagataatgtagctcgtagtctggcttgttactcttctaggcaaatattgtaa

SEQ ID NO: 4663 - DNA, 258 bp, B.fragilis
tctaccaggtatccaccgatagcaggcccgaaagagaccgaagcggcagaagcgatggaccagaaccccaatgccgtcccccgttgttcgggagggaatacatcgctcacaatagccatgccgacaggaaggagcatgccgcatccgaaaccttcgatcacccgccagaagatcagctcttcgatggtagatgaactgccacacatgaaggaaccggccgtaaatacgagtagggacaagaaatatatctttttataa

SEQ ID NO: 4664 - DNA, 2598 bp, B.fragilis
gtatttattcatcaacaagtaaacaataacattatgaaaattaaagtaagtaatgtgaatactccgaattggaaggaggtaactgtaaagtcacgtgttcctgcggaattagagaaactatctgaactggcacgcaacatttggtgggcgtggaattatgaagctactgaactcttcagagacttggatccgactctctggaaagaagccggtcagaatcctgtgcttttgcttgaacgtatgagttacgaaaaactggaagctttatcaaaagataaagtaatcctgaaacgcatgaacgacgtatatgctaaatttagagactacatggatgtgacgcccgataacaaacgtccgtcagtggcttactttagcatggaatatggtttgaatcatgttcttaaaatatattccgggggtctgggtgtattggccggcgactatctgaaagaagcttcggacagtaatgtagatctgtgtgcagtaggtttcctgtatcgctatggttactttacacaaaccctgtcgatggacggacagcagattgccaattacgaggcacagaacttcggacaactccctattgaccgcgtgacggatgcagacggcaaaccgttggtagtagatgtgccttatatggattactacgtacatgcaaatgtatggagagtgaacgtaggacgcgtttctttgtatctgctcgatacagacaatgaaatgaacagcgagtttgaccgtcctatcactcaccagctgtacggaggtgactgggaaaaccgtttgaaacaagagatcctgctgggtatcggcggtatgctgacactgaaggcattgggtatcaaaaaagatatttatcactgtaacgaaggacacgccgccctgatcaatgttcagcgtatctgcgattatgtagctaccggcctgactttcaaccaggctatcgagttggttcgtgcatcttcactgtatacggttcacactccggtgcctgccggtcacgactactttgacgaaggcttgttcggtaaatatatgggcggatatcccgttaagatgggtatcagctgggacgacctgatggatcttggacgtaacaatccgggtgataagggcgaacgtttctgtatgtctgtatttgcttgcaacacttctcaggaagtgaacggtgtaagctggctgcacggaaaagtttctcaggagatgttctcttctatctggaagggatacttccccgaagagagccatgtgggttatgtaaccaatggtgtacacttccccacctggagcgctaccgaatggaaacagctttatgctaaatactttaacgaaaacttcctgtacgatcagtcaaatccgaagatctgggaagctatctataatgtgcccgatgaagagatctggaagactcgcgtgacgatgaagaacaagctggtggattatatccgtaagcagttccgtgaaacgtggttgaagaaccagggcgatccttcacgcattgtatcgctgttggacaagatcaatccgaatgcattgctgatcggtttcggccgccgttttgccacttacaaacgtgctcacttgttgttcaccgatctggaacgcttgtctaagatcgttaacaatcccgattacccggtacagttcctcttcacaggtaaggctcacccgcacgatggtgcaggccagggactgatcaagagaatcgttgagatctctcagcgtccggaattcctgggtaagatcatcttccttgaaaactacgatatgcagttggcccgtcgtctggtgaccggagttgatatctggttgaatactccgacccgtccgctcgaagcatccggtacatcgggtgagaaagcgttgatgaatggtgtattgaacttctctgtactcgacggatggtggcttgaaggttaccgcgaaggtgcaggttgggcattgaccgaaaaacgtacttatcagaaccaggaacatcaggatcagctcgacgcagctactatctacagtatcctcgaaacagaaatcctgccgctgtattatgcacgcaacaagaagggatactctgaaggctggattaagagtgtgaaaaactcgatcgcccagatcgctcctcactataccatgaagcgtcagctcgacgattactacagtaagttctactgcaaggaagctaaacgtttcaaagaactgtctgccaatgacaatgcaaaggcaaaagagatagcagcctggaaagaagaagtcgttgctaagtgggactctatcgagattgtttcaaaagagagggaagcagacattgcacaaggcgatatcgaaagcggcaaagagtataccattacagttgtcgttgacgagaaaggattgaacgatgcagtgggactggagttggttacaacttatacgactccggaaggcaagcagcatgtatattcggtagaaccattcagtgtgatcaagaaagaaggcgacctgtatacattccaggctaagcacagcttgtcgaatgcaggaagctttaaagtggcataccgtatgttcccgaaaaatcaggatctgcctcaccgtcaagacttctgctacgtacgttggttcgtctga

SEQ ID NO: 4665 - DNA, 696 bp, B.fragilis
ctaaaacaacagaacattctcagttacatgaaaataaattctctgttaatagccattactctgctgggaacgatgcttatatcgttctcagcttgtaatgggatattgagcagcctatatgatgaaccggaaaccgcaaaggatttcggcttcattacgatagatcatgccaatcatagcggtacggtacgggtggatgctacccaatatacaaaatggaactacatcaatctgcacaccctgcagattgactcggccaaagttactgcagaaggtgcggatgatccggacacatgggaccttgccattcatcgatacgatgtaaagactaatggcggtgaggtgcttgaaaccgattatcaaagcctgagtgcactgaaaaacgcaggcagcatgcctcaaggtatctttgtcgccgacgaatggaccacaaataaaatagctgtcgacgtttcacacatgatggaggataacggttatctgatttatgctccgtctgacttcaatccggaactttcaaaatggctcaacgtcgataccagtgaaatgcctcccatttacactccgtccaacaaagtctatctgctcaggatgaaagacggcacaatggctgccatccgcctggtgagttacatgaatgctgcgggcataaagggatacatgacttttgactacatctacccatacgaaccataa

SEQ ID NO: 4666 - DNA, 1071 bp, B.fragilis
acgaataaacaagaaaacgatatggaaacaaaaaaattaaagaaaaatgccctcttcaatcccgaaggtgatacagaaacccgtctcagaaagatgatcggaggcaatacaaccaatctgaatgatttcaataacatgcgatacaaatgggtaagcgactggtatcgtcaggccatgaataacttctggatacctgaagaaatcaatctgacacaagataccaaggactatccccatctgaccccggccgaacgaacagcgtatgataaaattctgagcttcctcgtcttcctggattctttgcagagtaacaatctcccgacactcagcgaatacatcacggcaaacgaagtcaacctctgcctgcatattcaagcatttcaagagtgtgtacacagccagagctacagctatatgctcgactctatctgtagtccggaggaacgcaatgacattttgtatcaatggaaaacagacgaacatctgctaaggagaaatacgtttatcggcaattgctacaatgaattccaggaaaatcgtgacggatttgccttgataaagaccctaattgccaattacatccttgaaggtatttacttctacagtggttttatgtttttctacaatctgagccgtaacggaaagatgtccggatcggctcaggaaatccgttacatcaaccgggatgaaaacacccatctctggctatttcgcaacatcattctggagttgaagaaggaagaaccggaactgtttacgcctgacaaggtgaaagtgtatgaagagatgatgcgtgaaggagtgaaacaggaaatcgcatggggacaatatgtaataggcgaccaaatccagggcctcaaccgacaaatgatctctgactatatccactttctgggtaatctccgttggagtagcctgggttacactcctctgtacgaagacaaccgaaaggaaccggaaagcatgcattgggtatcgcaatattcaaatgccaacatggtaaaaacggacttcttcgaagcgaaaagtacggcgtatgccaaaagtactgcgctggaagatgatttataa

SEQ ID NO: 4667 - DNA, 1212 bp, B.fragilis
tcacattataaaaacaacaaaaacatgcgacaaacaattgcttcaaaaactccccgtatcgaggtagtggacgcattgcgcggttttgccgtgatggcgatcctgctggttcataaccttgagcactttatctttcctgtatatcccgccgcagcctcccaaccgggatggctcaatatcctcgacgaaggggtattcagtgtgacattttctttatttgccgggaaagcgtatgctatttttgctttgcttttcggattgacgttctacatacagtataccaaccaacagaagaaaggcaaggattttggttaccgttttctttggcgtctgctcctgttgggtggttttgccactttgaatgcggcattcttccccgcaggagatgtgttgctgctattctgtgtggtaggtattttcctgtttattgtccgtaagtggagtgaccgtacggtatttatcctggccattttcctgctgctgcaaccggtggaatggtatcattacgtgatgaatcttttcaatcccgcccattctttgcccgacctgggagtcggtcagatgtatggcgaagtagccgaatataccaaggaaggagatttctggaagtttatctggggaaatgtaaccttgggacaaaaagcgagcctgttctgggcaataggtgcaggacgcttcctgcagacagccggactgtttctgctgggaatgttgatcggacgaaagcaactcttcgttgcttcggaggccacgatccgcttttgggtgaaagccctgatctggagtgccgttctgtttggtcctctctatcagttgaaagtgcaattgatggatgccggacagccggatatgatacgccagacggtaggggtagtgatggatatgtggcaaaagtttgctttcacaatagtattggtcgcttcgttcgtgctgctatatcaaacggagaaattcaggaagctgacagccgatttgcggttttatggtaagatgagtctgacgaactacatctcccagtctattgccggagctattatttatttcccgttcgcgctgtatctggccccttattgcggttataccgtcagcctgctgataggctttgcattcttccttttgcaggttcgtttctgtaaatggtggctgaaggcgcataagcagggacctttggaaagcatctggcataaactgacctggattcgttcggaataa

SEQ ID NO: 4668 - DNA, 1335 bp, B.fragilis
attgtaaataataacatggctacaaaagcatttcaaaaaatatatactaagattactcagattaccaaggccacctgttcgctgaaagctacaggggtaggatatgatgagttggccactgtgaatggtaaactggctcaggttgtaaagattgccggtgacgaagtgactttgcaggtgtttgagggtacggaaggtatcccgaccaatgccgaagttgtatttctgggtaaatcgcctacgctgaaagtgagcgagcaactggccggacgttttttcaacgctttcggtgatcctatcgacggaggaccggagatcgaagggcaggaggtaccgatcggagggccgtctgtaaacccggtacggcgtaaacagccttccgagctgattgcaaccggtatcgcaggtatcgacttgaacaatacactggtttccggtcagaagattccgttcttcgccgatcccgaccaaccgttcaaccaggtgatggctaacgtggcgttacgtgcagaaacagataagattattctgggcggtatgggtatgacaaacgatgactacctgtatttcaagaatgtattttccaatgccggtgcgctcgaccgtatcgtcagtttcgtgaataccacggagaaccctccggtagaacgtttgctggtaccggatatggctttgactgcggctgaatatttcgcagtacagcacaatcagaaagtattggttctgctgaccgatatgacttcgtatgccgatgctttggctatcgtgtcaaaccgtatggaccagattccttcgaaagattctatgccgggttcgctctattcggatcttgccaagatctacgaaaaggctgtacagttccccgatggcggctccatcacgattattgccgtgactacattgtccggtggtgatattacgcatgctgtgccggataatacaggctacatcaccgaaggacagttgttcctgcgccgtgacagtgacatcggtaaggttattgtcgatccgttccgttcattgtcccgtctgaaacagttggtaaccggtaagaaaacccgtaaagaccatccgcaggtgatgaatgctgccgtgcgtttgtatgccgatgccgctaatgccaagactaaattggaaaatggtttcgacctgaccaactatgacgaacgtactttagcttttgccaaagattactccaatcagttgctggccatcgacgtcaatctggatacgaccgaaatgctcgatgtagcctggggactgttcggcaaatacttccgtccggaagaagtaaatatcaagaaggaactggtagatcagtattggaaaaaatag

SEQ ID NO: 4669 - DNA, 1218 bp, B.fragilis
caactcataaaacttacaccgaacaagttccgtgtgcggacacaaagatacgtaaattttcaggattacaaaaattgttatatatttgtgtccatagaaataaaactattagtgtgtccgggcacaaaacctcacacaaataaaggtgaacgcatgaataaattgccagaaagaatcagaattaaggatattgcccgcttggcaaatgtatctgtaggaactgtagaccgggtgctccatggccgtagcggagtgtcggaagcaagccgtaagcgtgtagaagaaatcttaaagcaactcgactatcagcctaatatgtatgccagcgcgttggcttccaataagaaatatacttttgcctgtctgctacccaaacatctggaaggcgaatattggacagatgtgcaaaaagggattcgggaagcggttaccacatactccgacttcaatatttcggcaaatatcacccattatgacccctacgattacaattcgtttgtggcaaccagtcaggccgttatcgaagaacaaccggacggagtaatgtttgctcccactgtaccacaatataccaaaggatttaccgatgcactaaatgaactgggtataccatatatatatattgattcacaaatcaaagacgcccctccacttgccttcttcggtcaaaactcacaccagagcggatactttgcagcacgcatgctgatgttactcgccgtaaatgaccgggaaatcgtaattttccgcaagatacacgaaggagtgatcggctcgaaccagcaggaaagccgcgaaatcggatttcgccaatatatgcaagagcatcatcccgcctgtaacatccttgaactcaacctgcacgccgacctgaatattgaagatagccggatgctggatgacttcttccgcgaacatccggacgtcaagcatggcatcacgttcaattcaaaagtatacatcatcggtgaatacctgcaacaacgcaggaaaagtgatttcagcctgatcggttacgacttgctcgagcgaaacgtaacgtgcctgaaggaaggcactgtctctttcctgattgcacagcaaccggaattacaaggattcaatagtatcaaaactttgtgtgatcatctgatattcagaaaagaagtggcttgtaccaactatatgcccatcgatctcctgaccaaagaaaatatcgactattatcacagtaagtaa

SEQ ID NO: 4670 - DNA, 1800 bp, B.fragilis
agacaaataaaaataaatatgcaaagactactaaaatcggcatattgcttcttcgcagccctcttgttgacgacagcagctgccgcacaacataaaatatccggcagggtgatcgataccacccaggaacctctggtgggtgccaccatcaccctgaaagaaaaaccgtctgtcggcaccaccaccgatacggaaggacgctacaccctgacactgccggaccagaaagaatataccgtacaggtctcttttgtgggatatgtgaccgctacaaaaaaaacaacagctgcccgtcaaagtcgtctcgatttcattctgaaagaagatcagatgaatctgagtaccgtagttatcaccggaacacgtactccgaaactactgaaagatgctccgatcatcacccgggtaatcacagccggcgatctgaagaaagtggacgcaacccatatcggacaattgcttcaggtagaactaccgggtatcgagttctcttattcaatggatcagcaggtaaagctcaacatgcagggatttggcggtaatgccgtcctctttctggtagatggcgaacgtctggccggagaaacactggataacatagactacaaccgcctcaacctggacaatgtagaacgagtggaaatagtgaaaggcgcggcctctacgctgtatggttcaagtgccatcgggggggtaatcaatatcattaccaaagcttcggacgatccgtggaatctgaacctcaatactcgtttcggagtacataatgatcagcggcatgggggtacggtaggattcaatgccggcaagttctacagccagaccaacgtacaatataccaacatagactcttataacgtaaaacagggggattatacgaccatcaacggcaataaaacctggaacgtgaaggaacgcctgatgttcactccgaacgagcaattgcgactgacggcacgtgctggctattatttccgtgaacgggatgcctcctcggaaaccaagaaccgttatcgcggattcagtggcgggctgaaaggaaactacgacttcaacacgaaaagtaacctggaactggcctacacattcgaccagtacgacaaaagtgactatctggtatcgtataagaatgatatccgcgactacagtaatgtgcaacacagtgtacgcgcgctttacaattatacgttcaacgataagaacacgctcaccgtcggaggagactatctacgagattatctgatgtcgtatcagttcaaagaaaacgccgattataccatgcattccgccgatgctttcggacagttcgactggaatcccacggaacacttcaacgtgattgccggattgaggttcgactacttctccgaatcgaacgtgcgccatttctcaccgcatctgggattgatgtacaagataggaaactgctcgctgaggggctcttatgcgcaggggttccgttcgcccaccttgaaagagatgcacatgaacttctatatggcaaacaccatgatgatttatggtaacccggatctggagccggaaaccagtcacaacttctcactctccggagaatataccaaaaaccgttataattttacgctgacaggatattataacctggtgcacggtcgccatcaagtatacctctttcagagataccgacggaatgatcgcacaaagatatatcaataccccacgggtagacattgccggaatagatgccaatgcctctgccaaatatccttgcggtataggtgcacgtatctcgtatacgtacatccacgagttcatgcgtga

SEQ ID NO: 4671 - DNA, 1872 bp, B.fragilis
gtcatcgcaaaagattctgaagtcacagcaggaaaaaaggaaggaggcagaagcatgattacgaaaatgaagaaactcacgttcctggtttatcataaggagtacgaagatttcctgaacagtcttcgtgaactcggagtggtccatattgtagagaagcagcagggagcggcggagaatgtcgaactgcaagataatattcgtctttctgcccgtctggccgccgcattgaagttgcttcagaaccagaagcacgagaaggatgcggtcattgctgccaatggcggtagtgccgaacgtggtttgcaggtgctcgatgaaatagatgccttgcaggccgaacacagtaaactgttgcaacagcagcaaacctgtggcaaggagaaagacgctttggaggcttggggcaactttgagccggaaggcatacaacgtttgaaagatgccggttatgtagtcggcttctatacctgctccgaaggtaactacaaggaagaatgggaagcggaatacaacgctatgatcatctgccgcatatcctcaaaagtctttttcatcaccgtgaccaaggacggggaggaagtcgatctggatgtggagcaagctaaactgccatcgcagtcactggcccagctcgaggcgcaatatgcgaatacagagaccgcacttgaagagaatgaaaagaagttggtcgctttgtccgaaaccgatatcccttcgctgaaggaggctttgaaacaggtgcagactgaaatagaattttcaaaagtcgtattgagtacagagcagactgcgggtgacaaattgatgttgctcgaaggatgggcccctgctaccagcaaggtagagatagaggcttatctgaacgatgcacatatttattatgagatcacagatccgacaccggaagacaacgtgccgatcgaactgaataacaaaggtttctttgcctggttcgagcccatttgcaaactctacatgttgcccaagtataatgaactggacctgaccccgttctttgccccgttctttatgatctttttcgggctctgcctgggagattccggttatggattattcctgtttgtaggagctacggcttatcgtctattggcgaaaaaactgagtcagtcggctaaatcgatcatttcgctgattcagatactggcaacttccactttcttctgcggattgctgaccgggacttttttcggagccaatatttacgatctgccctggccgttcatccagcgcctgaagagtgccgttttcatggataataatgacatgttccaactttcactgattctgggtgcggtacagatcttgttcggcatggtactgaaagctgtcaatcagactatccagtttggcttcaagtatgccattgctacaatcggatggatcatcctcttgctatcgttagccttctcggcactgttgccgaaagtgatgccgatgggaagtacggttcatttgatcatcatgggtattgccggcgttatgattttcctgttcaacagtccggggaagaacatcttcctgaatatcgggctgggcttatgggattcttataacatggcgacaggtctgttgggcgacgttctgtcatacgtccgtttgttcgctttgggattgtcgggaggtatccttgccggcgtattcaatagtttggcagtgggcatgagtccggacaatgtgattgccggccccattgtgatggtattgatttttgtaatcggccatgccatcaatatctttatgaatgtgctcggagccatggttcatcctatgcgtctgaccttcgtggagtttttcaagaattccggttacgaaggtggtggcaaagagtacaaaccattcagaaaataa

SEQ ID NO: 4672 - DNA, 429 bp, B.fragilis
attatgggaaagaaagtcgttacattaggcgaaatcatgcttcggttgtctcctccgggaaatacccgctttgtccagtcggactcttttgatgtggtatatggtggaggtgaggctaacgtggcggtgagttgtgccaattatggtcacgacgcttattttataaccaaactgcctgaacatgaaatcgggcagtcggcagtaaatgcactccgtaaatacggggtaaagacagactatattgcgcggggaggcgaacgtgtaggaatctattatttggaaaccggtgcagctatgcgtcccagtaaagtgatttacgatcgtgcccattctgccattgccgaggccgttgcagcggactttgattttgacaagatcatggagggggccgactggatccattggtctggtattactcctgccatctaa

SEQ ID NO: 4673 - DNA, 360 bp, B.fragilis
agaatgaagaacttccatcctacgggaacttgtcccatcagggacgtattatgccggctgggcgacaagtggtcgatgctggtgctggtgacgctgaatgcgaacggaacgatgcgctttggtgacattcataaaacaatagacgatatttcgcaacggatgctgactgttactctccgtacgttggaggccgacgggttggtggaacggaaagcatatgcggaagtaccaccgagggtggaatattgcctgacggaaatgggacatagtttgattccacacgtcgaagcattggttggatgggcactggatcatatgacaatgatttttgaacatagagaacaacagaaagggttatga

SEQ ID NO: 4674 - DNA, 759 bp, B.fragilis
acggcttctgacccaagaacagactttggtgtacatgctaaaattaatcagagaagaataatcggacagagtgaaaaagctccgaacattccgataattataaaaaagaactggaagtctttgtcaatcaaaacaaaacccttatctttgcacccgctattacgagttagtagcattaattcaaatcattcattaaaaaaacatttatttaaaatggcaacaagaattagattgcaaagacatggacgtaaaagctacgctttctactctatcgttattgcagacagcagagcaccacgtgatggtaaatttacagagaagattggtacttacaaccctaacaccaatcctgctacagtagatttgaatttcgaacgtgccttgcactgggtgctggtaggtgcacaaccttcagacacagttcgcaacatcctttcacgtgaaggcgtttatatgaagaaacacctcctcggcggtgtagctaaaggcgcatttggtgaagctgaagctgaagctaaattcgaagcttggaagaacaacaaacagtcaggtctgtctgctctgaaagctaaagaagaggaagctaagaaagctgaagcaaaagcacgtctggaagctgaaaagaaagtaaacgaagtaaaagcaaaagcattggctgaaaagaaagctgctgaagaagctgctaaggctgctgctgaagctcccgcagaagaagctgctccggcagaagaagctgcaactgaagctgctgctgaataa

SEQ ID NO: 4675 - DNA, 1344 bp, B.fragilis
  unsure (110): Identity of nucleotide sequences at the above locations are unknown.
gattttgacgatgctttagtctcacctctgtttctttcgcctacggctccggcgcctctgcaatctcttggggttaaaacgctgtatcccgttataaatcatccagccgntcatcaaacctactactatgaagatcaggatcgtaatgcccactcccagattgtctcccttaatgcgcgaccagatttcaagaacatctttcgtcttatcgccgaaatcacgaatcatggcacaacgttctaccaccttacggtccgggtactgtatcttgtcaatctgcaggctgtctgctcccggtccgaagaaatagctcaaatccgaataataagtcagggtggtgtctgtcttcgcctccatgatttcaggcgaagccacagcacttacataaccgctcgcttccatattccgcaaagcaatgtcgggacggcacataaagttgatgaaatagctggcagcttccggattaccggcatacttaggaatcacccagccgtcataccagatgttgcttccttcccgaggcactacatagtccaggtccactcctaccgcatccgcttcttcgatggcccatttggcatctccgctccaggtcatattgagccatgctttatttttggtcatcatctctttaccgaagtctgcctcccaaccggctatattgggtttcatcgccttgaggtatttttcggcaatctccattgcacggggagaatagtcgttcatcagatcctctactgtcaccttgcctccggccagatcacgggcatgtgcgtaaatgatggccgtcccgtacgcatcgcggtaactgtctttcatcaatatcttgccggcatatttccgatcccaaaggcaactccaactttcggcatccgcatcgggaacaaaagccttgttatacagtatcccggccgttccccacatgtaacacacggcataatgactggcaacgcgtccgggttgactcaacttatcgatctgttcccggatataaggagacacgtcattcatgtagtcgggcgaatggggaaaaacggtgtcgatgggcaacagcaagtctttcttcaacatccgctcgatgatgtattccgaagggcataccacatcaaaatcttcgtgccctttttcgatcttggtcaacatgatttcgttgatatcgaaagtttgatagacaatacgaatatcctcgcctgtctgctccttataatatgcctggaaatcttccagcactccgtcaccgatgtaatcggcccagttataaattttcaataccttttcgcggggctcaccggaattgtaacaaccggaaagcataaacgacgctgcaaggcaaagagttattaa

SEQ ID NO: 4676 - DNA, 465 bp, B.fragilis
agaacaacagaaagggttatgaaagtcgaacaggtattttcagacaggaagcgtttcctcgatttgctcttgctggcagatgagcaggaagatatgatagaccggtatctggaacgtggagatatgttcgctctatatgatgaagacaagctcagggcggtttgtgtggttactaacgaggggaaaggaatttacgaattaaagaatatcgcaacttgtccggatagccagcgtaagggatatggtaaaagcctgattgaatatctgtttcaccattattcagaccgatgctcggtcatgtttgtgggaaccggagatactccacatacgcttttattctatcaatcctgcggatttattccttcccatcgtattaagaattttttcaccgaccattatgatcatcctatttatgagaacggcatccggctcagggatatggtttatttgaagagggaaaaataa

SEQ ID NO: 4677 - DNA, 732 bp, B.fragilis
cgattaaaagaaaaaactatgttatcagaaaaatatggtcgtacctatcactatccgttctctcccgggacgacgagtgacgaccggatcaatcatacatattgggaagatatccggcagataagcaccttggtgcataccgagaagctggatggagagaataattgtttgagcagatatggagtctttgcccgttcgcatgtcgcacctaccacttcgccatggacaagccagttgcgtcaacgctgggagttgctgaaaaacgatctgggagatattgaactgttcggtgaaaatctgtatgccgttcattccattgagtataagcggctggaaacacatttttatgtatttgctgtccgttgcttggacaaatggctgtcatgggatgaagtgaaattttatgctgcactgttcgatttgccaaccgtgcccgaattgtgcacggagtgcgtggacggattaacagtagcatctttggaacagcatgttgtttgtttggcgcaggagccgagtgtcttcggctcctgtgatgcacagaccggtctggactgtacccgggaaggagtggttacccggaatatcggtgaatatgctactgccgattttgctcacaatgtgtttaagtatgtccgtaaaggtcatgtacaaacaggggagcattggacacgtcattggaaacgtgcccgtctggtatgggagttgaaacaagagaaaggaggtaatcgatga

SEQ ID NO: 4678 - DNA, 1116 bp, B.fragilis
tcgatgatttggaaattgagcgaacggaaagactggaactcgttggaacaacagtttgggtgggtacgggatatgaaccaagttcctcagcatacggtgcatcatgccgaaggaagtgtggctgtacatactcgcatggtgctcgaagcattgctgcgacaacctgcctatccgatgcttccggaacaggaacgggaaatactttgggcagccgctttacttcacgatgtggaaaaacgttcgacttcagtcgatgagggtaatggacaggttacctctaagaaccatgctaaacgtggggagactactgtccgtactcttctttatagagatatacctgctcctttcaatatacgcgagcatatagcttcactggtacgccatcatggtctgcctatttggttgatggaacgcgaagatcctttaaagcgtgcttgtgaggcttcgctgaggctggacacctcgttgctgaaacaattgactgttgccgatatttgcggacgtatcagtacagacaaagaagtgttgctggaggctaccgaattttttgagatgttctgtcgggagcagcaatgttggggaaaggcacgggaatttgccaatggcacagcccgttttcactactttcatacaccccgatcctatatcgattatgttccccacgatgattttaaatgtgaggtaacattgcttgtaggtctgcccggtatgggaaaagactattatatcgaatctcgatgtgccgatatgccggttgtcagtttggatgccatccggcgtaaacataagtttagtcccactgacaaggcggccaatggctgggtggcacaaactgctaaagaacaggcccggatctatcttcgaaagggacaggacttcatttggaatgctaccaacgtgagccgtcaaaggcgtactcagttgatcgacttgttcattacgtatggggcacgggttaaaattgtctatatagagaaaccttattcagtctggcggcgacagaacagtacacgcgaatatgaagttccggaaacggttctggataagatgttaggtaggttggaagttcctcagttgacagaagcccacgaggtggtttatgtcgtagaggaataa

SEQ ID NO: 4679 - DNA, 198 bp, B.fragilis
agggggggttgtaccccccctcccgccaagactaaagtttccctgatcaccgcctatcgggatcaggggttagtcgggttcctaaagcccaacccgaccggtgaagcccgatgcaaaacacggttattattccctgtcctacctgttggagtgatgtggaaacggaggaagtgccacccccccggcctgaggaattag

SEQ ID NO: 4680 - DNA, 186 bp, B.fragilis
ttcttgctgtgttccccgaactttatgctatcgtggcattggctgctaccttccttatcggtagtgcgcttgcataaactaatgatttataaaaaacacttaagcgttttcgacagaacgtttaagtgttttctgaaaagacttaagcgttttccgaaaacacttaagtctttttttatgctctga

SEQ ID NO: 4681 - DNA, 1548 bp, B.fragilis
cgtgaagatcgtcaaagaatgaaagaaagttcttcttataaatggatcgtattgggcaacatcatgataggcacctttatggcggtgcttgattctacagtcgtcaataccgggctgcctgtgattatgggtacgctcggtgcggatatcaatgtggccgaatgggtgctgaccggatacatgctttcgatggcgagtattcttcctgctgccggatggctgtccgaacgcttcggttataaaaagatatatttcttgtccctactcgtatttacggccggttccttcatgtgtggcagttcatctaccatcgaagagctgatcttctggcgggtgatcgaaggtttcggatgcggcatgctccttcctgtcggcatggctattgtgagcgatgtattccctcccgaacaacgggggacggcattggggttctggtccatcgcttctgccgcttcggtctctttcgggcctgctatcggtggatacctggtagattatatggactggaactatatcttttatgtcaacatcccgataggaatcctggccctgatcgtcactgccattgtgcaaaaggaacatgtgaaaggaaccggagttcctttcgatatcccgggtttcatcacttcagccatcttcttgcctgtcttcatgtacgggctttccgaagtcaattcgtcaaccaattccatgggatggagcagtcccgtagtacttggtgccatgtggattgcagtggtcacttttattcttttcctttatttcgagtttaccgtcaagacaccgctgatcaatctgcgcctgtttgtcgacagggactttgcgttgtccaacctgattctgtttgtttttggtatcggcatgttcggcagtacgtttttgattccgctctatttacaggacaatctgggctattcggctttgcaggccggtatgtttttcatgccagtggggattatccagggagtggcttctcctttgtccggcaaactgatgcaacggatcaaccccaaggtctttatcgtgtcgggaatcctgttgatggctttgagtttctatatgaactattatctatcttttctgaccgagaagtggtacatcatgctgagtctttatctgcgcgggctgggtatgggattgctcttcacccctttgctgaccctgtcgctggtgaatatccgtaacagtaatatggcacaggcttccagtatcacgaacattgtccggcagatgggaggaagtttcggagtagccatcttcagtcatctgttgacacagcgtacggcttttcacacgcagcgatatggcgaagcactcaactatacaggagacgtataccggcagacccttcattccttgagccggtttatagaacatacagggggcagaacgcccgatacagcccaagaagtggcggagatgctgatattgaagcgtatcgatctggagggatacatcagtgccattaacgacgatttttttatcgcctttatcgtcacgttgctgtgtgtcgttccggtactgtttctcaggacgaagaaaggatag

SEQ ID NO: 4682 - DNA, 930 bp, B.fragilis
ctttgcaaccggatttataaacatcccgacatagataaaaaaaacgcatttattaaaatactaactactaaaataaaatgccaaatgaaaattaagagtttactgactatgatgtttgtgctgtgcgcttgtgcagcttgtaatgacgacaaaaatgaagaaacacctctcaatcaagtagtagccggaaaatacgacggatacaccaaagctgtggcgcaatacttccccgcaggacaatatgctgacaaacaaagcatcacactgactcctaacgacaacggaacagtaaacattgcctatacctccgagtcattcggtgaattcagtatcagcaatgccactgtggaattaaaaaatgacgcgtacctcgttaaaggagacgggaaaacaaccatgggtatgaatgggggcacccctaaagaatatgattgcacatttgaaggaacaatcagcaaagacaagaaaacatctgccctcgagttcaatgtactggcagtaatgaacggactgactgtcactttcactcaaggagaagctccggcagcagtaatggcagcaggctcttataagggatatactaaagccgttgcccagtatttccctaacggacaatatgctgcagaccagactatcaaagtgaccgccaatgaagacggtactgtaaacgtaacatacacttcgacttcgttcggtgaattcaccattaacaatgcaactgtaaaatcagagaacaacgcatacactattaatggagaaggaaaaagcgtaatgggcatggaaggcaaagaacctaaagagtatgcctgcaccctcaaaggaacaatcgatgcagccaaagcaacccccactttcgaaatatcggtacctgccgtaatgaacggactgaccattactttcgccacaggggacgtaccggaaaataaatga

SEQ ID NO: 4683 - DNA, 186 bp, B.fragilis
gtatggttacggcatactggccggatggttactcccttttttgtctatccttattgtttttctgtaaaagtgaaaaacagaaccccgttttcaggacttctggaaggggtgaagttggctgctaagtcttccggttgccctatatgcccgtttttaaatagagggtgcgttagcagaatcttttaa

SEQ ID NO: 4684 - DNA, 354 bp, B.fragilis
attgttgaacgaaaaacgtgcggcccgatgaaacgaaacctactcagaaaagaagaagatgctgacccgatcagcgttgtatcgaacctgttcgatgtagccatggtttttgccgtagccctgatggtagctcttgtcagccgctacaatatgaccgaggttttctctcaggaagactacacgatggtgaaaaatccgggaaaagaaaacatggaaattattaccaaagagggacagaaaatcaaccgttatactccttcggaagaccagcagaaaagcggtaaaaaaggaaagaaagtaggtatcgcctatgaactcgataatggggaaatcatctacgttccggaagaataa

SEQ ID NO: 4685 - DNA, 417 bp, B.fragilis
ttagatattagtaggtattgccttcacttggtgatctgcgtacttttgtgccatcaccaaaacgttaaagttatgatggaactaatcagcagaacccgcaatggaatgatcacttactgtgcccattgtaaagtgtatcatctggaatttggcaaccttttctttcgtctgtccgaagccggatttgagtgtctacgcaattatattgtatcgattaacggaccttactgtgagaggtcgaacaggaaaatgaatgccaaccggaagatctttctgaaattgccggcccagaatgtctatttctgtgtctgtacggccgaacttgaagaactgaagtctctggtcttgctgcagtcgccggccgttgaagaaacggatggcttgataccttttatgcatgatatttcattgaactaa

SEQ ID NO: 4686 - DNA, 636 bp, B.fragilis
ataaagaataggataatggaaaagacgtatttacaaatcacttcaggacgtggtcctgtagagtgttgccgtgtagtggctttggtactcgaaaaaatattgagagaagcacagaaacggaaattgagagtagaaatcctggaaaaagagactggtcctgtcaatcgcactttgttgtcggcagtcgttgcactcgaaggtgcaggttgcgatgtattggctgacgaatgggaagggactgtgctatggattgcccgtagcccgtatcggattcatcacaggcggaagaactggtttgtcggtgtgcagactttcctcctgtccgaaagtcgtgaggctaccgaagatgatatccggtatgaaaccttacgggcgtccggacccggagggcaacatgtcaacaagacagaatctgccgtaagagctgttcatatccccagcggaatcagtgtagtggcatccgaccagcgttcgcaatggcagaataaaaaactggctactgaacgattgttggtcaagctgaccgcttggaacatagagcaagcgatgattcaggcacagaccaattggagcaatcacaacagccttcaaaggggaaacccggtgaagatcattcaggaagaactccggttttaa

SEQ ID NO: 4687 - DNA, 300 bp, B.fragilis
ccggaaaccagtgtattgttcaagtcgatacctgcgataccggttgcaatcagctcggaaggctgtttacgccgtaccgggtttacagacggccctccgatcggtacctcctgcccttcgatctccggtcctccgtcgataggatcaccgaaagcgttgaaaaaacgtccggccagttgctcgctcactttcagcgtaggcgatttacccagaaatacaacttcggcattggtcgggataccttccgtaccctcaaacacctgcaaagtcacttcgtcaccggcaatctttacaacctga

SEQ ID NO: 4688 - DNA, 4404 bp, B.fragilis
cggaaaaggctaagccagcggatatctccgatcgtccggccggcatttagtaagaacgaaataaaccaaagaacaaaaaacaatatgaaaaagaaacaaatcatcaccacttgttgtgtggctgcggcaatactcgtcggggtattcgtctggcaagcctacttcagtgccacgaagattgcctttgtcaatttccagaccatcaacctgggaaatatttcgaaggcgaacgacaattcatttgtcaaactaagggaggtctctaccgatcacctggacgaactgacgggctatgatatggtgttcgtcaacggtatgggattgcgcatcgtcgaagaacaacgccaacagatacaacgggcggccgacaaaggtataccggtgtacacctccatggctaccaatcccgcaaacaatatctgcaatctcgattcggtacagatgagtcaaatacgtcaatacctgactaatgcgggaaaagtaaattaccggaatctgctttcgtatgtccgcaaagagattgatggtaagctgatctccgcccccgtaccggaagcaccggtagaaaagccgaccgacattctttaccacgccggagtgaagaacccggatgatgaaatggaatttctcaacgtaaccgattatgaaaagttccttcgtgaaaacggactctatcatgaaggtgcccgcaaggttgtgatcaccgggcagatggcggatgccacaggactaatcctggcactcgaaaaagccggacacaatgtatatccgatctcttctttcacccgtttcatggagttcgtccgtgaaatacgaccggatgctgttatcaatatggcacacggacgcatgggcgacgatatggtggaatatctaaaagaacgcaatatccctctctttgcaccactcacagtcaacagcctggtagaagagtgggaaaacgatccgatgggtatgtcgggaggatttctttcgcaaagcgtagtgacaccggaaattgacggtgccatccgtcctttcgccctctttgcccaatacaaggacgatgaaggactgcaacactctttcgccgttccggaacggttggagacatttgtcaacacagtgaacaattatctcaccttgaaaacaaaacccaacagcgaaaagcatatagccatcgtctactacaaaggccccggacaaaatgccctcacagcaagcggaatggaagtaggcccgtcactctacaacctgctgctgagaatgaagaaagaaggctaccgggtagaaaaccttccggagagcgccaaagagctggaaaagatgatccaggcacagggagccgtattcggaatgtatgcagaaggcgcatttgatgaatttatgaaaacagggaatcccgaactggtgactaaagaacaatacgagagctgggtaaaagcatcgctacgccccggaaaatatgctgaagtggtagccgccaacggtgaattccccggccaatacatgactacgccggacggacgcctgggcatcgcacgattgcagtttggcaatgtggtactgatgccgcagatggcagccggtagcggagacaacgcctttcaagtggtgcatggaaccaacgccgcacctccccacacttatatcgcttcgtatctttggttgcagcatggttttaaggcagacgcaatgatccacttcggtacgcacggaagccttgagttcactccgcgaaaacaggtagcgttgtgtagcgatgactggcccgaccgccttgtaggagctcttccacacctttatatatattctatcggcaacgtgggggaaggcatgatagccaaacgacgttcgtatgctaccttgcaatcttaccttacacctcctttcctcgaaagcagtgtacggggcatctaccgtgacctgatggagaaaatcaagatttacaataacaccacaggagcgaaagaaaagcagtcgcttgccgtaaaagcactcaccgtgaaactgggcatccatcgtgaactggggctggacagcttgccgacccgcccatacagcgaggacgaagtggcacgtgtagagaacttcgctgaagaactgggccacggaaaaatcaccggacagctttataccatgggggttccctatgaaccggagcgtatcacctcttccgtacttgccatgacaaccgaaccgatcgcttacagcctcttgtcactcgacaaacaacgtggcaaagcaacagccgatgtagaaaagcatcgctctctcttcacccaacgctatctgaatccggcccgtgccttagtagagaaactgatagccaaccctgctttggcaacagacgaactgatctgccgcactgccggtgtcagtcccgaagaactggcaaaagcacgagaaatagagacctcacgcaatgctccgaaaggaatgatggcgatgatgatggctgccgccgccaaaaacaagaccggggataaaaccggcaaaacagccgataagatgccggaagccatgaagaagaaaatgaaagaaatgggcgcacatatggattcatccaaagccatggaaatggcaaaaaaaatgggtgccgatccggaagccctgaagaaaatggaagcaaaaatgaatgcctcaaagggagataagccggaagcggataaagctaaaggcatgtcggacatgatggccgccatggggaaaaaaacggctcaaaaggaatacagcaaagaagaaatcaactttgcccttgcactgacggaggtggaacgcaccatccgcaatgtaggcaactaccaaacggaactgactgccagcccagagaaagagcttgccagccttgtcaatgccctcaatggaggatacaccgcaccttcaccgggtggtgatccgattgccaatcccaacaccctacccacaggacgcaacatgtatgccatcaatgcagaagccactccgtcagaatcggcctgggaaaaaggagttgcacttgccaagcaaaccattgaaacttaccaacgccgccataatgacagtatcccgcgtaaggtcagttacacgctctggtccggcgagtttattgaaacgggaggagctaccatcgcacaagtattgtatatgctcggtgtagagccggttcgtgatgcattcggacgtgtcagcgatctgaagctgatcccttctgccgaattaggccgcccacgcatcgacgtagtagtacagacatcggggcaactacgcgacattgcggcttcccgcctttttctgatcaatcgtgcggtagagatggctgcagctgccaaagacgacaaatatgaaaatctggtagcggcaagcgtagtagaagccgaaaagacactgaccgagaaaggggtaagtccgaaagatgcccgtgaaatggctgcattccgtgtgttcggcggtgccaacggaatgtatggtacgggcattcaggagatggttgaatccggtgaccgctgggaagatgaatcagagatagctgccacctatcttaataacatgggtgcttactatggcagtgaaaagaactgggaagccttccggaaatatgccttagaagccgcactgacccgcacggacgtagtggttcagcctcgtcaaagcaatacatggggcgcgttgagcctcgaccatgtctacgagtttatggggggtatgaacctggccgtacgcaacgtgaccggcaaagatcccgatgcttacctgagcgattatcgcaaccgtaaccacatgcgcatgcaagaagtcaaagaggctgtcggtgtagaaagccgtaccaccatcctcaaccccgcttacatcaaagagaagatgaaaggcggctcttcctctgctgcggaatttgccgagacagtcaccaatacatatggctggaacgtaatgaaacctgccgccatcgacaaagagctttgggacaacatttacaatgtatacgtaaaagacgaatacaacctgaacgtgaaagaatttttcgaaacacaaagtcccgcagcgcttgaagaaatgactgccatcatgctcgaaagtgcccgtaaaggtttgtggaaagcaagtgccgaacaggttgccgaactggcaaaactgcatacggagacggtaaataagtatcgtccgtcgtgctcgggctttgtatgtgacaacgccaaactgcgcgaatacatcgcgtccaagtcagacgctccggctgccgcacagtacaaagaaaatatctctaaaatacgcgaagcgaaagtttcgggcgatgccaaaggaatggtgatgaagaaagaagagataaaccggacaccggaagagcaaaagacaaccctgagcaacattgccgtgggtgcagccgttgtagtggtaatactggcactcgtactctttgtccgtaaacgtcgtaaaacatcagaataa

SEQ ID NO: 4689 - DNA, 696 bp, B.fragilis
ctaatctcaagaattatggacgctgcaaatacatcgaatccctctgataagaaaaagtttatctggctggtgatattgcttatcatcgctattgtcgtagccgttgtctggtggtggaactatcgaaaatacgtatctaccatagatgcaaacctggatggcagtcgtgtgaatgtgtccgtccgtgcgatggcccctttgtctgctgtcttcaagcaggagggtgacagcgtgaagagaggtgaactgctggctgtgctcgacagcacgatgactgaggattaccggattgtttcacctgtcgatggcttgatagccaagcagtgggtggttcccggcgatctgttgcagccgggcgagaatatctttaccttgaacgagggcaagaaactctgggtgactgtctacttgcaggagactaagtttgatgaagtccgtatgggacaacaggctcttttcaccctcgacgcctatcccggactgacgttttacggcaaaatcttctatatcggtgccaatactgcatccgagttttctctgattccccctgataacgcatcgggcaactatacaaaggtggcccagcggattcccctgaagatatcaatcgaccgggtagaaggtaaagagaaactgaaagccaatctccgactgctttcggggatgtctgctaacgtgaagatcgtcaaagaatga

SEQ ID NO: 4690 - DNA, 267 bp, B.fragilis; identical to SEQ ID NO: 2762

SEQ ID NO: 4691 - DNA, 810 bp, B.fragilis
tacgaacgaaggaggtgggctatggtaaagaagattttcgctcagacctatttgtggattctgcttttgctgctctattcgcctatcgtgattataatgatctactcttttaccgaggcaaaagtgctgggcaactggaccggattctccacaaaactgtattcgtcactgttcactaccggcactcaccattcgctgatgaatgcgctgatcaatactgtgaccattgctttgattgcagctacggcttccaccctgctggggagtatcaccgctatcggcatcttcaacctgaaggcacgttcgcggaaggccatcagctttgtgaacagcattcctatcctgaatggggatattattaccggtatttcactgtttctgttgtttgtgtcgctggggatatcgcagggatacacgaccgttgtactggcacacatcactttctgtactccttatgtggtactcagcgtgttgccccgtctcaagcagatgaatcctaatatttacgaagccgccctcgatctgggagcgactccgatgcaggcactccgcaaagtgattgttccggagattcgtccgggaatgattagcggtttcatgcttgcgctgacactttctatcgatgattttgcagtaacggtatttacgatcggtaacgaaggtctcgagacactttccacctatatctatgccgatgcccgcaaaggagggctgactccggaactgcgtccgctttcgaccattattttcgtggtggtgctggccttgctgattgtcattaaccggcgtgccggaaaagagaaaaagtga

SEQ ID NO: 4692 - DNA, 414 bp, B.fragilis
acagaaaggagttcagtaatggaaaaagtatttggaatattgttattggttttattcgtttgcacttcatgtggcgataaaagtgaaccttcatttaaagtgtacgatgaatactctaaggagaagaaggtagagaaaaagaataatatcgggaaggcaacctatatcttttggataaacaaaacggaagccaaaaaattgcgcgggttgactttcaatataaaatgtaaagtgacgatcaacgaggatggtagtataaagattctcgggtatgaaaaagaacagccctatacggtaacgaaaagtttaaaaaaatacttgaaaactttcagggtagacaaggaggctttggcagatggaagagttaaggtcggcgatcaggtggtctttctgcgttatgtcgtgctgaagtag

SEQ ID NO: 4693 - DNA, 1254 bp, B.fragilis
tatagaaatggagagtttatgaagaatatcaggcaatttcatctcctaagttcaattctggggggagtatttttattttcttcctgttcggtcgttcccaaggccgaagagaaaaatctttcggagcaatggccggtggtcgcttcctatcaatgggccggtcaagactcggttgtggtatgtgacctcagcttgctgaaagatacggttgacttaccgttcagtttctttttgaaagactttcaaatcatcaagctcgataaccgtgatgaagcgatggtcggagaaaacaatctgtgtgtttccgaaaattacatccttgtctacggttctgtttatgaactccatccctgccggttatttactaaaaaaggagagtttgttaccaatataggtgctatcgggcaagggccgggagagtatcgtgccgtatacaaagcggagattgacgaaaaacataattgtatctatctgatgcctttcgctaacagcaatgccatctatgtttatgatctggctgggaaaccgttgcgttccattccgttacatcagtcggtctccaaggctgtattcaaagtcgatgccgataaacgtgaacttacggtgggggcacttccctttaccggatacccttttgtggcatgggtacaggattttgaaggacatctgctcgattcggttcctgctgccaggcatctgtctgttcttcccgattatagcaatgaggtgatgtacggtgccaatacggaagtattcgatttttatatcagcaccttctttgaactgcgtcccgatacgctttatcattatatccgttcgggaagcaggctgaagccccgcttcacactcaacattggagacaggaaacgttcgataaccacattctatgagttgcctcaggcctatgtaggcagattgatggtagaggaacaagtgggtgatggaatgtgggagacgaaatcaccttcgaactttatagtggataaggcatcgttgcgcggaacttttttccgggtgatcaatgactttgcgggagggatgccggatcggttgtggaccccttggtcactccgtaacaaacaatatataaggctggtggaaccgggagtgctgaaagcggaaatagagtcttatctctcctcgacagatggtaggaaggggaagaataggaaaaagttacaggaattgtgtgagtcgatcggtgaggaagataatagttatgtgatatacgctaaacagaaaggagttcagtaa

SEQ ID NO: 4694 - DNA, 783 bp, B.fragilis
cccaaccttatggacatccaccaagaactaaaagaactatctaaattcctgtctgaatattcgaccagtctgatggccgtaggcgtacaaacatcacgaatcgtacgaaacacctcacgaatcgctgaatctttcggcttcttctgtgacatgacaatctttcagaaaaccatcatcatgacattacgcgatgccgacaattcgcattcatacagtacggtaaacaagatcaagcccatgggactgaacttcgccattaattcagcactcagcacgctgagttgggaagcatatgacgaacatttgtctctcagcgagctccaacgtcgctatcacgaaattgtcagcaaaccacgtgaaagtaaatggcttgtattgattctggttgcctttgccaacgcatctttctgccgcctgttccaaggtgactttatttccatgggaatcgtatttgtagccaccttggccggattctttgtccgtaccgaactgatgggacgtcactggaatcatctggcaatattcatcatttcgtcgttcattgcttccatgatcggtagtacgggctatctgatgcactggggtgacactccggatatggctttaggtaccagcgtactttatctgattccgggtgtaccgctgatcaacgccatcatggacatcatcgacggacatgtattggccggaacatcgagatttattaacgcctgtctgcttatcatctgtatagcgatcggcctttcaatgacccttttaatcaccggaatcagcactttatga

SEQ ID NO: 4695 - DNA, 558 bp, B.fragilis
caggatattataacctggtgcacggtcgccatcaagtatacctctttcagagataccgacggaatgatcgcacaaagatatatcaataccccacgggtagacattgccggaatagatgccaatgcctctgccaaatatccttgcggtataggtgcacgtatctcgtatacgtacatccacgagttcatgcgtgacggacagaccaaactcagctctacccgcccccattcggctacggtacggttggagtatggcaagacatgggatcattatgacttcaatctgtcactcgacggacgggccttgtcacaggtgaaaaccaatcaatatacttccaatgatccgaatgcgggaacggaaaaggtaacttatccgggatataccatgtggaacctgacgctcacacaaagaatatggaaagggatcaatgtgaatatggccgtcaataacctgttcaactaccgacctgactattattatgccaattcaccctatacgacgggaaccaacttctccgtagggctgtcgctggacattgaccaaatgttcagaaaatag

SEQ ID NO: 4696 - DNA, 684 bp, B.fragilis
atcgtatatattcttatggctaaatttgataaaatagctgtcttgaacaaaataggttcgacaggtatggttcctgtattttatcacgaagatgtggaaatagcgaagaaagtggtaaaagcttgttatgaaggtggagttcgtgcttttgagtttaccaatcggggggactttgcccaggaagtatttgccgggcttgtaaaatttgctgtccgtgaatgcccggagatggctatgggagtcggatcagtggttgatccggctactgcagctctgtatatacaatcgggggctgactttgtggtaggtcccttgtttaatccggagattgctaagatatgcaatcgccggctgatcgcttatacaccggggtgtggctcggtttcggaagtgggctttgcacaggaagccggttgtgatctttgtaagatatttcccggagatgtgtacggaccaaattttgtgaaaggcttgatggctccgatgccttggtccaaattaatggtgaccggtggggtagagcctacccgggagaacctgacaggatggtttggagcgggtgcattctgtgtcggtatgggatctaaattatttccgaaagataaggtagcagccgaagattggggatatgttaccaagaaatgtaccgaagccttagaatacattgccgaggcaagaaagtaa

SEQ ID NO: 4697 - DNA, 600 bp, B.fragilis
tccgtgaatatggaaaacaaaattcaagagttgaccgataagatttatcgtgaaggcgtggaaaaaggtaatgaagaggcccgccgtcttattgcgaatgctcaggaagaagctaaaaaaattgttgaagatgcccataaagaagctgaatcaattattgcctcctctcgtaaatctgccgacgaactgacagaaaacaccaaatcagaactgaaactttttgccggtcaggctgtgaatgctttaaaatcggaaatagccactatggtgactgacaagattgtgactgcaccggtaaaggagtttgcacaaaataaagattttctgaatgcatttatcgtagctctggcttctaaatggagtgtagacgaaccgattatcatctcaacttctgatgcggagtctttgaaaaagtattttgctgccaatgctaaagcattgttagataaaggtgttaccatagaacaagtgaatggcataaaggcattgttttccgtatctcctgcagacggttcatataaagtgaatttcggagaagaggaatttatgaattactttaaagcattcctgcgtcctcagttggtagaaatgttattctaa

SEQ ID NO: 4698 - DNA, 663 bp, B.fragilis
agtcgatgtattatgagaaggatttttatttttattgcttttgcactgtgcagtttgtggcaattgagagctcaggctgatacggcttcgttcctgtttgataagtatgaagatgcccaagtgctcctgagagccggaggcgaattgaagtctaaaatgaactacagtatagtagtcaataagttttattttatagaccctcaggataagcaggtgaaagagcttgccaatccgggagatattctgctgatcaagatagcgggacgtacattttatcccgaatccaacggagccggtatagaaatgttgccgaccaaaccggtggtttacgttcagtataaagctaccgcccgtaaggaagctcccatgggggcttatggtacccgttcggaaacaacggcagttcagagctatggcaccataacgagcaacggacagtcttacaagctggaaggtgaaaaaattattgtcagcaatcggcaccatgtctattgggtggagaaggatgataaaatgaagcagttccgtaactttaagcaacttgccaaaatctactcaaaacatcgtgcggaggtggagaagtatattgaagataataaggtgaattttgaagatgtggatcagattgtgaagctctgttcttatgccgattcactgaaataa

SEQ ID NO: 4699 - DNA, 393 bp, B.fragilis
tcaagccccttaaaaactacaagcaaaacaatgattaaagaaaaagcaactccgcatatcggtctggtaaccgatctgacaacaggacaaatagacggaaaaatcactccgggtggaatggttttagttaccggatgtaatattaaaatagagaacggaaacaaacctgtctgtgaagcaatccaactctcccaccaaaatggagaagttatctgcatcgacccaccgttcgaaatgaacgaaccccatatcctcaaattcaagatgccggattcactgcccaccggagaatatacgctaaccatcaagactcgtttcgcaggtaaggataaacggcttctgacccaagaacagactttggtgtacatgctaaaattaatcagagaagaataa

SEQ ID NO: 4700 - DNA, 2523 bp, B.fragilis
ctcatggaaataaccaagaggaacggaacgacggaaccctatgacagggagaaaattgccgtcgccatacgaaaaagttttgccagtacagggcaggaagtaagtaacgaaatcatctattcggtggtagaagaggtggagaattttgtcgggaaagataccgcaaaccgtagtgtcgaacagatacaggacaaagtggagcaaagcctgatggaacacggcttttatgccgaggccaaaaattacatactctaccgctggcaacggactgaacgcagaaaagcactcaacagcataataaatgaattaggagacggaactgtgatggatgtcctgaaagagattcagaaagacttcaccacccacgaatacagtctcgttgtactctatgaaaaattttcagggttttgcaaacaggaaatgccacattccgaacgtttggcagcattgattaaggctgccgtggaactgaccactcaggaagcacctgactgggagtttatcgcggcccgtctactcaatttccaactatcgaaaaaactggaaaagcaggcggcatcggcaggcatccgttcgttttacgacaaactgcgttatctgacggaagaaggactatacggtagttacatactggcggcctactcgcaacaggagattgaagaagcagccggatttatctgccctgacagggacaaactatttaattattccggactggatctgcttgtcaaacgctacttgatccgtacccgactccatgaaccggcagagtccgtacaagaaatgtatctgggtatcgccctccatctggctatgcccgaacagaaagaacggatgacttgggtgaaaaaattctacgacttactaagtcgtttggaggtgacaatggccactcctaccctctcgaatgcccggaaaccttatcatcaactttcaagttgtttcatcgatacggtacccgacagtttagaaggtatctaccgcagtatcgataactttgccatggtaagcaaatttggtggcggcatgggaatgtactttggcaaagtacgtgcggcaggaggaaatatacggggttttaaaggtgtagcaggaggagtaattcgatggatgaagcttgtgaacgatacggctgtagctgttgatcagttgggtatgcgtcaaggtgccgtcgctgtctatctggatgtatggcacaaagacctgccggaattcttacaattgcggaccaacaacggagatgaccggatgaaagctcacgatatttttccttcggtatgttatccggacctattttggaaaatggttaaggaagaccttaaccaaccatggtacttattctgccctaacgagattatgacaatcaaagggtattgcctggaagattattacggagaagaatgggaaaagagataccatgactgtgtaaacgatacccgactttccaaaagaagtataagcattaaagacattgtcagattggtgttgcgatcggcagtcgaaacaggtactcccttcaccttcaaccgtgacacagtgaaccgggccaaccccaatgctcaccggggcatcatttactgttcgaatctttgtacggaaatagcacaaaatatggcagctatcgaaacggtatccaccgagatacgtacggaagagggtgacacagtagtggtgaagacggtacggcccggcgactttgtagtttgcaatcttgccagcctctcgctggggcatctcccattggaggacgaagaacagataaaggagaaagtaagcaccgtagtgcgtgctctcgacaatgttatcgacctgaatttctatccactcccttttgcgcaaatcaccaaccagcgttaccgcagtatcggactgggagtaagcggttatcaccacgcacttgccatacgcaatatccgctgggaaagcgaagaacatctccggtttgtagaccgagtattcgaacagattaattatgccgccatcgaagccagtgccgacctggcaaaagaaaaaggacgctatgaatacttcgaaggaagcgactggcaaacgggagcatactttggcaaacggggatatacttcccccgaatggaatcggctggcagccaaagtagcggaaaacggtatgcgaaacgcctatctactcgctatcgcaccgaccagcagtaccagtatcatcgcgggaaccactgccggtaccgatcctgtaatgaaacgtttcttccttgaagagaaaaaaggggccatgctgccacgtgtggcaccggcactgtcagacaaaaccttctggttatataaagatgcctatacactcgaccaaaaatggagtatccgtgcggcaggcacccggcagttgcacatcgaccagtctcaaagcctgaacctgtatatcaccaatgaatttaccatgcgacaagtactcgatctctacttactggcatgggaatgcggagtaaaaacggtatattacgttcgcagtaaatcattggaagtggaagaatgcgaaagctgtgcatcttaa

SEQ ID NO: 4701 - DNA, 705 bp, B.fragilis
aacatcagaataatcagaagtatggatacagtcgtacttgtattaatgctgttaatagcattcaactttctgctgaaacagactttctggaaaacggtcgcagtcggcatcatagccactgttgccgccctgtttgcaggactgatgtggccgtatgccatcgagcaatcgaaaacacagattgccgactggctgggtaacacagccctgatgctggacacttccgttttgctgaccatcgaagtcagcctccagatggcctatgccatgctggcggtacatgttgccagtgcctatccggtaaaaccgcgtacactgctcacctaccgcttcctgagatggtttccgggactgctcatctttccggtactattcagcgggctggtctatcttatctttgccttcccagggacaccattcaccaccgtggcatggatgtatgccgcttgcgtgctgatagccattcccgtaggacgttggttactgctttacctccttccggagaaggagttgcggctggaactcttcttcctcactaacgcattggtggccattctgggaattgtcgctaccgtaaacggacggacctccgtagccggagtcagtgaagtaaattggggagcactggccggcgtcggtggaataaccatcatcggcagtgccatcggactcgtttggcgaagggtgaagaaaagaatcaattaa

SEQ ID NO: 4702 - DNA, 240 bp, B.fragilis
aggaaaagaataaaagtgaccactgcaatccacatggcaccaagtactacgggactgctccatcccatggaattggttgacgaattgacttcggaaagcccgtacatgaagacaggcaagaagatggctgaagtgatgaaacccgggatatcgaaaggaactccggttcctttcacatgttccttttgcacaatggcagtgacgatcagggccaggattcctatcgggatgttgacataa

SEQ ID NO: 4703 - DNA, 1413 bp, B.fragilis
atgtgtacctttgcaccccaaattagtatgaatatgcaagaaagcaaatccattattgaggtgaacggtgtgtctaaattcttcggtgagaagactgccttggatcatgtgaccctgaatgtaaagaaaggtgagttcgtcaccattctggggccttcgggatgtggcaagactactttgttgcgccttatcgccggcttccagacagcttcggaaggcgagataaaaatatcggggaaagaaatcacacaaactcctccacacaaacgtccggtaaacacggtattccagaaatacgctctgttcccgcatctgaatgtatatgataatatcgcttttgggctgaaactgaagaaaatgcccaagcagaccattgagaagaaggtaaaagccgctttgaagatggtggggatgaccgattacgaatatcgtgatgtagattcgctgtccggcggacagcagcagcgtgtggccattgcccgtgccatcgtcaacgaaccggaagtgttgctgcttgacgagcccttggcagctctcgacctgaaaatgcgtaaagacatgcagatggagttgaaggagatgcacaaatctctggggatcacttttgtgtatgtcactcacgatcaggaagaagcactgacgctaagcgatacgattgtagtcatgagcgagggacgcatccagcagattggtactccgatcgatatatataacgagcctatcaattcgtttgtagccgatttcatcggagaaagtaatatcctgaacggagtgatgatccacgacaaactggtacgtttctgtaataccgaattcgagtgtgtagacgaaggttttggcgagaacatgcccgtggacgtagtgatccgtccggaagacctttacatctttccggtttcggaagcggcgcaactgaccggtatggtgcaatcgtctgtctttaaaggcgtacattacgaaatgacggttctctgcaatggctatgaatttctggtacaagactatcatcattttgaagtcggggctctcgtcgggttgctggtgaagccgttcgatattcatattatgaagaaagagcgtgtgtgcaatacttttgaaggcaagctgatcgacgaaacccatgtggagtttttgggatgcaacttcgagtgtgctcctgtcacggggatcgaagcaggcagcgaggtgaaggtggaagtcggtttcgacaacgtgattcttcaggacaacgaagaagacggtgcactgaccggagaggtgaagtttatcctttataagggtgaccattatcatctgactgtgctttcggattgggacgagaatgtgtttgtagatacgaacgacgtatgggacgatggcgaccgtgtaggtatcaccatccccccggacggtatcagagtaattaagaactaa

SEQ ID NO: 4704 - DNA, 615 bp, B.fragilis
ataaacgagatggctataaagtttcaatataacaaaacctcctttcagcaacttgagaagcaactgaaagtgcgggtacgtactctcccgattatcaaaaacaaggagagtgcccttcgcatggaagtgaagcgctgtaaaagcgaagctgccgatctggagaaaaggctggaaaaacaaatccaggcttatgaagccatgttcgcactttggaatgagtttgacacctcattgataaaagtaaatgatgttcatcttggtgtcaagaaaatagccggtgtacgggtgcctttgctcgaaaatgtggatttcgagatccgtccgtacagtctgtttaatgctcctaagtggtatgccgacggtatacacctgcttaaggagttggcacataccgctatagagcgtgagtttacgctagccaagttgggcttgttagaacatgcgaggaaaaagaccactcagaaagtgaatctttttgagaaggttcagataccggggtatcaggatgctttgcgcaagatcaaacgattcatggaagatgaagaaaatttgtctaagtcatcgcaaaagattctgaagtcacagcaggaaaaaaggaaggaggcagaagcatga

SEQ ID NO: 4705 - DNA, 1320 bp, B.fragilis
gcaaatattgtaaacactgaaacaaaagagcagatattagccgccttgggcgatattctcaagaatcccgaggtatataaaaacagtgagatatggagtaaactggccgaacatctttctcctgtatttatcgaaaaaagattgacgccgtatgatttacttgatgagcccttgggttataaaacatatggaagcaagtacattgaaacattagccaaacagcagatgaatctcgccatgcggctgccgattactcttgccggagcattgatgcccgatgcacatgccggttacgggttaccgatagggggagtattggctacagatcatgcggttatcccgtatgctgtgggggttgatatcggttgtcggatgaatctcaccctgtttgatgccggggaggattttctgaaacgctattcgcaccatattaaagaagcgctgaaggagtttactcattttggcatggatggcggattgtcttttgcacaagagcatgaggtgcttgacagagaagagttccgaatgaccgaattgttgagaggacttcatggcaaggcggtacggcaattaggtagctccggtggtggaaatcattttgtggaatttggtaagatgagcttacaggccggtaatgtcttgggcgttccggaaggaaactacgtggctttgctgtcccattccggttcgcgtggtttgggtgctgccattgccaaacactatagtatgctggcacgcgacctctgccgtctgcctcgcgaggctcagcactttgcctggctggggttggatacggaagaaggacaggaatactggcttagtatgaatttagcgggtgattatgctcgtgcctgccatgagcggattcatctgaatttgtcaaaagctttggggctgaaacctttggccaatgtgaacaatcaccacaattttgcatggaaagaggaaatcgctcccggacagacagccattgtgcatcgtaaaggagcaacacctgcacagaaaggccaaccgggactgatccccggaagtatggcaacgcccggttatttggtatgtggtaaagggataagtgaagccctttgttctgcctcgcatggagcgggacgagctatgtcccgccaaaaggcaaaagacaactttacccggtcggcattgagaaagtatctttctcaggccggagtcacgctgattggtggcagtgtcgaagaaatgccgttggcttacaaggatattgaccgggtgatgaagacccaggaggaactggttgaagtccaaggtaccttcatgccctgcatcgtacgaatgaataaagaatag

SEQ ID NO: 4706 - DNA, 1782 bp, B.fragilis
aatctcgttgtaaacgcttgtttgtgctattttgcttatattttttgcataaagcattatttttcaataaataatgcgtacttttgcacctgcgtaataaaaagagttttaaacatttatatggtaaaagatttattaacccccgattatatcttcgaagccagttgggaagtgtgcaacaaggtaggaggaatttatactgttttgtctacaagggcaaatacgttgcaaactaacttccgtgacaaattattttttatagggccggatgtatggcagggaaaggacaatcccttgtttatagaatctgacaatctttgtgcggcatggaaagaacatgccctcaagaaagatgacctttctgtccgtgtcggacgttggaatattccgggtgaacccattgttattctcgttgactttcagcctttttttgagaaaaagaatgaaatctatactgaaatgtggaatcactttcaggtcgattcattgcatgcttacggcgattatgacgaagcatccatgttttcgtatgctgccggaaaagtggtggaaagcttctatcgctacaacctgaccgaaaatgataaggtcatttatcaggcacatgaatggatgaccggcctgggagcactgtatctgcaattggctgttcccgaaataggaactatcttcaccacccatgccacttctatcggccgtagcattgccggaaacgataaacctttatatgactatctgtttgcttataacggcgatcagatggcacaggagctgaatatgcagtcgaagcactcgattgaaaagcagactgcgcatcacgttgactgctttacgacggtgagcgaaatcaccaacaacgagtgtaaggaactgcttgataaagccgccgatgtagtattgatgaacggtttcgaggacgatttcgttcctcagggaagcgctttcaccggtaagcgcaaacgtgcgcgtgcattgatgttgaatgtggccaataagcttctgggtacccatatggacgatgacacattaattatcggcaccagtggacgttacgagtttaagaacaaagggatcgacgtgtttctggaatcattgaaccgtttgaaccgggacaaggacctgcagaagaacgtgctggcatttgtcaatgtaccgggttgggtgggagagccccgcgaggatttgcagacacggctgaaaagcaaagaaaaattcgatactccgctcgaagtacctttcattacccattggctgcataacatgacccacgaccaggttctggatatgctcaaatatcttggtatgggaaatcgtccggaagataaagtgaaggtgattttcgttccgtgctatctggatggaaaagatggaatcctgaacaaagaatattatgatctgatattgggagaagacttgagtgtctatccttcttattacgaaccttggggatacactccgcttgagagtgtggcattccgcgtacctactattacaacagacctggcaggcttcggcctttgggtgaacagcctgaaaaatcagcatggcatcgataatggggtagaggtgttacaccgttcggactataattactcagaggtagccgacggtatcaaagatacgatcgcactgttttcgggtaaaacagataatgaggtgaaagagatccgcaaacaagctgcggctgtggccgaacaggctctatggaagcatttcatcaaatattattacgaggcttatgacatcgccttgcgtaatgccatgaaacgtcaactaaactaa

SEQ ID NO: 4707 - DNA, 807 bp, B.fragilis
gagttaagagtgaaaagattatcggtctttttttcatcacgtaagagttggacactcccttacattatcttttcggcgatcttcgtcgttattccgctactccttatcgtggtttatgctttcaccgatgacagcggacatctgactttggaaaactttgcgaagttttttcagcaccacgaagctatcaatacctttgtctattccatcggtattgccattattaccaccattgtctgtatcctgctgggctatccggcagcatggatactgagcaacgcaaaactgaaccggtcgaaaacaatggtcgtactgtttattcttcccatgtgggtcaacattctggtacgtacgttggctacggtagccttgttcgactttttcagtgttccgctcggtgagggtgccctgatattcggtatggtctataacttcataccatttatgatttaccccatctacaacactttgcaaaagatggatcacagttatattgaggctgcgcaggatctgggtgccaatcccgttcaggtcttttttaaggccgtgcttccgctttccatgccgggggtgatgagtggcatcatgatggttttcatgcctactatctcaacctttgccattgccgagttgttgacgatgaacaatatcaaactgtttggtaccacaatccaggagaatatcaataacagtatgtggaactatggcgcggccctgtcgctgattatgttgctgctgattgccgcgacctctctgttcagcaccgacgacaaagataatacgaacgaaggaggtgggctatggtaa

SEQ ID NO: 4708 - DNA, 219 bp, B.fragilis
gtggcgatggtcctgggagtttcctgtgttgctgttacaggttcactgacctggcaactgtcggtagtggaagctgtagcttccatggtgttggttactaacatttctttttactttttcttaaatctgtgtgatacatacatgttgcttttccgcatttccggcgtatgggaggaaatgtggttaatgtgtcagtacagtgtttcgatttcggtttag

SEQ ID NO: 4709 - DNA, 402 bp, B.fragilis
caaattttattaattgtattaattattttttcaatgaacatttttattgcaggtatcagctataatcttagcaatgctgatttaggagaattattcgaagagtttggagaagttatttcagccaaaatcgttatggacagagaaactggccgttctaaaggattcggttttgtagaaatgcctaatgacgaagagggaaatgctgccatcgcagcactgaacgaaaaagaaatagacggaaagacacttgccgtatcagttgcacgtccgagagaagaaggcccgcgtcgtaacagcaattacggtggtggtaatcgtggcggctatggtaacaaccgtggtggtggttacggtggtggtaatcgtggcggcggctatggcggcggtcgtgacagatattaa

SEQ ID NO: 4710 - DNA, 2067 bp, B.fragilis
aacacgttatttgaggctatatacggactttcccgctttgaggttggttctcttctcgcacaaatagcatatatttgctgtcattcattcatttattgtacttcttatatgcgatattgtattttgatatttgggtttattctactcttttttttgcctgtcggatgtaaacaatcatccacagtgacaccactttcttttaaagagtggatgacccatcatcccggggagtgtatcgaacattatatggggctgcacgattcgcttttcgaagcgggacgttatgatatgctcacggacatttacagcgggatgtttctctatatgccttccgatccggatggtaatccggatacacttcgcagacaattattgcgtatcatgccgttgtacaatcaagttttatcaaaaacaggagcttatgaagctgccgtacagttgctcgacagtattcgtctttccggacacccgtttctgacgggatattgtgcttatcctctttgggctttcgaagcgcagaacagtttgatgacggatgataatagacgcacagaggcattggccgattcttttgccgtgctattgccaccggacgatcagtcggtcgtcatgctgtgttgccacatggtttcgtgggcttaccacttcagcagtgctcgcccgaatgtagcgtgccggatgcaggaacgggctgtagaggcttatcggcggggtggggaaacccaagatgtgggagccatattggcacggttgggatactattacaggcgcgaagggcgatatgtaaaagctgttgatctgtccctcgcagctgttgaatggtatgataaacatcccggtattgctacggatggcatgatacgagcctatgccgatcttgctgccttatattctacccttgccctcaccgagaaagctttggagatcaatgcgagagtgattcggatggctgcccgtgaagacagcatggcgctgtgcggggcctatcgtgtgcgttcttctttttttatggatctggaacaggttgattcggctgctttttatctgggtaaagagagagaagtggcgcaacggatgggagagagaagtttaaagacgtggctcagagaccgggctaaatattggttacagatgtgtcccgactccaatgcggcggcactgcgtgatatggaagctatttttgccgacagtgccggtgtacgtcctgccacccattcaggcacccgatactggctgggattggctctggtaagagacggacaggaagagcgtggtcttgccatgatggaacaagcgcattgtgaatttgcctatatggactgggatgaaatggaagcctttgcggcaaaaggacttttgggaatctatgcttcacgccatttgggttcgaggatgttggagttttatccccgatatgccgctttgcaagattcgctgaatgaaaaagacaagttgcgctataccgctgcggccaatgtgcgttacgataccggacgaaaagagcaggaataccgtgcattgatggctgaggtcgaattgaaggagcgtacgttgacctacattggaattgtggttgtattgcttttcatgttgttgggactggtagtggtatatatgttacaacgccgccgccattaccggcgtgaagcacatctccatagagaacggctttcccgtctgatttccatccatcaggaactgaacgggcgctacgaatctctcaataacgaattagagaaggtggcacatgcggacgtgattgataatgtgcgccagaaactgaacccgatgctgctgagtggggatgacgagatacggttccgtcagtcgttcgcagcactttatccccactatttacctgtattgcgttgtcaatgtcccgagttgacccgtaatgacgaattgctttgtatgttgatccggttgaatcagagcactgatgaaatagctctcgctttggggatttcgcgtgccagcgtgaattccggccgtagccggatacgcaagaaactgggattgggcaaagatgaatctcttgaagcctatttgcaaaatatcaaaaagtag

SEQ ID NO: 4711 - DNA, 492 bp, B.fragilis
aataataaattaaaaaataaaattaagattatggaaatgaatttgtttattgcttacattggcatcgcggttatggttggtttgtcaggcatcggaagtgcttacggagtgactattgcaggtaacgctgctatcggcgcattgaagaaaaacgatagtgcattcggtaacttcctcgtactgacagctcttccgggtacacagggattgtatggtttcgcaggttactttatgttccagactattttcggtatccttactccgcagattaccgccattcaggcttctgccgttttgggtgcgggtattgctctcggattggtggctctgttttccgctatccgtcagggacaggtttgcgccaatggtattgcagccatcggacaaggccacaatgtattcagcaacacattgattcttgctgtgttccccgaactttatgctatcgtggcattggctgctaccttccttatcggtagtgcgcttgcataa
